(12) United States Patent
Yang et al.

(10) Patent No.: US 12,275,987 B2
(45) Date of Patent: Apr. 15, 2025

(54) EGG-TYPE CHICKEN WHOLE-GENOME SNP CHIP AND USE THEREOF

(71) Applicant: China Agricultural University, Beijing (CN)

(72) Inventors: Ning Yang, Beijing (CN); Congjiao Sun, Beijing (CN); Zhuang Liu, Beijing (CN); Yiyuan Yan, Beijing (CN); Guiqin Wu, Beijing (CN)

(73) Assignee: China Agricultural University, Beijing (CN)

( * ) Notice: Subject to any disclaimer, the term of this patent is extended or adjusted under 35 U.S.C. 154(b) by 1053 days.

(21) Appl. No.: 17/281,223

(22) PCT Filed: Sep. 29, 2018

(86) PCT No.: PCT/CN2018/108741
§ 371 (c)(1),
(2) Date: Mar. 29, 2021

(87) PCT Pub. No.: WO2020/062160
PCT Pub. Date: Apr. 2, 2020

(65) Prior Publication Data
US 2021/0395803 A1 Dec. 23, 2021

(51) Int. Cl.
*C12Q 1/68* (2018.01)
*C12N 15/10* (2006.01)
*C12Q 1/6827* (2018.01)
*C12Q 1/6837* (2018.01)
*C12Q 1/6876* (2018.01)

(52) U.S. Cl.
CPC ....... *C12Q 1/6837* (2013.01); *C12N 15/1065* (2013.01); *C12Q 1/6827* (2013.01); *C12Q 1/6876* (2013.01); *C12Q 2600/124* (2013.01); *C12Q 2600/156* (2013.01)

(58) Field of Classification Search
None
See application file for complete search history.

(56) References Cited

FOREIGN PATENT DOCUMENTS

CN 105238859 B 3/2018

OTHER PUBLICATIONS

Liu Wenbo et al., Screening of Polymorphic Loci Associated with Eggshell Quality Traits Using High-Density SNP Chips, College of Animal Science and Technology, China Agricultural University, Beijing 100193 (non-official translation: The 16th National Conference on Animal Genetics and Breeding Academic Discussions, Dec. 11, 2011) (2 pgs.).

*Primary Examiner* — Jeanine A Goldberg
(74) *Attorney, Agent, or Firm* — Westbridge IP LLC

(57) ABSTRACT

Provided are an egg-type chicken whole-genome SNP chip and the use thereof. The SNP loci of the chip are respectively derived from 14,624 SNP loci shared by each line of the major egg-type chickens in China; 3,677 SNP loci associated with disease-resistant traits in egg-type chickens; 16,000 SNP loci associated with economic traits in egg-type chickens; and 9,358 SNP loci making up genomic regions not covered by the foregoing probes. The 43,681 SNPs on the egg-type chicken whole-genome SNP chip have DNA sequences as represented by SEQ ID NO. 1-43,681. The chip can specifically identify the genetic relationship between commercial egg-type chickens and egg-type chickens of local breeds, and can also perform applications such as whole-genome association analysis, genome selective breeding, and QTL location analysis of target traits and population genetic analysis.

1 Claim, 4 Drawing Sheets
Specification includes a Sequence Listing.

EGG-TYPE CHICKEN WHOLE-GENOME SNP CHIP AND USE THEREOF

RELATED APPLICATIONS

This application is a national stage filing under 35 U.S.C. § 371 of International Patent Application No. PCT/CN2018/108741, filed Sep. 29, 2018, which is incorporated by reference herein in its entirety.

TECHNICAL FIELD

The present invention relates to the fields of molecular biology, functional genomics, bioinformatics and genome breeding, and more particularly relates to a whole-genome SNP chip for egg-type chicken and use thereof.

BACKGROUND ART

SNP refers to polymorphism of a nucleic acid sequence caused by the change of a single nucleotide base at the genome level. Its mutation forms include conversion, transversion, deletion and insertion and the like and SNP has the characteristics of large number, wide distribution and easy detection. As a genetic marker, SNP contributes to the genetic variation of qualitative and quantitative traits, and also some complex disease traits, so it is widely used in genetic research. A SNP chip is made by fixing a large number of fluorescently labeled DNA probes on a glass substrate through photoetching. It works by means of hybridizing and binding the probe DNA strand with the test target genomic DNA, and after staining with a dye, using a laser for scanning to perform genotyping of SNPs. The advantages of the SNP biochip lie in that the detection throughput is very large, and it can detect hundreds of thousands or even millions of SNP loci at a time with high detection accuracy.

A whole-genome SNP chip is a single nucleotide polymorphism (SNP) microarray, with millions of DNA marker sequences aligned and immobilized to form an array of SNP probes on a glass slide or a special silicon wafer. It works by means of base-pairing reaction between the DNA marker sequences immobilized on the chip and the target genome so as to accurately identify the genetic information. The SNP chip uses advanced microbiochemical reaction technology, micro-labeling technology, imaging technology with micro-scale scanning resolution and biological information computer processing technology to accurately identify specific mRNA or DNA sequences in biological individuals. There are two main commercial chicken SNP chips, Illumina's iSelect chicken 60K SNP chip (which is off the shelf and owned by Cobb, USA) and Affymetrix's 600K high-density chip. The Affymetrix 600K SNP chip currently on the market includes about 560,000 SNPs, and SNP loci are mainly derived from commercial broiler lines, egg-type chicken lines and some inbred lines. Compared with the previous Illumina 60K chip, the chip density of Affymetrix 600K SNP chip has been greatly improved, but the application of these SNP loci in Chinese local breeds has not achieved the desired effect. From the applicant's previous test results (about 2,600 chicken individuals), it is found that about half of the SNP loci on the Affymetrix 600K high-density SNP chip have poor polymorphism, and the high cost has further hindered its practical application in large-scale populations in China.

The livestock and poultry whole-genome SNP chip can be applied to many aspects such as molecular genetic research, molecule-assisted breeding and the like due to its advantages such as high marker density, uniform coverage of the whole genome, high measurement accuracy, easy realization of standardization and automated detection, etc. It can provide support for upstream and downstream processes of breeding, including genetic diversity analysis of germplasm resources, genetic relationship analysis, whole-genome association analysis, QTL (quantitative trait locus) mapping, selection and evolution studies and the like, wherein its application in genomic selection is very important. Genomic selection is currently the main breeding technique in livestock and poultry breeding, which uses whole-genome markers to estimate all possible genetic effects, interpret all genetic variations, and predict Genomic Breeding Values by adding up the genetic effects of markers. Genomic selection has the advantages of high accuracy of estimated breeding values and rapid genetic progress and has been applied to the breeding practice of commercialized lines of dairy cows, pigs, abroad high-yielding egg-type chickens and fast growing white-feather broilers.

However, the loci information of the current chicken 600K commercial SNP chip (Axiom® Genome-Wide Chicken Genotyping Array) lacks the genome variation information of Chinese local chicken breeds, and there are great limitations in its application in Chinese local chicken breeding and related basic scientific research. Moreover, compared with other animals, chickens have the characteristics of numerous breeds and large population, low individual price and the like, and therefore, a relatively low-cost whole-genome SNP chip is needed for large population sample testing. Thus, in egg-type chicken breeding industry and scientific research fields, it is urgently needed to develop a whole-genome SNP chip with moderate throughput, including specific information about the genetic variations of Chinese local egg-type chicken breeds.

SUMMARY OF THE INVENTION

One purpose of the present invention is to provide a whole-genome SNP chip for egg-type chicken and use thereof.

The present invention first provides a combination of whole-genome SNP markers consisting of 43,681 SNP loci, the nucleotide sequences of which are represented by SEQ ID NOs. 1 to 43681, respectively.

The present invention provides an egg-type chicken whole-genome SNP chip comprising 43,681 SNP molecular markers having the nucleotide sequence represented by SEQ ID NOs. 1 to 43681.

In the egg-type chicken whole-genome SNP chip provided by the present invention, SNP loci include five types of probes: the first type of probes are well-polymorphic SNP loci including 14,624 loci and screened from resequencing data of a total of 479 individuals of 7 domestic lines in China (Line 1 derived from Rhode Island Red, Line 2 and 3 derived from Rhode Island White, Line 4 and Line 5 derived from White Leghorn, Line 6 derived from Houdan, and Line 7 derived from Dongxiang blue-egg shell chicken); the second type of probes relate to the functional loci discovered by the applicant in the early research on disease-resistant traits of egg-type chickens, and include 3,677 SNPs; the third type of probes include significant loci related to important economic traits (laying performance, egg quality, feed efficiency and the like) of egg-type chickens which was excavated by the applicant through genome-wide association analysis (GWAS) technology, and include a total of 2,677 SNPs; the fourth type of probes include loci related to the economic traits of egg-type chickens reported in the literature of relevant candidate genes and QTL database, and include a total of 13,345 SNPs; and the fifth type of probes include 9,358 SNP loci from the SNP database (ftp.ncbi.nlm.nih.gov/snp/organisms/archive/chicken_9031/) which supplement the areas that the previous types failed to cover. The above five types of probes include a total of 43,681 SNP loci.

In the combination of egg-type chicken whole-genome SNP molecular markers and the egg-type chicken whole-genome SNP chip according to the present invention, the SNP loci of the molecular markers are located at the $61^{st}$ position of the nucleotide sequences represented by SEQ ID NOs. 1 to 43681.

The molecular markers are associated with disease-resistant traits in chickens or associated with economic traits in egg-type chickens. The disease-resistant trait is a trait resistant to Marek's disease; and the economic traits are laying performance, egg quality, feed reward and immunity.

The present invention also provides use of the above-mentioned egg-type chicken whole-genome SNP chip in the detection of DNA samples. The chip can be used in applications such as evaluation of germplasm resources for hen breed resources, genomic selection, identification of QTLs for target traits, association loci and candidate genes, genetic relationship identification and the like.

Specifically, the present invention provides the use of the above-mentioned combination of egg-type chicken whole-genome SNP molecular makers and/or the above-mentioned egg-type chicken whole-genome SNP chip in improving egg-type chicken germplasm resources.

The present invention provides the use of the above-mentioned combination of egg-type chicken whole-genome SNP molecular markers and/or the above-mentioned egg-type chicken whole-genome SNP chip in identifying breeds of egg-type chickens.

The present invention provides the use of the above-mentioned combination of egg-type chicken whole-genome SNP molecular markers and/or the above-mentioned egg-type chicken whole-genome SNP chip in genomic selection of egg-type chicken.

The present invention provides the use of the above-mentioned combination of egg-type chicken whole-genome SNP molecular markers and/or the above-mentioned egg-type chicken whole-genome SNP chip in identifying genetic relationship between chicken breeds or lines.

The present invention provides the use of the above-mentioned combination of egg-type chicken whole-genome SNP molecular markers and/or the above-mentioned egg-type chicken whole-genome SNP chip in analyzing genetic diversity of egg-type chicken.

The present invention provides the use of the above-mentioned combination of egg-type chicken whole-genome SNP molecular markers and/or the above-mentioned egg-type chicken whole-genome SNP chip in QTL mapping for target traits of egg-type chickens.

All SNP markers on the egg-type chicken whole-genome SNP chip of the present invention are named according to the name in the SNP database, the nucleotide sequences of which are derived from the $5^{th}$ version chicken reference genome (Gallusgallus-5.0, 2016).

The advantages of the present invention lie in that: 1). optimized design: even distribution on each chromosome of the whole-genome with high coverage, which ensures the accuracy of genetic evaluation of the egg-type chicken genome; 2). functional correlation: the significant loci related to traits such as laying performance, disease-resistant traits, feed utilization efficiency and egg quality of egg-type chickens are collected in the chip, and the practicability of the chip is increased; and 3). applicability: the chip loci are derived from SNPs with high polymorphism in independently bred commercial high-yielding egg-type chicken breeds and Chinese local chicken breeds, which not only meets the scientific research needs of scientific researchers, but also satisfies requirements of the whole genome molecular breeding work of egg-type chicken companies.

SPECIFIC MODES FOR CARRYING OUT THE EMBODIMENTS

Figure 1:
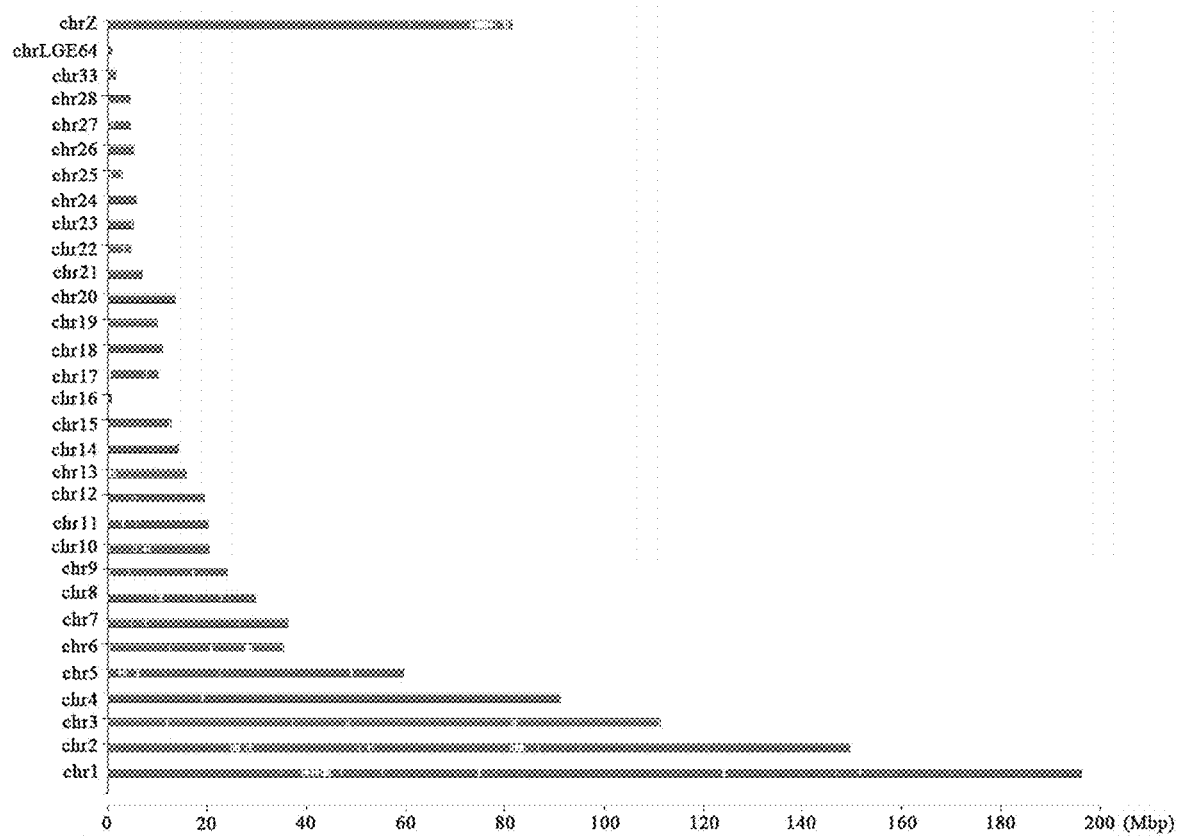
FIG. 1 shows the distribution in the chicken genome of the egg-type chicken whole-genome SNP chip in the present application. The abscissae represent 20, 40, 60, 80, 100, 120, 140, 160, 180, 200 Mb, respectively, and the ordinates represent chr1, chr2, chr3, chr4, chr5, chr6, chr7, chr8, chr9, chr10, chr11, chr12, chr13, chr14, chr15, chr16, chr17, chr18, chr19, chr20, chr21, chr22, chr23, chr24, chr25, chr26, chr27, chr28, chr33, chrLGE64 and chrZ from bottom to top.

The following Examples further illustrate the content of the present invention, but should not be construed as limiting the present invention. Without departing from the spirit and essence of the present invention, any modifications or replacements made to the methods, steps or conditions of the present invention fall within the scope of the present invention.

Unless otherwise specified, the technical means used in the Examples are conventional means well known to a person skilled in the art.

Example 1: Preparation Method of Egg-Type Chicken Whole-Genome SNP Chip

The first type of probes of the present invention were obtained as follows: commercial egg-type chicken breeds independently bred in China and Chinese local egg-type chicken breeds were subjected to the whole-genome resequencing, wherein, the egg-type chickens include 7 lines (Line 1 derived from Rhode Island Red, Line 2 and 3 derived from Rhode Island White, Line 4 and Line 5 derived from White Leghorn, Line 6 derived from Houdan, and Line 7 derived from Dongxiang blue-egg shell chicken), totally 479 individuals (Line 1: 92, Line 2: 74, Line 3: 91, Line 4: 60, Line 5: 69, Line 6: 68, and Line 7: 25), the SNP loci of each breed with MAF<0.05 were eliminated, and at the same time the SNPs shared by each line and the SNP loci shared by Line 1 and at least one other lines were screened out, which guarantees the polymorphism and versatility of SNP loci to a large extent. Finally, 64,396 SNPs shared by all lines and 3,782,699 SNP loci shared by Line 1 and any other lines were used as the core candidate SNPs of the chip.

The second type of probes of the present invention were obtained as follows: based on the applicant's earlier research on disease-resistant traits of chickens, using the Marek's disease-resistant inbred White Leghorn population established by the Poultry Disease and Tumor Laboratory of the United States Department of Agriculture (wherein, there are three individuals each for the disease-resistant line and the susceptible line). Through whole-genome resequencing technology, the genetic variations existing in each line is unearthed, and a total of 1,554,188 specific SNP loci of the lines related to disease-resistant traits were selected, and then subjected to overlapping with the SNPs with good polymorphism obtained by resequencing of 479 individuals in the 7 lines described in the previous step of preparation of the first type of probes, which greatly guarantees the applicability of these SNP loci in other egg-type chicken breeds. Finally, 480,341 disease-resistant specific SNPs were selected.

The third type of probes of the present invention were obtained as follows: this type of probes were obtained by screening based on the applicant's previous genome-wide association analysis of important economic traits in egg-type chickens. There are two parts: the first part comprises performing association analysis on laying performance (number of eggs laid and egg weight) and egg quality using 385 White Leghorns and 361 Dwarf egg-type chickens from 40 families; and the second part comprises performing whole-genome association analysis on laying performance, feed utilization efficiency, egg quality and reproductive performance of 1,512 hens which are F2 resource population obtained by the reciprocal cross between White Leghorn and Dongxiang blue-egg shell egg-type chicken. The above obtained SNP loci associated with important economic traits in egg-type chickens were analyzed and deduplicated by biostatistics methods, and 2,677 functional loci were obtained and added to the chip.

The fourth type of probes of the present invention were obtained as follows: QTLs related to egg quality, laying performance, feed efficiency and immunity of the chickens were obtained by searching for related candidate genes in published literature and online QTL database (www.animalgenome.org/cgi-bin/QTLdb/GG/index), QTLs with large confidence intervals and insignificant P values (P>0.05) were eliminated, and 1,238 candidate QTL intervals were finally obtained, then SNPs obtained from resequencing data were subjected to overlapping with candidate genes and QTLs, so as to screen out 589,164 SNPs as candidate loci related to traits.

The fifth type of probes of the present invention were obtained by downloading from the chicken SNP database of NCBI (www.ncbi.nlm.nih.gov/snp).

Identification process of SNP loci: considering that the sizes of different chromosome fragments in chickens are quite different, and the recombination rates of mutation loci on different chromosomes are inconsistent, the level of linkage disequilibrium on each chromosome was firstly detected, so as to set the optimal window/interval size for each chromosome, these windows/intervals were used to make SNPs evenly distributed on each chromosome, and one SNP shared by each line of the first type of probe was preferentially selected for each interval. If there was less than one, the SNP of the second type of probe was selected. The third type of probes were SNPs that were forced to be placed in the chip. If the window cannot be covered after the first type of probes and the second type of probes were selected, the SNP of the fourth type of probes was selected, and the fifth type of probes were used to supplement the interval that cannot be covered by the above-mentioned types of probes.

Figure 2:
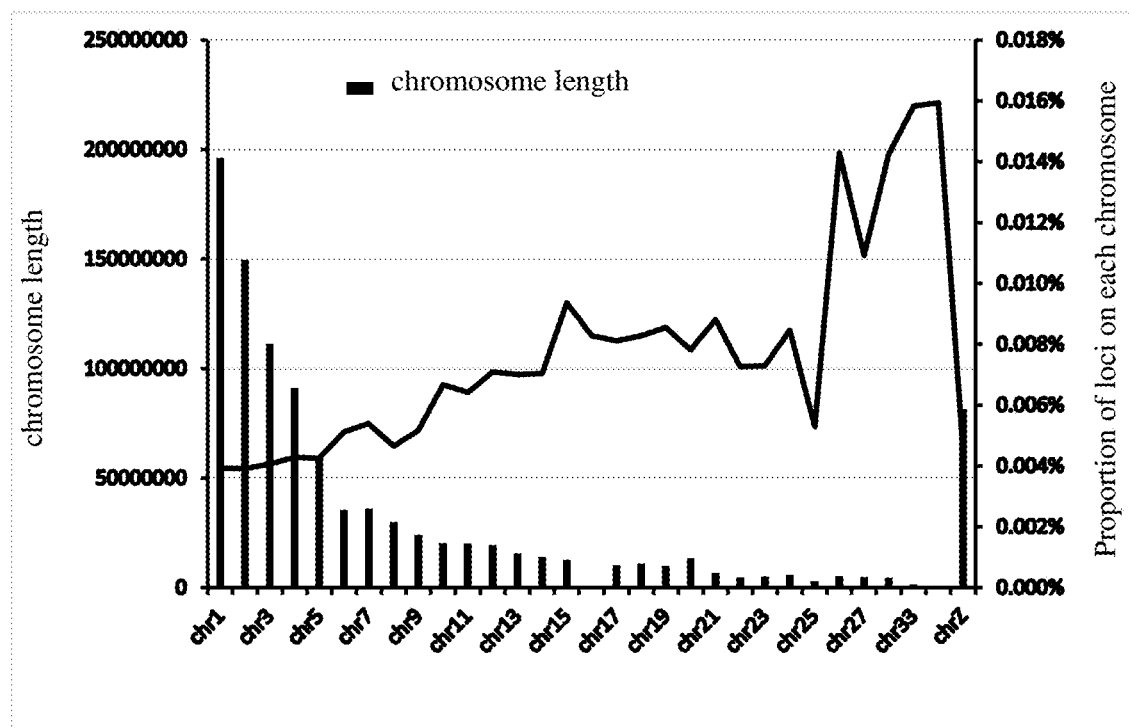
FIG. 2 shows the proportion of all SNP loci on each chromosome of the whole-genome in the present application.

The identified SNP loci were submitted to Illumina for scoring with the Infinium XT scoring system (www.illumina.com/), and all loci with scores less than 0.8 were removed. For the deleted unqualified SNP loci, the nearest SNP loci were selected for supplementation, and the scoring was performed again. According to the above steps for identification and screening, a total of 50,000 tag-SNP loci were obtained. Since there is a problem of successful conversion rate when making a chip with these 50,000 SNP loci by the Illumina Infinium XT platform, thus, the number of effective SNP loci on the final egg-type chicken whole-genome 50K SNP chip is 43,681 (see FIG. 1 and FIG. 2).

TABLE 1

The distribution number of loci of the egg-type chicken whole-genome SNP chip of the present invention on each chromosome

| Chromosome | length (bp) | number |
|---|---|---|
| chr1 | 196,202,544 | 6,916 |
| chr2 | 149,560,735 | 5,111 |
| chr3 | 111,302,122 | 3,907 |
| chr4 | 91,282,656 | 3,419 |
| chr5 | 59,825,302 | 2,287 |
| chr6 | 35,467,016 | 1,604 |
| chr7 | 36,946,936 | 1,722 |
| chr8 | 29,963,013 | 1,248 |
| chr9 | 24,091,566 | 1,117 |
| chr10 | 20,435,342 | 1,227 |
| chr11 | 20,218,793 | 1,148 |
| chr12 | 19,948,154 | 1,213 |
| chr13 | 18,407,460 | 973 |
| chr14 | 15,595,052 | 861 |
| chr15 | 12,762,846 | 994 |
| chr16 | 652,338 | 47 |
| chr17 | 10,956,400 | 718 |
| chr18 | 11,053,727 | 799 |
| chr19 | 9,979,828 | 735 |
| chr20 | 14,409,371 | 915 |
| chr21 | 6,862,722 | 513 |
| chr22 | 4,729,743 | 300 |
| chr23 | 5,786,528 | 313 |
| chr24 | 6,280,547 | 439 |
| chr25 | 2,906,300 | 131 |
| chr26 | 5,313,770 | 654 |
| chr27 | 5,655,794 | 441 |
| chr28 | 4,974,273 | 524 |
| chr32 | 78,254 | 13 |
| chr33 | 1,648,031 | 201 |
| chrLGE64 | 897,576 | 109 |
| chrZ | 82,310,166 | 3,082 |
| Total | | 43,681 |

Figure 3:
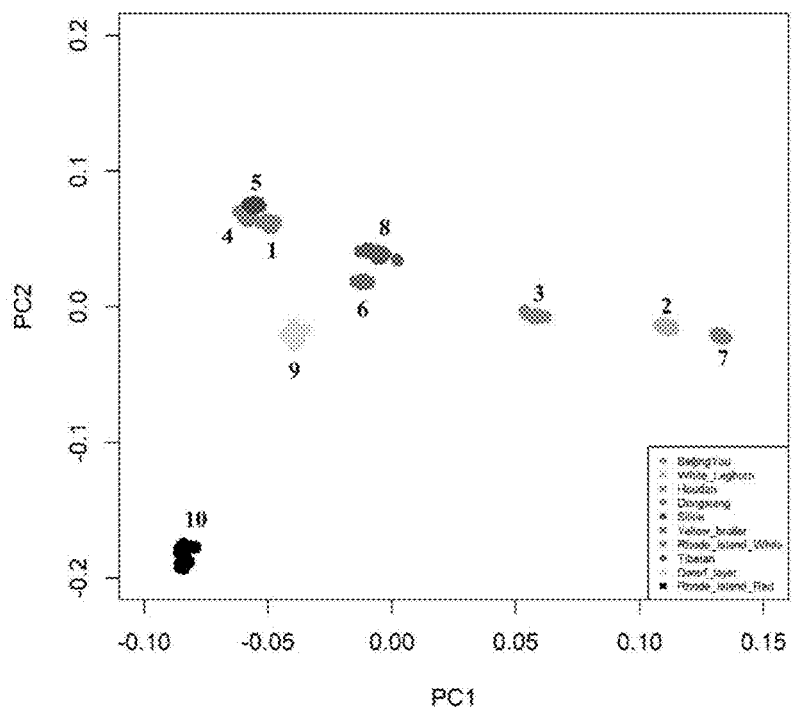
FIG. 3 shows the principal component analysis diagram of each chicken breed. The numbers in the figure represent 10 breeds, respectively. 1 represents Beijing You chicken, 2 represents White Leghorn, 3 represents Houdan, 4 represents Dongxiang blue-egg shell egg-type chicken, 5 represents Silkie, 6 represents Yellow broiler, 7 represents Rhode Island white, 8 represents Tibetan chicken, 9 represents Dwarf chicken, and 10 represents Rhode Island Red.
Figure 4:
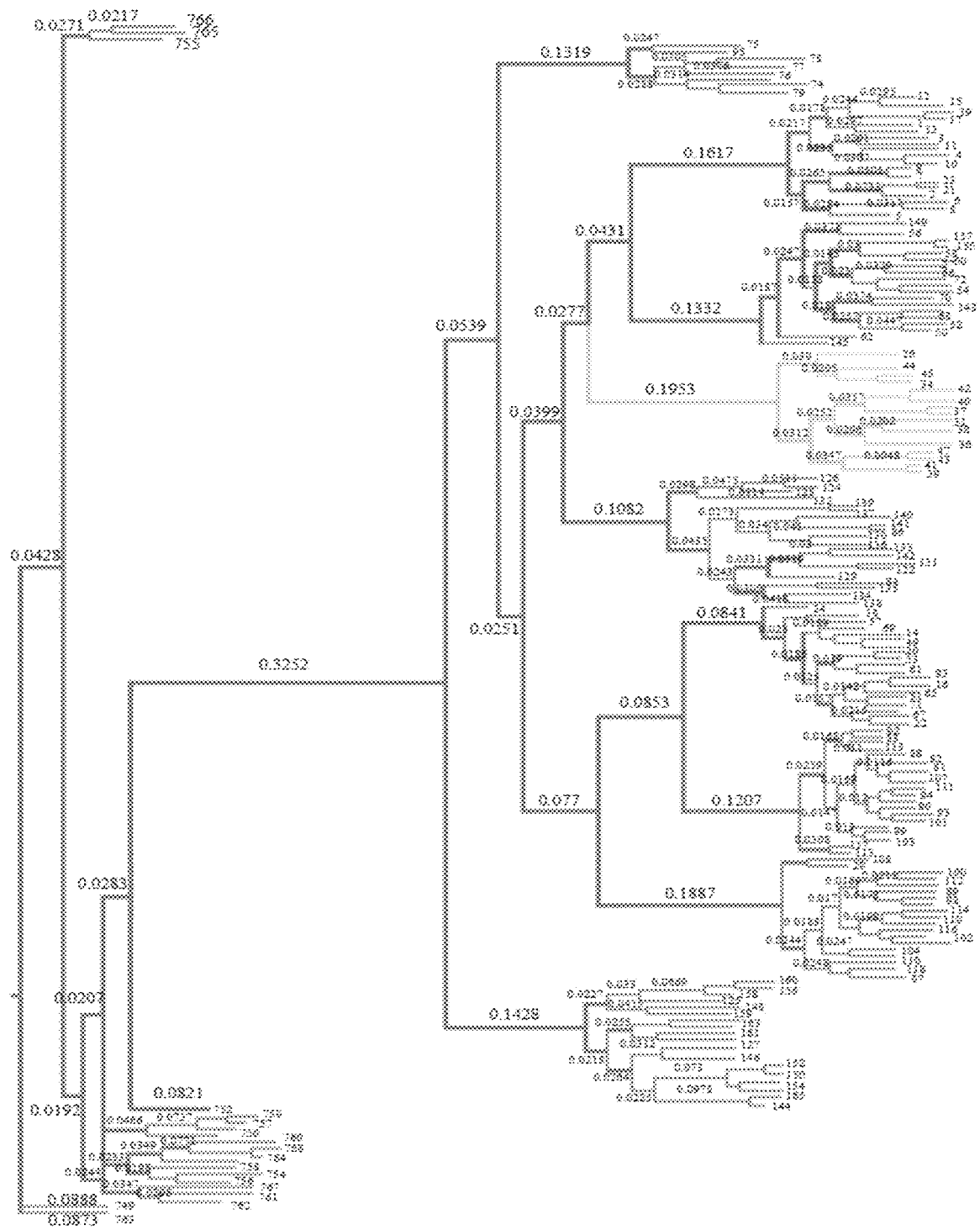
FIG. 4 shows the cluster analysis diagram of each chicken breed. The large branches represent that each breed can be distinguished independently, and the small branches represent each individual.

Example 2: Principal Component and Cluster Analysis Based on the Egg-Type Chicken Whole-Genome SNP Chip of the Present Invention DNA genotypes of 20 Rhode Island Red, 20 Rhode Island white, 19 Beijing You chickens, 19 White Leghorn, 19 Houdan, 20 Dongxiang blue-egg shell egg-type chickens, 20 Silkie, 8 Yellow broilers, 20 Tibetan chickens, and 20 Dwarf chickens were detected by using the the whole-genome of egg-type chicken 50K SNP chip provided by the present invention. After the SNP loci with MAF less than 0.01 (641 SNP loci) were firstly eliminated, principal component and cluster analysis were performed with PLINK and SNPhylo software, respectively. The results of principal component analysis and clustering evolutionary tree analysis were shown in FIGS. 3 and 4. All breeds can be distinguished separately, which also illustrates the applicability of the chip of the present invention in different breeds. Among them, the local breeds of Beijing You chickens, Dongxiang and Silkie are clustered into one group, the abroad commercial breeds of Rhode Island White, White Leghorn and Houdan are clustered into one group, and in particular, Rhode Island Red chickens are individually clustered into one group with a genetic distance far from other breeds. This is also because Rhode Island Red has undergone high-intensity artificial selection for multiple generations, and the genetic structure of the genome and nucleic acid polymorphisms have changed. The above-mentioned principal component and cluster analysis results can well prove the applicability of the chip, and the identification results are accurate and reliable.

Figure 5:
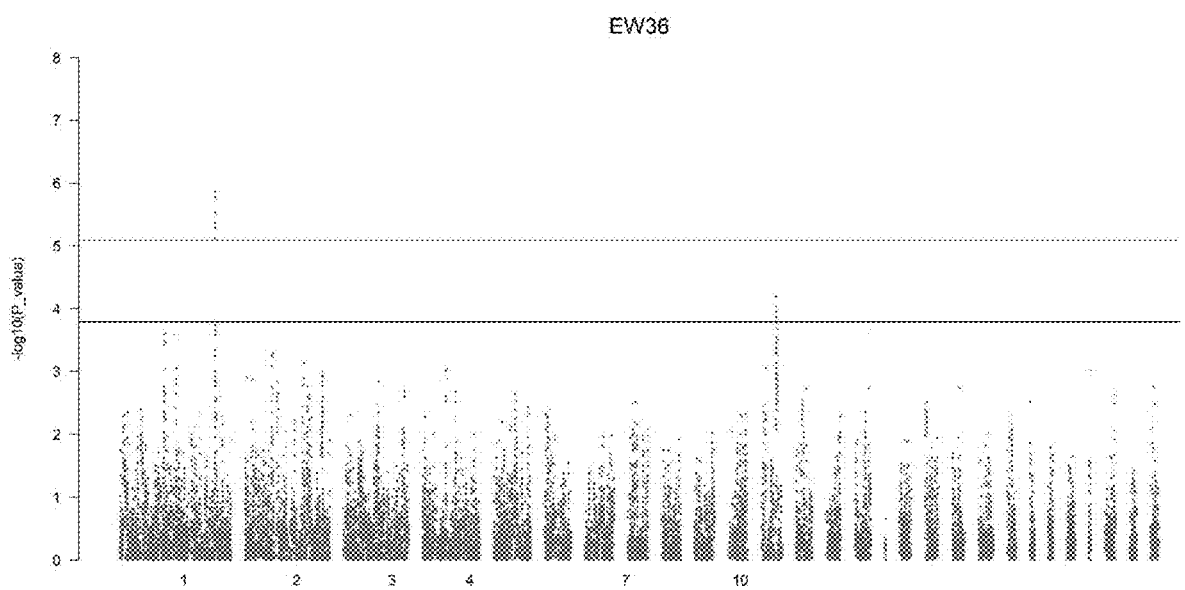
FIG. 5 shows the Manhattan graph of the egg weight of 36-week-old Rhode Island Red.

Example 3: Application of the Whole-Genome SNP Chip of the Present Invention in Genome-Wide Association Analysis 680 Rhode Island Red hens provided by Beijing Huaduyukou Poultry Co., Ltd were subjected to genotype detection using the egg-type chicken whole-genome SNP chip provided by the present invention, at the same time, the egg weight phenotype data of these hens at 36 weeks of age (EW36) were collected, and the quality control standards for SNP genotyping were as follows: sample Call rate>95%, MAF>0.01, and Hardy-Weinberg equilibrium test P value is less than 1e-06. After quality control, the remaining 673 individuals and 38,627 SNPs were used for the following genome-wide association (GWAS) analysis. Linear Mixture Model was used as the analyzing model, the P values of 8.1e-06 and 1.62e-04 in number of independent test of SNP were respectively used as the thresholds for genome-wide significance and potential genome-wide significance. The Manhattan graph of the GWAS results was shown in FIG. 5. The results show that there is a significant region associated with egg weight on chromosome 1, which is also consistent with the results reported in previous studies (Liu et al., 2018, Frontiers in Genetics).

Example 4: Use of the Egg-Type Chicken Whole-Genome SNP Chip of the Present Invention in Genomic Selection—Genetic Evaluation The egg-type chicken whole-genome SNP chip provided by the present invention was used for genetic evaluation of the genome. The DNA of 2,950 egg-type chickens (285 roosters and 2,665 hens) of three generations of a certain line provided by Beijing Huaduyukou Poultry Industry Co., Ltd were subjected to SNP genotyping. At the same time, genetic evaluation of the body weight at 28 weeks of age (BW28), the egg weight of hens at 28 weeks of age (EW28), and the number of eggs laid at 38 weeks of age (EN38) of these individuals were performed using both pedigree-based selection methods and genome-based selection methods. The specific steps were as follows:
(1) The typing test results of 2,950 chickens were subjected to quality control, the sample Call rate>95%, MAF>0.01, and Hardy-Weinberg equilibrium test P value is less than 1e-06. After quality control, the remaining 2,950 individuals and 38,413 qualified SNPs were used for genome-wide selection analysis.
(2) Model: BW28=Date+Hatch+Sex+Animal+Error
EW28/EN38=Date+Hatch+Animal+Error
Date, Hatch, and Sex are the fixed effects of individual birth date, hatching batch, and gender, respectively;
Animal is the random additive genetic effect of an individual animal, that is, individual's breeding value.
Error is random residual.
(3) Genetic evaluations were performed by pedigree-based selection method (PBLUP model) and genome-based selection method (ssGBLUP: one-step genomic model).
PBLUP model: the conventional breeding value is estimated by a single-trait animal model:

$$y = Xb + Zu + e$$

wherein y is a vector of phenotypic value, X is a design matrix for fixed-effect, b is a vector of fixed-effect including generation (birth year), hatching batch and gender, Z is a correlation matrix for random effect, u is a vector of breeding value and assumed to follow $u \sim N(0, A\sigma_u^2)$, wherein A is a matrix for molecular blood relationship, $\sigma_u^2$ is an additive genetic variance, e is a vector of residual and assumed to follow $e \sim N(0, I\sigma_e^2)$, wherein I is a identity matrix, and $\sigma_e^2$ is a residual variance.

ssGBLUP model: the ssGBLUP model is similar in form to the PBLUP model. The difference lies in that: the vector of random effect in the ssGBLUP model follows $u \sim N(0, H\sigma_u^2)$, wherein H is a matrix that integrates pedigree information and genomic information (Christensen and Lund, 2010; Legarra, et al., 2009). The H matrix is constructed as follows:

$$H = \begin{pmatrix} H_{11} & H_{12} \\ H_{21} & H_{22} \end{pmatrix} = \begin{pmatrix} A_{11} + A_{22}^{-1}(G - A_{22})A_{22}^{-1}A_{21} & A_{12}A_{22}^{-1}G \\ GA_{22}^{-1}A_{11} & G \end{pmatrix}$$

The subscripts 1 and 2 represent individuals without genotypes and individuals with genotypes, respectively. The inverse matrix of the H matrix is quite simple in form (Aguilar, et al., 2010):

$$H^{-1} = A^{-1} + \begin{bmatrix} 0 & 0 \\ 0 & G^{-1} - A_{22}^{-1} \end{bmatrix}$$

(4) Results:

TABLE 2

Comparison of accuracy of different genetic evaluation methods

| Traits | PBLUP | SSGBLUP |
|---|---|---|
| Weight at 28 weeks of age | 0.19 | 0.29 |
| Egg weight at 28 weeks of age | 0.17 | 0.30 |
| Number of eggs laid at 38 weeks of age | 0.22 | 0.38 |

(5) It can be seen that, compared with traditional selection methods, the use of the chip of the present invention for genomic selection can effectively improve the accuracy of genetic evaluation.

INDUSTRIAL APPLICABILITY

The SNP loci on the egg-type chicken whole-genome SNP chip provided by the present invention are respectively derived from 14,624 SNP loci shared by various line of major egg-type chicken breeds in China; 3,677 SNP loci related to disease-resistant traits in egg-type chickens; 16,000 SNP loci associated with economic traits of egg-type chickens; and 9,358 SNP loci for making up the genomic region that are not covered by the aforementioned probes. The 43,681 SNPs on the egg-type chicken whole-genome SNP chip of the present invention have DNA sequences as represented by SEQ ID NOs. 1 to 43681. The chip can specifically identify the genetic relationship between commercial egg-type chickens and local egg-type chicken breeds, and can also be used to perform applications such as genome-wide association analysis, genomic selection, QTL mapping for target traits, and population genetic analysis. The chip has versatility for domestic and abroad chicken breeds, can help accelerate the rapid development of the egg-type chicken industry, and has great economic and practical value and scientific research value.

SEQUENCE LISTING (43681 sequences)

SEQ ID NO: 1 - DNA, 121 bp, Artificial Sequence
  Synthesized
  misc_feature (61): n=a or g
attcaaataagaatagttttttttctcatctttacctatatccttgtagatcttttcatanttttccatctctctcaggttcatgtcataaaccagaagagtttttcccattgaaaattca

SEQ ID NO: 2 - DNA, 121 bp, Artificial Sequence
  Synthesized
  misc_feature (61): n=a or g
cgctctcgttcccagacccttgacatgcctgaagacttttggtgaagtgcactgagccgangtgacagactttatatttaaagaatgaaaccttatattaaaatggaattgagattagcaa

SEQ ID NO: 3 - DNA, 121 bp, Artificial Sequence
  Synthesized
  misc_feature (61): n=a or c
gagcaatgtcgtaacccaaggccacaacagcaacaccctgagacagcagcgcaggggctgngaaacctgacgcatccttactggggaggggagagtgaagctgccaagctccaggggacag

SEQ ID NO: 4 - DNA, 121 bp, Artificial Sequence
  Synthesized
  misc_feature (61): n=t or c
taccgctggtttggttacagacactggactggtaaaggcagagtcacggctggaggaaagngagcctggcttgtgttcatttctgttggctttccatggacttggctacgttgaaaagaac

SEQ ID NO: 5 - DNA, 121 bp, Artificial Sequence
  Synthesized
  misc_feature (61): n=t or c
ggtccttctcacatgcccacacaggtgaagctggagctggacaagactggagatgtgctgngactggctcaggagcaatataaaatccagatcctcatttcccctgccagtccctccaagg

SEQ ID NO: 6 - DNA, 121 bp, Artificial Sequence
  Synthesized
  misc_feature (61): n=a or g
gatacccgcaccttgctcatggaagcctggagcctaggaagctgtgccctaacaccaatcncctcagtgctttctgcttcagtttctcctttttcaaagtgagaatgatgctgatgatatg

SEQ ID NO: 7 - DNA, 121 bp, Artificial Sequence
  Synthesized
  misc_feature (61): n=a or g
tacaggaaagctgcacgtgggggtttaaaagccttcactcttcccttggtgctcacagaanagatgaagatgagtcatgcctctaagaaccggcctgagagggacaggagcaggacggtac

SEQ ID NO: 8 - DNA, 121 bp, Artificial Sequence
  Synthesized
  misc_feature (61): n=a or g
ctcccacaagctagtagataaatataggatatacaagtaaggttaaaaatgtaatactagnccaggtgcagtataggttactggttcagtgcttactttttttttcttctgacaccacact

SEQ ID NO: 9 - DNA, 121 bp, Artificial Sequence
  Synthesized
  misc_feature (61): n=t or c
atttacagatcctaccatgttgacagacatgatgaaagggaatgtaactaacgttctgccnatgatccttatcggcggttggatcaacatgacattctcagggtttgtcacaagtaagtgt

SEQ ID NO: 10 - DNA, 121 bp, Artificial Sequence
  Synthesized
  misc_feature (61): n=c or g
ctaagtaaatatattgaagtttcaagtgaatccaatcctagttggaacccaatggagcctnagtgacttcagatttctatctatcttctattgtgacaaatcacctctccatctctgagct

SEQ ID NO: 11 - DNA, 121 bp, Artificial Sequence
  Synthesized
  misc_feature (61): n=a or g
aatacaagggaagcccctggtgcagtggggaagagaaatgatgaaggttgtgccaatggcngaggaatactgtaagaagaccattcgtcacatggcaggtaatgtctgaaccaagagttat

SEQ ID NO: 12 - DNA, 121 bp, Artificial Sequence
  Synthesized
  misc_feature (61): n=t or c
tttgcttgtctagaacaaactcacaatgctggacattgcatccaatagaatcaagaagatngaaaatatcagtcacctaacagagctgcaggagttctgggtaagtgctgcacacagtgaa

SEQ ID NO: 13 - DNA, 121 bp, Artificial Sequence
  Synthesized
  misc_feature (61): n=a or g
agatgcgttattttgtaaggttcaattaagcaatgcagctatctagacaaggcgttatttntaaatatatgcagtatattggtttggctgttcatcatccatgacactgacacgtagattt

SEQ ID NO: 14 - DNA, 121 bp, Artificial Sequence
  Synthesized
  misc_feature (61): n=a or g
atctgtgctggaaaggatgaaacttcaatacttgactgccttttgcattctgccttttgcntttattaacgaggggcaccaattagcaggaaacctcagcagaagccctttcagaagctct

SEQ ID NO: 15 - DNA, 121 bp, Artificial Sequence
  Synthesized
  misc_feature (61): n=a or g
actttttgaaccagcacaattttagaagtgttttcatgttctctcttgtctgcttaatagntgatttaagttctgagtagaaaggagatggtgcaggtttacttttgctttcaaatttcct

SEQ ID NO: 16 - DNA, 121 bp, Artificial Sequence
  Synthesized
  misc_feature (61): n=a or g
agaaagagctgaaataacactattcccctacctccaacatgtcagttgagaaggtaaagcntgtctgacacagcacatcagttgcactaaacaagcaatcgtatcttcataattaaaacac

SEQ ID NO: 17 - DNA, 121 bp, Artificial Sequence
  Synthesized
  misc_feature (61): n=t or c
gttcaatgacagtgatgtcctttgcttccctcaggtttttgtgccgggtggtggatggcgngacacacgacgcgaatgcggtagggaagctcaccactatgctcagtcacctttaagcttg

SEQ ID NO: 18 - DNA, 121 bp, Artificial Sequence
  Synthesized
  misc_feature (61): n=a or t
ctaacaaaatgctttgtttccaacttcgttgtgcaaatataattttgttataattggaccntttttttttatacaaacaccctttaaatttaaaagcttcagataattgaaatggttacca

SEQ ID NO: 19 - DNA, 121 bp, Artificial Sequence
  Synthesized
  misc_feature (61): n=t or c
gtctgttttctacgtgagccagctggaggcatcgcagcatgtagtgagctgtgatgggacngtgcacatctgggaccagttcacaggtaagaagggaaagggcagcctggaataaactggt

SEQ ID NO: 20 - DNA, 121 bp, Artificial Sequence
  Synthesized
  misc_feature (61): n=a or g
ggggctggtttgccccctttcaacctgaaagatggcaaaaagaaagatggagctgaagcanaacacgtgcaaaggaggaagcgggtccgaggcaaacatccctgctcccagcaggacgcac

SEQ ID NO: 21 - DNA, 121 bp, Artificial Sequence
  Synthesized
  misc_feature (61): n=t or c
gttgatttccctgtatgctgtcagcacctttgtgtatgtttgccttatgatagcagcactngggttatttttcaaaaaatgttctttacatacattgtttttgtgtttaaacctaaataca

SEQ ID NO: 22 - DNA, 121 bp, Artificial Sequence
  Synthesized
  misc_feature (61): n=t or c
tcaggagaaacatgatagcttacagcttccatttaaaattgcagccttcagcacaagtcgntattgaaagcggatgcagaaagtagtttgtaaccaaaaaatttaaaggacgaagaaccga

SEQ ID NO: 23 - DNA, 121 bp, Artificial Sequence
  Synthesized
  misc_feature (61): n=t or c
cgagaaggagcgtggtgtcatccttcaggagctgaaagaaatggacaatgacatgacaaangttacctttgattaccttcatgccactgctttccagggcactgcactggcccgcaccgtt

SEQ ID NO: 24 - DNA, 121 bp, Artificial Sequence
  Synthesized
  misc_feature (61): n=a or g
tgagaaatgccactgtgtctcagtgtagtatgccagaacaaaaccgaactgcttctacctntgtcttacagatgcagcaactggagacattgcttcacgtgctgctagcaaggaaggcttt

SEQ ID NO: 25 - DNA, 121 bp, Artificial Sequence
  Synthesized
  misc_feature (61): n=t or c
tgctgcagcctgtgcttacgtgagaaattgcatctgcatatgaagcacacccatcagggcnttacacaaccatgttctggtcttctgttaagatgaaaatcctcaggaccagtcatgcacc

SEQ ID NO: 26 - DNA, 121 bp, Artificial Sequence
  Synthesized
  misc_feature (61): n=a or c
catctgcagctgagaaggaagagtcaacacccaaaacatccgcccaactcgcattctcccntctcttatagaagtattacctttcagttgtacaagtgcttgagagagcaatgaagttact

SEQ ID NO: 27 - DNA, 121 bp, Artificial Sequence
  Synthesized
  misc_feature (61): n=a or g
ggggagtcaacagcttgggacaaggagaactgaatcattacctgcaaactgcagatccccntgttttggaaaaaatgatttcctcaagtacctgttattagagaaggttcaaatgtaaaaa

SEQ ID NO: 28 - DNA, 121 bp, Artificial Sequence
  Synthesized
  misc_feature (61): n=a or g
gcaaatgggagctttgctgagcacatacaacggtgtgggactctgtgctcccagctttacntacaacaccatgttattgacagcactgccctgacccattgctcgcaggcatggggtgacc

SEQ ID NO: 29 - DNA, 121 bp, Artificial Sequence
  Synthesized
  misc_feature (61): n=t or c
atgagattttcttctctgtggtgaatattctcagattctgtaaggacagatgtgcttattnttctcctggttctacaggcaggagctagcagagaagggttctgcagaatatcactggtta

SEQ ID NO: 30 - DNA, 121 bp, Artificial Sequence
  Synthesized
  misc_feature (61): n=t or g
ccatgtgcctgtagcgaatggcactgggataccactcacaggcgggtgcttctgttttgtnccctgcattgagcaaagcacatgtattcctgtgctgacagccactgtgaatacatgcctt

SEQ ID NO: 31 - DNA, 121 bp, Artificial Sequence
  Synthesized
  misc_feature (61): n=a or g
ttcatggcattctctaattaaagacaaacaaacctatccagttaagtgctcgggaaccacnatggaaacccacactaacaataaactcccttttcccaatatagcacttccacaagcacag

SEQ ID NO: 32 - DNA, 121 bp, Artificial Sequence
  Synthesized
  misc_feature (61): n=a or g
cctggcacctctcaccactgaagtgcattggagcattttacaaggagcacaaccccggccnttcccagagcggagccaagcaggctctctttggaggcagggtattgcagggaaggggagg

SEQ ID NO: 33 - DNA, 121 bp, Artificial Sequence
  Synthesized
  misc_feature (61): n=a or t
cacaactaatttctctgaggttcagtttggtttgcttcacttaaggcagcacttccaaacngcctccctgactttggatttagtatgcatatttaggtctgtaaataaagagattggaagt

SEQ ID NO: 34 - DNA, 121 bp, Artificial Sequence
  Synthesized
  misc_feature (61): n=t or c
caaccacctttcactacagctacctgtgccagcaggctttgggggtgagagggtgttgtantgaagcagagcttatacctgtacctccaatgaaatcaagttctgacaatacatgtcaacc

SEQ ID NO: 35 - DNA, 121 bp, Artificial Sequence
  Synthesized
  misc_feature (61): n=t or c
ctttttcactgtttgcaacgttctgtcagctgcctgatgctgtgcctttcctgtgatacgncgaggctattgctatggattgcaaactgttgggggtttgagaggttcactgctgctttgt

SEQ ID NO: 36 - DNA, 121 bp, Artificial Sequence
  Synthesized
  misc_feature (61): n=t or c
ctggttggtcgtcgagttgtggaacagaaacaagcacaggaatgggctgacaaacatggcntggaatactgtgagatgtcagtagtgagtatctgctcttttcaccatctatagaagtggg

SEQ ID NO: 37 - DNA, 121 bp, Artificial Sequence
  Synthesized
  misc_feature (61): n=t or c
cttccagcagttacctggaacactgcaggtgtgaaatgctcttaacaggaacagcagaggnggtgctgcatcaccattaaacacaggttcacaagcagctgagcgcagaacaacttctggc

SEQ ID NO: 38 - DNA, 121 bp, Artificial Sequence
  Synthesized
  misc_feature (61): n=c or g
accttactactgatatagtacaaatgttcattacctcttcggtttacggtttgcagcaatntatacctgctgggtttgttggggtatttttggtacagaatgtaactgccctcagacagtt

SEQ ID NO: 39 - DNA, 121 bp, Artificial Sequence
  Synthesized
  misc_feature (61): n=t or c
cagctgtaatacagtggaagagagagattctctacaaagaggagccatagttttcaacagnagcgcttggttccaacagcttttctcagctccaagcacgtttcctagtacaaaagggatg

SEQ ID NO: 40 - DNA, 121 bp, Artificial Sequence
  Synthesized
  misc_feature (61): n=a or g
gccttaatgattctgtggttctctacctcttctctacatagggctgggagcataaccctcngtgttgctgcaccagggcagcgatgggtcaaggcaggacgggctgtggccaggggacagc

SEQ ID NO: 41 - DNA, 121 bp, Artificial Sequence
  Synthesized
  misc_feature (61): n=a or g
accagtgttttctatcagattcacagatcttctgtgcacctggacctgttctgcaacacgnaagagatggccacagaacaggtttgacctaatgagaggaagtgcggccaagaccgacgta

SEQ ID NO: 42 - DNA, 121 bp, Artificial Sequence
  Synthesized
  misc_feature (61): n=t or c
tggtactgatgaatttggtgactgcacagttctgtttgaagggggttttgggtggttctgntctgcagtgccatcatcctttcttgcaacagtatccagtgtgatgtttcctgaacaatca

SEQ ID NO: 43 - DNA, 121 bp, Artificial Sequence
  Synthesized
  misc_feature (61): n=a or g
ttaatttttattttcatttttcttgccagctctgggaatccaagaaaggatgtctgaaggntgttgatatgggctggctggctgtcagggtgctcagaggtgggctgaggaaggagctggt

SEQ ID NO: 44 - DNA, 121 bp, Artificial Sequence
  Synthesized
  misc_feature (61): n=t or c
ggcctctttcccatctgactttcataactccgtgtattttcttgtcaaggactgtgcttgntgaaggccaaaggactgacagtgctggaaaaaaaagagacccctggcttgaatcttccag

SEQ ID NO: 45 - DNA, 121 bp, Artificial Sequence
  Synthesized
  misc_feature (61): n=a or c
tttaattgcaataatagtagtactgacctgtgaattggaacttagtgcaaatttggctagngcacttgctcttgaaagatcaatcagaaggaggaagaacggtaaagcttcactggggaaa

SEQ ID NO: 46 - DNA, 121 bp, Artificial Sequence
  Synthesized
  misc_feature (61): n=t or g
aggtggtgcttacagtgtgatagtcatagaacgctgctgagcttcagttcttaagaggagntgggcctaagccacagttcatagagtccactgaacactgttaaaaactagaagtagagga

SEQ ID NO: 47 - DNA, 121 bp, Artificial Sequence
  Synthesized
  misc_feature (61): n=a or g
cttcagtttccttcccagttcaatgtttactttcattacccgtttctgatgggctttgatntgctggctttgggagaagtttgtgtatcaagccaaggacagctttgttgctcacgatgct

SEQ ID NO: 48 - DNA, 121 bp, Artificial Sequence
  Synthesized
  misc_feature (61): n=a or t
taatgccttcattctcctcataaaatcacccaattggcaagagcataaaagcactttaacnttagcatgtttttgctggtgcaggactacatgaaggcagatctctcacagattaggaatc

SEQ ID NO: 49 - DNA, 121 bp, Artificial Sequence
  Synthesized
  misc_feature (61): n=t or c
gaagttaagcggattatttcagcccctcaactctggattccagcaagggctctgagcatanggatttataatgaagttggggaaaacactcaaatatttgacctgcgtcatatggagcagc

SEQ ID NO: 50 - DNA, 121 bp, Artificial Sequence
  Synthesized
  misc_feature (61): n=a or g
tttggtgacaagcttcatggcaacatcatacacattgctgttcaaagaggtgtcactttcntactgaaaccaatagaccgtctctctcaccactcttccactccactcgagagtaatggga

SEQ ID NO: 51 - DNA, 121 bp, Artificial Sequence
  Synthesized
  misc_feature (61): n=a or g
aaaagagattaccttaaacctggtacgctgaccagcacgagtctgcttctggacaggcatnatcttcaacacctcatctttcagagaagaccccaggaagaagtcgatgatctctgactcc

SEQ ID NO: 52 - DNA, 121 bp, Artificial Sequence
  Synthesized
  misc_feature (61): n=t or c
tgtctgtcagtggtgaatgaagttcaggagaggagggagttcctggcagagatggaagccntaggacagggcaagaagtatcagagaattatctccactgaaatctcacaggtacgtaaga

SEQ ID NO: 53 - DNA, 121 bp, Artificial Sequence
  Synthesized
  misc_feature (61): n=a or g
gaagacccggagcttgagggcatctcctgctctctcaagcagttctgcttgtggtagtccnaggccaggagtaggtcctcagagctgctcacccccttcccctccttgcccttcctctttg

SEQ ID NO: 54 - DNA, 121 bp, Artificial Sequence
  Synthesized
  misc_feature (61): n=t or c
gctgcttctgttggctccaaatgggtacaacatcacaacacaacagccctgtaacagtcangtctgcaggtcacggcagcctgcaggtcccatgtcagtcattaagctccaggtcatactc

SEQ ID NO: 55 - DNA, 121 bp, Artificial Sequence
  Synthesized
  misc_feature (61): n=a or g
gctgcacaccagccagtccctggcgatggattgggggtagccaggctcggcctccagctcnctgtccagcactcgccagtactccttgcccctgaagaagtagcttgcacctgggaaaaag

SEQ ID NO: 56 - DNA, 121 bp, Artificial Sequence
  Synthesized
  misc_feature (61): n=t or c
gcggttcctcttctcccctagctgctcacataccagctggtcgccctcccagaaaacagtngtctgaaaaaaagcagaggggaagacgtggacccaacaaaagcagtacagatttccagtg

SEQ ID NO: 57 - DNA, 121 bp, Artificial Sequence
  Synthesized
  misc_feature (61): n=c or g
agcaagatcctgatcttgggcatctcaggtacctgctttttcttaagcaaacctttcctcntcagaattcatgtccctgaccctaaaaactccctttgttatcagttgcctctatttgaac

SEQ ID NO: 58 - DNA, 121 bp, Artificial Sequence
  Synthesized
  misc_feature (61): n=a or g
gcgtgcaagcattcacagtaaaaagcgttcattaaactcttctgagtgagcaactcagatnctgaaaacactcgcaaacacagttttgtttggagaaatcagcaaaattgagagataatga

SEQ ID NO: 59 - DNA, 121 bp, Artificial Sequence
  Synthesized
  misc_feature (61): n=a or g
gcggcgccactcaactgcccatggcccctgtgctgaagggccgtctcagtgggttagggtnaatcttgtgggctgtgcacaaggcaaaaggagcaggttttggggtgtttcaggtgtcaag

SEQ ID NO: 60 - DNA, 121 bp, Artificial Sequence
  Synthesized
  misc_feature (61): n=a or t
acaagatgtttgtaagcattatctgaatcactgtctggcttcttaattttgcaaggattcnttatacttaaggctgagctaacaagccttggatccaagtgtgtcagcgctggtgcacttt

SEQ ID NO: 61 - DNA, 121 bp, Artificial Sequence
  Synthesized
  misc_feature (61): n=t or c
ccttcccttcccacaccaacacacatctatgaggcttgtggcataattctttcttgctgtngccacctggggatcagctacctcccaagccacctcagaagagataggcaaagcagtggct

SEQ ID NO: 62 - DNA, 121 bp, Artificial Sequence
  Synthesized
  misc_feature (61): n=a or t
tagttcatttttgttttccttcttcttcttttttctttttttgtaattgatcttgaagcanactgctatgaaatctcccttgcagtggagccgagctcctgactgccagatgcttaattct

SEQ ID NO: 63 - DNA, 121 bp, Artificial Sequence
  Synthesized
  misc_feature (61): n=t or c
agctctgaacttcaaactcctttgcaaaaaaaaaaggaaaaagcatttccattctctgcanatccccactccaattatgggcaaagatttgttttcctgcaggctcaaggcaggaggctaa

SEQ ID NO: 64 - DNA, 121 bp, Artificial Sequence
  Synthesized
  misc_feature (61): n=a or g
tagaagacctttatagctccttgcttttttgagaatacagtataaaggatagataccaatntaatacactaaatcatcattaactcaagtaaagcactctctgtatttcctagaaactagg

SEQ ID NO: 65 - DNA, 121 bp, Artificial Sequence
  Synthesized
  misc_feature (61): n=a or g
gaggtattaatttttaaaacatggaaaatttccacattcaccattattttagcaaaaaggnattcaatcttgcatattccatgtaatctgttgattaattcccaaggcgaatgtacccttc

SEQ ID NO: 66 - DNA, 121 bp, Artificial Sequence
  Synthesized
  misc_feature (61): n=t or c
tctaaataagcccagaatcaggtttgttaccatgtatttttagaatactagaatacatccngcgatgcttttctgtaatataacagatattcagactgtatttgatatttaactttattca

SEQ ID NO: 67 - DNA, 121 bp, Artificial Sequence
  Synthesized
  misc_feature (61): n=c or g
ccagaagctctgttaggggggagggagaggataacattcatccccaactacagcactatgnggatggagaaaggctttacgcaggacaagaaaacaggaagggacattcaagctcagatga

SEQ ID NO: 68 - DNA, 121 bp, Artificial Sequence
  Synthesized
  misc_feature (61): n=t or c
gaagaagggttaacaagcattttggggagaagaggaacgtgggggaacaccgtctctctgngtgggtatgtttaaatgagttcagctcaagagattccttagattgtggtgttatctctca

SEQ ID NO: 69 - DNA, 121 bp, Artificial Sequence
  Synthesized
  misc_feature (61): n=t or g
ttttttctcttctacagtgtctgttgtgagagggtctcaaagcacttcaaagacattatgntatgaaccctcataatgcctccatggaataggaaagtgttgctattatcattgtgtgttg

SEQ ID NO: 70 - DNA, 121 bp, Artificial Sequence
  Synthesized
  misc_feature (61): n=t or c
cctaaaaggacttctcctgtctgccagcacctccagatcagcctttccctccttccaatanacactaacctcctcaaatttccctgctcagaaacatccctctaccatcagtttccccccc

SEQ ID NO: 71 - DNA, 121 bp, Artificial Sequence
  Synthesized
  misc_feature (61): n=a or g
ggtggagaagcgaagggcctaagtacagctaatgatctcctggaacttgtcaggtaactgnaaggtaatcaaataagagtttgtcttttcgtgaagattgatgaatattggaaaaataaaa

SEQ ID NO: 72 - DNA, 121 bp, Artificial Sequence
  Synthesized
  misc_feature (61): n=c or g
gattcctgctggccctgcttttcagcactgcgattcttgacaagccattgcagatctcttntggtcctgtactgtgttagggccaaggacatattttgcatagcacccagaaagcattctg

SEQ ID NO: 73 - DNA, 121 bp, Artificial Sequence
  Synthesized
  misc_feature (61): n=a or c
acatgcatagagacagctgagtctgctgagtttgcacttgttcccagacagttttgtttgnctttggttagcagccaccaaagcttgctgtaacgttgcctgttcatggcactgctgtctc

SEQ ID NO: 74 - DNA, 121 bp, Artificial Sequence
  Synthesized
  misc_feature (61): n=t or c
aactgcccccaccaagaattaaagaagggtaactgtcacaggcaattcctttccgaggggnacagaaggccccatctgtcagcataacctacctgtaggaaagtccgatgcctcactaaag

SEQ ID NO: 75 - DNA, 121 bp, Artificial Sequence
  Synthesized
  misc_feature (61): n=a or g
atagtgatctgttgttctgcttgaatataactgcaaggttaggactgcttagcaactgctntgtttctgctgcccttcatagagttgtggagttcttccagtgggagggtggggcttttcc

SEQ ID NO: 76 - DNA, 121 bp, Artificial Sequence
  Synthesized
  misc_feature (61): n=a or g
aagttgtcttatgatagatagcaaaatgtctttcttaggtctaaaactcctctggattcgngaagctgttttggtcagggtatttgcaggcccaaaggttacaaagaggatcatccctggt

SEQ ID NO: 77 - DNA, 121 bp, Artificial Sequence
  Synthesized
  misc_feature (61): n=a or g
agctaagagtgttgtcaaattaaagaagtgttccttaatgaatattgctttaaacctgttncctgagtgtctcttaaaatcaagaaatgtcaggttaattggagttctgtcatgactggag

SEQ ID NO: 78 - DNA, 121 bp, Artificial Sequence
  Synthesized
  misc_feature (61): n=a or c
agaaagagcaagaagtggtttgtgggaaggtacctggggtcaacaaaggacagaattgccngggattatgaaagcaacaagcagctcagcttctacaaactgagcacgtgacggcagctgg

SEQ ID NO: 79 - DNA, 121 bp, Artificial Sequence
  Synthesized
  misc_feature (61): n=t or g
gacagagtggcaacaggcagccatcgagcacaaactcattagtgctttcagaaagagcttncagagagatggcagaggagggatttttgctggagcgtttggggtaggaagcatcacagct

SEQ ID NO: 80 - DNA, 121 bp, Artificial Sequence
  Synthesized
  misc_feature (61): n=t or c
catttattgctgttttcagcaaaccccaaactaaaccaatttgatggggatccaaatctcntttccctctgacccagaggcttctggcagagctgttactggcagctctccccatcctgct

SEQ ID NO: 81 - DNA, 121 bp, Artificial Sequence
  Synthesized
  misc_feature (61): n=a or t
gatctctgctccaagcgctgaaggtaaagcatgtgctcctaattaaagacaagaagatgtnatttaattatgtaaccactcgggcctgatgtcaggacaatgagccaggtcaattttacag

SEQ ID NO: 82 - DNA, 121 bp, Artificial Sequence
  Synthesized
  misc_feature (61): n=a or c
atttatctgataggggagattttatgatccattcagttcctcatttcaaaggtattataantaccaaataaaaaagactgaaacaccagttgagaaattatgactatcagtagtttggaat

SEQ ID NO: 83 - DNA, 121 bp, Artificial Sequence
  Synthesized
  misc_feature (61): n=t or c
ctaggattttagaagcaatttgccatcatttctttaaagtgtgcatgtattttcctagcangaaaataccctcaattcagacccctgcacaatacttataaagaagactgtactgtaaatt

SEQ ID NO: 84 - DNA, 121 bp, Artificial Sequence
  Synthesized
  misc_feature (61): n=t or c
aagtatgcttctacacagcattcagcccgaagttcctctggatttttctggtgtgtgaacngctgaatttgttaaagagaaatttaattgctgtggaggagaatggaccgtatctgagagg

SEQ ID NO: 85 - DNA, 121 bp, Artificial Sequence
  Synthesized
  misc_feature (61): n=t or g
agctggcactgacctgttcgttgtgctggggcagaggtgcacggggattcttttgtatttnctttttaatcagtctcctcagaaggagatgttttcccctctgctttgtaacttcacccag

SEQ ID NO: 86 - DNA, 121 bp, Artificial Sequence
  Synthesized
  misc_feature (61): n=t or g
taccaacagcagtagctccttttgcacaggcagagggagcaggctgagtttggatcccagnaggctaagtttcttatggataccttctggctgttatttcaaggcatctaaatataaattg

SEQ ID NO: 87 - DNA, 121 bp, Artificial Sequence
  Synthesized
  misc_feature (61): n=a or t
aacatggtccaaccaaggatccaagtcagaaccagtgctgtcaaaaaaaaatgcaaagggncttcattactgaggactcctcgctgaggggtactagataaacccatttgacacctggata

SEQ ID NO: 88 - DNA, 121 bp, Artificial Sequence
  Synthesized
  misc_feature (61): n=t or c
gttctccctgcacacgtgggagctgttgaggtgctgccaacctgggaggtgcagttgcagnactggttgtgctggaggagaaggatgcctgtttccttgaggcagtgttttgctcaaggat

SEQ ID NO: 89 - DNA, 121 bp, Artificial Sequence
  Synthesized
  misc_feature (61): n=t or c
aacaacaaaactaaccagggaatgagatgtaccgtaagttttattaaaagatgattttgtnacctgtgtgttggcatcatatcatataatcatagaatcacagaacggtttgggttgaaag

SEQ ID NO: 90 - DNA, 121 bp, Artificial Sequence
  Synthesized
  misc_feature (61): n=t or c
aaaaaaaaaaaggaattattcattgctatgaaaatgccagtagtgaaggtggtttggtagnttgagtcttctgaattgtgcttctctttaccttttttggtgttcagtgctctttaagtgg

SEQ ID NO: 91 - DNA, 121 bp, Artificial Sequence
  Synthesized
  misc_feature (61): n=c or g
aaccagctcttcacagctctacccattctgaaaacacattccagatgcaaagcttcttccntggctgtttccagctgtagacacaagaactgagaccctccctgtttgttaactcttttac

SEQ ID NO: 92 - DNA, 121 bp, Artificial Sequence
  Synthesized
  misc_feature (61): n=a or g
ctacacagttgctagtaggtctgatatcattgctggtctggcagttttatgagtgagacantataaacagtccttcttgcctcctgctacaactgcattttcacgaggttctgtatcaaag

SEQ ID NO: 93 - DNA, 121 bp, Artificial Sequence
  Synthesized
  misc_feature (61): n=a or g
gacatagttaacttcatttggaattattttgaaacacattactctctgcattgctctgatnattttgaataagatagaaattcaaggcacaaataaataaggaaaattcctgcactgggag

SEQ ID NO: 94 - DNA, 121 bp, Artificial Sequence
  Synthesized
  misc_feature (61): n=t or c
gtatgaattctatttgtgctgggggcagagcattgaggaaggtagcattcaggtggtttcntgaaattgcttgatttgtcacctacttgtatgaccaatgaactagaagaaaaggctggtc

SEQ ID NO: 95 - DNA, 121 bp, Artificial Sequence
  Synthesized
  misc_feature (61): n=t or c
accattagtctcattgtaaataattgaagagcagggagttccatcccttgggttctttctngcaaagccacccagagcaggcagctcctgagaacagatctaggtgcaagcactggtggag

SEQ ID NO: 96 - DNA, 121 bp, Artificial Sequence
  Synthesized
  misc_feature (61): n=t or g
taaaaatgctgaagtcctattatgcttttccagggcttaagcaacatataaaaaaagtggnatagcttcattccctgttatgagccagcaatgaacctgtgggtaggcactatatggcaaa

SEQ ID NO: 97 - DNA, 121 bp, Artificial Sequence
  Synthesized
  misc_feature (61): n=t or c
gaaatatatgcaattaatctttacccagctttgtgctgatttatgataatgtaattctgantaaaataattgcagtcctaaattcgatcaaactggtttttaaaggtaagctttttatttc

SEQ ID NO: 98 - DNA, 121 bp, Artificial Sequence
  Synthesized
  misc_feature (61): n=a or g
tgcacatttccactgatacttaacgctacatatagacttgtaacagggaagccacgctgancaacattgagaaagcaacaccgcgctagacggctgaatcattttaattcaattcattcgt

SEQ ID NO: 99 - DNA, 121 bp, Artificial Sequence
  Synthesized
  misc_feature (61): n=t or c
atcatttctattcttccagaagttgtcacttgctttttccaaacagttgtagccttatttngccactgttccaatgatgactcacgatatttcataaatagtttatatgaggtgttcttca

SEQ ID NO: 100 - DNA, 121 bp, Artificial Sequence
  Synthesized
  misc_feature (61): n=t or c
cagatcgtgtccgtgctgaatgagcagctgcaaagaaccaggatactggagatgatgcttngctctgggttgctaaaataaactcttgttttggtgctttgatttaaagcactgaaaatct

SEQ ID NO: 101 - DNA, 121 bp, Artificial Sequence
  Synthesized
  misc_feature (61): n=c or g
aggtccaggctcaaggtgtaggctggaaatgggcatagggccaccagcttaagcagtgagnatctttgatgcaagagtagggctgtgtcgggctgagagtacatggtaggaaaaaaagaac

SEQ ID NO: 102 - DNA, 121 bp, Artificial Sequence
  Synthesized
  misc_feature (61): n=a or g
tgctttttgggtagtacttttaggcctggacagaaaaaagtgtatctgcagatttatccantgacttaataaacatctttcttttctcacgtgaacacgtaatttgtgtaagtgcactgcg

SEQ ID NO: 103 - DNA, 121 bp, Artificial Sequence
  Synthesized
  misc_feature (61): n=a or g
aaactaacaataaaaggtgaaggaaaaggttaagaacgtattgttacagcctggagaaccncagacaaccagggaatctgaattgctgatcaaagggtcagctctcatttactcattttta

SEQ ID NO: 104 - DNA, 121 bp, Artificial Sequence
  Synthesized
  misc_feature (61): n=a or g
aggatccttaacttattgatgggctgcctacttctttgtcaagagcctagctttcattgcngagggaaaagagtattccttgcacacaggttgccatatatgtgtcttgggtttgctgcag

SEQ ID NO: 105 - DNA, 121 bp, Artificial Sequence
  Synthesized
  misc_feature (61): n=a or g
ggcagcagaataacagtgctggtagttcaggcttagcctcctcctatgtggaatagggagntttgcttttgcagctctctgtgttgcatttcagccctccaggtgagtgctttgcagctgg

SEQ ID NO: 106 - DNA, 121 bp, Artificial Sequence
  Synthesized
  misc_feature (61): n=a or g
cggacctccttcactatgcagggggactcatttcagagttacaaggaaaacagggcttgcntttcctgatgcaaaaccatctccgtgtgccggcagcctgacctcagtgcacaaggacaga

SEQ ID NO: 107 - DNA, 121 bp, Artificial Sequence
  Synthesized
  misc_feature (61): n=a or g
aaaggaaatcttgaaagctgagaagttgctcttaaattctgtcagcaatatgcagcgcgtnctgtgcttgggggctttatgttcaatcatcagaacccccctactgtcaactactgaagac

SEQ ID NO: 108 - DNA, 121 bp, Artificial Sequence
  Synthesized
  misc_feature (61): n=a or g
aactgacattaggtataaaagaatttgagattagtttgcagaagctacttgcttacatctntgctccaaatctcccactgcatcagtgaatggagcacagctggagaacttaagtgcagga

SEQ ID NO: 109 - DNA, 121 bp, Artificial Sequence
  Synthesized
  misc_feature (61): n=a or g
tctttttgtcagattttgtcatctttaccagacccttttgaattctaatcccataatcccntatctttcagcacttttcaacttactattacatggaaattttactgatttgctgttttct

SEQ ID NO: 110 - DNA, 121 bp, Artificial Sequence
  Synthesized
  misc_feature (61): n=a or g
atgttactttcctcattcagaacaatgctcagaagcctctatgacattatcaagctgtacntttgctaacagaaggagcttggagtctgtgtagttactgcatgtaccttcataggtttta

SEQ ID NO: 111 - DNA, 121 bp, Artificial Sequence
  Synthesized
  misc_feature (61): n=a or c
ctggaattgttttccctcaggggtggaaacagtccaacaatttgacatgggttgatcccanctgcattgggacaggacagtgctcccaggcacttagagcacattgatgacattactgtgt

SEQ ID NO: 112 - DNA, 121 bp, Artificial Sequence
  Synthesized
  misc_feature (61): n=t or c
gaggccccaatcagagtagcacagagagctctgaagttacaccatgtgggtgctgtcacanacagcagtgcacacaactgagagatggatagtaaaagaaattaagttccatatttctatt

SEQ ID NO: 113 - DNA, 121 bp, Artificial Sequence
  Synthesized
  misc_feature (61): n=a or g
aggataactaaggtagataagtgtgtgacttagaatttagttgaaagagagcagttttgcncaaaggatcaggtgtactccagagtcctcccctaccagtgtgagccaactgacaaaaacc

SEQ ID NO: 114 - DNA, 121 bp, Artificial Sequence
  Synthesized
  misc_feature (61): n=c or g
ggaatcaaaaggtagacatcttgagatattccaaaggcagtaaggacaaactgacttctgnaggtgcttgccaactggcagatgactgttcaggaaggtgcatgatgggcaagataagggt

SEQ ID NO: 115 - DNA, 121 bp, Artificial Sequence
  Synthesized
  misc_feature (61): n=c or g
aatgcacagataacacaacttgcttttccctgtggtattccaggaatctaaaatagatctntgaggaattcagggctcgaatgttgctacagggatacatgtaagtgtcttacaattgaca

SEQ ID NO: 116 - DNA, 121 bp, Artificial Sequence
  Synthesized
  misc_feature (61): n=c or g
ctaatagcattactaattataactgctgaaaatttataaatagcaatagagtgtcattaantatgtgaatcatgaagagctagcttaattgtgtcttgtcttccaaacagccacatcaaaa

SEQ ID NO: 117 - DNA, 121 bp, Artificial Sequence
  Synthesized
  misc_feature (61): n=t or g
agctgcatttttatcacagctttgctgctatcaactttcttactgctttgtccctctgttncacagtctccaaaagtcatattgcagctttcagattactaattgactggcactgttatga

SEQ ID NO: 118 - DNA, 121 bp, Artificial Sequence
  Synthesized
  misc_feature (61): n=a or g
cccagagactccttgttagctataggagctgtaactgagcatttagtgattaatacatgcnctgtatttatttatcctgtctgcaaggggctttctccaaagggacacagcctcttcagca

SEQ ID NO: 119 - DNA, 121 bp, Artificial Sequence
  Synthesized
  misc_feature (61): n=t or g
aagaaaaaggacttgtgaagtatttttctgtggcaagaaacatctttaagtcgttgatctngaatgatgtagactcacacaactctaaaattcatgagtcccgtggccagtttccagattg

SEQ ID NO: 120 - DNA, 121 bp, Artificial Sequence
  Synthesized
  misc_feature (61): n=a or g
aaatttttctcttgattatttgtgtgtaccacagagctgtgtggaatcaatcatataaggngggtttacagtgtgtatacaagaggggtgctgtgcaaacatagagcaaaaatatgtacaa

SEQ ID NO: 121 - DNA, 121 bp, Artificial Sequence
  Synthesized
  misc_feature (61): n=a or g
tctccagcatttggtaaattgataaagtataatcaggcaaatttagttattccaggctgcnctgactaagaaataatccaatagtccttatagtaggatttcaagttaatgcttcctgtgg

SEQ ID NO: 122 - DNA, 121 bp, Artificial Sequence
  Synthesized
  misc_feature (61): n=t or c
ctccctgcctcgttgggccaacactatgaagacagatgcaccccaggctggatctttccanaagggctgtagcatatcttttagcgtgatgccttacaacacagatttgattccatctatc

SEQ ID NO: 123 - DNA, 121 bp, Artificial Sequence
  Synthesized
  misc_feature (61): n=a or g
accacaaaacattaatgaaagggagatgacattcacatccttccagaaaggctggagtttnaactcaactcttctagacaccagggaatactcattcatgagtgagctgatcaatggcatg

SEQ ID NO: 124 - DNA, 121 bp, Artificial Sequence
  Synthesized
  misc_feature (61): n=a or g
ttaagggagtaacagatccaatggacttggaacaaccactatatctggggaaaatgactgntttctgcaagtaactttaaagatagacaaaccactaactagatagcaacaactgattgat

SEQ ID NO: 125 - DNA, 121 bp, Artificial Sequence
  Synthesized
  misc_feature (61): n=a or g
ttaagaagtagattaaattcctttttttctgtgttctaaccaagtttcaagaagaactggngctatggaaaggggacttaataatcctgagataatttctgtcttgaaacaacttctatgt

SEQ ID NO: 126 - DNA, 121 bp, Artificial Sequence
  Synthesized
  misc_feature (61): n=t or c
tgtgccagctacatcaaagagagatgccatatctaagataatttacacaaataatcaaatncctaaatttactgttttttctccctttcatgtattgcctttgatgtctcagtctccccat

SEQ ID NO: 127 - DNA, 121 bp, Artificial Sequence
  Synthesized
  misc_feature (61): n=a or g
atataaatgagtaggatgtgagatgctgcctcattgtacccctaagctcaaaagtttatgntggcttttgaacgctaagcgaaagtgtgaagattgcagatgagttccctttaaactacaa

SEQ ID NO: 128 - DNA, 121 bp, Artificial Sequence
  Synthesized
  misc_feature (61): n=c or g
tatgtttcagtgcatttactttccaccgtatgtgtacctaagtcaaaaaagtaggctttcnaatactttgtattgagtctagcattagtacaaattaccagctagagcagcaattagtgcc

SEQ ID NO: 129 - DNA, 121 bp, Artificial Sequence
  Synthesized
  misc_feature (61): n=c or g
ctccatttcctgcatcactaataataatcaccactgttaaatgcatgttaatgaagagatnacagtgacagcaagaagcatttgaaaaacataacgagggagaaatgaccaacgtcctgaa

SEQ ID NO: 130 - DNA, 121 bp, Artificial Sequence
  Synthesized
  misc_feature (61): n=a or c
taaaatattttgctcttctagtttttattttactgtgttgaatgttctataacatcaccangaatgctttctttcctttcagtagcatgtttacattgagtgcatattaatttcctattca

SEQ ID NO: 131 - DNA, 121 bp, Artificial Sequence
  Synthesized
  misc_feature (61): n=a or g
aaatagtcactaatttcagaggcttattgtggaagcttatttatttggctcattatgttcntatccttcggtacgtgaagatgtttatatattctatgaaagcatcacataacattcatag

SEQ ID NO: 132 - DNA, 121 bp, Artificial Sequence
  Synthesized
  misc_feature (61): n=a or c
atagggcaaggcttagagccggcagatgtgaaactgctgcagaagaaccatgaactcctanacccagaatgaggaaaggaaaattgcttactaggctgctgcaccccagtggcggtacccc

SEQ ID NO: 133 - DNA, 121 bp, Artificial Sequence
  Synthesized
  misc_feature (61): n=a or g
tgcacacaactgtacagttctttctcaaagccacacataacaggaaacacagctcttcacnacttttgataggcacacaacttactactgctgtttgactccaatactagaggacagcagc

SEQ ID NO: 134 - DNA, 121 bp, Artificial Sequence
  Synthesized
  misc_feature (61): n=a or g
gctgtaatccaagcacagggcaggctaattattataatggtgtgccttttttccccgctgntattcaggatccagcaaatgtggcacagaagcttactgccactttctcagcgtttgggct

SEQ ID NO: 135 - DNA, 121 bp, Artificial Sequence
  Synthesized
  misc_feature (61): n=a or g
tgacaccacatgcatagcctgggtccacaattcccaaagtttggaaacagctttaaacagntcacttatgtgaagactggttctttgagtacaccagcgatgggcagatggacagatagat

SEQ ID NO: 136 - DNA, 121 bp, Artificial Sequence
  Synthesized
  misc_feature (61): n=a or g
caaggcagcaaatctttataaaattaatgaaatagtcaaggtagaaataaataatgactcnaagtaaggttcttgggatgtcaaatcataaagaagagtcctcctaatcagtgctttcctt

SEQ ID NO: 137 - DNA, 121 bp, Artificial Sequence
  Synthesized
  misc_feature (61): n=t or c
caattaagaaaataagttggaaatgaatcgcagaacagttttaagtgaacatgagatctanatgggaacaacttatgcagatgagttgttccattcactttgagtctcatttgcatggata

SEQ ID NO: 138 - DNA, 121 bp, Artificial Sequence
  Synthesized
  misc_feature (61): n=t or c
agctccatcctgtggcccccatagcacaccctgccagtcggcaagctccgaggcagcccangaatcaacatccaagatgaagtatgggatgctgattacttgagtgatttactgcttccag

SEQ ID NO: 139 - DNA, 121 bp, Artificial Sequence
  Synthesized
  misc_feature (61): n=t or c
aagctgaaactgttcattcctgaagggctattcagatagaagctgggtggatatcctatgncttcatttcactaatctgatctgcacagtggagctacttctgctgaagaacagaacaaaa

SEQ ID NO: 140 - DNA, 121 bp, Artificial Sequence
  Synthesized
  misc_feature (61): n=t or g
agtgagacttgagactaggagggtctttcagatctcaaccagttgtattctccctggcttnagcctgctgtgagtctgggaaggtttctcatgttgaagtgaagccaagagaaatggttgg

SEQ ID NO: 141 - DNA, 121 bp, Artificial Sequence
  Synthesized
  misc_feature (61): n=a or c
tcatctattccaactcccctgtaaggaacagggaaatttaagcttaatgccaaaaattaantaagaaagcaaacagagttttggtttccttttgtcactttggctgcagctgagtcacatc

SEQ ID NO: 142 - DNA, 121 bp, Artificial Sequence
  Synthesized
  misc_feature (61): n=a or g
attaaatctcagcatgaagcaaaaccggctgctctttgagttgtgatacatgaaagagttngtaaagcattttaggatccttcaggaaaaatgctaaatatctcttctataattcaatgta

SEQ ID NO: 143 - DNA, 121 bp, Artificial Sequence
  Synthesized
  misc_feature (61): n=a or t
gaagagaggtctcacagcctcttggatagcaatgagtcacatctgagattaagtccaggancagtgttcaaataacaggacttcttcaagtgccagaaaattccccaccttctgtattgcc

SEQ ID NO: 144 - DNA, 121 bp, Artificial Sequence
  Synthesized
  misc_feature (61): n=t or c
tcacgggatatgcttaattctgcttaattgctcagctctcttttaactaccagtttcatcnctacacgcaaaaggactgtatatgtacgtacacatatttttagttggattggttgttttt

SEQ ID NO: 145 - DNA, 121 bp, Artificial Sequence
  Synthesized
  misc_feature (61): n=t or c
acggtgcaaaacacgataatataaataagggagatttgaatgggaagtcagctttgaatantgtatcaagatgcaaaataatctgaagtctcagccactcaggattctaacaagtttagat

SEQ ID NO: 146 - DNA, 121 bp, Artificial Sequence
  Synthesized
  misc_feature (61): n=a or g
tatgaagggattattgggtagccatgaatggacctcagggagaacatgaggggaccaaagnctgaacatggcataaccatgcaggggccatagagtaagcatggtgagaacgtggtgggac

SEQ ID NO: 147 - DNA, 121 bp, Artificial Sequence
  Synthesized
  misc_feature (61): n=t or c
acagtgcagaagaggagtatgcccaggtagggaaatggctgaagtgtctctctgcacttcngaaatgacacaagagggaaatgccattttactgtatttctttcctgtttaattaaatggt

SEQ ID NO: 148 - DNA, 121 bp, Artificial Sequence
  Synthesized
  misc_feature (61): n=t or c
tggtaggcatgactgtgagaggcggctggatttcctcaatgactgcatcttgtttgtctcngtgttgaaccacagcaggcaacaaatagaagcgaaatgatttagaggaaattcttccaga

SEQ ID NO: 149 - DNA, 121 bp, Artificial Sequence
  Synthesized
  misc_feature (61): n=t or c
ttgcgtattttcagcagtagttttaatcccccaaactgctcctattccaccacagttaacnttcccctgtgtgtagccctaggtgatgttaagggaataaactataaaattagacgcctcg

SEQ ID NO: 150 - DNA, 121 bp, Artificial Sequence
  Synthesized
  misc_feature (61): n=t or c
catagagccactcgggaatctcttcatttcccttcttggcactccctggagcttattaacngcagctcagtgccagactccatctacctctgtgtctgagcagcagcgtggccaggccagt

SEQ ID NO: 151 - DNA, 121 bp, Artificial Sequence
  Synthesized
  misc_feature (61): n=t or c
gggctgtaattccctcgttagtggggacattgtaacaaaccccttcattaaggaaatgtangttttcaacttggaagacagtttaggctgcagggaacaagcatcgggcagcccatcctct

SEQ ID NO: 152 - DNA, 121 bp, Artificial Sequence
  Synthesized
  misc_feature (61): n=t or c
agttgtggtttactcctccttccatgttttcccaaatatgacaagcaaaattgtttggggnctttcttgaggctggtgtctcatgtaggtttaccaattacattaaattaatgctagcaat

SEQ ID NO: 153 - DNA, 121 bp, Artificial Sequence
  Synthesized
  misc_feature (61): n=a or g
ttgtctatccccagccttccttgtccatacctcactctctcaatttcctcagccctgggancagctctccagctcacagataatgctctgagagaaatcacctggctagcagcaagaagaa

SEQ ID NO: 154 - DNA, 121 bp, Artificial Sequence
  Synthesized
  misc_feature (61): n=t or c
ggggtgttagtttttgtatcaatattttgtcacattcgacagtgagggcaaggagtaatgncattcctagctgtttggtctccagctacttgagatcatagtgggttttatgtatgggagt

SEQ ID NO: 155 - DNA, 121 bp, Artificial Sequence
  Synthesized
  misc_feature (61): n=t or c
aggcaagtttgttttgctttcaagtgtgttgcaaacacagaaactggagaatccagagttnaaccatgtgctaaaatatataatggcacaaccttccttaattgtacaagcacgtgatact

SEQ ID NO: 156 - DNA, 121 bp, Artificial Sequence
  Synthesized
  misc_feature (61): n=t or g
gagatatgcgatggtctaaaacacaggccaaggaacctgggtgaggacacccttttgagcnctgaggttctggctcctcagaatggggccaatgaagtgactgggtggtctaatttagggt

SEQ ID NO: 157 - DNA, 121 bp, Artificial Sequence
  Synthesized
  misc_feature (61): n=a or g
taaactgaaacctgatattgggccccttgtgggtggggagccaaggaagctgctgtgtttngattttgctcctttagttccactgaaccatggcaagtagctgctgagtcaatcttgctgc

SEQ ID NO: 158 - DNA, 121 bp, Artificial Sequence
  Synthesized
  misc_feature (61): n=a or g
aaattccgagtgatttatttctgtcatagtactatgacttgctgcttgaatcaagagaacngtcttcccgctgcttgagctgcaatccagcatcattaataaatagcattggtaagaaagt

SEQ ID NO: 159 - DNA, 121 bp, Artificial Sequence
  Synthesized
  misc_feature (61): n=a or g
tccgagcacagagcccatccccatagaatcatagagatccatctgtgctgtaaaattgtcntaatggtgcctggccccgctctgtactatgtggataacccacaccagtgcccaggatggg

SEQ ID NO: 160 - DNA, 121 bp, Artificial Sequence
  Synthesized
  misc_feature (61): n=a or g
atatcccctttatcagagagactgcttgcaaaggggcaaatcctcttcccttgcatgcatncagtatgaagatgagctcaatggagagagcttcccttcccctcatgtatgtgggatcatt

SEQ ID NO: 161 - DNA, 121 bp, Artificial Sequence
  Synthesized
  misc_feature (61): n=t or c
ccaaaggcttttaaacacatccagcaattcagcattacttagttgcaccttcatggtttanaatgtcacaggcatacaggaagtagaagattgcatactgtttgacttaatgtaacttgtc

SEQ ID NO: 162 - DNA, 121 bp, Artificial Sequence
  Synthesized
  misc_feature (61): n=t or g
agagttcacacaaagaatactattagcatacaataaaggaaccaaggagactgaaatcctntgttataataaaattgttcagttactacatccttaccacgtttttttttcccaatttaaa

SEQ ID NO: 163 - DNA, 121 bp, Artificial Sequence
  Synthesized
  misc_feature (61): n=a or g
atcttaatcttttccacaatgtgttacaaacaaaaaactgggattattttttctttctcanccccattggcttcttagggattcctgccatatttcaggtggcttaaacatcacgtgtgag

SEQ ID NO: 164 - DNA, 121 bp, Artificial Sequence
  Synthesized
  misc_feature (61): n=t or c
tctggcattctgcaggacaaggctaaccactgaaatccatgtctgcagcaggttcgcgaantgggagccagcttcatgctaactgaaactgtggctcttactgccactctgtttcaggtaa

SEQ ID NO: 165 - DNA, 121 bp, Artificial Sequence
  Synthesized
  misc_feature (61): n=a or g
gtatgcagcacaggttgagagttatgcattgtttttaatgaactgtcacttaaaatatgtngtctgataagtacactatgccgtactggcttcagtctcacatctcaagcaaatacttcag

SEQ ID NO: 166 - DNA, 121 bp, Artificial Sequence
  Synthesized
  misc_feature (61): n=a or c
gacttctcatattgaattaacaagatgagagcacaggtgcccatttatccttttggaatgntgggtgcccagctcatttcaggtgtgtggctataattgtgttagcttgcctgaattctgg

SEQ ID NO: 167 - DNA, 121 bp, Artificial Sequence
  Synthesized
  misc_feature (61): n=a or g
ttgagtacatacaatgtttccctatgaagctttttggcttcagaaggatcctccaaacacngagaggtaccagaattactgtatcgacacatcccggggtcactcagagcacatcgcctta

SEQ ID NO: 168 - DNA, 121 bp, Artificial Sequence
  Synthesized
  misc_feature (61): n=t or c
ctgatattcgcgtgtcccttgctaaggttggcagagacagcatcactcagcctgatgtgtncaggctgctgccctgctgatcggatgtgactgtcactgacgtgagagccttttgctcatc

SEQ ID NO: 169 - DNA, 121 bp, Artificial Sequence
  Synthesized
  misc_feature (61): n=t or c
tgagcacaagggttttgtaattaaacttccaaatttggtaacttagctcagtagctgatcntataatggtaaaacagaaagtaaccgtgccagtgtgagtctgtggaagaagtgtccttaa

SEQ ID NO: 170 - DNA, 121 bp, Artificial Sequence
  Synthesized
  misc_feature (61): n=a or g
catgagggcagtggctgccacgaggagcacacgagtactggggctgcgtgctctcttagtnccctgctatccttcagccctgctcttgtaggggagttagcttgagaaacctcagcctctg

SEQ ID NO: 171 - DNA, 121 bp, Artificial Sequence
  Synthesized
  misc_feature (61): n=a or c
aagcagcacaactgctctccgctgctttattaaggagggaaaagcataaaacaaaagaccnaaaccagcagtaatatgtttgaggatgtttaccatgtgtctaaaattagccaagggaccg

SEQ ID NO: 172 - DNA, 121 bp, Artificial Sequence
  Synthesized
  misc_feature (61): n=t or c
atttgggggtaaattcctatattcatgaaggtagaaggaagtatgtgagcagttatggtgnttgccttctatccatggatatgaaaccttcccctgcagaatttctcttggctctccatat

SEQ ID NO: 173 - DNA, 121 bp, Artificial Sequence
  Synthesized
  misc_feature (61): n=a or g
atattctgctgatcagaagggagaggggggatcagaaatatctcactcagcctgaaaaaangactaagcagttgctatctatggacaaccaaaaaaatccaaaggttggattttatctccc

SEQ ID NO: 174 - DNA, 121 bp, Artificial Sequence
  Synthesized
  misc_feature (61): n=a or g
taagtcggctgccacaagctttcagaagcctggagacagtgaaaaacaagtggaagcagcntttattaagcctgcttgctaagtgacaaaatttagacagaaatctggtgtaacagaatat

SEQ ID NO: 175 - DNA, 121 bp, Artificial Sequence
  Synthesized
  misc_feature (61): n=t or c
gttcaaatgatctgtgacttctgacccaagattaaatctagtgtgtaactggtggttgtanacggagtcacatgcatgggctaacggcaggaaccccgtgttctccaaacagagagagcgg

SEQ ID NO: 176 - DNA, 121 bp, Artificial Sequence
  Synthesized
  misc_feature (61): n=t or c
gctgctacaacaggatctcaaagcactttccagaagatggtcaaaggctgttttcgtgttnttacccacagctacgcacaggcaaaggcttttcagggagatcacgaaactcttgcagatt

SEQ ID NO: 177 - DNA, 121 bp, Artificial Sequence
  Synthesized
  misc_feature (61): n=a or c
ctgttctcacagaggccttgaagaaggtgatgctcctttacagggtttcttgccctctttnttttgttctgcctctcattacataaagtaactccagatatccagaagacagcttgacagg

SEQ ID NO: 178 - DNA, 121 bp, Artificial Sequence
  Synthesized
  misc_feature (61): n=a or g
aatagcccctatagtgtggcttcttaaggggttttagcctttagtgttcacccacaaagcntggggggctggagggtgatgctagaccagtgctcaatttggagcatcccagcagggtgag

SEQ ID NO: 179 - DNA, 121 bp, Artificial Sequence
  Synthesized
  misc_feature (61): n=a or g
tgccctggattcaggtacgttgcatgcagtttcggggacgaacatcaaatttagtcacacngctggaatcttgacttgtagcactgaacttggagtttggaaaacttgttccagtgctgga

SEQ ID NO: 180 - DNA, 121 bp, Artificial Sequence
  Synthesized
  misc_feature (61): n=a or t
ttgttatgcatctgtactacagtccacacaatgtgatgctgtttcctggctggtacttttntatgtgagcacagtcatatcataaaggaataaatatcttgattatgtcaagcttaggtag

SEQ ID NO: 181 - DNA, 121 bp, Artificial Sequence
  Synthesized
  misc_feature (61): n=t or c
agatttctttggctaatttgggatgcatagtggggtcaggatttgggttctcgttgcttanttttgaaactgcagagaaaagcaaaatgtgctgcactggcttattcttaacttgatggct

SEQ ID NO: 182 - DNA, 121 bp, Artificial Sequence
  Synthesized
  misc_feature (61): n=t or g
gaaacttgctacatctggctgtgttttaatgcataaacactggtatcagttttatatgaangtgtctctatgaagacagcaatgtagtgtaagatgctgctgctctttaataataattcat

SEQ ID NO: 183 - DNA, 121 bp, Artificial Sequence
  Synthesized
  misc_feature (61): n=t or c
ttcatcatctgaacttgtgaaagaaaaatctgcttctcctgtcctggccagctcgtcacangtggagtactcctctgagtaatagtgagacatctctgcttcttccttcctcagcttctga

SEQ ID NO: 184 - DNA, 121 bp, Artificial Sequence
  Synthesized
  misc_feature (61): n=a or g
agtttcacctgtgcatacccacaatattcagtgtaaacaattagaagaaaaaaactaccantagcagcatttggacatttaattactgaaacgacacactgagaagaatcatgaagtcatt

SEQ ID NO: 185 - DNA, 121 bp, Artificial Sequence
  Synthesized
  misc_feature (61): n=t or c
attcagagggcaatttaccaaacccagcttagataccatcctagcctatgatgaatcaccntctgcacttgtttgtgtcatgccactgatcctagcagaaaattagacaaatagtttagag

SEQ ID NO: 186 - DNA, 121 bp, Artificial Sequence
  Synthesized
  misc_feature (61): n=a or c
cattagtaatgtcgcatgacagtatgcacaaattatctgctgctggtatgaatggtcctgnaatcactgatggcaatgtgctgctgtgtttggaaatgaacttacacctcccagctcccgc

SEQ ID NO: 187 - DNA, 121 bp, Artificial Sequence
  Synthesized
  misc_feature (61): n=a or g
atccttgcagtgctttcaattgtgattatatgcagagctgtacttctttggatctatcagnaacatgtggctatggtatcactcccagctgtttcctatccttctgtcagctgcaaggtac

SEQ ID NO: 188 - DNA, 121 bp, Artificial Sequence
  Synthesized
  misc_feature (61): n=t or c
tttctattgggaaccccttgaagccattcatcttgctacaaaagaactctggcattgttantccttgtaaagggacagggcaaggaaagcaaatatcttctgacaatgacagtgcttcttt

SEQ ID NO: 189 - DNA, 121 bp, Artificial Sequence
  Synthesized
  misc_feature (61): n=a or g
tctcaaggctgcgtccatccccaataattattctgggatggacaaaactgcctgcctgttnttttggcattggaaacactttcttaacaaaagatttaacaattttttctgtttccataag

SEQ ID NO: 190 - DNA, 121 bp, Artificial Sequence
  Synthesized
  misc_feature (61): n=a or g
agagctcaggaaaactcaaagaagaaaccagactgctcaaagaaggaattcgacctctcanagaagaaatgagaccgcctgctgctctagcgatcatctgctgacagccccggatctttct

SEQ ID NO: 191 - DNA, 121 bp, Artificial Sequence
  Synthesized
  misc_feature (61): n=a or g
ataactggtagagcaattttaaataagaggtagtttattgtaattgactcttgcagagcantcatgctggtgaaagagggaaagtataaacttctttcagcaatgaaaccactgctgattt

SEQ ID NO: 192 - DNA, 121 bp, Artificial Sequence
  Synthesized
  misc_feature (61): n=a or g
ctgcttccaaagctacaggctggactttctccagcgacaagccctccttgtgctgtgcacntcttggcatagattgccctattcaaatttgccgtctgcaaagcaaaaagcacctgggaca

SEQ ID NO: 193 - DNA, 121 bp, Artificial Sequence
  Synthesized
  misc_feature (61): n=t or c
agtttaatttatgagaatgatctctcattcccattccaccaaacgctaccgatggacttancggttagagatggaacaaaaacgagatggctttttgggtttggatttcattagaatttta

SEQ ID NO: 194 - DNA, 121 bp, Artificial Sequence
  Synthesized
  misc_feature (61): n=a or g
tgtactgctaattgagttcaggataataaagagactactgctgttatttcctgaatgcacntcaagatgtttgagagcttgtgatacacgcagttgggccatcacttgacctgtgcagagt

SEQ ID NO: 195 - DNA, 121 bp, Artificial Sequence
  Synthesized
  misc_feature (61): n=a or g
aataaacctttttttttttttgttgaggctgagctgctgagccatgcaggacaggcagcancttacagagcaggaggtgcaagaagatgcaaacatcccctggagcattgggtgctgcctg

SEQ ID NO: 196 - DNA, 121 bp, Artificial Sequence
  Synthesized
  misc_feature (61): n=t or c
ccactcctcctgttctaccaaatgcaaatgggctcttctgagtggtttttgtagtgtctangcgcatttttgtgcaggtctgctacaggccacctaagcaggaagagcatgggcatgtagt

SEQ ID NO: 197 - DNA, 121 bp, Artificial Sequence
  Synthesized
  misc_feature (61): n=a or g
catcagcaaagtcgagacaatatgtaatgtcccatatgttcatgatcctaagccccttgcnctatcttaggtaatgctcttttagtgtcagaaatgtctcatttgccaatcactaagaata

SEQ ID NO: 198 - DNA, 121 bp, Artificial Sequence
  Synthesized
  misc_feature (61): n=t or c
catctattcttcatgaatacatcaaatgcaggctatcaaatcatagggtagataataacantgatttttaagcagaattactctgcagtttgctcatgtattcagtgctagcatctaaatc

SEQ ID NO: 199 - DNA, 121 bp, Artificial Sequence
  Synthesized
  misc_feature (61): n=c or g
gtgtgggcaccacaccctcaatcctcttccataccgggatgatgacacttaatggtggctngtgtatttgaaaacctgctgtctttcttccagcccagcagtttctcccttcctgggatcc

SEQ ID NO: 200 - DNA, 121 bp, Artificial Sequence
  Synthesized
  misc_feature (61): n=a or g
gtccttatttgaaaccaaataaattgtgcaggtatggatgtgctacagatggaaatacacnttccagtgtaaagactaatgcaagaaaaccatagtccttacagaaatatcataatatttc

SEQ ID NO: 201 - DNA, 121 bp, Artificial Sequence
  Synthesized
  misc_feature (61): n=a or t
atattccatggacattgtttgcatttcctgtattgctgatcctttgctgaaaaagagatcnagcagaaggttttgttatcattgaggagatctcagacagtagatctcagtaaacctgaag

SEQ ID NO: 202 - DNA, 121 bp, Artificial Sequence
  Synthesized
  misc_feature (61): n=a or g
ttttacactgggaggtgggtggcagtgtctgtcataaacaatgcacttcagtaccttaaantagtagcatcagtggcatgatgggttgacataatcaaatgtccaaattaaatcatctttc

SEQ ID NO: 203 - DNA, 121 bp, Artificial Sequence
  Synthesized
  misc_feature (61): n=t or c
atcacatttaccctgctcctgtgctgcacacagactgctatatagccagttctaactgctncttctgcctggctaatggcatacaagaagacaacaagtgcatccaactacacttcttagt

SEQ ID NO: 204 - DNA, 121 bp, Artificial Sequence
  Synthesized
  misc_feature (61): n=c or g
ggcaccagaggaaggaagaggcccacagtagggcactcgagtgtggagagatgataactcnttcctctccagcttgtttgagaccttactagcccagtgggtaatggttcttcccatgcag

SEQ ID NO: 205 - DNA, 121 bp, Artificial Sequence
  Synthesized
  misc_feature (61): n=t or c
tctggacagtttggtaggtgctgtccctgacattgtttccatgagacacctcaaatccatnagttaacctgtgaaatataagagctgaatatactttttaaagctcaatgtatcttgtatt

SEQ ID NO: 206 - DNA, 121 bp, Artificial Sequence
  Synthesized
  misc_feature (61): n=a or g
tgtgctgttggaaatgaggtgacagagatgagagctggaagacagaacagtatacagaaantagacctatctaagactaggacctgttttggggtagagacacaagaactatttactctcc

SEQ ID NO: 207 - DNA, 121 bp, Artificial Sequence
  Synthesized
  misc_feature (61): n=a or g
tcatttgctagtttgtgtgatcactgaccaaagagctttaagagaaccactcattttcctncatccatactcaaaaggttgagaatctaccaaaagagtgttgggctggattacagattat

SEQ ID NO: 208 - DNA, 121 bp, Artificial Sequence
  Synthesized
  misc_feature (61): n=t or g
aggctgacatcctctagtagagagtccgaagtattttaacactcaagatacccaaatattntattactcacaagttctggactatccatacatcttcatagctactttgcaaataaatcag

SEQ ID NO: 209 - DNA, 121 bp, Artificial Sequence
  Synthesized
  misc_feature (61): n=a or g
agaggaaagcaggagtcactggactggagtcctaatccagggaagcaggaccatgcaacanagcatctagatgtgactacaggatgttagtcacctgcaggatgagttctgaagctcatta

SEQ ID NO: 210 - DNA, 121 bp, Artificial Sequence
  Synthesized
  misc_feature (61): n=t or c
gcctactgcttcaggatgttcctccatcaaaggctcctttatcaaaccttagtattgttgntattttattggcaacttttcccaacatagtctttacaaatttaactgcttgctccagctt

SEQ ID NO: 211 - DNA, 121 bp, Artificial Sequence
  Synthesized
  misc_feature (61): n=t or c
cttttacagtacagccactgagttggcttcttggcaaaattaataactttaagaacttaanacccaccatgggacacaaatacctcggggcaaatcagaactgaagaatacacaattgtag

SEQ ID NO: 212 - DNA, 121 bp, Artificial Sequence
  Synthesized
  misc_feature (61): n=a or g
cccaagaactaaaagggtttggagcattgtccagatgatatgatgtgctggatgagatcgntctgatgttttgtatatctgaggtctctttgccttgttgtccttcagtttttccgcacct

SEQ ID NO: 213 - DNA, 121 bp, Artificial Sequence
  Synthesized
  misc_feature (61): n=a or g
agagtttgtttgagaaggacatcaacagtgtatggttgtgggctcttcaaatttcatagcntttgggctgtcttggctcaggaacatacactgaatttggtactgacatagccaagcttac

SEQ ID NO: 214 - DNA, 121 bp, Artificial Sequence
  Synthesized
  misc_feature (61): n=a or g
aagccacttgctctggcacctttctgcctctgcactgaaacatgggacagcagctgcttcngagctgcccccaccgtggtcaaagggattcatctgcactttaaacattcagtgcacagaa

SEQ ID NO: 215 - DNA, 121 bp, Artificial Sequence
  Synthesized
  misc_feature (61): n=a or g
tagacaatttattgtcagactcatttgttcattctggctacagttaatttcagagatttcntcattattcaaatagaccttccagcgtagacatatatttcattgcaatcttattgtaact

SEQ ID NO: 216 - DNA, 121 bp, Artificial Sequence
  Synthesized
  misc_feature (61): n=a or c
cacggtgagcacaccatttcttcctgtacagctctctgttctgcaacatggaacctcaatnaatgcaagaactgccattgcctgacatggttattagtgcagtgctaagcaccagtgcatt

SEQ ID NO: 217 - DNA, 121 bp, Artificial Sequence
  Synthesized
  misc_feature (61): n=c or g
aggcgtgacacatatccaacctccacctctctcttcataaatggctaaaaggagcttcctntcgggtttctagagctgtgttaagaatgtaaaattatctgaggctgcttgccagtaaaat

SEQ ID NO: 218 - DNA, 121 bp, Artificial Sequence
  Synthesized
  misc_feature (61): n=t or c
tgaaacacattggagctaataatgacaaagaatgactgaaaacatggaacactaattatcnctttgcagtttatcacatattaaagtgcatgtctgtctacgcttctaaggcatacctgtt

SEQ ID NO: 219 - DNA, 121 bp, Artificial Sequence
  Synthesized
  misc_feature (61): n=t or g
tatttaaaaattaactcaatatccagcaaatgattgctaatgaaggtacataacccagcangcccaccatagcagaagaccagatttggcagaaatcagataatcttgacagacctggaca

SEQ ID NO: 220 - DNA, 121 bp, Artificial Sequence
  Synthesized
  misc_feature (61): n=t or c
gctcgctttagttcagtgtgagataagcatttcacacaccaggaaatgctggatactactntggggagaaacaatgcatttcctgtcattttatccataaagcacagcaccagttcagtca

SEQ ID NO: 221 - DNA, 121 bp, Artificial Sequence
  Synthesized
  misc_feature (61): n=t or c
gcatcctggaagactggaattcccttgattgtgagttcataatgctttttgtatattttangtaatcccttttgtaagagtgcctgtcttatgtaatgtcttagaaatggaaatgaggcca

SEQ ID NO: 222 - DNA, 121 bp, Artificial Sequence
  Synthesized
  misc_feature (61): n=a or g
attcacaaataaaattaggatgggatgttaggaaaattgaaggtgttatcccacctctcantgtacaatgttgcccaaaatgttattgccaaggaggtaaatttaaaaaggtaatgctttg

SEQ ID NO: 223 - DNA, 121 bp, Artificial Sequence
  Synthesized
  misc_feature (61): n=a or g
catgcatggatgacgaccctcctccaagaagcccacttggaacagtggcacaaagttgtgnatagtctgtctgtggcttggtcagtgtagtattttgatttgagtgtgttcttggtattaa

SEQ ID NO: 224 - DNA, 121 bp, Artificial Sequence
  Synthesized
  misc_feature (61): n=a or g
aagacaagaacccagtgtggaaataactaagaccttaaaatgaactaacacaaggtgtttntttaaatgtataagcccaggcacgtacaacttggagcacttcactggattcttctcaggg

SEQ ID NO: 225 - DNA, 121 bp, Artificial Sequence
  Synthesized
  misc_feature (61): n=c or g
aagtgtgttctttaacattgtaataagagttctgaaaaagaatgaaaacagttagcagganttgtgaaggatcaagatttataaaggcttatctgatctaaagctttccatgaaagcttct

SEQ ID NO: 226 - DNA, 121 bp, Artificial Sequence
  Synthesized
  misc_feature (61): n=t or g
aatcagaacagaacactcgaattctgaaattacatcattgctaaatgagtgaacataattntgctatttcttgattctatagacaggcttttagattataacaggagtcgatctgctttca

SEQ ID NO: 227 - DNA, 121 bp, Artificial Sequence
  Synthesized
  misc_feature (61): n=t or c
taaaaaagcactgaccaatagttcagaggtgtcctagcagtggcctgtactgtgagcgtgnactgtcttaattctctggcatttagcctcagcgttcagcatcctaacagggaaactctgc

SEQ ID NO: 228 - DNA, 121 bp, Artificial Sequence
  Synthesized
  misc_feature (61): n=a or g
tccagcctctgaagtggctcagcacaccgcatgcaggtaccagaccaattactgtggtttnctttccttctatttccaaaaccaccaaggctgtaaatgtaattacctggcttcctggtta

SEQ ID NO: 229 - DNA, 121 bp, Artificial Sequence
  Synthesized
  misc_feature (61): n=t or c
aagaacataacctcaatcttgttgaaaccacagaaaggactctaacataaaattagaaacnttcttcagacacacttcagtagaaggagccaatcctctcacagcaaaactaggcacacgt

SEQ ID NO: 230 - DNA, 121 bp, Artificial Sequence
  Synthesized
  misc_feature (61): n=a or g
agcaccagcaaggagccttggcagtcagctaatagggcagcatgggaacaaggaagtgacngaggctttgaaacaggggtcactgagagaactgaccctgtcgaggtgggaatttgtccat

SEQ ID NO: 231 - DNA, 121 bp, Artificial Sequence
  Synthesized
  misc_feature (61): n=a or g
tgcagttctctgcgtatttatcccatacatacctgctcttgcagtctgtgtttcactgcantcgaaagcaaaagggacacactgaagggacacagggctttaccaggatccttctgttgct

SEQ ID NO: 232 - DNA, 121 bp, Artificial Sequence
  Synthesized
  misc_feature (61): n=a or c
ataatagttcttaatgtccttgcttaatgccctgtctctgtaacctgtatcttcataaacnaagacctgcagaaaagccatcaggaaaagactgcagggaggttcaagtgtgcctttacag

SEQ ID NO: 233 - DNA, 121 bp, Artificial Sequence
  Synthesized
  misc_feature (61): n=t or c
caaagcaaaaatgttgagaacaaatgtgaaagctcagtgaattcggaccaggtaagcctgngttcatgcagctgcttggttggtgctctagtgttagcaatcttttgcccaaatttactct

SEQ ID NO: 234 - DNA, 121 bp, Artificial Sequence
  Synthesized
  misc_feature (61): n=t or c
agcaggctgtgttaatctgccttgggtttctcagtccctgcgcagtgctgatgctgttctnggccactctgctcttctgtgtttgtggaaggcagtcatgatctcagggctgtggagctat

SEQ ID NO: 235 - DNA, 121 bp, Artificial Sequence
  Synthesized
  misc_feature (61): n=t or c
tttcctgctttctttccatgtaaatgggaagacacaccaagtaatgcattactatagttcngacatctctcatgcttatacagctgccccgtcttcgcattccaggacatacaaagggcct

SEQ ID NO: 236 - DNA, 121 bp, Artificial Sequence
  Synthesized
  misc_feature (61): n=t or c
agttgtacagggatacaattgccaatctttttcctaaaggccatacaatgtttccacaaancagttgtctcatcagtaaagaagcagtccaggcaggaccgtgggttttgagtttttggag

SEQ ID NO: 237 - DNA, 121 bp, Artificial Sequence
  Synthesized
  misc_feature (61): n=t or c
atttaacaacacccagttggcctccagtccctatcagaaccactcttgtacctaattcacnccatccctcaccatttttctcccccttctccttccccttcatgaaaaacgtctggtaaaa

SEQ ID NO: 238 - DNA, 121 bp, Artificial Sequence
  Synthesized
  misc_feature (61): n=a or t
caaggagtaaagaggttatttctctcagtgggcagattggccttggagatgactgcaagantatttccttacctgttccatcttcaaaaaatcactgagtattgcataaaccggaagtaag

SEQ ID NO: 239 - DNA, 121 bp, Artificial Sequence
  Synthesized
  misc_feature (61): n=a or g
attttactgcactttaatctcgggtcttaagctttcgagttttcatgggaagacccctatntctggagcttcatttatttcacaacttaaatgataataatgctaaatgaattgcttgtcg

SEQ ID NO: 240 - DNA, 121 bp, Artificial Sequence
  Synthesized
  misc_feature (61): n=t or c
gctttgcaatattattcaacagtatttgattatatagtattttgtgaatcatttatactangctttctagtggtttcctcatctctcttcctaggggttatattcactgctggtaatgcac

SEQ ID NO: 241 - DNA, 121 bp, Artificial Sequence
  Synthesized
  misc_feature (61): n=t or c
agaaaaacagtgtggcagtctcctctctgctgcatcaccagagctgacccatgttgctctnctgctggtgaccggcacaaacatttcatttctaagcagagagagtgtgcttcaccttgca

SEQ ID NO: 242 - DNA, 121 bp, Artificial Sequence
  Synthesized
  misc_feature (61): n=a or t
aaacaatcggataattacttgggacaagattatgtatttcagacttaattcacttatctcncagctttagttgttcttaaggtgcatactcgattgagatcagctcaggtaactgccaatc

SEQ ID NO: 243 - DNA, 121 bp, Artificial Sequence
  Synthesized
  misc_feature (61): n=a or g
cattctgttctgcttttcttatttgtatagtgttaccaaggcacatatgagacacgtttcnaagtacagatatcagctcatttacagctaattataataggcaagtggtgcagtaaatgga

SEQ ID NO: 244 - DNA, 121 bp, Artificial Sequence
  Synthesized
  misc_feature (61): n=a or g
agcccttaacaaatgactcccaaggaatttaaatggctaacgctgactgaccaataaagcnatgcataaactccgtgagcaggtcgcacggctcgtgccattaggaagaagggctgctctg

SEQ ID NO: 245 - DNA, 121 bp, Artificial Sequence
  Synthesized
  misc_feature (61): n=a or g
attctgacctggtgcaaagaagaagagaataaggttctcctccttttacctcccagaagtngagttatatatgagactatttgtctgagcatatattgtcttgctgacagaactggctgac

SEQ ID NO: 246 - DNA, 121 bp, Artificial Sequence
  Synthesized
  misc_feature (61): n=t or c
tttctttccattgtagcattttaagcctttgctgagcagcagaggggccttgaaattttgntgtgaagatttttatttcagctttttctcctgcctgatccccaaacaaggtgatactcat

SEQ ID NO: 247 - DNA, 121 bp, Artificial Sequence
  Synthesized
  misc_feature (61): n=t or c
tagccaagcctgtagtttgctttatgctatgagggcaatgttggctgacattcaaccacanatccaccacaacccttcaatcttttcagcaaagccgctcctcagccagtcccttcccagc

SEQ ID NO: 248 - DNA, 121 bp, Artificial Sequence
  Synthesized
  misc_feature (61): n=a or g
aggcttcagctggtttataggaatcccttgagacagagaactgaagagtctagtacagctntttgattctcaaggatcacttcctacaagcttaagaacagtccagtccaacatgcagaaa

SEQ ID NO: 249 - DNA, 121 bp, Artificial Sequence
  Synthesized
  misc_feature (61): n=a or c
tgaagctcacctcactccctctcttggtgcaatgagagcgttcaccagcccaaggaggccngtgaagaccaagaaaactagaatatttccccatgctgggtgaggaacatctctgtcagct

SEQ ID NO: 250 - DNA, 121 bp, Artificial Sequence
  Synthesized
  misc_feature (61): n=t or c
ctcacacgtcattttagttaccgtgttgtgttcttgggacaggagtgaaaagtgagttggnaatttcagattctcttgttgagggtggaatgggttgcagtgaacttgacaaaagtttaag

SEQ ID NO: 251 - DNA, 121 bp, Artificial Sequence
  Synthesized
  misc_feature (61): n=a or g
tggcctctccctggtattcatgttaactttcccatctcaattagaaagtttgacaccagcntctgctacccacactgcttgtacacctacatgacttccagaaatgctgctggctcttctt

SEQ ID NO: 252 - DNA, 121 bp, Artificial Sequence
  Synthesized
  misc_feature (61): n=t or c
gccatcattgcatacagtttcttctcaaaaaaggtcagctctattccatttatccacatgnaattcttttggaggtcatttccatccactaaataccataagaatattttacagtgctgag

SEQ ID NO: 253 - DNA, 121 bp, Artificial Sequence
  Synthesized
  misc_feature (61): n=a or c
cgggcggagatttgggattagcatctccccctctcatctctcacactcctgccacagtccnaaacctactgcctctcagtttctaaagcaacaccccactttttattgtggctgaaaaaaa

SEQ ID NO: 254 - DNA, 121 bp, Artificial Sequence
  Synthesized
  misc_feature (61): n=t or c
tcgtacaccatgaaggcaccacatctctctcaccctgggtatgacactttggcaaaccacngagcaggtttgtttcaaatatggactcagcttttgccatagcttcctgagatttcggagt

SEQ ID NO: 255 - DNA, 121 bp, Artificial Sequence
  Synthesized
  misc_feature (61): n=a or g
cagtagcattagtttctactcatttttgatgctacttggatgaatgtggtagagaagtatntgagctgtgccgagaggtgagagactcaggaaggagatacttctgggaagagaagacagg

SEQ ID NO: 256 - DNA, 121 bp, Artificial Sequence
  Synthesized
  misc_feature (61): n=c or g
tatagaaaatacagttttaagacatacaatcttgcaaagtgcaacagagctttccatcctnattacttgctgcaaaaataaagccatcagagtctttactctttaccaggcttgtcttttc

SEQ ID NO: 257 - DNA, 121 bp, Artificial Sequence
  Synthesized
  misc_feature (61): n=a or g
aagctaaatgtgcttgtataagtagcatagcttatgcaggcaggagatgcaaagctcttcntagaaatcaggttcacactgactttctgaaaatgatactggtcgttagcagcatggtcca

SEQ ID NO: 258 - DNA, 121 bp, Artificial Sequence
  Synthesized
  misc_feature (61): n=a or c
atagaaagtgaggctgaaggagttagctgagagctggaggagggaattaggagaggaagtnatgagcgatcagatcagagatggctatagaggacttggaaagaaatgtaaatggaactgg

SEQ ID NO: 259 - DNA, 121 bp, Artificial Sequence
  Synthesized
  misc_feature (61): n=a or g
aatatggtgagagtattatcagcaaactctgacagagcataatttaccttcaacacagatnagtcaatgcattaagacatacaattcccagcatgttcttgtgagactccataagtgatct

SEQ ID NO: 260 - DNA, 121 bp, Artificial Sequence
  Synthesized
  misc_feature (61): n=a or t
gttgtctggaatctgtaccaactttaaaattattgcctctggacatcttgctcgttgtgcntgtatcaccttcatggtacgtcggatgtttcctgcaggtgagttaacgtgatgttttgat

SEQ ID NO: 261 - DNA, 121 bp, Artificial Sequence
  Synthesized
  misc_feature (61): n=t or c
ctgtaaaatttgggactaaggtgtggagctatttatgccttgattaatattgattcccacngaagtttccttttactgcagcatgtgctaagatgaaacacatcaaaataatagggaattc

SEQ ID NO: 262 - DNA, 121 bp, Artificial Sequence
  Synthesized
  misc_feature (61): n=t or c
actccaaatgctcccgggaacaactctcttataaataattgagagctgggagtatgtattncagtttaaacactgaagtatagcactttacccatcacatgccttagcatatagaagttct

SEQ ID NO: 263 - DNA, 121 bp, Artificial Sequence
  Synthesized
  misc_feature (61): n=t or c
tgtcgtgaagatcagtccctgacaaaggctttaggactttgtttctgtgagctgtgctctnccttttcttgccacttgctcggctactttaagcatgtgaaaagctcaggtgcattaaggg

SEQ ID NO: 264 - DNA, 121 bp, Artificial Sequence
  Synthesized
  misc_feature (61): n=t or c
actgcaaccttcagatcaaccttctccaatgggggcacttttctggtacctgttggctaanttccagtcaggcgtgaagaatgagtggcctattgcttgtgatagattaaattgcactttg

SEQ ID NO: 265 - DNA, 121 bp, Artificial Sequence
  Synthesized
  misc_feature (61): n=t or c
tattaacacatttatttgaaggaaatatgcatattttaacctgtctggcagcaattagagnaaataaagcaattaaaggtgccactggaacgggaggtggtacttctccctttctgtggtg

SEQ ID NO: 266 - DNA, 121 bp, Artificial Sequence
  Synthesized
  misc_feature (61): n=a or c
caaaaaatatggccctctgggttcttaaacacactcaaaatgaaatccgtctaggctgtgnaataggaaaactgatgcctgcaatgaatccagagcaaggatgataaagcgataactttta

SEQ ID NO: 267 - DNA, 121 bp, Artificial Sequence
  Synthesized
  misc_feature (61): n=a or g
tgcttaagtggttggcttacatgtgttgtagaaaaggacaatatgtacaaatttcatagcncagttaattctagaaggtctaacgcccaaagagatacaaatcaaaaagcatgaatctgtc

SEQ ID NO: 268 - DNA, 121 bp, Artificial Sequence
  Synthesized
  misc_feature (61): n=t or c
aattttacaaatgcacagtgacatcttacagaaaagcacttaaaacaaacgtttgttcatncactagccttaagccaccagctgaggttcacatcacagacgtaacattagcaaaagagtg

SEQ ID NO: 269 - DNA, 121 bp, Artificial Sequence
  Synthesized
  misc_feature (61): n=t or c
caagcaatgactgagatgacatggaatgacagcagagacttgtttcgtgtcaataatcatncatgtttattcagagaagttgccactgcttccatgtaattccttttaataatttttactt

SEQ ID NO: 270 - DNA, 121 bp, Artificial Sequence
  Synthesized
  misc_feature (61): n=a or g
tagttacagttataaagggagcacacttcttgaccttgatctatttagagatcttcatacntcctcggctacagattagtctgaattacttttccaactagcttctattgaaaaaaataaa

SEQ ID NO: 271 - DNA, 121 bp, Artificial Sequence
  Synthesized
  misc_feature (61): n=a or g
aaatggaaatggctacacctcattttcagtaaccaagaggatgaactctaaacatttgcantattacagaaaacccacagagcagataacgggtaccagcagccaggagtgaagtggaaga

SEQ ID NO: 272 - DNA, 121 bp, Artificial Sequence
  Synthesized
  misc_feature (61): n=a or g
gtcagactgctctctgctctaaggacaaatgtctgcaccctgcttaaacagaggccttgcnctggccctctgctctccatgttccactgggaactcttcatccttcagaaagaaaacaacc

SEQ ID NO: 273 - DNA, 121 bp, Artificial Sequence
  Synthesized
  misc_feature (61): n=a or g
tctactattacttaatcagtaattcttatttaaagacttgtcctggcttctctctcaggcncatggctcaagcttgtctttgtgttctgttttactaaggaaatgagcttctgtgcgcatc

SEQ ID NO: 274 - DNA, 121 bp, Artificial Sequence
  Synthesized
  misc_feature (61): n=a or g
ccaatagatgttaaattcattgaatgggtttcacaggagctgagagtgcactggaaggatntatggctgtcaggtgaaccagcagatacccaatgcagtaccaaagcaatgtgcaaaacca

SEQ ID NO: 275 - DNA, 121 bp, Artificial Sequence
  Synthesized
  misc_feature (61): n=t or c
taccatggcttgttcctcttctgaagtcacagagccagcctacgagaaagaggggagcganggggtgggcagtgtttagcttcaatttgagtctgtctggtcctgggtcgtttgtcagtgt

SEQ ID NO: 276 - DNA, 121 bp, Artificial Sequence
  Synthesized
  misc_feature (61): n=a or c
ccgcatctcagatacccagcattataataacatacagcaacgtacaaggagtagagctgcnttcaggatacagtgctggcttcctgcacccaaagaacaaaagccacaaacagaacaagag

SEQ ID NO: 277 - DNA, 121 bp, Artificial Sequence
  Synthesized
  misc_feature (61): n=t or c
agattggaatacagcagatttaaatatattttccaaactgctgcagctgaagcagaagacncactttttgatagcacacacaatggaaagaagtgccatcataacagcacggttggcatga

SEQ ID NO: 278 - DNA, 121 bp, Artificial Sequence
  Synthesized
  misc_feature (61): n=t or g
cgtgctatgttttaattaacaagaattaattgaggctggttagacagaaatagcgtaggtngcatgtatttgaaggttagagtagagattcacatgtatttacaaataactctaagataat

SEQ ID NO: 279 - DNA, 121 bp, Artificial Sequence
  Synthesized
  misc_feature (61): n=t or g
ttttttcatattacttcaggattatccgtgttagcaactttaaacattctgaaaacccacngcagatgaatctgcattttcattttataaccttctattggtaaaaagaattcaaacctca

SEQ ID NO: 280 - DNA, 121 bp, Artificial Sequence
  Synthesized
  misc_feature (61): n=t or c
aaaccaacaacaaaaaaaccccacataaatattagaggaaaaattcatggtataaatgaangcactaagtttctcctagcaatggccatgccaattggcagcaggtaatgactgtcagcac

SEQ ID NO: 281 - DNA, 121 bp, Artificial Sequence
  Synthesized
  misc_feature (61): n=t or c
tattgactttaaaaatattggaatatttagagcattaacaaactctttaaaagatgtctantaacagcagagccacagtttgaaatggccatcacagaatgttcttcagatcacattaaag

SEQ ID NO: 282 - DNA, 121 bp, Artificial Sequence
  Synthesized
  misc_feature (61): n=t or c
tccttagatttcatgaattccttgatcaagattaataggattgattttttttgtcataccnctaatcagttcagcatcatcacattgattcattgaccaacacatcccttttcaacagtat

SEQ ID NO: 283 - DNA, 121 bp, Artificial Sequence
  Synthesized
  misc_feature (61): n=t or c
aactaatacacccttttctgtgttcagttttgaagtacagattttattacattgactgctnttgatttgcaagtaaaaacaaacaggattttcgttgttgaatccaggttgtcacattcaa

SEQ ID NO: 284 - DNA, 121 bp, Artificial Sequence
  Synthesized
  misc_feature (61): n=a or c
ctagggtttagaaagaagatgagcaaaaatgaagtagaaaacatcattatgatgatgcttntgcatcttgaatattgtatttagctctggcaccatcttcacaggggtatatatgaatcag

SEQ ID NO: 285 - DNA, 121 bp, Artificial Sequence
  Synthesized
  misc_feature (61): n=t or c
cggcagtttcggtggagttggtggcagaatggttgcaggaagataatacaaaaacttgttncacacctgtaagagagcagcagctggtcatcaccaaagcacctctctttctttttcttca

SEQ ID NO: 286 - DNA, 121 bp, Artificial Sequence
  Synthesized
  misc_feature (61): n=c or g
tattttagtattaatgtgtaggtaaaaagctcaagattagccttgtcttttaatgcgtttnccatagccgctcctcctcaatttcaaccccatatatgtttatttaagaaatggatatctt

SEQ ID NO: 287 - DNA, 121 bp, Artificial Sequence
  Synthesized
  misc_feature (61): n=a or g
tccctcaggccacagaagatctttttgcagtacgtctgattattgtgcagactgagtaaantaaagcattgtagcagtacctgtgacagagcgagctgcaagtacttgtttccctggtgcg

SEQ ID NO: 288 - DNA, 121 bp, Artificial Sequence
  Synthesized
  misc_feature (61): n=a or c
attcttgtgcttacctgattggagcatacaaaaaactttcaagaagcccttttgctagttntttaacctctaaacatctggtaggaaaggactacattccttcacgttagttctcttctac

SEQ ID NO: 289 - DNA, 121 bp, Artificial Sequence
  Synthesized
  misc_feature (61): n=a or g
gttcatttgcttaatttttcatcccatttcatgccattcccttttggaaaacagcaagggnaagacaagtgtaggtggccatatgttgcctgtgcacgagactgcagctctggtggggagt

SEQ ID NO: 290 - DNA, 121 bp, Artificial Sequence
  Synthesized
  misc_feature (61): n=t or c
ccagcagaggggtctgttagcaaatgccatctgacccgcctgcacaccagagctcaggctncatgaacaattcgtactgttcatgtctgacctctgcagacgtgaacagtatggattttct

SEQ ID NO: 291 - DNA, 121 bp, Artificial Sequence
  Synthesized
  misc_feature (61): n=t or c
ctccagaaaacccttttactgactgaggcaatttgagatgacagaacatcacaatatttangttgcaagcaccttgattatttgttgttttcttttctttcaaaatgcgccagtttagcaa

SEQ ID NO: 292 - DNA, 121 bp, Artificial Sequence
  Synthesized
  misc_feature (61): n=a or c
agccagtagagtattatggtaataatataatccatgaaaaagacaatatgaaatagatgcntgaaaccgttgtgagcaaagaccatttgaatctttcttcgatcatgctaaaaattgattg

SEQ ID NO: 293 - DNA, 121 bp, Artificial Sequence
  Synthesized
  misc_feature (61): n=a or g
tggccaatccttagtactcaggttcctttttggaaggagtcagtatgtcttcctggctccntacaggtatttatttcttttccttctccagaaaatctggaagaatcatagaatcgttaag

SEQ ID NO: 294 - DNA, 121 bp, Artificial Sequence
  Synthesized
  misc_feature (61): n=t or c
aagaaacctaataacacaagctctctgaaacagaacaccttttcatacttccaaacaagtntttttccatctctgaactctgggcttcatcacaaaacgtttagcatgaatcaggatgtaa

SEQ ID NO: 295 - DNA, 121 bp, Artificial Sequence
  Synthesized
  misc_feature (61): n=t or c
gtcccacggtgtggaattgtaagtgcaagtgtcctgctgtgtaaatggctttctgcatagnttcatgctgatctgtctgcttgactaagctgtatgggaagttggtggtacgagctactct

SEQ ID NO: 296 - DNA, 121 bp, Artificial Sequence
  Synthesized
  misc_feature (61): n=a or c
gagaagcagatcatgcagagcgctcactcagacttcatcgtgaggtaatgtccatctgtcnatgctggagcacagcacagccagccacagcagctgattaaactccataggaataacccgt

SEQ ID NO: 297 - DNA, 121 bp, Artificial Sequence
  Synthesized
  misc_feature (61): n=a or g
ttgggcagcaacttttttgttgtctgcattatggcagtcagtggccttacgctttccacancatcattcctctgttcaaaccaatgcacgggatggctttcttggtagcacccaatgtaga

SEQ ID NO: 298 - DNA, 121 bp, Artificial Sequence
  Synthesized
  misc_feature (61): n=t or c
ttcagctgcacggattcctgtcgaagttaacagaaatgttggtggcagaagatggctgaantgaacccattctttgtatcttcagtaaaatttgtaaaaaccgggtatgctgcaaatctta

SEQ ID NO: 299 - DNA, 121 bp, Artificial Sequence
  Synthesized
  misc_feature (61): n=a or g
aggaggcagtctgggtacacagtctgaattcaggcccttggcatacctgcaaatgaaaatncaaatctgacagtggtcacagttcctggattctggcctcagcttcaccatgtaccagact

SEQ ID NO: 300 - DNA, 121 bp, Artificial Sequence
  Synthesized
  misc_feature (61): n=t or g
agaaatacagctgcacctgagagcaagttttctcttctgaaattgcctgtcccaaagcttntgcctcagtgcagcatgtttgtgtaggctacacagctttgcagttgagcacagaatataa

SEQ ID NO: 301 - DNA, 121 bp, Artificial Sequence
  Synthesized
  misc_feature (61): n=a or g
aaggtcttagaggtgtaggatctgctgcttttgattcttttcaaatagaagtaggaacacnaatgcctttacgtgtgctacaaaccagcagaagaggcagaaacaccagatctgcaaaagg

SEQ ID NO: 302 - DNA, 121 bp, Artificial Sequence
  Synthesized
  misc_feature (61): n=t or c
gttagccatctgattgttgttatacacaaagtgtgatactgtcatgagccttctgaaaagntgaccattatgtttatttgcataacgtgttctgaagatactaaacgtaccttgagaaaag

SEQ ID NO: 303 - DNA, 121 bp, Artificial Sequence
  Synthesized
  misc_feature (61): n=t or c
acaaagcatagaactgtagctgaaatgagtaacccagttcagccaggacaaaccagtaaangctaccacaaaatgcctctaagattttattattaataaaagcacatacaagcaagaagag

SEQ ID NO: 304 - DNA, 121 bp, Artificial Sequence
  Synthesized
  misc_feature (61): n=a or g
aattaacgaggaagctcatattcttaataacagagaattgatatcaagtatttagcagtangttacaaaggtaaatttcctttgctgcaatgctaaatctatttcagttgttactattaaa

SEQ ID NO: 305 - DNA, 121 bp, Artificial Sequence
  Synthesized
  misc_feature (61): n=a or c
agtcgtgcaagtgaaacaaagagctcctaagattctcagccataatcaagccataccccanatcaggtgattatttctctactgcagatacacagggacaagtgaattctccaatatctgg

SEQ ID NO: 306 - DNA, 121 bp, Artificial Sequence
  Synthesized
  misc_feature (61): n=a or g
cataacaaggaaggcttgaggaggcttggtgtcaccaactgctgcacattgcatggggaancaaagcggactgaatgttctgtgggcaggaaagtcatcattacagaatatctgcagagga

SEQ ID NO: 307 - DNA, 121 bp, Artificial Sequence
  Synthesized
  misc_feature (61): n=a or g
ttcagtctttggatggaagattcaactgcattaacctgtatgatgatgtgcgaatcatccnatttttaagctatccttcagcagtgtggtacacacacacacacactcacagaggagactt

SEQ ID NO: 308 - DNA, 121 bp, Artificial Sequence
  Synthesized
  misc_feature (61): n=a or g
ctgtggctctgcagggagattgcagagaaccttgccctgtgcttcagcattcccattcctngtgctgataacagggctgacccctgaagaaagccaaatcactgacgagcagtaatggaga

SEQ ID NO: 309 - DNA, 121 bp, Artificial Sequence
  Synthesized
  misc_feature (61): n=t or g
aaaggaagatgcaaaggcaaaataccaacagattatgttttgaaaactataatgaatattncttgcaggcaattggaacccacaagaggtaccacgtagatgatgaggttatcttatgaag

SEQ ID NO: 310 - DNA, 121 bp, Artificial Sequence
  Synthesized
  misc_feature (61): n=t or c
tataccaacacacacagttacacttcaacaattcctgaggaagatattttcctggataaantcctaattaaatacaatttgatctattttcatttaccaatttatagcaagtaaggctgtg

SEQ ID NO: 311 - DNA, 121 bp, Artificial Sequence
  Synthesized
  misc_feature (61): n=t or c
cctcatcttaatcttccactgaacacaggccagagatcatttcaactcagctgcatcttanaaatgattccagagagccttagctgacacaacagaaatcacagcgatgctcaagaacaca

SEQ ID NO: 312 - DNA, 121 bp, Artificial Sequence
  Synthesized
  misc_feature (61): n=a or g
catattatgtgttgcgattattctgactttaaaattgaaatttctgatagctttaacagcntgtaatgctttcttcatatgtctagaatatgacgcaggtatttatttttaattcttttcc

SEQ ID NO: 313 - DNA, 121 bp, Artificial Sequence
  Synthesized
  misc_feature (61): n=t or c
tctaggaaatcgttgtatttcagccatagctccaggggctctacctgcccaccagcactangctagttccagtcagcaagttggaagtcacaggtttgacagacaaccatacaaggagatg

SEQ ID NO: 314 - DNA, 121 bp, Artificial Sequence
  Synthesized
  misc_feature (61): n=t or c
agagctgggactttttagcctagagaagaggggagttctcaggggaagacctcatcaatanacataaatacctgagggaatagtgcaaagaggacacagctattctttattcattggtgcc

SEQ ID NO: 315 - DNA, 121 bp, Artificial Sequence
  Synthesized
  misc_feature (61): n=t or g
ttctacctcaaggtaaagcccaggcccacagctaaaaccaacagctttagtgctaggaacntagcctgtaagtgcattttttagcactatttaaactgtgaggagacatttacaatgattg

SEQ ID NO: 316 - DNA, 121 bp, Artificial Sequence
  Synthesized
  misc_feature (61): n=a or g
tcttgctagtagggcagatgcctgcgtaaagccccatttgagataatgggattctgtgtcngttgatgaacctgcatttgtacatcaatatcatgagattggagtctgacacttctccttg

SEQ ID NO: 317 - DNA, 121 bp, Artificial Sequence
  Synthesized
  misc_feature (61): n=a or g
tttctcagttgtgcatcaggatttcaaaacaaaaacctgatagtatcttttaacattttcnagcactttttcttcaagctccaccgaagaatactaagcaattactattgaataaatgcaa

SEQ ID NO: 318 - DNA, 121 bp, Artificial Sequence
  Synthesized
  misc_feature (61): n=a or g
agagaatgtcttgtcttcacctggttgttcttatactctcaaaaaacttttaaggatgacnagatgaaaataagctagagaaataataaaaggaggctgcaatctcatattttgtcttcat

SEQ ID NO: 319 - DNA, 121 bp, Artificial Sequence
  Synthesized
  misc_feature (61): n=t or c
tggaggctgacttttatgatctgctttcttctggatcttcctcttcttcctgcagtctgcngtgctaggtgcagttactcacagatatctgctgtgattggctgttgacttctgtttagca

SEQ ID NO: 320 - DNA, 121 bp, Artificial Sequence
  Synthesized
  misc_feature (61): n=a or g
acttgtcaatagcttgtccgtcataaatctcacatctcccaaaccctgtctgctcataccngaatcagttcgcagacttctaaaaatgctattcagacctcagcttcatgtggcttcagtt

SEQ ID NO: 321 - DNA, 121 bp, Artificial Sequence
  Synthesized
  misc_feature (61): n=a or g
ctgccctcggaaatacttaccttgcttaacagtgtctgtttagaaacatccaagaatgtgngtttggagatgtgtaataacttcttggtgctgggtcaggtgtacaccctaaaggcaacat

SEQ ID NO: 322 - DNA, 121 bp, Artificial Sequence
  Synthesized
  misc_feature (61): n=t or c
tctacagcaaacatggcactcaggtggccccaaacactggggatgagagaacggctcaggntgaaggacctcagaaccttgggctgccaaccaccagggtgtgcttccagttgtcttccat

SEQ ID NO: 323 - DNA, 121 bp, Artificial Sequence
  Synthesized
  misc_feature (61): n=c or g
gtcccacttctgggagacaacctgatgttctctcctccctccagtgtcaacaatggctttnagcccaataatgccacccataacaccaaggaaacctcagttgtcattaatacaccattaa

SEQ ID NO: 324 - DNA, 121 bp, Artificial Sequence
  Synthesized
  misc_feature (61): n=c or g
cttgatgctgagttctcagcagtgaatctccagaattatcacagcagagacttctctgttncatcctacagctgaatgggtgatgtaaggggggaaggtttgataataataataggcagca

SEQ ID NO: 325 - DNA, 121 bp, Artificial Sequence
  Synthesized
  misc_feature (61): n=t or c
gttaggccttgtgaatctgggttgaaatgagtgaccagagctccgtgttgagtgctctgtntgggggcagtgttttggcagatatggagaaggtgatctaattcatctgatggtaatgtgc

SEQ ID NO: 326 - DNA, 121 bp, Artificial Sequence
  Synthesized
  misc_feature (61): n=a or g
aaacatttccgttttactaacagaaacacaagagtggtccaacagtgcaatttcattaacncccactgaccagaatgaggggttttggagattctcattccttgtgctgacccttacttaa

SEQ ID NO: 327 - DNA, 121 bp, Artificial Sequence
  Synthesized
  misc_feature (61): n=a or g
aataagactgggctcacacatcccatactggaagatgtggttgctgatacacctgcacagnataatcgaggtcatcctgtcccctttctggaagctacggccttccctaaacttccctttg

SEQ ID NO: 328 - DNA, 121 bp, Artificial Sequence
  Synthesized
  misc_feature (61): n=a or g
agaaaacatttaaaaaccacatttttttctgctctcagtatcctgacacccagaaacttcngaggcagctacactacaaggacagtgccaatcaatacagtcaaactccaggttattcatt

SEQ ID NO: 329 - DNA, 121 bp, Artificial Sequence
  Synthesized
  misc_feature (61): n=c or g
ccagttcctacagtaggttgcaagccttagtggcaactctgtgaggtcagagcacaatganaaatgcagcaacttgcattggcgatgcaatcaccactgaaggctggtgatggaaacccca

SEQ ID NO: 330 - DNA, 121 bp, Artificial Sequence
  Synthesized
  misc_feature (61): n=c or g
tgctggttcagcttgtgtgaattgaaagatccgttttatcttctgatgtgcaaagaaaaantcgactgttgctaggtttttgtcttacattttccagaagcacacagaaatctgtgatact

SEQ ID NO: 331 - DNA, 121 bp, Artificial Sequence
  Synthesized
  misc_feature (61): n=t or g
actagttttaagatttaccattgcagcacaatactcctgtttgccttgggcttatagctcnctctgtatatttctatttcctaaaggtcacctcttcacatcctttctttatgaaccataa

SEQ ID NO: 332 - DNA, 121 bp, Artificial Sequence
  Synthesized
  misc_feature (61): n=a or g
aagaagtgactgaaaatttaaatctcttccagcctctcaggtacatttgtgtccagcatanatgaaagcttgtgagaaaggttctcatttgcataatccaaactactttgcctttccccac

SEQ ID NO: 333 - DNA, 121 bp, Artificial Sequence
  Synthesized
  misc_feature (61): n=a or g
ccgtaatttgaatcaatgtagagttcacatctggaggtgcataagcaccttatttgtatcnctcacatagaactcaaagcagagctttagttattctattaagatttaagagctcacttaa

SEQ ID NO: 334 - DNA, 121 bp, Artificial Sequence
  Synthesized
  misc_feature (61): n=a or g
tgcagactgctctgaactcaggatgctgaaggctcagagctgggaatcacagccagccacntccccatggctcagtgcctccactgcatttgcagtatgattttgcaaactcaaaggaact

SEQ ID NO: 335 - DNA, 121 bp, Artificial Sequence
  Synthesized
  misc_feature (61): n=t or c
agaacccttttagtttttaaaccgagcccggattttgccacgatgctccggatttacgctntcagatttttactcttcgaagtggcgttcagaaaaataacgctcccaatccgttgtgcgt

SEQ ID NO: 336 - DNA, 121 bp, Artificial Sequence
  Synthesized
  misc_feature (61): n=a or t
accaccaattgcttatgattgccaaaggcttctcctgcacttcagatacaggttattgtanactaatggagagcaaatgctcctaagtcaaaatgtcgtgtcttcatcttgcaacaaaaat

SEQ ID NO: 337 - DNA, 121 bp, Artificial Sequence
  Synthesized
  misc_feature (61): n=a or g
aaggacctggacttgctatttttaaagttgcttttcattcttgctactaggtaggtcgtgnctttctctcaccatgtgtttcccataaaagccctggctgccttgagtgctgtgtgatagg

SEQ ID NO: 338 - DNA, 121 bp, Artificial Sequence
  Synthesized
  misc_feature (61): n=c or g
atgtcacctttataattatttcagtcaattaggacttcaaataaaacaccaaacaagatantaatagcggcaccatgcaggatgtcaacatggataaacagaatgtcttttattgttttaa

SEQ ID NO: 339 - DNA, 121 bp, Artificial Sequence
  Synthesized
  misc_feature (61): n=c or g
aaacgcaaagtgatccgtgtaggattcaagagattgtaaaaaacagtgaaagaaggacaangggtggatcattgcttaatacaaagtagaatgcttgtgtttagggctgagaatggtgaga

SEQ ID NO: 340 - DNA, 121 bp, Artificial Sequence
  Synthesized
  misc_feature (61): n=a or g
atcacaactattcttcatagagacagaacatacctgtgtttttttcaagcagaatatctangtagttagatagaacagaaaacatgaccacattatggttattactgcatacattctcagg

SEQ ID NO: 341 - DNA, 121 bp, Artificial Sequence
  Synthesized
  misc_feature (61): n=a or g
tctataaagaaaaaaataataataaagaggacaggctcagattattcctggatgctacacnagacttctttcctcagcctaatggcagtcttggaggtttagttttggctgtttctacact

SEQ ID NO: 342 - DNA, 121 bp, Artificial Sequence
  Synthesized
  misc_feature (61): n=t or c
tgctacattaacagtaccctctggctgatttgggaatgtgcatgggtgactgtatgtgctngtttatatatagtgaaaaatgacatctcagagagaaatggagtggaaatcccttaactag

SEQ ID NO: 343 - DNA, 121 bp, Artificial Sequence
  Synthesized
  misc_feature (61): n=t or c
tctagtaggttaaatcagcactccaaagatttatttttcatcatttgaactgaaggcgtgnagccaaatacagttgaaaagggaaggtttacaacctaacttagttaatggatataagtct

SEQ ID NO: 344 - DNA, 121 bp, Artificial Sequence
  Synthesized
  misc_feature (61): n=a or g
catgggaaccctgccgagccgtccccggagcccaggcagcggtggtacaagtctgctgctnattagacctgcaagtcctcccgtgagctcagggtgcgggggtgatatttggttattcctg

SEQ ID NO: 345 - DNA, 121 bp, Artificial Sequence
  Synthesized
  misc_feature (61): n=a or c
ggagagaatcagtggaacctcattaaacaaagtgtttcagatggtcagaatatgattttgngaaacatttagagtcatgttcgtaaaaaactgcagtttaatgggcaattaaaaagcgtta

SEQ ID NO: 346 - DNA, 121 bp, Artificial Sequence
  Synthesized
  misc_feature (61): n=a or g
aaagcactccgaagagttcaagcactctagcagtgcgcataaacgaagatgccattgtacntcgcctggggactttcatcttcaaacaggcccttcagtgatgtcacacagataattcacg

SEQ ID NO: 347 - DNA, 121 bp, Artificial Sequence
  Synthesized
  misc_feature (61): n=a or g
aactgggactggtcagctaatgcacaatgttgcgtctttccaacgagcagcaagcaggtangagctcctggtgtgaaaacttgcctacggaactttaattgcaaagttcttgtgccagtaa

SEQ ID NO: 348 - DNA, 121 bp, Artificial Sequence
  Synthesized
  misc_feature (61): n=a or g
agactgacttcaaactgccatgtcactcagaaatgaatgacaccatcctccctaatgtacngtcagcacaaacaattctcaaatacctgcatttgttcctcgcatcgaggttcaagacatc

SEQ ID NO: 349 - DNA, 121 bp, Artificial Sequence
  Synthesized
  misc_feature (61): n=t or c
gttcatttgtttatcagggtacagtggtatccagagggtcttggtgaacagcaaggagatnctctgatcagtatttatccgaggagagcagtggagccactggcaggcctaaccccagatg

SEQ ID NO: 350 - DNA, 121 bp, Artificial Sequence
  Synthesized
  misc_feature (61): n=a or g
acccacgtataaaagcacacaggtgcaataggtgataggttagtctattacgttgcaaggntgcacaaccacgaaacagttaacactttcaaatgcagtcctacgaccttctgtatttact

SEQ ID NO: 351 - DNA, 121 bp, Artificial Sequence
  Synthesized
  misc_feature (61): n=t or c
gagatgtggctcacatttgcatcctgtgacatctgactgtccagcaaagtgaccgaacacngttaagagttggtatggatctctgcatgggtccaaaccatggttcaaacaccagcattaa

SEQ ID NO: 352 - DNA, 121 bp, Artificial Sequence
  Synthesized
  misc_feature (61): n=t or c
gtatgtgaggcaaatataggctacgaattttttgttgtgaatccagaaacaactgtgtttngctcccactgtgctgaaccacatctaggtctgcctgctaggtggtggtgtttcttttccc

SEQ ID NO: 353 - DNA, 121 bp, Artificial Sequence
  Synthesized
  misc_feature (61): n=t or c
gtatgcttgaagtgactatagaccatccagtctggggtcaagtcttactgctattctatcnaccccactgcaaatgctttttgtcatgcaaacttgtgttcttggtacaaaagtctgagat

SEQ ID NO: 354 - DNA, 121 bp, Artificial Sequence
  Synthesized
  misc_feature (61): n=a or g
caggatctacaaaagtctgcaactctgatccacagcctcttcatcgactaatatgcattcncagtttccttatttacatgcaactctccagaggtttggcaggctggtatttaagctaaca

SEQ ID NO: 355 - DNA, 121 bp, Artificial Sequence
  Synthesized
  misc_feature (61): n=a or g
aaacatctcccatttcactagaaacatcaagcagtgagatgaaaagctagtgagacgaaanttcagtctatttgttttctcttttggacactcttgtcttagttcccttaaaggtcagatc

SEQ ID NO: 356 - DNA, 121 bp, Artificial Sequence
  Synthesized
  misc_feature (61): n=t or c
cctcagactgaaataagtaatacagccctgatgctttttaaaatttcattgctcttcatancaagatatacactgatctctgtaatgttcagtacataatgtatgaacgcgctttccaaaa

SEQ ID NO: 357 - DNA, 121 bp, Artificial Sequence
  Synthesized
  misc_feature (61): n=t or c
ctatgaatattttctgtttgcacttctgttagaatgacacatgctaactaaatttggattntttttgttctaggtatatattaagagatgctacccagacatatgctgaaaatacaaagtg

SEQ ID NO: 358 - DNA, 121 bp, Artificial Sequence
  Synthesized
  misc_feature (61): n=a or g
atatgtgaaattgattgtgaggaaaaatttagatggagaaattagaatgaaagttggctanaactcttacagaaaagattatatgaaatgatgatttcttatacatctgaaaatataaaat

SEQ ID NO: 359 - DNA, 121 bp, Artificial Sequence
  Synthesized
  misc_feature (61): n=t or g
taaagtgtactcattgtgcgtgtttcgttcacttatttactgtagcaagtacataggaatnaatatttttggaacaagtggttgatatacagttaatactgctctggggagacctgatagc

SEQ ID NO: 360 - DNA, 121 bp, Artificial Sequence
  Synthesized
  misc_feature (61): n=a or g
gtgacagccaacccattaatttcccacatgaagataaaccacagggagaaacaagtgacangaacactggagagatgatagactatgactgcagtagctcccaagctaagcgatggggttg

SEQ ID NO: 361 - DNA, 121 bp, Artificial Sequence
  Synthesized
  misc_feature (61): n=t or c
agtggcagatctgagttaataggctcctctgagtcagggaggtgatatgcaggctcctctngtctttgcaaatcactgtactcttttgcaaaacaagaatgaagacttgaatgctgccttt

SEQ ID NO: 362 - DNA, 121 bp, Artificial Sequence
  Synthesized
  misc_feature (61): n=a or g
tcagggaaagttcccagagaagttatcagatatatttaatggtttggaacaactaacaatntagttagagcaaccattatgttacagctaaaaagcagtggatgcacagatccaattccaa

SEQ ID NO: 363 - DNA, 121 bp, Artificial Sequence
  Synthesized
  misc_feature (61): n=t or g
cttcttttacatccactgaaactcaggtaggctttgcagagagatgccactctgcgtgttntgctagatgggacaaaacacaggaaaatattgccatcaaattcatatatatatatttatt

SEQ ID NO: 364 - DNA, 121 bp, Artificial Sequence
  Synthesized
  misc_feature (61): n=t or c
tacctttgttatcctccaatatcaatacagtacaaaaaagagtaaagagcatcaaaggtgnacgttttattcatggtgtgctgtctctgctatgcatctgttgtgaaataacctttatggt

SEQ ID NO: 365 - DNA, 121 bp, Artificial Sequence
  Synthesized
  misc_feature (61): n=t or g
tcatctgtaggcactgtgctacttttctcctcctctcatgtagaggaagttcaagtccagntactcatgctattttttagtcaagcgtcaatgtgaagaactgtaccctatgaaagcaatt

SEQ ID NO: 366 - DNA, 121 bp, Artificial Sequence
  Synthesized
  misc_feature (61): n=t or g
ttctgcaggttgacgcagtcagacgtgaacataacatccttgctccttagatctttggaanttaagggattttaaaaaggccatatgaaaacacagatgccacagatctggtcccagtttt

SEQ ID NO: 367 - DNA, 121 bp, Artificial Sequence
  Synthesized
  misc_feature (61): n=a or g
acagtgttccttcatagaactctgttgaaagctgaaaatgcagtttaaatgagaaggtaangaaataatgaaggtccaaaattccagaatggaagtgcttatatgttaaacacagtgattt

SEQ ID NO: 368 - DNA, 121 bp, Artificial Sequence
  Synthesized
  misc_feature (61): n=a or g
agtttattagagaaaacagctcaaagatcatttcttagcagtttctgaaagcttatttatntattgtgcacttttttttgtaagtagatattcttattagagtcaatctcttatattatcc

SEQ ID NO: 369 - DNA, 121 bp, Artificial Sequence
  Synthesized
  misc_feature (61): n=a or c
agatgatcacagatgtagaaagataaaagcccaatgaaaagcaattaaaaatattcaaatnagatatcactacttgctaacttctaaggcacacctgtatgaaaataaaaaggggcacaag

SEQ ID NO: 370 - DNA, 121 bp, Artificial Sequence
  Synthesized
  misc_feature (61): n=a or g
ttgtaacagctttgatgaaagcaacagttgtttttgcatgtctttttggctccttcttacncagaaattattgaaatataaccagaaaaaaatgtgatgcagtatccctgatcaggcttca

SEQ ID NO: 371 - DNA, 121 bp, Artificial Sequence
  Synthesized
  misc_feature (61): n=a or g
accaaagagtaccaaagcactgaagacaaggtaacagcccaggctattagtgaaagcacangctccccaaggatgcagtgggattgtttccactgctgaatcccacacaccaggctggcca

SEQ ID NO: 372 - DNA, 121 bp, Artificial Sequence
  Synthesized
  misc_feature (61): n=a or g
tgattctctttccagcattgccagggctgatgctgaaagtctctccagccattcagccacnctcagggtaggcctggtaacacaacctctaatttctggtaactcgagctgccttcgtgtg

SEQ ID NO: 373 - DNA, 121 bp, Artificial Sequence
  Synthesized
  misc_feature (61): n=t or c
aatttcctaaatcccaaaggatgatggctgagcacttagagaaggtcttacagctataagncagtgtgccgttggtagtgcgagaggaactttgaccatgcgaaaacaaacttagagtcaa

SEQ ID NO: 374 - DNA, 121 bp, Artificial Sequence
  Synthesized
  misc_feature (61): n=a or g
atctgttcccagattgaactgtagatgtagcattctgctaataattgcactgcccattccntttccttttcgtttccaatgactttaaggtcagtccattttctctgttaccactgtgtgt

SEQ ID NO: 375 - DNA, 121 bp, Artificial Sequence
  Synthesized
  misc_feature (61): n=t or c
tgttgtcaaagttaattgagcaagaatataaactgcagcatcttagggctacggtcacttntccacagcatcctcctgaaagctctggagccaaaattctgcattatttttccaggctgca

SEQ ID NO: 376 - DNA, 121 bp, Artificial Sequence
  Synthesized
  misc_feature (61): n=t or c
atttattagaagtcagcttaactggtttttactcacagttagtaaacactctagctcttangtatgtcaattaggcatgaattttaagtgcaataggactcagggaccacaaagaggttta

SEQ ID NO: 377 - DNA, 121 bp, Artificial Sequence
  Synthesized
  misc_feature (61): n=t or c
gagatgttcttcaactgcatgaagtgccacacacaggcttcattcgacatcagctgacaangactcaggcctaaagcactagttaaaatgtcgcctggacaaaacaaaatgagcatccaga

SEQ ID NO: 378 - DNA, 121 bp, Artificial Sequence
  Synthesized
  misc_feature (61): n=a or g
agttgaaaaaaaccaaagatgaataaataagaatttggaaagtcaaaaaaggaatactgcnttgaggtgcttttctattctagcatcactgagcagatccccccttccaaatagcttagca

SEQ ID NO: 379 - DNA, 121 bp, Artificial Sequence
  Synthesized
  misc_feature (61): n=t or c
aaattacaaaaagaaaagataatcagtatagttttacattaacactgctgatatcagagtngtgaaggaatacgtaggttaagtgtcatgtggggatttcttttctttgtttctggagctc

SEQ ID NO: 380 - DNA, 121 bp, Artificial Sequence
  Synthesized
  misc_feature (61): n=a or g
agacagaggattcccagacccccctggctgacttgtctcagggaggtaaacaagaagagtntcctaatgagcatcaagttaaggtacagagacaaaacatcctcttcgttgtgtgatggga

SEQ ID NO: 381 - DNA, 121 bp, Artificial Sequence
  Synthesized
  misc_feature (61): n=t or c
gcttttctctctccatgcaactcctactcaaacatgcaaccatattctgctaccagtgccntgtcttttaacgttggttccatttagtttcattagcacacttgtgtcagtttggaaagtg

SEQ ID NO: 382 - DNA, 121 bp, Artificial Sequence
  Synthesized
  misc_feature (61): n=c or g
cacttttagcaatggctttcagtcattctctgtggaaatacagagttgcattaaatcccantaattaagcaatttcagctgtctttgagcttttggttctgcagttgccttgtgagttagg

SEQ ID NO: 383 - DNA, 121 bp, Artificial Sequence
  Synthesized
  misc_feature (61): n=a or g
tgatcattttctttctttaattccttgctgctggtttctctcctaacctccctacgtgtancaaccattctttataatcacagggaacactgaatccaagaatagatcctgttgccaaaat

SEQ ID NO: 384 - DNA, 121 bp, Artificial Sequence
  Synthesized
  misc_feature (61): n=t or c
tgagctaacagcagggctagaaacaacagctgacagcacatcacagctgcttctgtcaaanagtgcatataccaggaggtgccaaagcctcactccctccactaaacatgtctcaccacca

SEQ ID NO: 385 - DNA, 121 bp, Artificial Sequence
  Synthesized
  misc_feature (61): n=a or g
ctgtgatgagtgtcgtagaaaaatccaacaaggaattattcgcactctattcagtgcagangtttggtgctgtgcagaaaacagcctcagctcttgcacagtgtggaaaaagacttacttg

SEQ ID NO: 386 - DNA, 121 bp, Artificial Sequence
  Synthesized
  misc_feature (61): n=a or g
tatttggaaatattacacgtttccaaggagttttaattctttattccctcatgcagatacngatcagaatttcgcttttcttgtgtttgttttccagtcagtctgaatgatttttctccct

SEQ ID NO: 387 - DNA, 121 bp, Artificial Sequence
  Synthesized
  misc_feature (61): n=a or c
ggttgagtcaccaggaattggtgtttgcaaagccagtagatctaccatcacgggtcttcantgtcatgggaggcaaggagcatttcctggtggttttgaataaacaaaacactcagtgtct

SEQ ID NO: 388 - DNA, 121 bp, Artificial Sequence
  Synthesized
  misc_feature (61): n=t or c
tcagaacggctgcaacgaggtgccctcagagctatcaaacaatccttcttctaaagcactnggtctttgttgggaaatgaattgagtgtatggttgttggggatgtccacagtgtaaatag

SEQ ID NO: 389 - DNA, 121 bp, Artificial Sequence
  Synthesized
  misc_feature (61): n=c or g
tgagacacgtgttgtatgggcactcagctgagtcagcctgacattcttacacatgtggatngtgtgagtgaacctggtgagtgaactcaggtgtaacactgcacagatcaaagctgatcct

SEQ ID NO: 390 - DNA, 121 bp, Artificial Sequence
  Synthesized
  misc_feature (61): n=c or g
aagcaaagttatctctgagaccagaaagctggatgtgtagaacacgctatgtctctgctantgaagctcagggaggcaattcttggtgcaaccacagctatgtgagcagcaactgaaagcc

SEQ ID NO: 391 - DNA, 121 bp, Artificial Sequence
  Synthesized
  misc_feature (61): n=t or g
caaggaagacctagtcctaggagttcggacttcgtggcaataaaagtagtgcaaatggcanctgactgtctggagcagaattttagctgaccagtactggaatgttctttatttgaagatt

SEQ ID NO: 392 - DNA, 121 bp, Artificial Sequence
  Synthesized
  misc_feature (61): n=t or c
tcaccagtgatccttacgttgcttaaaagataagggcatgccttcaaacttctgcaagcangggggtgaattttgaacaaatcttaaagaggttgaaatttaatatttttcttcttatggc

SEQ ID NO: 393 - DNA, 121 bp, Artificial Sequence
  Synthesized
  misc_feature (61): n=t or c
gtgtcagtaaagttgaagtccagtgtgtaatccagataggtctggcattaggatgcaatgngtacctatgtacaagtcagtacagtttgtcagtgaattctattctcaaacacacttgtgc

SEQ ID NO: 394 - DNA, 121 bp, Artificial Sequence
  Synthesized
  misc_feature (61): n=t or c
acgtattagtatgttacaaatatgaaatgtctcttgaatgtaggtacagacatttcatcanaatattttcctaccgaacagtcgatatgccagatgagctgtaccatattgactgtatgct

SEQ ID NO: 395 - DNA, 121 bp, Artificial Sequence
  Synthesized
  misc_feature (61): n=t or c
gtattgtgttgcagttgtgccttcaagtgtcagccaaggctagagcctcgttgtgctaaangttgtgtaaatagaataagaatccgtatgtagataggacagtttctattctgaggaccag

SEQ ID NO: 396 - DNA, 121 bp, Artificial Sequence
  Synthesized
  misc_feature (61): n=a or g
attttattgtctgattctgtttttactggttaaagattccaccttctacttaccgtagtcntgccattgaaagggttataccattttcctgctttctatttctttgtaattaatgtgtaat

SEQ ID NO: 397 - DNA, 121 bp, Artificial Sequence
  Synthesized
  misc_feature (61): n=t or c
gcatgtaggagtaaatataagcctcatgttcagtctcttgaaactgtcccaatgtttctantgtgtaattctacacagtatttccactgtgctgaagtaatttgagtttattctccttcca

SEQ ID NO: 398 - DNA, 121 bp, Artificial Sequence
  Synthesized
  misc_feature (61): n=a or g
cgaaagaccaatttttaaatgaacctttgctacgagccagatttgcctgggcaagcagaanggacccagggaagcaccaatggactccctgcttctttctgggcgtagggagcatgcaggc

SEQ ID NO: 399 - DNA, 121 bp, Artificial Sequence
  Synthesized
  misc_feature (61): n=a or g
tcttgttcacatgtaatggttgttccatcaccacttccatgttgctacccattcaggttcntttgcacaattagctgtgctagtgcagacatacctactcaggctgctatttgggaatctc

SEQ ID NO: 400 - DNA, 121 bp, Artificial Sequence
  Synthesized
  misc_feature (61): n=t or c
tacacactctgcaacccctcggatgacaccaaagcaaggggagcagatgcaatgtgagaangtgagctcccattcaggggatccaaaccatccggaagaatgggttgagcaagacctcctg

SEQ ID NO: 401 - DNA, 121 bp, Artificial Sequence
  Synthesized
  misc_feature (61): n=t or c
gcttctcagctctacagacacactccaacagaaagggactccctacactatcatctatcangatgcagtaattgggcaggacaacacattacctccatatacaagagctgtgagctacatt

SEQ ID NO: 402 - DNA, 121 bp, Artificial Sequence
  Synthesized
  misc_feature (61): n=a or g
ctttccagggattcatgtttatagcaaagaaaactgatttttggctcaaacttgaatcccnagctggatctgatatctgctgcacaggctgtcaacagctcacaagatttatcttctctga

SEQ ID NO: 403 - DNA, 121 bp, Artificial Sequence
  Synthesized
  misc_feature (61): n=a or t
caggaaggattgtaatgttcacggtgcctttgtaatgtcagtggcgcatcatcctaaagcngatcagtttacagcttattttacttatactaactctatttttggttataaagcccacact

SEQ ID NO: 404 - DNA, 121 bp, Artificial Sequence
  Synthesized
  misc_feature (61): n=t or c
aatccattaacagtctccaataatattttccagcagataccccaacaagctattctgcatnatcctaaagatgtacgtacttctcacttgcagtccatcctaactctgaccacagagtttc

SEQ ID NO: 405 - DNA, 121 bp, Artificial Sequence
  Synthesized
  misc_feature (61): n=t or c
ttcttccccttatggtggaaggaggcatgtatatgtcctgttgctttcattttgatatacngagtctttgagaaacctgtcacagtcattttttctcactctcagagttctgtcagttttt

SEQ ID NO: 406 - DNA, 121 bp, Artificial Sequence
  Synthesized
  misc_feature (61): n=a or t
cctagatattactattatttttttcagcacttggttaaaagattttgatgtgccctacaanatcagctgcagtcagttgcagagatgaagcaagcttacttctttccagtctgtactgctg

SEQ ID NO: 407 - DNA, 121 bp, Artificial Sequence
  Synthesized
  misc_feature (61): n=t or c
acatgatcatgcagcacatgttgaacttcactgcatcacacatcatttcactgatgcctgnatcagagtaaaactcaagctctacagggctaatggatagaaatttggaggatatgccatg

SEQ ID NO: 408 - DNA, 121 bp, Artificial Sequence
  Synthesized
  misc_feature (61): n=a or g
agggataatgtaaagtttagggaaaggacacaggcaggtttattaacagaaagaaaagatnagggacaaaaagggagaagagaaaggataaagggagggatgcctaagaggaaagggagag

SEQ ID NO: 409 - DNA, 121 bp, Artificial Sequence
  Synthesized
  misc_feature (61): n=t or c
tctgccatgggaaatacagctgtaattgaagcactctggaaaagtaacaacgtctaaatgngagggtaggctggtgttcttaccaaggctgctccagagttcaaagttaatatgatttata

SEQ ID NO: 410 - DNA, 121 bp, Artificial Sequence
  Synthesized
  misc_feature (61): n=a or g
ggatctggaaataggacagaggaaaacttgttcctgtctcctgacagacatctccatctcnttgctgtgtgcttttcccacagtgacgatcactgctccttgcaatggtcctgaggctttc

SEQ ID NO: 411 - DNA, 121 bp, Artificial Sequence
  Synthesized
  misc_feature (61): n=a or g
cacttatttcaggtgctcaataccatactgtatttatatatgatataatctgctcaggacntgtacttggagatgtacttggcagtcttccttcttcccatgaaaccatcaatggcccaag

SEQ ID NO: 412 - DNA, 121 bp, Artificial Sequence
  Synthesized
  misc_feature (61): n=t or c
cagtccctcctcggacagacaggtcagtgtgtgctcaatggcatcctttggtgacaagagncctcgcctctgctcatggctctgtctcaacctccccagattatggacagcaagagcacgt

SEQ ID NO: 413 - DNA, 121 bp, Artificial Sequence
  Synthesized
  misc_feature (61): n=a or g
aatagaatgtaggaaaatttcgaagagagtgaagtatcactcatcagtttcaagattcatntgggttttctgctttggaaaagattgttctgcagaaagtgtggtagaaggctgcaagaat

SEQ ID NO: 414 - DNA, 121 bp, Artificial Sequence
  Synthesized
  misc_feature (61): n=a or t
ggctcacaaggctctcgggtatcatccagccagtgatatcattacttggaacatctttatngactttgtagacacaaaaccagctggctgcctgactgcaacagcccaagagaaagccatt

SEQ ID NO: 415 - DNA, 121 bp, Artificial Sequence
  Synthesized
  misc_feature (61): n=a or c
ccatgcaggggttttggctcacagtctgtcagaagtttctcatcatgagatcagagcctgngctgctgcacaggactgacagacagcagtacagccacactgcacccagccctgctgtgct

SEQ ID NO: 416 - DNA, 121 bp, Artificial Sequence
  Synthesized
  misc_feature (61): n=a or g
aaacgtcccacatctatcatctgctcattctcctttgtgtccccacctcagctgggaaacngagtatttaaaagtttcagcagctccatgaggtcactgcagctacagaaagctgtaaaag

SEQ ID NO: 417 - DNA, 121 bp, Artificial Sequence
  Synthesized
  misc_feature (61): n=t or c
ccatggtagctgtatggtttgttcctgagaacaggaggtaattcagtgaagctagcttctngtgacatcttaatcattcactgtgcatttgcactcatttgttgattagtataaacttttc

SEQ ID NO: 418 - DNA, 121 bp, Artificial Sequence
  Synthesized
  misc_feature (61): n=a or g
acatggcaccttcgttgagttattattttagagatgaagcgaagggtgataaaagacaacncgtgatgtttatcatacagggtggtgaaaggttatccaaaacagaagagaggtatggcta

SEQ ID NO: 419 - DNA, 121 bp, Artificial Sequence
  Synthesized
  misc_feature (61): n=t or g
ctatttggattgtgcaaatatgacaatatttgagtaaatctgtggccagcaaggatacttncatgacaaaaacctaggaaaacttggatttgtgcagccctttttatgaatcttcctactg

SEQ ID NO: 420 - DNA, 121 bp, Artificial Sequence
  Synthesized
  misc_feature (61): n=c or g
aatccttccccgctctctgttcatacagtccccactttcacgtttgggacataatgtgctnaagtgctaaacaactgatgtccatggggaggaaaggggaatcatcatcaaaagcagacag

SEQ ID NO: 421 - DNA, 121 bp, Artificial Sequence
  Synthesized
  misc_feature (61): n=a or g
ttgcagcctctttggttcatctcttgggacactccttgatacatgtttaattcagcagagnaaaagaagccttttgaacacatttctgcatctaaaggcagggcttttttcttctatcttt

SEQ ID NO: 422 - DNA, 121 bp, Artificial Sequence
  Synthesized
  misc_feature (61): n=t or c
gcagagcagtctggcagtagaggttatctcactttgttagcaggacagacaggcgcaatcngtcagatgggtacagtctgcaagtggtactggaaggttctgcctgtatgtttggattctt

SEQ ID NO: 423 - DNA, 121 bp, Artificial Sequence
  Synthesized
  misc_feature (61): n=a or c
tccgctacttctccctaattgggcttgtatttatacacacaaacataaacagcgagcgcantgaacccatgtgtcactataaatactgtctgacctctggcaaggaagagatacagtggag

SEQ ID NO: 424 - DNA, 121 bp, Artificial Sequence
  Synthesized
  misc_feature (61): n=a or g
ggaacccaccaggggagttgacttcagccccattcggagcgtgcttgggctgaatgcagcngcttcagctgcactgggagagaagtggcaggccatgatctggagagacttgtcgctggct

SEQ ID NO: 425 - DNA, 121 bp, Artificial Sequence
  Synthesized
  misc_feature (61): n=t or c
ccatttcacattgacagatttattctaagatatatcaggctgcaaggtactctgaggtcangaagtaaaggtgccatgaatcttcaaactgcttcataaaatagcccaaattagaacactg

SEQ ID NO: 426 - DNA, 121 bp, Artificial Sequence
  Synthesized
  misc_feature (61): n=a or g
agttgctgtttttgagcaaagctttgcctgcagttaagagagagcctaacagaattacctncaaatgtgatttttctcacatgcttccccaatggactgcgagctgtgggatctttgtgat

SEQ ID NO: 427 - DNA, 121 bp, Artificial Sequence
  Synthesized
  misc_feature (61): n=a or t
attttcataaacaacattatccgtgaggatacataatgcacttgcaaccctctttaaatcngtgcagtatctgaaaatgaggaggaaggacagcaaaagggaaaccagtccatgtctctct

SEQ ID NO: 428 - DNA, 121 bp, Artificial Sequence
  Synthesized
  misc_feature (61): n=a or c
ttcaagcttagatgagttccctgagaaatacccactgccaactctcctaaatcattcagcnaaattattcaatcatttctctttggactgtacagacctgctgagatccttgtttccatga

SEQ ID NO: 429 - DNA, 121 bp, Artificial Sequence
  Synthesized
  misc_feature (61): n=t or g
ggtgacaaattgaaaatgttttaaaaggcaattctttttcaccaggacttaattaaaaaangaacctaattgcttttagaagttaatgggaccaagaagtttgcaagtctagaacaggttt

SEQ ID NO: 430 - DNA, 121 bp, Artificial Sequence
  Synthesized
  misc_feature (61): n=c or g
tgtctctattgctgtttaactggaattgaagtcaaaatacagtccttagagcatccagaancaatgtgtgcactttctagggctgttttcattgcttgaaaacaaatgagtctcagaaagc

SEQ ID NO: 431 - DNA, 121 bp, Artificial Sequence
  Synthesized
  misc_feature (61): n=a or g
agctgtggtaagtacttacattggtattaaaaaggcatttgctagcatagaagtatcatcngagtacaatgcactccacccatactaatatatccatggtcagggacaatgagcttgctcc

SEQ ID NO: 432 - DNA, 121 bp, Artificial Sequence
  Synthesized
  misc_feature (61): n=a or g
cacctgcgtttttagtttctgggatatattggtgccaggtggggaaaaaagtgggagatcnagtccttgcaacaacctttgcaactggatctttacagcaagcaagagagacagcgaaaaa

SEQ ID NO: 433 - DNA, 121 bp, Artificial Sequence
  Synthesized
  misc_feature (61): n=c or g
gctcaggtgttagccaggcatgtggagtgtgctctggtttcctgctctgcacatcttaaancaagcaggagctgctcaatcccacctggaagtcattacccacccctgcaaagggcaatgg

SEQ ID NO: 434 - DNA, 121 bp, Artificial Sequence
  Synthesized
  misc_feature (61): n=t or c
gaagtgtggctataagcaggtgggggccctgagtggagcagatgttcctggcaccatcctnctcccatctcctgggtttggtttgtgtacccatccatcagctgtcctccccttcccattg

SEQ ID NO: 435 - DNA, 121 bp, Artificial Sequence
  Synthesized
  misc_feature (61): n=a or g
aggtttctgttagctttcagcagatcagagatttatgagtattttaaagggaatagaaggngagaaagcagataaattggcccatagaagaaaatgcataatgcatgtttttgtgttggag

SEQ ID NO: 436 - DNA, 121 bp, Artificial Sequence
  Synthesized
  misc_feature (61): n=a or g
cagtatgagcccataagcagtcaatgggatttcaaggatcgtgaaaaaagagcgtggctcntcttccccgtggagcctctgcttgtcctcattattccccacctcccagccctgtagccag

SEQ ID NO: 437 - DNA, 121 bp, Artificial Sequence
  Synthesized
  misc_feature (61): n=a or c
cagggtgtggtttgggtttaataaggctaagaaatggaagtcctactgctagctcatgctntgcaccttcgggaggtgagactccaccactccctttcccctatactgactgaaactgagc

SEQ ID NO: 438 - DNA, 121 bp, Artificial Sequence
  Synthesized
  misc_feature (61): n=a or g
tgagaggcagccagaggggtctgtctgtgtgtgatgtagtggctgtgtccattctaaagcnggacaggtgcgtgggaaaggactggaaagcaattcatcagtgagcagaagtgcaggctgc

SEQ ID NO: 439 - DNA, 121 bp, Artificial Sequence
  Synthesized
  misc_feature (61): n=a or g
aagatcatctagttccaaaactctccgctcctttctgctgttctgctcacagatggaaaancctttgcaaaaagccagcagccaagcacgtctttctgtttggcacacaaatgcagtttcc

SEQ ID NO: 440 - DNA, 121 bp, Artificial Sequence
  Synthesized
  misc_feature (61): n=a or t
ctacgagcacagactcccaaaggagggaaaaagaaagggaaatagagaaaaaaggacttcnattgcaccagcctttaatttcccttgtcgtttagcaggatacctcccacctcatctgctt

SEQ ID NO: 441 - DNA, 121 bp, Artificial Sequence
  Synthesized
  misc_feature (61): n=t or c
gggaggggagcagggagcgagaggtgcgtgatgtgttctcactctgcccttcatgctctgnatgtatggaaaggggacttgggaaaggcagaatggaaggaaagaaatgttatgcttagag

SEQ ID NO: 442 - DNA, 121 bp, Artificial Sequence
  Synthesized
  misc_feature (61): n=a or g
gcctcagcccgcacactgagccacgtgcagcacacctacctttgtatccttggaataaacnttcagagaaaaacgctctgtgttgagtcctgggcgcagcacaggggctgcaggggcggcc

SEQ ID NO: 443 - DNA, 121 bp, Artificial Sequence
  Synthesized
  misc_feature (61): n=a or g
gaaggggtgaaattccacctcctgacctcctcagacacactcagcaccctcagcaaaccanaacccacagccacagccacatgtcgggacagcctttcagaagtctttcagggtctgtttc

SEQ ID NO: 444 - DNA, 121 bp, Artificial Sequence
  Synthesized
  misc_feature (61): n=c or g
ttctacgcagagtgcagccatttccataaaggagtcatttgaaggtagagaatccatatgntctatttccatcaaacaagccactgccacccacctttccccaggacaaccccaattcaga

SEQ ID NO: 445 - DNA, 121 bp, Artificial Sequence
  Synthesized
  misc_feature (61): n=a or g
aatacatgtaatgaggaacaaacgttctgcaaagagcttgcaccttactgaggaagggganagtattcttccttcacagagggggtgagggtttcttgctgaaggatatgctcataaaaac

SEQ ID NO: 446 - DNA, 121 bp, Artificial Sequence
  Synthesized
  misc_feature (61): n=t or g
gtcacaggggtgtgatggggaaagcactgaagagtggcagtgaggagaaagagctggaagngacttccagggaagaagggcagctctgtagtggcagaaggaagggaccccactcacgtcc

SEQ ID NO: 447 - DNA, 121 bp, Artificial Sequence
  Synthesized
  misc_feature (61): n=t or g
gctctgagcccggcgtagggtgactgccccactgagcccggcctccctgcacacatggcantggaggacacgcagcagcaatgctcagagcagaagcttttgcttggatgctgggctgagc

SEQ ID NO: 448 - DNA, 121 bp, Artificial Sequence
  Synthesized
  misc_feature (61): n=t or g
agggtagaagtagcaaattctgttgttgaccagtgctttaaagtagacctgtgactttagnggaagaatacttctcactctaaagtggaatcctttccaaatactagacctagaccttcca

SEQ ID NO: 449 - DNA, 121 bp, Artificial Sequence
  Synthesized
  misc_feature (61): n=a or g
cacggattgctccatctgcacacccacctggacgggctgcaaagatccctcttcctcaccncttccatttaaagttcaaaacctcaaattgtcttcagaggcttttcatagaaccagagag

SEQ ID NO: 450 - DNA, 121 bp, Artificial Sequence
  Synthesized
  misc_feature (61): n=a or g
tccacataagtttatcagcatcggcttgacaataagtggcaaaacatgaaaatgttctgcncggtcaagccagctgctctcagaacagaagctacgagccaacgagtgggaacgatgggat

SEQ ID NO: 451 - DNA, 121 bp, Artificial Sequence
  Synthesized
  misc_feature (61): n=a or g
gaaacctttaatgtgtcgtttataaaggatgtgtaagtattattgaggatacctgcagtcngcttcagtagaggagcaaaggcctgaggtctctcatctcctggtgactaaaagttgtggg

SEQ ID NO: 452 - DNA, 121 bp, Artificial Sequence
  Synthesized
  misc_feature (61): n=c or g
cagagctggaattaagcgtgcaacagcccacagaaagccattcgtcttagtgctgtgctgntgagacgacacagaagcgtggctgaggtgcggagagctgcactgcaaatccaccacgtct

SEQ ID NO: 453 - DNA, 121 bp, Artificial Sequence
  Synthesized
  misc_feature (61): n=a or c
cgtgatacccattcagtttcagtttacatttctatataaaacctcctcactagaaaacacnatggagtccagaaggttttaactgccagctgaaatgttgatttatttactctcagaatac

SEQ ID NO: 454 - DNA, 121 bp, Artificial Sequence
  Synthesized
  misc_feature (61): n=a or g
tgcgtagaaaggctgccccctcagcttgttgttgcacatcatgcaggtgaagcactccacntggaagacctggtccatggctgtgcagccagtgccttccccaacaacattctccccacag

SEQ ID NO: 455 - DNA, 121 bp, Artificial Sequence
  Synthesized
  misc_feature (61): n=a or g
tcagggatgagcatttggactcacaacacctgaagggcttcccagaacttcaggcagccanaggctgcagggtgaaggaccagaccatggctgaaacccagcccaaagcccagtggccagg

SEQ ID NO: 456 - DNA, 121 bp, Artificial Sequence
  Synthesized
  misc_feature (61): n=t or c
atgcatgttgtgggtcatgtaggaaggcagggaggtacaaatgagaatgtagaaacacaanggaaatacagagagcaaaataaattggagctaatttcagccagcatccagatttctagga

SEQ ID NO: 457 - DNA, 121 bp, Artificial Sequence
  Synthesized
  misc_feature (61): n=t or c
cactgataaattctatacagtaaacaaaaaccagaagtgtgctttgcatagttgtagatangcttaacacaggactaacttaattcctccatgagtcggtctggctttctgtctccacata

SEQ ID NO: 458 - DNA, 121 bp, Artificial Sequence
  Synthesized
  misc_feature (61): n=t or c
tgtagttagaagaaaagcttgatctgtaagagtgactccaagtcagaggctagtaaatatntggagacagactggttttattaggtagtaagactgttggaggtattaaacgtcataaatt

SEQ ID NO: 459 - DNA, 121 bp, Artificial Sequence
  Synthesized
  misc_feature (61): n=a or g
accactttttatagtgatatgttatacactttcagttgtgtgatagtgttatggtccaacnctactgcctgtgctgcatcttctgtcctcttctctgttgactcccttctcaagatgccag

SEQ ID NO: 460 - DNA, 121 bp, Artificial Sequence
  Synthesized
  misc_feature (61): n=a or c
aaaatgaaatttaatttatgagtggcatggcctcactggacccattcccatattgttgggntctgagtttaattaagtactcaggatggcattttccatgcagggaatattcatgacacat

SEQ ID NO: 461 - DNA, 121 bp, Artificial Sequence
  Synthesized
  misc_feature (61): n=t or c
gcaaaggcacgaaatgtattcctgaatgcacctattttgctaaagctgaaaataaacgcangcttctacatcctgttttttctctccaaacagaaatagccagcgcagacacaatgcgccc

SEQ ID NO: 462 - DNA, 121 bp, Artificial Sequence
  Synthesized
  misc_feature (61): n=t or c
ctaactaacaaatcagagccaagccagaaattaaagcaacaagttgttctgatgtctctanatcctgcaaacaccaatggtggaccccattccccaaggacaccgtggccatggccactgg

SEQ ID NO: 463 - DNA, 121 bp, Artificial Sequence
  Synthesized
  misc_feature (61): n=t or c
atttatgggacgttgtctctgtttgtcagacaggaatataagctggtagtttttaccagtnaaaatttataatactgctgtcttagagtgttgtgttcacagacaggcatagctagaaggg

SEQ ID NO: 464 - DNA, 121 bp, Artificial Sequence
  Synthesized
  misc_feature (61): n=t or c
gggacaggtgctttcctaaaatatcctgccttcagattttaaaggaccaagagaaagcacngtctgacttttaggggtatgtttggcgtatctcaaagacttgcagtgcaaggctattgcc

SEQ ID NO: 465 - DNA, 121 bp, Artificial Sequence
  Synthesized
  misc_feature (61): n=t or g
cccatgtacaaaaaggggttgagaatgcagcaattctctatgcaatatcttgaaatatacngtcctttcttgttaagttacataatatcattaagtctacagagtaccattgttgataaaa

SEQ ID NO: 466 - DNA, 121 bp, Artificial Sequence
  Synthesized
  misc_feature (61): n=a or t
tcaaagttagcaaccccgctctcatgggccatggttctgcacttttgctctggctcgctcnttgtcaacaaacgcacagttgtacagagatgcttaatgaagcacaaaaacatggctcata

SEQ ID NO: 467 - DNA, 121 bp, Artificial Sequence
  Synthesized
  misc_feature (61): n=t or c
aattacgcatattagaattaccagcaccatcgttgtagaggttactacagttgacttgcantacatatgtcctcctagcatttcccctctggtagaacaagcaaagattctttaggtcccc

SEQ ID NO: 468 - DNA, 121 bp, Artificial Sequence
  Synthesized
  misc_feature (61): n=a or g
tccacattaaatggctgcatatttgatgtttaggggttctgtgtgaggcacttcgtgcctngctgtgcctacgtgggcatgccatgtaggtgtgaagttgtcctctgctcttcagagctat

SEQ ID NO: 469 - DNA, 121 bp, Artificial Sequence
  Synthesized
  misc_feature (61): n=a or g
gagaaagcccaggcaactggaagcagaatgagtgaataaaatcaggtcaaatgaagtcctnctacaagcaaggatgacccagtcaaggatggatgctctatacctgctgtagctgactgca

SEQ ID NO: 470 - DNA, 121 bp, Artificial Sequence
  Synthesized
  misc_feature (61): n=a or c
gcattctgactacagactacacattaacaaaaagagtgcagagctactaagaattaacacntggggaacccaagagctgaccccaaaagccaaccccacagctactggaaaatgacagtcc

SEQ ID NO: 471 - DNA, 121 bp, Artificial Sequence
  Synthesized
  misc_feature (61): n=a or g
tctgcattctgcatgctctcatagctctctttctgtcaaatgcatctacggggatttgcantggttgcattttggggggaggaaacgtttcaagccaagcagaccttactctgcacctatc

SEQ ID NO: 472 - DNA, 121 bp, Artificial Sequence
  Synthesized
  misc_feature (61): n=t or c
ggcttcctctgaatatgggtattttgtaccactgaggcatgtctttttggcaagcttcccnctgcttcaagagggctaaatttggctactgttcagccatcctacctagttacatgagata

SEQ ID NO: 473 - DNA, 121 bp, Artificial Sequence
  Synthesized
  misc_feature (61): n=t or c
aaaccatgtgagtctaatgatgccatttaacagactgtttttcttggcataaataaggacnccttagaaaatggttataaaaattggaagaagctgtgttatctgaggaagttgctaaaaa

SEQ ID NO: 474 - DNA, 121 bp, Artificial Sequence
  Synthesized
  misc_feature (61): n=a or g
gtcagtagccttgatttttaggtgcctgctgtagtttgtaaacccttgcaggcttcagcanatgagcacagtcaccccagagagcagagatgtgaattcaattatgtggagtatgttgaat

SEQ ID NO: 475 - DNA, 121 bp, Artificial Sequence
  Synthesized
  misc_feature (61): n=c or g
ctggaccaggattttctctctgggtagaattaaaaggctgcaccctgcgtgtgtagtacangctcttcaaagttgctttcttctccctgagtgcagctaaggagcaaaggacaccagccca

SEQ ID NO: 476 - DNA, 121 bp, Artificial Sequence
  Synthesized
  misc_feature (61): n=t or c
tgctcccagagctgagttcagtttatgcctcggtcagccatcatcctcagatgaaacaacntcagtgagtgactgagcacccttcatgcagcccccactgccatctgagcactgcacatgg

SEQ ID NO: 477 - DNA, 121 bp, Artificial Sequence
  Synthesized
  misc_feature (61): n=a or g
ccactagtttggaaggaaaactaatttgctctgtcttctctgcttgttcaaagcagagagncagcttagagaaagcagagagtaaaaactaaccatttgcactctttggggagcacctgca

SEQ ID NO: 478 - DNA, 121 bp, Artificial Sequence
  Synthesized
  misc_feature (61): n=a or c
ttttttttttttttttactacttctttttttggataaggaaaatgctcatgtggccaacantggtcactctacaggcttcaataagaaaaggacacttgatttaaaaaataaatacttaaa

SEQ ID NO: 479 - DNA, 121 bp, Artificial Sequence
  Synthesized
  misc_feature (61): n=c or g
taatcttattcccattgcaatcataactgttatttggcatagtaaaactctccctcaaaanacatcacagaagcttaaatttgcaataccgttcaaaaaagcaattagctacttatttttt

SEQ ID NO: 480 - DNA, 121 bp, Artificial Sequence
  Synthesized
  misc_feature (61): n=t or c
tcccttttatagccgtggagatacacagcactgcagactttgtttgattgagtagcagtcngggaatttttcaaagtaggaaaatcaagagaatctaaatctgaatttcggccagttcatc

SEQ ID NO: 481 - DNA, 121 bp, Artificial Sequence
  Synthesized
  misc_feature (61): n=a or c
gctagtttatacaaacagatgtattcaagactatcaacttctcagtttaaataacatgtcncacgttcatttctggtggggtagctgaccgagcacagcagaaggactcttagcactcatc

SEQ ID NO: 482 - DNA, 121 bp, Artificial Sequence
  Synthesized
  misc_feature (61): n=t or c
tccagcagtttctgcgtcaagcctctaactcctgtttaccaagcacagaaagacattccancttacctttcaaactacaacacaatgaatacctatgaaaaccatacgtgattcaggacta

SEQ ID NO: 483 - DNA, 121 bp, Artificial Sequence
  Synthesized
  misc_feature (61): n=c or g
agctctttcaaagtatagtgattattgagatatttaataaggagtaaacactacagaacantctctctattattctaaatagacaaaaatgttctagggggttttaatgttttcctcactt

SEQ ID NO: 484 - DNA, 121 bp, Artificial Sequence
  Synthesized
  misc_feature (61): n=a or g
agttgggaggttcctttctgttgtgagaaaccttgtagataatcttgtgcttaggtcatcngtttgcttcaagtgaagtacaacatcagaagatactctgaagtgcgattctcaaatgacc

SEQ ID NO: 485 - DNA, 121 bp, Artificial Sequence
  Synthesized
  misc_feature (61): n=a or g
cagcacccactgggccgtgttacccagaccttcgctcagcctcaccaggatgaagtgcccnaagaggttggtggtaaagacctcctgcagcccatccccgttcagtctgtccgtctgcgtc

SEQ ID NO: 486 - DNA, 121 bp, Artificial Sequence
  Synthesized
  misc_feature (61): n=a or g
atccaatgataaaagacctgaaaatacaattcctcaaagccgtttggaagcagctgatggngatgagggatgcagatgactcagaaaagcacccgacggggtgatgcagctctgcccgtcc

SEQ ID NO: 487 - DNA, 121 bp, Artificial Sequence
  Synthesized
  misc_feature (61): n=t or c
cagaataaatgagagctacaaaaataccattgcaactaacactgcacatcatttttcaatngctgaagtgaccgatctgtatattctctgctttgtgatagaaagaaattaatggggagac

SEQ ID NO: 488 - DNA, 121 bp, Artificial Sequence
  Synthesized
  misc_feature (61): n=t or c
atacaaaaaaagacttatggcattgttaaattattgtgtaacaagacaagttttctgaatnccaggtagccacccacacacgcaccccccaaaaaagtcccttcttccctttgtcttttgt

SEQ ID NO: 489 - DNA, 121 bp, Artificial Sequence
  Synthesized
  misc_feature (61): n=t or c
acacatggcaaaataagcttcaaaaccccaaccccatgggcatcacactgacctgctgctnatcaccacctgctagtgctgactgaaccaatccccaacacctgctttgaggcttttcctt

SEQ ID NO: 490 - DNA, 121 bp, Artificial Sequence
  Synthesized
  misc_feature (61): n=t or c
acgagcacaaagggatgctggcctcaatatgggacataggtctgagagaccaccaccccanagtctttggtgactggacctatggagatgttgagagggaggaatgcaagtgatctgttgg

SEQ ID NO: 491 - DNA, 121 bp, Artificial Sequence
  Synthesized
  misc_feature (61): n=a or g
ttaatagaaattatagatgctaaagttgtgtgaaaaatatgtgttaaaatttgtacttaantgggtggtaataatgaagagtccaagcaaaaagtgttattctttcaggtgggaaaattgt

SEQ ID NO: 492 - DNA, 121 bp, Artificial Sequence
  Synthesized
  misc_feature (61): n=a or g
ctgggaaaatagagttgagattaaggctggggccttcaaagccccagtgttgatagctggncttcagcagaagtgcccagtctgttgcagctcatttgcaggtgccagccccaagaacttg

SEQ ID NO: 493 - DNA, 121 bp, Artificial Sequence
  Synthesized
  misc_feature (61): n=t or c
ctgttccccaaagtttccctactgctaagttactctcatcctttcactttctatacatctnccataagagtcacattggcacctgcattaattcaagaaaacctgaaatttaatttctaac

SEQ ID NO: 494 - DNA, 121 bp, Artificial Sequence
  Synthesized
  misc_feature (61): n=t or c
agtgatgctctcaccagtttctcactgtctcagaactgtgatatccggatgtggcctcaanctgctggctgagctcctgctatttaaacattaattagtctccttaaacagggagccaagg

SEQ ID NO: 495 - DNA, 121 bp, Artificial Sequence
  Synthesized
  misc_feature (61): n=a or g
gtaaattgaatgagcttgaaaactgttttatctcagttattcttttaaccattaggaggtntggtaggctctatcttggcatgagcttttttcctaatccttcaaaagagatgtgtatatg

SEQ ID NO: 496 - DNA, 121 bp, Artificial Sequence
  Synthesized
  misc_feature (61): n=t or c
tatacccggcctcagttcttttttttgtaaaggtgcagtctgatgacagaattgcctaatngtgacatatgaaatagtaggtgttgatcctagctaattttttttattaaggtaattatct

SEQ ID NO: 497 - DNA, 121 bp, Artificial Sequence
  Synthesized
  misc_feature (61): n=t or c
gtttaacttgagagatacatatacattcacatggaggattcagtcacatttgaaagtattnacccttaattatagtaacattgaagctgtaaataagaagtataatatggaaaaaaaagtt

SEQ ID NO: 498 - DNA, 121 bp, Artificial Sequence
  Synthesized
  misc_feature (61): n=t or c
gtttgaacagtgaccgtgtctgcgtctcctgtcattttttgaatgaagcctgtgttagtgnttcacgttattctcagactgatcagcacatccacactgctctctgggctttcttcattcc

SEQ ID NO: 499 - DNA, 121 bp, Artificial Sequence
  Synthesized
  misc_feature (61): n=a or g
ttcagtatgttagggaattagaaaacacctgaggtgactagtaaatattgaaatttatgangtttattgtcctgccatgtatactggccttcacatatagatttggctttgcttttgggga

SEQ ID NO: 500 - DNA, 121 bp, Artificial Sequence
  Synthesized
  misc_feature (61): n=a or c
tcatttaggatgtttgagctttgcctaagtgaatgtatggtctggacctgccagctattantcatcactgttttaatacagccacttcaatcaccagacagcagttttccaagttacatac

SEQ ID NO: 501 - DNA, 121 bp, Artificial Sequence
  Synthesized
  misc_feature (61): n=t or c
atctactgagaacaacaatggcaatttagcactcacagatagagtagagctgtatctgctngtagtatatactgctgtaacttcctcaaaacatgcctgagtaccaatatttcttctttaa

SEQ ID NO: 502 - DNA, 121 bp, Artificial Sequence
  Synthesized
  misc_feature (61): n=a or g
atgtgtaaaaggatgcaagagctcagcctcctcacccacagaaacatgcaggtacctggtnctccaacttgctgctgcccccaagcagaactcttggggcaggctgtcacagccagcgggt

SEQ ID NO: 503 - DNA, 121 bp, Artificial Sequence
  Synthesized
  misc_feature (61): n=t or c
gtcatgattctccttcatttatagctatgagctgtctgtccatgcttatgtgctgaaaggnattgatgcactcttgaaagagccctgtagtgctcatttaatcagtgtcggcactgcattt

SEQ ID NO: 504 - DNA, 121 bp, Artificial Sequence
  Synthesized
  misc_feature (61): n=t or c
caatggtttgggaagcaagttaagtttttaggagtccaaaggacagattgtagaggtagcngcctatgtggcagatagagctaatggtctggactgctttctcagtcagtggagagagatt

SEQ ID NO: 505 - DNA, 121 bp, Artificial Sequence
  Synthesized
  misc_feature (61): n=a or g
tttactactttcttttccacttctttgcttctgatcaatttcctggtatagctgcattagnctgattctaagctcatttgattctattaatataactttacatatgtaggtagcagcaacc

SEQ ID NO: 506 - DNA, 121 bp, Artificial Sequence
  Synthesized
  misc_feature (61): n=c or g
tgccctttccacaagaacgattcctagatggtacatatcctgaaatgacagataacattanttgttggaaactcccctgaacattatgctacagagatattaataatattatccacaggat

SEQ ID NO: 507 - DNA, 121 bp, Artificial Sequence
  Synthesized
  misc_feature (61): n=a or g
ccagctgtagtggtattcttctggttatgttttgaagaatgttagcctgtcaccccttgtntccatggaaggagatggctacgtacatgcctcgcttggcagatctgatgaatgccttaaa

SEQ ID NO: 508 - DNA, 121 bp, Artificial Sequence
  Synthesized
  misc_feature (61): n=a or g
cccttctttccacctaaggcattttaagctcttcatttttactataacctggagaacaaangaggtctcgaacacctctacttcgtttgcagagctggagaacatctggatcctgagatga

SEQ ID NO: 509 - DNA, 121 bp, Artificial Sequence
  Synthesized
  misc_feature (61): n=t or c
aagagccacaaagttgcttacaagtaacttcagaaaaacctttttgttttcctggtgagcngtgtgctggaggccaggctgagctgtcatgaaaaagcacatcctcactgaagacgaagac

SEQ ID NO: 510 - DNA, 121 bp, Artificial Sequence
  Synthesized
  misc_feature (61): n=a or g
gattgtgtagataaatgcagagaaaagaaaatctcctgggcaaataaaagaacagttttcncgtttcccagtgttgcttctactctcctctaaagacctcttaacgctcaagtctgacacc

SEQ ID NO: 511 - DNA, 121 bp, Artificial Sequence
  Synthesized
  misc_feature (61): n=a or g
gtttaacttggagctgtctcaggtgctgacatagcacggatgcatcccatcagtaggaagngcttggcgtgatgcctcctgtttatccttctccataataacagcaaagacccaaggggat

SEQ ID NO: 512 - DNA, 121 bp, Artificial Sequence
  Synthesized
  misc_feature (61): n=a or g
gggaaactgagtcatgcagggatggaaagaaatctcttctttgttcttggcagccaactgnaccttatttgtcaatctgagcagtgcaactgcttttggtttggtgccgtgttacagaaaa

SEQ ID NO: 513 - DNA, 121 bp, Artificial Sequence
  Synthesized
  misc_feature (61): n=t or c
ttcaaagcctctgcctgaaataaaaggcattcaagattcagtaatatttctagaagcacanagttctaaagaactcctccaatccttggccctcaaataacctttatactcatttactcaa

SEQ ID NO: 514 - DNA, 121 bp, Artificial Sequence
  Synthesized
  misc_feature (61): n=a or g
ttatagtaagcatctgtctaccctgtaggtaggctatgggtaaatgtgttaagttgctcancaagtcacaagcaaagggctagggggaaaagatacatcagaaacaacttctgagcttctc

SEQ ID NO: 515 - DNA, 121 bp, Artificial Sequence
  Synthesized
  misc_feature (61): n=a or g
tgcatgtaaaaccccatataaaatgtcacaaggcagtatttatgaaataaataggcaagtntgcattccccttctcattcctgttccctctctgcttgcgaagaagtgcaaaatgcccagg

SEQ ID NO: 516 - DNA, 121 bp, Artificial Sequence
  Synthesized
  misc_feature (61): n=t or c
atgttctgtcacagccctataatttatggggctgtgtggactgaccacattttggggccgngtctcaagcagatcctttcttctggatggagggggaaagatggactgtagcatcatacct

SEQ ID NO: 517 - DNA, 121 bp, Artificial Sequence
  Synthesized
  misc_feature (61): n=t or c
catgcgttcaaacattctcctgccagtacttggtgtgctgcctcatgtatctaccttacangtgaggtgcagtaaaagtttgatagaggcctacctctcagaaagcccaaggaaatgccca

SEQ ID NO: 518 - DNA, 121 bp, Artificial Sequence
  Synthesized
  misc_feature (61): n=t or c
gcatgcctttccatccagccctattggagaagtgttccgtgcacgcttgaggcagtttccntctcttgtgaactgctgtaccattgactggtttaacgagtggcctgctgaagccctgcag

SEQ ID NO: 519 - DNA, 121 bp, Artificial Sequence
  Synthesized
  misc_feature (61): n=a or g
gtctagtgtatgtagagtgtctaaattgcatctagagcaatgtagtgcttaatcagaagtncattcatggatctagaacaccttatggtttacacctgctgtgctgacttacaaatcttct

SEQ ID NO: 520 - DNA, 121 bp, Artificial Sequence
  Synthesized
  misc_feature (61): n=a or g
tttatttagactgtcagaaaaaagcctgagaaaagctttgattacagaatatagcacaganaatgtagggatagttaaatctgtcagaaaaaaagacagcaagagtcatggaaatgaaagc

SEQ ID NO: 521 - DNA, 121 bp, Artificial Sequence
  Synthesized
  misc_feature (61): n=t or c
gatatccccttttagcattttttctcttaatgcattccctcttatcgtcaccatctgctgngatgcctttggattaacaaggtataaggtctcgtctttgcaaggccctgatatactctgc

SEQ ID NO: 522 - DNA, 121 bp, Artificial Sequence
  Synthesized
  misc_feature (61): n=a or g
acgcagtaatcacgtcttctgcagctgaaaatgtgcagtacttcagattaattttaaaagntctcagtgagaagtgctttaccaaggacaccaattgatgaccagatcacctagcacagag

SEQ ID NO: 523 - DNA, 121 bp, Artificial Sequence
  Synthesized
  misc_feature (61): n=t or c
agcattgtgggccttttcaacccaggccattctatgattctgtattacactgcaatttgtnagcacctcttcactctattaagaaggatcagctgatacttcagcagcacaaactgcatcc

SEQ ID NO: 524 - DNA, 121 bp, Artificial Sequence
  Synthesized
  misc_feature (61): n=t or c
tctatgtcctttgcattaaaagcttgtgaagcggagcacagacctcacattgagtgctccngatcctcacctagtcttcagtaagtcatgcaaccacctctaaattcatacttcagaataa

SEQ ID NO: 525 - DNA, 121 bp, Artificial Sequence
  Synthesized
  misc_feature (61): n=t or c
aacagaagtagaacatacagaacagcaagattttgctaactgcagactttctttcaggttnctgaatgttggacaacatagaaataaataccaatcctcaaagcatggactgactctagcc

SEQ ID NO: 526 - DNA, 121 bp, Artificial Sequence
  Synthesized
  misc_feature (61): n=t or c
tgtatgctcctgtacaaaccacacctgcacaaagcagtgagaatgagtcactggtgggaantctacagccctggccatttcacggggcaagagagtgaggcagacttactgttttgtcttc

SEQ ID NO: 527 - DNA, 121 bp, Artificial Sequence
  Synthesized
  misc_feature (61): n=t or c
caggctgctttccccagtttttaggcagagaacaaagaaacacacgaggacttgaactagnttgttcagcaaaagcaggtgataaaaaataataatcctcaaacccccaggtactcagatt

SEQ ID NO: 528 - DNA, 121 bp, Artificial Sequence
  Synthesized
  misc_feature (61): n=c or g
aatggacctcacaagacagaactgcaaagcatgttttcctctgttcctaaccactaagganaaagaaaaaaagatccaatacaaaatttgcagacttctaccaagacaagcaggaattgaa

SEQ ID NO: 529 - DNA, 121 bp, Artificial Sequence
  Synthesized
  misc_feature (61): n=t or g
gaaatcaggtgcgattttctggaatcagaaaatatttgcccataaaatcatcatcaaaatnatccacctttcaatgacaaggatctcattataaaactgactactggtttggctcagaagg

SEQ ID NO: 530 - DNA, 121 bp, Artificial Sequence
  Synthesized
  misc_feature (61): n=a or t
cacacctcttgtagtctgagaaaaaacagcatattgaagccttaaaaaacaagcagtgtangcaaagactcagtcagtctgcctaaaaagaaaaccaaagagaaatgaaatgaggcagagg

SEQ ID NO: 531 - DNA, 121 bp, Artificial Sequence
  Synthesized
  misc_feature (61): n=a or t
ttaatttatttttctaacatttttgggcagtatattttcttcactgactgtgtgtatcaanttcattgagagaatctatgaaaatgttttacattttaactgccttaatacacttagcact

SEQ ID NO: 532 - DNA, 121 bp, Artificial Sequence
  Synthesized
  misc_feature (61): n=a or g
tagagcatatgtaagtactgtcacagaacagtgtgatggcacaactcatgatttccatgtnttattcttgcaagacttcttcaaagactcagggtctttgaaggggtagggatacacaaga

SEQ ID NO: 533 - DNA, 121 bp, Artificial Sequence
  Synthesized
  misc_feature (61): n=a or g
ctgcttcctgtccactcagcccccagccccttctgctgcaattttgttttgaactatattnagtttctaccagctcatttccacagtctgcctgtgtccactgaattgcaactctgtgctc

SEQ ID NO: 534 - DNA, 121 bp, Artificial Sequence
  Synthesized
  misc_feature (61): n=t or c
taaggatctgcttcttacatatatgattttccaagatgataaagaatctcttgctaaatcncctgctgaaaaaatgatgtgctttttgggagggatgtgatagaagagtggtttgtaagca

SEQ ID NO: 535 - DNA, 121 bp, Artificial Sequence
  Synthesized
  misc_feature (61): n=t or c
gctatcacttctaacagctgagagagggacggctctggagcaagaacacatgtatgttagnggagaagatacctcagttcaggcagtgctttttctttctgttgcatgacagaagcctgtg

SEQ ID NO: 536 - DNA, 121 bp, Artificial Sequence
  Synthesized
  misc_feature (61): n=a or g
actgaaatgtaattttaccctgtgcatttttgctgctgtgtctcagttcatcagctggtcnagtgacctgctcagcattatgtcctactctgcgtctgagtcagaaaatccagccttagcc

SEQ ID NO: 537 - DNA, 121 bp, Artificial Sequence
  Synthesized
  misc_feature (61): n=t or c
acagggatttgagagtccttgcagcgcgctacgaccagcacatcacagaaggaacagcagnaagctgcacgccagcactcaccctccgtccctgctcctctgtgcggtaggcatgcctgta

SEQ ID NO: 538 - DNA, 121 bp, Artificial Sequence
  Synthesized
  misc_feature (61): n=t or c
ttaaggccgttacctctcaccattacaaggcctgttgtaggcaggaaggtgtccgcagggnacacaggaaggcctctgcacagcccccacggcaccccaccagctcggctgggccatcccg

SEQ ID NO: 539 - DNA, 121 bp, Artificial Sequence
  Synthesized
  misc_feature (61): n=t or g
aatgcctccgcccgagcctgtgccagcagaaaaacgactcaatgtgcaggctctggggacntgggttgaagaaaccgacacaccacgtatacagaaagctgcgatcactcctattttaaag

SEQ ID NO: 540 - DNA, 121 bp, Artificial Sequence
  Synthesized
  misc_feature (61): n=a or g
tgcagctgaagccaacggggcccatggatgcaaatacggctctgcacagacacagagcccngccgtgcagctgtgactgcacgatgggtgctttaggaactgtccttctcacagccagttg

SEQ ID NO: 541 - DNA, 121 bp, Artificial Sequence
  Synthesized
  misc_feature (61): n=t or c
aaagactggtgttacacaaacactcagaactgcgccgtttcatcccagtgttgagcagggnttctcagatgttatcctatgcagtacttcattgcaagtgagagagtcatctgatgccttc

SEQ ID NO: 542 - DNA, 121 bp, Artificial Sequence
  Synthesized
  misc_feature (61): n=a or g
taaagcagacagagaagtgagagaaggacattcacggagattgactgatcagactgtcacncacattgtaatgccagtgaaatgcacatgacttgcttgctcatttagaggtgagccttac

SEQ ID NO: 543 - DNA, 121 bp, Artificial Sequence
  Synthesized
  misc_feature (61): n=t or c
tctcttgtgaataattccttttgacaggaatattgctctaaagaaagagttaatagtgggnattagtctttgcaaggcagaaagttaacctgtgtgtcctgtaggtattcaatttcagtag

SEQ ID NO: 544 - DNA, 121 bp, Artificial Sequence
  Synthesized
  misc_feature (61): n=t or c
aggaatgtcagacgcatgatgtgcacaaaggaaggaaaatatactggaaacgttacccaanaccttcataactagtaccactgcaagcattagagagtctcagcattacaaagcaattggt

SEQ ID NO: 545 - DNA, 121 bp, Artificial Sequence
  Synthesized
  misc_feature (61): n=a or t
tccattctgtgaaaatgccaatggatattcatgccttgaagcacttgccttctaagctgtncttttcttattcaatagcaatatgaagccagaaatatcagcacaacttttatgtatacta

SEQ ID NO: 546 - DNA, 121 bp, Artificial Sequence
  Synthesized
  misc_feature (61): n=t or c
agtgccaatcctgtgtgttgctgctcgctgctctccagagatgcagcctgaatggatagangttaatcaggcagcatggcccggtgccaggcgcggggtgagcaggtgccaggaggggagc

SEQ ID NO: 547 - DNA, 121 bp, Artificial Sequence
  Synthesized
  misc_feature (61): n=t or g
aataaatatcgtgatatttgtgtgtaaatttaagtctcactgggatatattagaaatcagnttatttgtggctgttctagcagctaaatgcaccccaggtttgtttctagttcttaccaat

SEQ ID NO: 548 - DNA, 121 bp, Artificial Sequence
  Synthesized
  misc_feature (61): n=t or c
tgtctgggaggttttctatcagcagccctcaccagagctcatggaaaatctcatttttctnctcacttcggcccatctctgagccctgctccaagcacagccctccccaccgaagtcatga

SEQ ID NO: 549 - DNA, 121 bp, Artificial Sequence
  Synthesized
  misc_feature (61): n=t or c
cctcagtaataacatgctgggaggcagtggagaaagcctgcactgagcactgtgagctacngcctggagcacaacagaaatcacagcttctgtgttactgctggcttccatcaaggctgga

SEQ ID NO: 550 - DNA, 121 bp, Artificial Sequence
  Synthesized
  misc_feature (61): n=a or g
atgaactgtgctggttctttgtaatgactgattattttaagccttatgaatgcctgatttntgaaaatagcactggtggttaatagccagagggttgggatgcagcttggtgtagcgactg

SEQ ID NO: 551 - DNA, 121 bp, Artificial Sequence
  Synthesized
  misc_feature (61): n=t or g
gagaaaccccttttgccattgccacgtaaaatacagaaacgcttttcaggttgtaggattnagcctcctgatctcctgatacgccagattctgccaggattatgggacccactggaatgtg

SEQ ID NO: 552 - DNA, 121 bp, Artificial Sequence
  Synthesized
  misc_feature (61): n=t or c
gtcccccagcatcatgctgcccccatataacctttctggctgtcacctcccagtggaggangattttgatgtcattttttagttctacaaggccaacactactggcggtgctccttccttc

SEQ ID NO: 553 - DNA, 121 bp, Artificial Sequence
  Synthesized
  misc_feature (61): n=t or c
cttcacaaaatcacactttctaaatactgacttagtgccctagtctccatgtgaatacaancacttacatttataaataaaacatattttgggatcttgttatttgtttttgggttcttaa

SEQ ID NO: 554 - DNA, 121 bp, Artificial Sequence
  Synthesized
  misc_feature (61): n=t or c
caatggaagctgctctcacatatcatttcagcaaaaggatcacattttggattcccacagntgacacaggtgagaatacagtgcccccagcatcagataggattcacgtgctggataggga

SEQ ID NO: 555 - DNA, 121 bp, Artificial Sequence
  Synthesized
  misc_feature (61): n=t or c
cccacctgaatgtgatgaacttttgggcaggtttggagaaggtcgcacgtcacacagtganaggcagcaaggcctgaagcatcttcatggtgcctcacacagagagctgaggctcaatggg

SEQ ID NO: 556 - DNA, 121 bp, Artificial Sequence
  Synthesized
  misc_feature (61): n=a or g
gcctgtgaatagcggggccaatgaattacttgggtagagttggagggataccgtaaagaantatttattaacagccagccacatgcagtctacaaattgtctttgatgttcttccagcccc

SEQ ID NO: 557 - DNA, 121 bp, Artificial Sequence
  Synthesized
  misc_feature (61): n=a or g
gctttgaccaaatgacaggatttgtatttagggaagcagcttggccctgcgactgctatgnagcaggaagaaagggcttgtcctctgtgaggctacaccacaaaggcagcgttgggcagct

SEQ ID NO: 558 - DNA, 121 bp, Artificial Sequence
  Synthesized
  misc_feature (61): n=a or t
ttgtctttgtaatgttataagctgcttgttcaagtgcctgctataatcaaatgtgaacatntagccatatgatagagagtcagagaatcatgtaggttggaaagaccactaagagcatcta

SEQ ID NO: 559 - DNA, 121 bp, Artificial Sequence
  Synthesized
  misc_feature (61): n=t or c
tctgtgaacctctaatgcaattatcctgttagttttatgagaagcacacagagtatccaangaccaactttggaaacacatctcctttctccctaacagttacaccacaagtaagtagaat

SEQ ID NO: 560 - DNA, 121 bp, Artificial Sequence
  Synthesized
  misc_feature (61): n=c or g
atctgcctgttcctcttaagtctggtcacttctggattccttcacagatttaggtgtctgnacttttgaaccccaaaaaaactctccaggcagtgaaacaacttaaaaaatcttacctctg

SEQ ID NO: 561 - DNA, 121 bp, Artificial Sequence
  Synthesized
  misc_feature (61): n=a or g
agtacatcttgctacctgttccaactgggaggagtaattgaagattggagcagccttacanctagaaaacatatgcaaaggtgatactttttccactctccatttgcacactgaaatcatc

SEQ ID NO: 562 - DNA, 121 bp, Artificial Sequence
  Synthesized
  misc_feature (61): n=t or c
ctttttttcccccttggctttctcttttctgaataataatcaaaagttggtatttctatgngacttcccaaatttctgaccacgctcaccgcagggtcacattccagcactaaatcccagc

SEQ ID NO: 563 - DNA, 121 bp, Artificial Sequence
  Synthesized
  misc_feature (61): n=a or c
gacaaaatttaaagtgtgctatttgccagagcatacatggaccaaaacacggagaaaaacnatcctgatacacatgcatgctgcacgttacccattacaaaggtaacatttccacactaat

SEQ ID NO: 564 - DNA, 121 bp, Artificial Sequence
  Synthesized
  misc_feature (61): n=a or g
gttagctgctatgcttgctctttctgccacctactgcgttgggcctgttctaacatttctnctccatcccctatcctactgcccccccccccccccatgctactcattgcaacttgtctgc

SEQ ID NO: 565 - DNA, 121 bp, Artificial Sequence
  Synthesized
  misc_feature (61): n=a or g
tttatctctttataggtacttttacccatttcctgttgggcctttactttatcaagttganctttcaattggggggcaacagtttcatgggaaaggaagaacaagacaagctgctaagcac

SEQ ID NO: 566 - DNA, 121 bp, Artificial Sequence
  Synthesized
  misc_feature (61): n=t or c
ttttgtgtctctggtgatcgatagctgctgacctctaaatctcaccaatgggtttgaggtncctgcttcagctacaatgtggctgtgatccatttatgtcatttttggaggaaaacccatg

SEQ ID NO: 567 - DNA, 121 bp, Artificial Sequence
  Synthesized
  misc_feature (61): n=t or c
gctgttattggattgaataaggtgtgatttaaggaaacacgatattggcccaagctgcaangaggacaaaattggctgctggcccatttcaggaacaagcaaatataaagataaagcaaag

SEQ ID NO: 568 - DNA, 121 bp, Artificial Sequence
  Synthesized
  misc_feature (61): n=t or c
tctccttattgagccagatttatattcttgtgttctccatctgcttcgtcttacgtcttcntccacatccaggagaaaaacaattcaaaaaccttgaagggaaagagagagcgagagcgag

SEQ ID NO: 569 - DNA, 121 bp, Artificial Sequence
  Synthesized
  misc_feature (61): n=a or g
gtgtttggaggtgggcgttttgtgggtgcaaacatttgttgtactcagtgagtaaagctgntaatgagaaatgggtattttccaggaggagagggagagctttccccaaactttgatgaaa

SEQ ID NO: 570 - DNA, 121 bp, Artificial Sequence
  Synthesized
  misc_feature (61): n=a or t
gtgcttaattatgatggcatgacttcccttaagtttccatactcctcaaacttgtagaacnatcagtctcctgaaggtggcaaacctttgtatgaccggtgtgtgtacattcaggagaaca

SEQ ID NO: 571 - DNA, 121 bp, Artificial Sequence
  Synthesized
  misc_feature (61): n=a or g
ggacaagatactagcaagtatgtgtattttcaggaatatcttagaaacttactctcaactncattattcaggaggcaaagataactggtaaggttgttctcctggccctagatttttttgc

SEQ ID NO: 572 - DNA, 121 bp, Artificial Sequence
  Synthesized
  misc_feature (61): n=c or g
cctatgcttcctaatgactacaggttaaatcacagaactattttatgcctcagtttacatntaagtgaagcataaaatctctatctcagagggctttacagttcaccaaccccctggggaa

SEQ ID NO: 573 - DNA, 121 bp, Artificial Sequence
  Synthesized
  misc_feature (61): n=a or g
tttttcctagcatctctgtgaaactctgcatctttacccataaaagaattccaagttgcantaggagatggagctgtgtctacagtcatatgggtgtctggggaagacctgatctcatctg

SEQ ID NO: 574 - DNA, 121 bp, Artificial Sequence
  Synthesized
  misc_feature (61): n=a or c
catccaaacacgtcctcccttgctgcagccaaagaccttgctactcttccaccatattttnttttctatcatgttgtagcattgcaaggtgagaaatgtggtctccagtgagaagtgtgag

SEQ ID NO: 575 - DNA, 121 bp, Artificial Sequence
  Synthesized
  misc_feature (61): n=t or c
aagacactctgaatcctcaaatgcttttgtatcaatatttaagcagcagtttacttacacnaggtcagtacttataataccatgaatgatgagcactcagtgctagcgatccctaccagta

SEQ ID NO: 576 - DNA, 121 bp, Artificial Sequence
  Synthesized
  misc_feature (61): n=t or c
tgcagatttccatggggtagtggtggcttacatggcccaccatttcccttggctaaattgnctcattccacgtctgcccacgcacaaaaacaaactgtatactatgtctactgcaaggaca

SEQ ID NO: 577 - DNA, 121 bp, Artificial Sequence
  Synthesized
  misc_feature (61): n=t or c
gatatgaacatcttgtagcagttacatccccccactattcaatacttttcagcattgtctnaagagactaaatagaaacggcttcccttgttgcctaatgcctctaactcttgtaaatatt

SEQ ID NO: 578 - DNA, 121 bp, Artificial Sequence
  Synthesized
  misc_feature (61): n=t or c
taccctgcgcctctcccactctcatacttgaagaagaaatattggtagaaagacacactanaacaacccggggcatcctgcagtcaaatgctttactgcaaaacctacacagctatcttca

SEQ ID NO: 579 - DNA, 121 bp, Artificial Sequence
  Synthesized
  misc_feature (61): n=a or g
gcaaggaaatatgattatttcttctggtgttcttccaactaaggattttttgaaccgtgcntatctatcttctacatcttttaggatcttcattagatttctcttctgtggtcttgcccag

SEQ ID NO: 580 - DNA, 121 bp, Artificial Sequence
  Synthesized
  misc_feature (61): n=t or c
ctagatactgctactctttcaaagttttgctattttccttagtagttagttatttagagcnttacgcggtatctgcagtggtgctctttatgtagcaattagcttgaaaagctttaacata

SEQ ID NO: 581 - DNA, 121 bp, Artificial Sequence
  Synthesized
  misc_feature (61): n=a or g
ctgtgaatcccttagtcccagttttcaagagaaaaacatcaagggaaaagatcttggcaancacttgagctcactttcatttattaaattgtacttgccaagatgcacgctcctaaatact

SEQ ID NO: 582 - DNA, 121 bp, Artificial Sequence
  Synthesized
  misc_feature (61): n=t or c
aacaataacaactgtcaggtcacttggttacgtccttcctaatgccttctgaaagtctacntgttcaggtgtggaaaaggggtaaaatatggtaaatgctgggttccaaacttaaaaaaac

SEQ ID NO: 583 - DNA, 121 bp, Artificial Sequence
  Synthesized
  misc_feature (61): n=t or c
tttttgtttgtttgtttgttttttactattattttgtactatgaggatactgcaaacaccngtcactctgagaggattgcagattgtgcactgtttttttccttttttccccaccatttcc

SEQ ID NO: 584 - DNA, 121 bp, Artificial Sequence
  Synthesized
  misc_feature (61): n=a or c
aaacaaagaagagttcagacatggacatattcaatctagagaagagatggcttcaaaaagnctttcatggggacatttttaactcagagtggtgatacactggaacaagctgcctggagaa

SEQ ID NO: 585 - DNA, 121 bp, Artificial Sequence
  Synthesized
  misc_feature (61): n=a or t
agttctaaatgagtgtcagggcattgtgtctgcactccagactcctaaattttctcagctncactaaatcttagcccttgcttagagcattgaatgcaaagcacagcagactgtgtaggga

SEQ ID NO: 586 - DNA, 121 bp, Artificial Sequence
  Synthesized
  misc_feature (61): n=a or c
ggttggaatcttcttgatttccttcctgtcctctgctatttctccaccttttgctatgtgnaaaccacatactgatatgaaaaccttatgttattcttagggagtgttaccttccttgtta

SEQ ID NO: 587 - DNA, 121 bp, Artificial Sequence
  Synthesized
  misc_feature (61): n=t or g
ctgaaaagtgttcaggtacttgaaagcatcccagggaggctggaaagtttgtcctatgagnagaggctgagggcacttgcgtatttgagcctggagacaaggagaccaagaggcagcctca

SEQ ID NO: 588 - DNA, 121 bp, Artificial Sequence
  Synthesized
  misc_feature (61): n=t or c
tttttttaacagaaatcactgcaaagtgaaaggaaccaaagaggaaggatgaagatactcnatagggataaaatcaaaagtgaagagaaataaaacaaactcagagttttaccatctatgg

SEQ ID NO: 589 - DNA, 121 bp, Artificial Sequence
  Synthesized
  misc_feature (61): n=t or c
ctacagtgcattacagttacagtcagtgctctagaaacgtgctaaagaaaattgcagcatntcagcaagttacatgatttagtgaaactggtaaatatatccatcagtgttcaagcatggg

SEQ ID NO: 590 - DNA, 121 bp, Artificial Sequence
  Synthesized
  misc_feature (61): n=a or t
ttttcccaagcacactaagtaatatggaatatttttggtacattcgtagcacttggattcnagtccttgcatgagtgatatctctcagctataaactaagttagcttgctggattagtctc

SEQ ID NO: 591 - DNA, 121 bp, Artificial Sequence
  Synthesized
  misc_feature (61): n=t or c
taatgtaagctgagaagtgatttcgtgtttgtggatagtgagattccaaggcataattcangaggcaaagaaaaggatcagtatctgagaaacaagctgttcactgttttgcccagctgaa

SEQ ID NO: 592 - DNA, 121 bp, Artificial Sequence
  Synthesized
  misc_feature (61): n=a or g
gccagccagctggcaaactgacttaagcatgaaacactctaccttctcaaagctgcatgtnaaggggaatgccattttttaaaacttgctttaatgcttagataaacaccctatccttcca

SEQ ID NO: 593 - DNA, 121 bp, Artificial Sequence
  Synthesized
  misc_feature (61): n=t or c
tgatgtacaaaattgataaatcaccaaaatattagtttgtgtctagttggcacagcagccngttagcttggtggtgtgcttgaaacctttttcagtaacatggcattagataaagttttga

SEQ ID NO: 594 - DNA, 121 bp, Artificial Sequence
  Synthesized
  misc_feature (61): n=c or g
gcagacttctgtgctgtgttagcctatggttttagtaaaagcattgtttgggacaatgganagggctgagctatttctagttcaccggatgcaaaagacatgcagttacaaatggcagccc

SEQ ID NO: 595 - DNA, 121 bp, Artificial Sequence
  Synthesized
  misc_feature (61): n=t or g
tgtggaagaagatatattctcagggctgttggtacaccacagcatcctctggagaactggncttagtcatttgctaatgaaaactgttacatttacagatgtcagtgaacccatacatgct

SEQ ID NO: 596 - DNA, 121 bp, Artificial Sequence
  Synthesized
  misc_feature (61): n=a or g
gctaaaagaaatggaaacagaattatagtatacagtactaagtaggaacattttaaaagcntggattcatctaataaaatacagtgaatgtcaaatctttagctacaaggacgctcaagac

SEQ ID NO: 597 - DNA, 121 bp, Artificial Sequence
  Synthesized
  misc_feature (61): n=t or c
ggcagtgttagcgtttgtaccaactctttcatgggagataaatctgaaactgaccattgtngcattaggactaatctgtaatgaacggtaagatggggcagatacttctctgtctcttctt

SEQ ID NO: 598 - DNA, 121 bp, Artificial Sequence
  Synthesized
  misc_feature (61): n=t or c
ttcactggtaatctctattctggaagagaaggtagaaagcagccctccaatgaaataactncatatcctaatttaaaacaatagttcagtgaatggggcctcctgtctcctcccctgctaa

SEQ ID NO: 599 - DNA, 121 bp, Artificial Sequence
  Synthesized
  misc_feature (61): n=a or g
ggctgtggcttttccatatctaacatttgagcagcagatggagcaaaggaccagacaaatncttgctggatcgctgtgctccaaaaaggcgaagcagaggaggaggctgttgcagcagtgg

SEQ ID NO: 600 - DNA, 121 bp, Artificial Sequence
  Synthesized
  misc_feature (61): n=a or c
actttgaacttatcttggtatttgcacaagatgttctcactttataaattaattgacctgnggcatggaaaaaaatactaaatcttctggtggttagtatagactaatataactactgcac

SEQ ID NO: 601 - DNA, 121 bp, Artificial Sequence
  Synthesized
  misc_feature (61): n=t or c
tataaatactgtaaatttgatttctctagctctgactgaatagttccatatggtttcaagncacggtaatatataaacctatcacctctgaacttcagatcagttattaaaatgattgttc

SEQ ID NO: 602 - DNA, 121 bp, Artificial Sequence
  Synthesized
  misc_feature (61): n=t or c
agtacttaccagctgatgattttgtttctgcctgaggccagaggcatgtgctttctcgttngttgcttcttaacgtcattgcctttgattgtgagcttgtcatctttgtgtttgcagtcat

SEQ ID NO: 603 - DNA, 121 bp, Artificial Sequence
  Synthesized
  misc_feature (61): n=t or c
tggctgtgctctgctgccgcagcacgcacaaggggactcgtgtagatgtgcttagctttantgcctcactgttgcacctattggccttagtgatacagaacgtggaagcaaaggaagaacc

SEQ ID NO: 604 - DNA, 121 bp, Artificial Sequence
  Synthesized
  misc_feature (61): n=c or g
cagctaggaaaggagcacagtggatgttgcaaaaagtgcagcaagacacaatttttcttcnaagggaatttacttctccattacaagtctcactatatacaaatagttggcttgttattgc

SEQ ID NO: 605 - DNA, 121 bp, Artificial Sequence
  Synthesized
  misc_feature (61): n=c or g
ctcagaatttatagcatgggcaaacagcggtacagtttagcttgcatatgagctgtttatnaatctttgggtttccccttttgagtcagtttttttctcttcttctgagttatttttccat

SEQ ID NO: 606 - DNA, 121 bp, Artificial Sequence
  Synthesized
  misc_feature (61): n=t or g
attgagtccaactgccttacctcttcagggctaaccaaaaattaaagcattttgttgagtncattgtacaaaagtctttttttaaagtagaactggtgaaacgaggacttttctgcatatt

SEQ ID NO: 607 - DNA, 121 bp, Artificial Sequence
  Synthesized
  misc_feature (61): n=t or c
actattcttaccattctatgcaaagaccataagatatatggttatgatataactcttatanacacaggtacttatattaagtgctttgttttccattcacttccaaacaagattttcccat

SEQ ID NO: 608 - DNA, 121 bp, Artificial Sequence
  Synthesized
  misc_feature (61): n=t or c
atccttgcccctttaatgagacgtatagtgattagagcattaaatattgcgcttcattcangtacaaacagtccagagctgagtaatgctccatcagtgcaggaccttagtaacgtaggag

SEQ ID NO: 609 - DNA, 121 bp, Artificial Sequence
  Synthesized
  misc_feature (61): n=a or t
acaaagtacaatagcttagtcaagtcagtacacaacttttatcttacacttgcacattatnatgggcttcataggttccctagcaaatactgagacagtccacaggaactttgaattttat

SEQ ID NO: 610 - DNA, 121 bp, Artificial Sequence
  Synthesized
  misc_feature (61): n=t or c
aaattgatgtatgccacagcacagaagggtatattacacgtaataaaaccattgtcagaanagtgtaaggaatagtatgtggttcagtatttagctgtgacaactcccagttatttgcagt

SEQ ID NO: 611 - DNA, 121 bp, Artificial Sequence
  Synthesized
  misc_feature (61): n=t or c
taaaaggctttaatatttggtttagtgtattaattttaagatattgaccaaagccaggtangtactttccaactatatggcttgagctctggaagtagtgtgaatgttttaactcatattg

SEQ ID NO: 612 - DNA, 121 bp, Artificial Sequence
  Synthesized
  misc_feature (61): n=t or c
cacctttcaggttcggcctcttggcaattaatggatggattgaaagcctgctagaaaatgnagtgctttagcactgcagcactactccatttagtactttgcaagtgggttgtaaaaattt

SEQ ID NO: 613 - DNA, 121 bp, Artificial Sequence
  Synthesized
  misc_feature (61): n=t or c
acttcccacaatcaggttccatttctttagattaaacagtactgtgaattatgccagcctnaacctccacttggttaagacactagaggggaataaaagcatccttctttgagttaattca

SEQ ID NO: 614 - DNA, 121 bp, Artificial Sequence
  Synthesized
  misc_feature (61): n=t or g
cagttgcctgttgaatcactacaggcatgttgcagctcactctacaagccaccggacagcngcaacacatgtccacgcagggactgagacacttgaaacatgtttttttcccctctttctt

SEQ ID NO: 615 - DNA, 121 bp, Artificial Sequence
  Synthesized
  misc_feature (61): n=t or g
aagtaagaattgtttatagttctaaaggttctaggtagcatccaagaatacctcttacagngcacatcaggcatgtaggctgggcctgtctctgagtgtgttggatcttgcttaaagctct

SEQ ID NO: 616 - DNA, 121 bp, Artificial Sequence
  Synthesized
  misc_feature (61): n=a or g
gagctgcatggagatggggtactttggctgtgagtttcacaagcatacttaaacaatagtngaggaatgatgaaacttgtgaatctctgtgttcagtccaggaacagtatgatttaccgag

SEQ ID NO: 617 - DNA, 121 bp, Artificial Sequence
  Synthesized
  misc_feature (61): n=t or c
cagctgccgtgcctgtgttcccacttcacgggcactgctgaccacgtggcatcagctctgnaagtctcccgtcagaagggaaaggtctgcaggggctgatgtcttttgtctcatctctgtg

SEQ ID NO: 618 - DNA, 121 bp, Artificial Sequence
  Synthesized
  misc_feature (61): n=a or g
acagtgtatgtgacctgaattttggagtagcctctaaggctattctcctaatgaaatctcngtgtgctgcgtttcccgcttctggttaactcccaccatccgatgggattgtcagaacctg

SEQ ID NO: 619 - DNA, 121 bp, Artificial Sequence
  Synthesized
  misc_feature (61): n=a or g
gagtggtcaaacactgatgctccatgcctatcagtgtttcagagtcattttgttaatgccntaataatatgctttaacttctggtttaccatgaaatggtcaggcatttggactcaatgat

SEQ ID NO: 620 - DNA, 121 bp, Artificial Sequence
  Synthesized
  misc_feature (61): n=t or g
atcctataatccactgattttctagggagtggactaggaggctgtaagtagttgagcagcnagtcattcccttaaccctcttcctttctctgcctctcatttctaggtagacaataatcta

SEQ ID NO: 621 - DNA, 121 bp, Artificial Sequence
  Synthesized
  misc_feature (61): n=a or g
tcagaacgtagagacaagaaaacccaagggacaagtatgtcgacctccatggatggcaaangacaagtcaaacccctcggggtcatggacgctcttccctcagagttgtggattcagctga

SEQ ID NO: 622 - DNA, 121 bp, Artificial Sequence
  Synthesized
  misc_feature (61): n=a or t
cccttctccatggagagtttaacctgagaagcagaactgtttttccaggtctaaccatggngctactctcacctctgaaacacatgtgctatctttttcattatctattgttagtcttaat

SEQ ID NO: 623 - DNA, 121 bp, Artificial Sequence
  Synthesized
  misc_feature (61): n=t or c
gaataacagtaaaggaaaaataaagttgagctttattgttattacataaaatggatatgangctatactgacagttctaagaagtcaagttttctcatccttcctcctctgaatataggtg

SEQ ID NO: 624 - DNA, 121 bp, Artificial Sequence
  Synthesized
  misc_feature (61): n=a or g
acacgcaacatattttgtctcaacttggcagtacaccgttgctttattgatatctatctcnaagggcattttctcagtctattgttttggtctctgtctcagtagttcacatgttggatgt

SEQ ID NO: 625 - DNA, 121 bp, Artificial Sequence
  Synthesized
  misc_feature (61): n=a or t
cttaatttacattttaaactgttggcagttaatttatcgtaggaatagaagaaatagaagncttcttgaatgctgttgctttttacagtatgtttgtctttgcaattcctattttgttagt

SEQ ID NO: 626 - DNA, 121 bp, Artificial Sequence
  Synthesized
  misc_feature (61): n=a or g
aattgcaagctgacatacaactccaggctctcgcctccaacagcagcctggcaagggaganccaaaagctttgaagatggcagctggagagactccgcccatgcagcatcctgcctatgga

SEQ ID NO: 627 - DNA, 121 bp, Artificial Sequence
  Synthesized
  misc_feature (61): n=a or g
acacttgggctgcgcttgtgaaaccacaaagtgcagtgttcagatagccttaagaaatacntgccccactcttccatggaaaccaaaacatttctagtggtgcacagcaacccaacaaagg

SEQ ID NO: 628 - DNA, 121 bp, Artificial Sequence
  Synthesized
  misc_feature (61): n=t or c
taccaagttatcatgttgcacgtacattgaaaacccaacttacaccttaaaatatgtcagnctttgaatttggcaaatcagtgctgtgtgttcagtctgaggttacactggcctggcgtga

SEQ ID NO: 629 - DNA, 121 bp, Artificial Sequence
  Synthesized
  misc_feature (61): n=t or c
tcatctagtccaaccatcaattcatcattgcaactactaactcaagttcctgaacagaatngtagaagacatgtatgttggtgcagtaagttacagtacatgctttcctgtaaaggcatct

SEQ ID NO: 630 - DNA, 121 bp, Artificial Sequence
  Synthesized
  misc_feature (61): n=a or t
tggatatctatggaaagtactataaacatgatatcatgtcagtgccttaccttaggcatcntgtacctttgcttatcttgctatagactccttgctcggtactgacccctgcctacttacc

SEQ ID NO: 631 - DNA, 121 bp, Artificial Sequence
  Synthesized
  misc_feature (61): n=t or c
tgtacaggagtgtgaaatttaaccttttctgtaaatcaaatgatacttcaaactggtgctngtcccagaaaacaataaactatttctgatttgcatcctagcccaccttgatggctgaagg

SEQ ID NO: 632 - DNA, 121 bp, Artificial Sequence
  Synthesized
  misc_feature (61): n=t or c
gctcttttctccagcctttccagtaacgccactgagaaggttattttttttagatcaatcnaatccaagcgcagctgaggtagcttcgactccatttctatagcatctaactgtctgagca

SEQ ID NO: 633 - DNA, 121 bp, Artificial Sequence
  Synthesized
  misc_feature (61): n=t or c
taatacacagtacctaaattaatgctttcatgctctgcctttgcaccatgcatgacatacnctcctgcgaaataaattactgtatcttcacagtggaacaagaaatgggaacatacattac

SEQ ID NO: 634 - DNA, 121 bp, Artificial Sequence
  Synthesized
  misc_feature (61): n=t or c
caagatttggctgttagtattatttaagttctatttactgagtgtgaacatttcagagtgnatgttccctccaagtcacagagatgttaaccagtggtgtaactgcattgcagcatcagaa

SEQ ID NO: 635 - DNA, 121 bp, Artificial Sequence
  Synthesized
  misc_feature (61): n=a or g
caaggacatttattttctgagactttctccatcacttcctagaactaagtgaaattgaganaacatggtggaaggaattcttgaatagccactcgaaatgagtttcttgagagctttcttt

SEQ ID NO: 636 - DNA, 121 bp, Artificial Sequence
  Synthesized
  misc_feature (61): n=t or g
atcacattaaaagctggcctttgtatcctccttgggacttgcttttatgaaatgaacatanaagtcagaccgagttaatccaaatcgttttgaaaattgaggtctacaggcttttaaaagc

SEQ ID NO: 637 - DNA, 121 bp, Artificial Sequence
  Synthesized
  misc_feature (61): n=a or g
ccaaagatgtatagactttgaacagcatgccacaattcaagaagcttagagtccctcatcngcttgaattaaaccatctgtgaagaaaaatggcttccagcttctagttcctgaggaagta

SEQ ID NO: 638 - DNA, 121 bp, Artificial Sequence
  Synthesized
  misc_feature (61): n=a or g
tcaaattattccttcaatctctgcataagagactgcatcgtgaaagtgctttatgttcccnacagagttttatgaaattccataggaaatccttatagttccttttcagcttgggatattc

SEQ ID NO: 639 - DNA, 121 bp, Artificial Sequence
  Synthesized
  misc_feature (61): n=a or g
taggcaaactagaggttcaatctatgacaagtgaacattgttgttctgccttctgaacttnctcccatttctagcagatgtgcccctggctttggtgtcttctatttctgctgctgggatc

SEQ ID NO: 640 - DNA, 121 bp, Artificial Sequence
  Synthesized
  misc_feature (61): n=a or g
agaaacaagagggagaactgtctaaatctgtgcccctgccattgaataggatgtcaagtantggaggcaagacacgttgccttccttatttctctcctctccattgcaagatgcccagctt

SEQ ID NO: 641 - DNA, 121 bp, Artificial Sequence
  Synthesized
  misc_feature (61): n=a or g
tttcatacagttgctgaaacacagagctcacaccttctacagatggggagggagcaaaacnaggttcccaagacacctgatttcctgaagtaccaacacctggaaactgctccttgccata

SEQ ID NO: 642 - DNA, 121 bp, Artificial Sequence
  Synthesized
  misc_feature (61): n=a or g
cagtcatgatccaccaacgactcggagaggtttgtggagacctgaagttgttgaaaaaggnaagaagagatagggagagagaaaaaaacttttagaaaacactggaggtaacatgagagct

SEQ ID NO: 643 - DNA, 121 bp, Artificial Sequence
  Synthesized
  misc_feature (61): n=t or c
tcccttcctcagcaaaagtcaagcaagtatgtctgtgtcctacagtcaggcttattataangtgtatatatggagttcagtaagtaactgaagcttagatacttgtgattcaacctgacgt

SEQ ID NO: 644 - DNA, 121 bp, Artificial Sequence
  Synthesized
  misc_feature (61): n=c or g
cccagttcaagttgtatgaatgggtacacagctcaagtctcttcttaaacaaaccaatganagaaatcattagcataaactcactaggtattatttactgaaaagcaaacaaacaaacata

SEQ ID NO: 645 - DNA, 121 bp, Artificial Sequence
  Synthesized
  misc_feature (61): n=t or c
cttgaatttctaagcttaggacagtgatgagaaacccaaggttgtctgtcaggtcttggcnccctatgtcttttcactagctagaagatgctctgtatcaccttctgctttcttgatctct

SEQ ID NO: 646 - DNA, 121 bp, Artificial Sequence
  Synthesized
  misc_feature (61): n=a or g
cctgttcaacacaagcctaataaaatgtttcagttttgctacccttgctaaatgatggctncagagctatggtgttttgttggcaatgactgatggagtttttcaggatgaaatatattaa

SEQ ID NO: 647 - DNA, 121 bp, Artificial Sequence
  Synthesized
  misc_feature (61): n=t or c
tcaagatctggggcctagcttcaggcagctacatggggaagcttaaaaaccaaagagtctnccatcttgtctcccagattcagtcagcctgcagctatggaaaatacaaatctagaagaat

SEQ ID NO: 648 - DNA, 121 bp, Artificial Sequence
  Synthesized
  misc_feature (61): n=a or g
gaaaattatttctgctgcctagtttaggcttcacatccacagatacgtttaggacacatcncccagatagagagcggagttcagtgctgcatgtcttctctacaatccatttttacctcca

SEQ ID NO: 649 - DNA, 121 bp, Artificial Sequence
  Synthesized
  misc_feature (61): n=a or g
gaaaatgaatttggtggtttgcatactagtggacttctgtcaacactgaaaaaacaccctncagtccaacacaatgagaaccttttgcttgaaagaaagcctggactggaataccagaggt

SEQ ID NO: 650 - DNA, 121 bp, Artificial Sequence
  Synthesized
  misc_feature (61): n=a or g
tgctgcagcctcacagtgttagtttggtcccttgttgaaacagtagtagtccttacacagnctgtgctggctttgaatttagaactatttaggattctaaacaatgatgcggattgattgc

SEQ ID NO: 651 - DNA, 121 bp, Artificial Sequence
  Synthesized
  misc_feature (61): n=t or c
attgtttttgtgaattgtgctttagagaggatgttgtagacaacaaattagagtgaggganaatgtaaagttctgatgcaaatactttacatcatacttcactgtacaggaagtgctgcat

SEQ ID NO: 652 - DNA, 121 bp, Artificial Sequence
  Synthesized
  misc_feature (61): n=t or c
tgcattcatcattggaaaggaaaaacattaaaaaatcacatcttaaagttttctaatgcantgcattgaaaaaggcagtacaaaataccaatttaaccaggagattttgatgtgtggtgga

SEQ ID NO: 653 - DNA, 121 bp, Artificial Sequence
  Synthesized
  misc_feature (61): n=t or c
gcagtgtgtacctgggagcttggaggatccaaagactgtgacacatcataagttgatacangctacttctgagaaggtgctaacagactcaaaaacagtgttggaggaaaacattcaagac

SEQ ID NO: 654 - DNA, 121 bp, Artificial Sequence
  Synthesized
  misc_feature (61): n=a or c
gtaagtgtacgttaccctcatttgaggggggggaaaaaagtcccaaaggacaaaaccagcncacatctctgaagcccgagatgcagtttgctcagtgccttttgaactgtcagtcagtttc

SEQ ID NO: 655 - DNA, 121 bp, Artificial Sequence
  Synthesized
  misc_feature (61): n=a or c
atattatgttcccaaacctgataacctgggctgcagggctacgtcggccagcaagttgacnactgtgtccaagcctttggcatcagcagaaacagcatacatgatggtgtccctgcaaggc

SEQ ID NO: 656 - DNA, 121 bp, Artificial Sequence
  Synthesized
  misc_feature (61): n=t or c
acatatttaacagctctttaagtagcaaagcttttgtgtcgtgctagatgtcaggttttanttcagctgataaaatgtgccttaacagataacccaagagaggcttcaagaaagtattagt

SEQ ID NO: 657 - DNA, 121 bp, Artificial Sequence
  Synthesized
  misc_feature (61): n=t or c
agcagttagcagccaggatacccatcagtgccaactcgaacagtgccacgagagctgatantttccttaaaactgtggattcaaatgtgcaaatcccacatcttaaaaccaagagaggctc

SEQ ID NO: 658 - DNA, 121 bp, Artificial Sequence
  Synthesized
  misc_feature (61): n=c or g
gaaagaagcagaggaacttcagcactgtaacaactacgttaaaaacacagcctcagatgtngctgctctatgatgctgatcatctgctggaatcagaagaactaccttgccataatggcat

SEQ ID NO: 659 - DNA, 121 bp, Artificial Sequence
  Synthesized
  misc_feature (61): n=t or g
tctaggcttacaaatcatcttactcttcaccagaaacagtttctagtgagggtcacagtcntcccaggatttcttgtgctaacacaaagtgcatacaagaagaaaaggaagagcctttcta

SEQ ID NO: 660 - DNA, 121 bp, Artificial Sequence
  Synthesized
  misc_feature (61): n=a or g
acatactgaagagaaggaaaaaattttatttaaaaaagagattgcaattttctggattggncagaggtaaaaacagagaaaatgaaaggcaaatgttttctggctttagaatattgtctaa

SEQ ID NO: 661 - DNA, 121 bp, Artificial Sequence
  Synthesized
  misc_feature (61): n=t or c
tgtagcagaaagagtcaacatagcatgctgcctctttcccagggggccagcaggaaagttnctgtgccttcagtgggtctgccttaccagaactacacagactcactctgagatgggagtg

SEQ ID NO: 662 - DNA, 121 bp, Artificial Sequence
  Synthesized
  misc_feature (61): n=a or g
gagaggcagcctcctactgtatctaaattcttttgccattccattcaataatacacttaanccagcaagcttcatcttttacacaggccctactagtcagcaccacatggaaaaaaaagtg

SEQ ID NO: 663 - DNA, 121 bp, Artificial Sequence
  Synthesized
  misc_feature (61): n=t or g
gccaataaagccaataaaatatttgagttttaaaccaactaggacttcaggaatttagtgnttcagactcacatgtgttaattttccctagacactaatatcagcaaataagcatgaaata

SEQ ID NO: 664 - DNA, 121 bp, Artificial Sequence
  Synthesized
  misc_feature (61): n=a or g
tttaacggacaagatccaaagtccccccagagggggttttgaggtttcttgtttttcatcngggtaaatttttgtgccatttggaaggtttcccaaccatactttgagctcactgtattaa

SEQ ID NO: 665 - DNA, 121 bp, Artificial Sequence
  Synthesized
  misc_feature (61): n=a or g
ggtgggaataaaaggtataacttcactatgtaaagatctctctcctgtctgacaaaagatntgtaaaagctgacagcacatatggctgctgtgtatggcactgtttaccccaccttttata

SEQ ID NO: 666 - DNA, 121 bp, Artificial Sequence
  Synthesized
  misc_feature (61): n=t or c
gcattgtgtcaggcaggctgccactatgaagctctcatactgctttcctgagccatttcangtgtgacctgcaggagacatgctgtctagaggtggaaggtgtcagtttctagacaagtta

SEQ ID NO: 667 - DNA, 121 bp, Artificial Sequence
  Synthesized
  misc_feature (61): n=t or c
gcaattccttgtgaggaaagattagttcagtgatacctacaatttttagctgatctttggntccctttaagaaagcaacatgtcacataaagttacacgtattgaactgacacttccaaga

SEQ ID NO: 668 - DNA, 121 bp, Artificial Sequence
  Synthesized
  misc_feature (61): n=a or g
tccagtttctggttcaaccaccaggatggggtgggaaagaaaacctgtccagctgcagccncttcgttccgtgttggtccacagacattcctcttctcatccacatgtgctgggcacatgt

SEQ ID NO: 669 - DNA, 121 bp, Artificial Sequence
  Synthesized
  misc_feature (61): n=a or g
atctgtaatcaccctactaccatacatactatcgctactgaaacactacagaactcatttnctagctgtgaagtcagctgttacaaaagcttgctcatgtgcaaatccctgcctgcatttt

SEQ ID NO: 670 - DNA, 121 bp, Artificial Sequence
  Synthesized
  misc_feature (61): n=a or g
tgattttgcaagtgttccctaccgttccaactgcattcatttgcagctcgtgtcttacacngtaaataccagcgaagttatgcacctccatttaccgcccgccccactcctgcatgaatcc

SEQ ID NO: 671 - DNA, 121 bp, Artificial Sequence
  Synthesized
  misc_feature (61): n=c or g
agggtgaggcctcttgtccacttgtacttaaaagtcaaattagccaacctcccaccattgnggagtgaaaggaggctgcctgcaggttggtgaggcttgttctctacatttcctgcagcat

SEQ ID NO: 672 - DNA, 121 bp, Artificial Sequence
  Synthesized
  misc_feature (61): n=a or g
aagtgctctcccacatcttacatggactttttttgcttagacttttgccctctggagcttncattcattgctctttgcatacccaaggcaccagacacttgttaactgaagccaccagctt

SEQ ID NO: 673 - DNA, 121 bp, Artificial Sequence
  Synthesized
  misc_feature (61): n=a or g
atatttgtattatgaattgggggtgggggtttaacagacaaatacctgtttgtgtattgcntgaaatcaggaaagttcgacatgacaaattggagacaggaggagaaagaatttcccacac

SEQ ID NO: 674 - DNA, 121 bp, Artificial Sequence
  Synthesized
  misc_feature (61): n=t or c
aaattcagatataaaatgagatgtttatttaaattgtatttcttgcttgctcatttaaatnacgattgaaaacggtgatctaccacacagatgtgaatcaatccacacctctggataaagc

SEQ ID NO: 675 - DNA, 121 bp, Artificial Sequence
  Synthesized
  misc_feature (61): n=t or c
ccagtgtatttatgaggtaacgtactttaccggggatttgccaattcatgcagaactgtgnatttatgaccccttgtatctcactcctccgtggctcagagacaggcataggccgggagct

SEQ ID NO: 676 - DNA, 121 bp, Artificial Sequence
  Synthesized
  misc_feature (61): n=t or c
ttcccacaaaacctaaactcagttgcctttcccagaggtgttagtaactcagtgtgtcccnacatcaggcagaggcaggatcctttgattcaataggtagctcttcctgctgagctgcctt

SEQ ID NO: 677 - DNA, 121 bp, Artificial Sequence
  Synthesized
  misc_feature (61): n=t or c
ctccaagtagtggccatctacaaacactacagacatgccatatcctaagttaaaaaccccnggagagcctgtgatgttagatggcagaacgttcagcggcttcaccaaatgttaggtttgg

SEQ ID NO: 678 - DNA, 121 bp, Artificial Sequence
  Synthesized
  misc_feature (61): n=a or g
cataagagctagacacttgtcaagattctttggtcaagtttgttgtcaagttgacaacacntatcaaagaacaaggttactcatccatttttcaaatgctgggcagaataccactgtaaca

SEQ ID NO: 679 - DNA, 121 bp, Artificial Sequence
  Synthesized
  misc_feature (61): n=t or c
cacgtgcacttgaaagagactattcaaaaaagttcatcaggagcatttaattcactacagnatacacaaaactgagctgagaaagaagcaagaggtgaaggttccaagcattccacctatt

SEQ ID NO: 680 - DNA, 121 bp, Artificial Sequence
  Synthesized
  misc_feature (61): n=a or c
tgggaagggagaacaagtgaagattgaatgacagcatgctccttgaacagaatcatctccntgctcttatgatcagaccctgtcctacttattaggcattattgtatggatctcttaggtg

SEQ ID NO: 681 - DNA, 121 bp, Artificial Sequence
  Synthesized
  misc_feature (61): n=a or g
ctaggatctcccatgagacagtgtccctcttttcttactttcagacactaacagagctccngcatctaaatctgttcgtatttactcctcctgccccaaccctattcctgcaacaacaccc

SEQ ID NO: 682 - DNA, 121 bp, Artificial Sequence
  Synthesized
  misc_feature (61): n=t or c
gaagttattgacaatatcatttgaaatgccacatgacttcacagtagggtctttccattanactgtcattatattgctgatgtgcccatgctgagtaaaaacaaagattggtaaagaattc

SEQ ID NO: 683 - DNA, 121 bp, Artificial Sequence
  Synthesized
  misc_feature (61): n=a or g
tttctttaggtatgggaaaattgtatcaacaaaggcaattcttgacaaaaacacaaatcantgcaaaggtatgttcaaaaagtttgccttgtgagttcattatttgagtcactggtggctt

SEQ ID NO: 684 - DNA, 121 bp, Artificial Sequence
  Synthesized
  misc_feature (61): n=a or g
gttaagagaagtgaccacagatagatgtttaaattgcattgctatcttcttagcaaaagcntaacttgttgtcagggaagaaatcttatgttttgatacttactttctcctttcaaacaaa

SEQ ID NO: 685 - DNA, 121 bp, Artificial Sequence
  Synthesized
  misc_feature (61): n=t or c
aatcacagatgtcagtctatcatccaacataattctgttcctcacctacaccacataaaanagccattacttctccctcttcattatttacctttgaattaccttccttgtggtgtttggc

SEQ ID NO: 686 - DNA, 121 bp, Artificial Sequence
  Synthesized
  misc_feature (61): n=c or g
aacatgttgaaaacaattctacatttaggcccgagctactaatttacaacaaattctgcancacgtgttaagagaggttgcctctttaaatacatcctggtcaagtgttggcagtctctgt

SEQ ID NO: 687 - DNA, 121 bp, Artificial Sequence
  Synthesized
  misc_feature (61): n=a or g
cataagcaggagctcaaagagatgaggaaatggttccagtgtatgagaaaacaacccatancagtgctgcgttagctgtgttaaactactgtgctcacacacatggtgatatattaaaatt

SEQ ID NO: 688 - DNA, 121 bp, Artificial Sequence
  Synthesized
  misc_feature (61): n=t or c
cttcaccagccagccacttccccagacaattatttcccactttgcattatgaaccccaagngggttatgagtctggcagcattttgtgtgcaagtaaatgaaaagttttaagaaggacgct

SEQ ID NO: 689 - DNA, 121 bp, Artificial Sequence
  Synthesized
  misc_feature (61): n=a or t
caggtttgttcgctccagctctagcagaggtgaatcagtctcagctgcttactcagtgtcncactctgtacagctcttcagcgctatggtgtaacatccaaacaaattctgaggcagccag

SEQ ID NO: 690 - DNA, 121 bp, Artificial Sequence
  Synthesized
  misc_feature (61): n=t or g
acatgacttccccttcctcacacttcagttaggcaccggtaaatgacagatgacaagtctnacactgagagtgatcattgtttaaagtgtaatggaaagtgttttgaaatgttagcaaaaa

SEQ ID NO: 691 - DNA, 121 bp, Artificial Sequence
  Synthesized
  misc_feature (61): n=a or c
cacatttcttgtcagtcgtgtgaattacttttgcaatcatctttcttaccagttaccaatncacatgtattaaaggaaatttaaagtgaaataaatgccagtgtttaactgagtattcaga

SEQ ID NO: 692 - DNA, 121 bp, Artificial Sequence
  Synthesized
  misc_feature (61): n=t or c
agcatccaccacatcaggcccactgaatgtgctccctgcaacaggagaataaggttacatnaagatcggctccaaatataagcctttaaatgccttccccctcccctgccctcacacacct

SEQ ID NO: 693 - DNA, 121 bp, Artificial Sequence
  Synthesized
  misc_feature (61): n=c or g
agacagtacattttgggcccatttccacttctatactgacatgagatctacagttttccanaagcaaaaggcaaacatctcacctaaagccctacaagagagtaactgaactactgatgat

SEQ ID NO: 694 - DNA, 121 bp, Artificial Sequence
  Synthesized
  misc_feature (61): n=t or c
ctgttttaattgttggtgtgttgttttttccagccttttcagctgcaagggttttagattngtaccaaaaggcttgctcttgggttcagtacagtcagccaaatagccttctgtgttagtg

SEQ ID NO: 695 - DNA, 121 bp, Artificial Sequence
  Synthesized
  misc_feature (61): n=t or c
tgtgctggtacaccccatgtgcttgtacgcgtttataggctgcagatcagagtacccaggnttttcttaatgctgtcaggagtaaaacagtgttgcactgtgccatctgaagcagaactgt

SEQ ID NO: 696 - DNA, 121 bp, Artificial Sequence
  Synthesized
  misc_feature (61): n=t or c
gaaatgtaacacggagcgcagatgtgagaagggaggctaagtgcactagagccagcagtgnttggggaggttttgtaggtggtcgttacgcattcatgtgggaggtgaacatctggttgca

SEQ ID NO: 697 - DNA, 121 bp, Artificial Sequence
  Synthesized
  misc_feature (61): n=a or g
cttggcgtgttaaagttcatacatagttggtggttttttttagtatgtatggagaaccctntgtagaatgcagcaggactggaagttgtggagggctgaccattttcagaatggacacaaa

SEQ ID NO: 698 - DNA, 121 bp, Artificial Sequence
  Synthesized
  misc_feature (61): n=a or g
acagacagggaaagctgaagcaaagatgtaactcagcacctctttcatctgttccctacantcacatattgcaagggtgatgtttattccgggagatgaatgaatacacttctcacgtcat

SEQ ID NO: 699 - DNA, 121 bp, Artificial Sequence
  Synthesized
  misc_feature (61): n=c or g
aaaatgtcatcaggccaaaagatggtactttcagtagccagagtaatgacgtataataatncataataaaggtgattaaaataacaaaataggactaatactctcaaagattttgacccac

SEQ ID NO: 700 - DNA, 121 bp, Artificial Sequence
  Synthesized
  misc_feature (61): n=a or g
atgacaataagcattatgttaaactaacatttcctggattagattcctagggcataatttntaaataataattaagaagttgtatttgcattttttatatacttatttcagcacaccttta

SEQ ID NO: 701 - DNA, 121 bp, Artificial Sequence
  Synthesized
  misc_feature (61): n=a or g
cgccctccagctactgaatatgtgactgaaagtgaagtcaggccacacatgacagtgcacnaagaatagctggagatcgattgagtgtccagataattaggacagatttgatatttgtatc

SEQ ID NO: 702 - DNA, 121 bp, Artificial Sequence
  Synthesized
  misc_feature (61): n=a or g
ctattctggtctatccaggtttcaagtagtgtgagatttgctgaatccataattcagtgtntgaagtcacagactgacctgatgatgtgccaaaacagcagagagaatccctgcaagacaa

SEQ ID NO: 703 - DNA, 121 bp, Artificial Sequence
  Synthesized
  misc_feature (61): n=a or g
aataaactgggaatgtgctgtatcgcggaggtatactgggtagttgatagttaactcagtncaggctgacagctgtgcacagaataacttcttggggtttttcttttttttgccctgacga

SEQ ID NO: 704 - DNA, 121 bp, Artificial Sequence
  Synthesized
  misc_feature (61): n=a or g
tggaatagatatcctgggccacaggacacttggagagaatttacagtgctcagatttaggngtggaagaggattccacggagcaaagataacaatttccagggatttcacaaacaattctg

SEQ ID NO: 705 - DNA, 121 bp, Artificial Sequence
  Synthesized
  misc_feature (61): n=a or g
attctattcctcaaagcctttcctcctaatctgtgtatgtacttattctccttgtccagcntgtgcaactcagtcagataacttggagacttatttgtgtgagtggtctcatgaaaatacc

SEQ ID NO: 706 - DNA, 121 bp, Artificial Sequence
  Synthesized
  misc_feature (61): n=c or g
gagcctctgggtgagtctgccagccttagtgcaccttctgtcacgcatggatacctgctgntctctgctctgctctgtgacgatggcttctgtcagggtgctaggctcaagcctaagtaca

SEQ ID NO: 707 - DNA, 121 bp, Artificial Sequence
  Synthesized
  misc_feature (61): n=a or g
catctgtctcccaggctttagagttttcctcgaaatttttgcccaatccggtttgaaactnttaaggcaacagtactatgatacactcaagaaagacaccaaaatcctttcagtcttcatc

SEQ ID NO: 708 - DNA, 121 bp, Artificial Sequence
  Synthesized
  misc_feature (61): n=a or g
tattcaccttgttcctatgaggaaagctcctaccacgacttatgaaggcgcctcaaaaacngatagaaggatacatttttctaacagaatcctaactgtagaataacttttgaatccgtta

SEQ ID NO: 709 - DNA, 121 bp, Artificial Sequence
  Synthesized
  misc_feature (61): n=a or g
cctaattctatgtgctcacagttggcccaggcctcttgcccagaaaagcgcatggaaaaanaaaaaactttgcctccaacatattgacaaaggtatgctaagttatttatgttcattgctt

SEQ ID NO: 710 - DNA, 121 bp, Artificial Sequence
  Synthesized
  misc_feature (61): n=a or g
tggtcttccaggacagtagttggaagacgattggaataatatgtttttgtaaactatgaanatctactgtagagttacattaagacaaagaatgggaatctcatgacacttttgtagtccg

SEQ ID NO: 711 - DNA, 121 bp, Artificial Sequence
  Synthesized
  misc_feature (61): n=a or g
cttactgaaaagatatttaccttgtattgaaatctgctgtatggttgatactttcagttancaattaatcttaatgattcttagtatttctgttgcaaatgaagatcagggatagatgggt

SEQ ID NO: 712 - DNA, 121 bp, Artificial Sequence
  Synthesized
  misc_feature (61): n=a or g
tttacacttcacaatctttgcttgaactgatcaatgctacctccaactcagcacagcagcngggagccatggttgagacacacagtaaccaagagctgggctcttccccaagagcttctcc

SEQ ID NO: 713 - DNA, 121 bp, Artificial Sequence
  Synthesized
  misc_feature (61): n=t or c
actccccacctgtagtgaaagatcccccaggactgcattcacagtacctcctgagttccangcacatcacagctccagcactcctagggaacctgacagcactcctagggaacctgacacc

SEQ ID NO: 714 - DNA, 121 bp, Artificial Sequence
  Synthesized
  misc_feature (61): n=a or g
tccaaaagcaaaactgactctgttaaaaagtgtgcttctccctgacctacctttccactgngagataaccctcagaccgagtgggctgactctattgagaaatactgattgctttcttaga

SEQ ID NO: 715 - DNA, 121 bp, Artificial Sequence
  Synthesized
  misc_feature (61): n=c or g
caaaccactttggcagagcaggagagatcaaatcaaagtgaacattcctctgcaaaaatangaacaaaattatcactgtgacttcatccatccatcagccattttaaaccacgcaaccctc

SEQ ID NO: 716 - DNA, 121 bp, Artificial Sequence
  Synthesized
  misc_feature (61): n=t or c
cagaaagaatggtactgtaggaatctaatgctttaaaaatgaaatatgctgattagtatgnttacatgaaaccaatacaacttaaaggaaagagaaagtaaagaattggagtaaatccatt

SEQ ID NO: 717 - DNA, 121 bp, Artificial Sequence
  Synthesized
  misc_feature (61): n=t or g
tgtgatgtgtattttgagaatgcttttgttcaggttccttgatcctaatgagctattcatntataggttttcttaattgtcttgggtaaaatgctatttcacagagaactcccagatttca

SEQ ID NO: 718 - DNA, 121 bp, Artificial Sequence
  Synthesized
  misc_feature (61): n=t or c
aatcaggagaacgctgctcgcacccactgcaccccctgtatgagatgcgtagtgtctctgncgcctgcaaaagccacactgttgttttttctctactacagcccaagccattgcatattta

SEQ ID NO: 719 - DNA, 121 bp, Artificial Sequence
  Synthesized
  misc_feature (61): n=t or c
ctgtaaattccagactaagtggtctgaagggaagggatattggcaacttagtcacacgcangtagttagcttctttctcgaaggtgatatcactgaaaagctttttggctaaacaaccatc

SEQ ID NO: 720 - DNA, 121 bp, Artificial Sequence
  Synthesized
  misc_feature (61): n=t or c
ggagccctaaatgtaaaggtaaatccctaaaaaggccaccattcaaagatatttccacctnctgagcaaaagaaacacctgtgaagaatttagttgagataccagaaggaacacgttacct

SEQ ID NO: 721 - DNA, 121 bp, Artificial Sequence
  Synthesized
  misc_feature (61): n=a or t
tctcaaactaaagccttagaagagcatttaagggacctctggagtagatgcttatgcctcngatagagagtagatgctgcctgttttcccagctcactagagctacacctctgtgcttgag

SEQ ID NO: 722 - DNA, 121 bp, Artificial Sequence
  Synthesized
  misc_feature (61): n=t or c
acagaagtgccaacacagcaacattgcggggctgtgtagtgatggggagtcccagcctcanggtactgcctcacctacaaggctgttcttattgtgtatatacatgccagatgtgagtaca

SEQ ID NO: 723 - DNA, 121 bp, Artificial Sequence
  Synthesized
  misc_feature (61): n=a or g
tccacggccatttgggatgagattcataaatcctatttttgctccttttcatatttaaacntgcagaagtgcagagcacaccataaattcatatactccacaaatttcctgtttgctaatc

SEQ ID NO: 724 - DNA, 121 bp, Artificial Sequence
  Synthesized
  misc_feature (61): n=a or g
ctttttcatgttcgcttctggctgtcagtcaaacggcaataaaatcagttccaattaaggngatatgcaaggaatttcatgataacgtcaacactccatcaatatagggataaagaaatta

SEQ ID NO: 725 - DNA, 121 bp, Artificial Sequence
  Synthesized
  misc_feature (61): n=t or c
taaatagatttgttctaatcagggtgttcatcacaagaatgctttggtcaatgccacaagngtctgagcacctgcactagagggaacatgtggagagaaagaatactcaaaggtacagtct

SEQ ID NO: 726 - DNA, 121 bp, Artificial Sequence
  Synthesized
  misc_feature (61): n=t or c
gctgagccaggcttgtaatatttaatgtaccgtttgctcctctcacttacttatccatgantgcaaaagacaatttggtagtgagtgttgcctgtcctctcccagttattcattgtggaca

SEQ ID NO: 727 - DNA, 121 bp, Artificial Sequence
  Synthesized
  misc_feature (61): n=t or c
aagccaagctggtcccaaagaaaggttattcaaacttaactcccttgggagtctatactanaaaagttttatataaaaaatatttgtttgggaattttttagaaaaaaagtaaaaaaaaaa

SEQ ID NO: 728 - DNA, 121 bp, Artificial Sequence
  Synthesized
  misc_feature (61): n=a or t
cttacacctatactgtatgtaaaaattaatctcagatttactcaattttactcgatccacntgtgcactcatttttatgtgccacccatttatcaagagaatctgcagtgttgatattttg

SEQ ID NO: 729 - DNA, 121 bp, Artificial Sequence
  Synthesized
  misc_feature (61): n=a or g
tgccctcactgtggccctgctgtagatgtcaggtatttctgatgttcaggctgcctgctcnccctcagagctcaaatcagtgaggtttcatgcagtttctcatagggtagatagcaaagga

SEQ ID NO: 730 - DNA, 121 bp, Artificial Sequence
  Synthesized
  misc_feature (61): n=a or g
ggaataatgcaaagctgatagatgctgcacaaatgtgcagtatgttttatgttgcatcttntttcaaaagcagccacttaccaagaaggattgctctctttgtgatgattgtgtgcttcat

SEQ ID NO: 731 - DNA, 121 bp, Artificial Sequence
  Synthesized
  misc_feature (61): n=t or c
agagtgactgtccatagaatttctcacatgggtaatttcgttaacttgcttaaaaaaatanactgaaacaacgtttgaagttatcctgatcagggagctgagaggggaaaaaatggctatt

SEQ ID NO: 732 - DNA, 121 bp, Artificial Sequence
  Synthesized
  misc_feature (61): n=a or g
ctccatataacttaaaagaaaatatacctttaacaagggctcagtcactgttctgttcacnggttgaaacaaatatcaacttatgaaagctgtcttttaggtattttggctctagctcttt

SEQ ID NO: 733 - DNA, 121 bp, Artificial Sequence
  Synthesized
  misc_feature (61): n=t or c
cttcagatgtacaagataatctggagaggattctctaacctgctacgctaattccaaagcntacgtagtttaacaggagctgtttggggtgtcaggtttttttaatatacaagcaatttac

SEQ ID NO: 734 - DNA, 121 bp, Artificial Sequence
  Synthesized
  misc_feature (61): n=t or c
ctcctcctgttttgtttgctcttgataggattttgtaaaggctttgtttgagtctgttttngcgtattatgatgcccacgtggagtgcacgaagaaaactgtcccaaagcaaggtataaag

SEQ ID NO: 735 - DNA, 121 bp, Artificial Sequence
  Synthesized
  misc_feature (61): n=a or g
ggatcatggaagctcctgagtgaataatgtagcgcttggtaggacaagtttggctcaaaantgagtgttaaccttctttatctatagatatcacagttatactatttcttacataagagta

SEQ ID NO: 736 - DNA, 121 bp, Artificial Sequence
  Synthesized
  misc_feature (61): n=t or c
acttatttattctctgttctgtactagtattcaagatgttaaaaagcagcaataacacaangtgaatttaaagagtgattagtctattctgatggatagactcaatttttgcagcaaaaaa

SEQ ID NO: 737 - DNA, 121 bp, Artificial Sequence
  Synthesized
  misc_feature (61): n=t or c
aatttatcttctcgttttctgacagcatgtcttgctttatttccattggatccccttccantcaaattaggcctcacagaacacctctttctagtgtttgcctacagcttttccaccagaa

SEQ ID NO: 738 - DNA, 121 bp, Artificial Sequence
  Synthesized
  misc_feature (61): n=a or g
gctggctgagacacctgctgactccagagctcacggcacaggctctgcctctcacctctcnccccgtcagcagagcactggaaagcacaaattctgctgagattacgttataatttaaggc

SEQ ID NO: 739 - DNA, 121 bp, Artificial Sequence
  Synthesized
  misc_feature (61): n=a or c
ggccatttcgatgcctacatgtgctgggcaacctctgtggtccagagatgcatgcttgtgntctccctgcaaatagctcatctgtcagatggggcaggggatggatgataggagagaaagc

SEQ ID NO: 740 - DNA, 121 bp, Artificial Sequence
  Synthesized
  misc_feature (61): n=a or g
acacccctaaggtggtacagttgcagtttcaacacaagcattagtataataccatcaagcnagtctacacagtctgtgttctatccttcccaactctatatataaacaagaaaataattaa

SEQ ID NO: 741 - DNA, 121 bp, Artificial Sequence
  Synthesized
  misc_feature (61): n=a or g
tccatttcccaatcactcaccgacatcagctcgcatctccctccggaccttcaatgccagnagctcatcctcgagccgctggttctccagctccacagccatcagcgccgcatcgaggccc

SEQ ID NO: 742 - DNA, 121 bp, Artificial Sequence
  Synthesized
  misc_feature (61): n=a or c
gagctggtgcccaagtgaagacattttatatcctacccacctttaattcgggtaaggcacngtttttgcaggctcttagctttggtgatggtttgttggtgacccagtggaaacagttctg

SEQ ID NO: 743 - DNA, 121 bp, Artificial Sequence
  Synthesized
  misc_feature (61): n=t or c
acacagtgcagagaagcctctcagaacaccaacaagcaccaactgaaccacttccaggcanacataaggaaggaagatacctgctactgtcttaagttctgtgcttagactgccaggggtg

SEQ ID NO: 744 - DNA, 121 bp, Artificial Sequence
  Synthesized
  misc_feature (61): n=t or c
ctagggaaaaaatacaaatctggagaacacagatcctttttctggacttacagataattanttactttgaaggctgataaaacttgagaacagttgctgagttcaatctgttggttattca

SEQ ID NO: 745 - DNA, 121 bp, Artificial Sequence
  Synthesized
  misc_feature (61): n=a or g
ctaacaggaccccctactgctattaattagaagcagaaggtgtttagatctgatggtgacnggcagcagagccaactactgggacagacacacagaatcctaaaagggaagatgcaccact

SEQ ID NO: 746 - DNA, 121 bp, Artificial Sequence
  Synthesized
  misc_feature (61): n=a or g
atttacggtatttctttttacatgcagtctatccagtgaattctaccagtgaagttttgcncatatctttatatacctgtatcaaatcattactccctagggatactagagaatttttcaa

SEQ ID NO: 747 - DNA, 121 bp, Artificial Sequence
  Synthesized
  misc_feature (61): n=c or g
cagaattttgcataattgcatttttaaaattggttcttaattcttctgacactaaaatgtnctgtgcttctatgaagtgtgatctcttcaatttcatcactgaattctttcacaagtatgg

SEQ ID NO: 748 - DNA, 121 bp, Artificial Sequence
  Synthesized
  misc_feature (61): n=t or g
aaaataatggtcacgagaaagaagaccaagaaaaagacatggcttgttatgttgctgcaangccatgcaagcaagaatacgacttaagaagaggagggcaaaatttccacttcagcctgcc

SEQ ID NO: 749 - DNA, 121 bp, Artificial Sequence
  Synthesized
  misc_feature (61): n=t or g
tactacagaatgaagcaggggttcaaactctgttcaacagtgtcatagtcctgtgaagggnttcagtgtaatgatgcagccttgggatggagtgcccttttagttagaatgttagaatttc

SEQ ID NO: 750 - DNA, 121 bp, Artificial Sequence
  Synthesized
  misc_feature (61): n=a or g
tgcgctggaacgcaagttaaaatggctgctgcaaataaagctgtaactctaagcactaaanagggtgaaagtaattctcatccctgtcctctgctacgtgcatttctcaaggctcagatct

SEQ ID NO: 751 - DNA, 121 bp, Artificial Sequence
  Synthesized
  misc_feature (61): n=t or c
gtttcttcacatgttccacgcagggctagattgttcttcatggagcaaatctctccacaangtggaagtaaaccctcaccatcaccaacaggtaaggttaaacatatattacagttggaaa

SEQ ID NO: 752 - DNA, 121 bp, Artificial Sequence
  Synthesized
  misc_feature (61): n=a or t
taaagtaatacacgaagattatagaaaatactttgggccatttcctaacagaaactttttntactatttttaacgcctgagatttgatactgtgttgagaagcatcgtttagaagctacca

SEQ ID NO: 753 - DNA, 121 bp, Artificial Sequence
  Synthesized
  misc_feature (61): n=a or g
ctcctcttaatcagagcgctacaaagaaacatgatcctagttgatgaagggggtgcatttnccagtgacacatggtaaagaggcaaagatgacttatccatttgagctaacctcacttggg

SEQ ID NO: 754 - DNA, 121 bp, Artificial Sequence
  Synthesized
  misc_feature (61): n=t or c
taatgttttgtgtggggttacacagatccttttatagaccttgacctgagtctccgtgcancatctagatactgttttatgtccctgatctcttgtagttttcttaactaaactccttcct

SEQ ID NO: 755 - DNA, 121 bp, Artificial Sequence
  Synthesized
  misc_feature (61): n=t or c
agtgtgctcatgataatggtggtcaaaaatctacagcatctaactactgtaatgtaggtanagatttgtgtataattgtggcatattaaaatacacgttattaacaatttttagataaaaa

SEQ ID NO: 756 - DNA, 121 bp, Artificial Sequence
  Synthesized
  misc_feature (61): n=t or c
agagctaacaataaccttctactgtacaaagactgacaagcatccaagatatgatatgtantatatgaatcagtttcagttcagtagttttgaaagatcatgcttaagaagaatattatat

SEQ ID NO: 757 - DNA, 121 bp, Artificial Sequence
  Synthesized
  misc_feature (61): n=a or t
ctgaccctaaacatctcttgacaacagctccacaaggtaggccagtgttttaacaactggnctgacctacgaatttctcattcagctaatggtatttccaagatttttcacaagcttctta

SEQ ID NO: 758 - DNA, 121 bp, Artificial Sequence
  Synthesized
  misc_feature (61): n=a or g
atatgacagactaagtgaactgttaaaaaaagatcctaatgattttaaatctcatattcanagaaatgatttaggagatatagtttcagtgactttagtgaagaagtatagaacctgaatt

SEQ ID NO: 759 - DNA, 121 bp, Artificial Sequence
  Synthesized
  misc_feature (61): n=t or c
tgaactaagcctgccaagcagacccttccctttttccagaggtgaaggagcgcctgcaganaagagtgagaggctgctcaatctgcccacatgccacccagccaaaccccaggccttgcct

SEQ ID NO: 760 - DNA, 121 bp, Artificial Sequence
  Synthesized
  misc_feature (61): n=t or c
aacaacttcctcagagatatattctgctgcccagaaaataaaaaagatagactttcttttncacaaagagtagaatgatcaagcagaatgtactaaaataagttaagtctgagtcagagct

SEQ ID NO: 761 - DNA, 121 bp, Artificial Sequence
  Synthesized
  misc_feature (61): n=a or g
tgtacattgtttacacatacagacatcatgtttcattgattccagcccagaaaagcataangtctttacagtacctaggtgatagctcaaatttaaaatatgacttaaaaaaaaaaagtct

SEQ ID NO: 762 - DNA, 121 bp, Artificial Sequence
  Synthesized
  misc_feature (61): n=t or c
cagacaaatctgattcagaagcccagttttcattttggattgctattgcagccttggtgcngtggcagttacttctgcctcatttccagtgcctgaaatgggcttaccttctgttttcttt

SEQ ID NO: 763 - DNA, 121 bp, Artificial Sequence
  Synthesized
  misc_feature (61): n=a or g
tataagtagagccttgagaaatccacctgatatgcaagcccctgtaactcactccagcacncatgtgaaagaaaaagctttcatgaatcaattaaagaaatgaagatgcatcagaattatt

SEQ ID NO: 764 - DNA, 121 bp, Artificial Sequence
  Synthesized
  misc_feature (61): n=t or c
tgagggaatcaaaataagccaacaattaaaatacgtttgaggagttacatcctcatatatnttcataagaagagttcagtataactagcatcaaagtgattttgaaaagacctaacagcca

SEQ ID NO: 765 - DNA, 121 bp, Artificial Sequence
  Synthesized
  misc_feature (61): n=a or g
ggactaggtgatcttagtggtcttctctaaccttactgattctctgacgataattgcaaanccttgtcattttcacatagcaattatgtttttgttgcagattgatgtcctcaaggcagac

SEQ ID NO: 766 - DNA, 121 bp, Artificial Sequence
  Synthesized
  misc_feature (61): n=t or c
tactggttcagagaggccccttacctgcaacagctggcttgcatcctgacagcaccaccgnaggagttgggacattccaatcacaccacatcaggtaaaggaagagggatggatctctgga

SEQ ID NO: 767 - DNA, 121 bp, Artificial Sequence
  Synthesized
  misc_feature (61): n=t or c
ccaggtcccattgtgcagcattccccgccccggcagcagctgtagaatagatggttctgtnaactccatgtagcatgctgtctgcagtggaagggatgctaagtcactggcagtcctcctg

SEQ ID NO: 768 - DNA, 121 bp, Artificial Sequence
  Synthesized
  misc_feature (61): n=a or g
attttagttgatatgcagctaactgttcgaggaaaagtgtttccctgaagaagccactgcnttaggattccagagcagagtaaatatcttcattaaatgtctataaaaactaaacttgcca

SEQ ID NO: 769 - DNA, 121 bp, Artificial Sequence
  Synthesized
  misc_feature (61): n=a or g
tactggcaaaacagtctctttgttcaggaaccttgtccgtttgggattattcaacaaatgnaagtgtttcgtagcgcaagcctgtaaactacacaagggtttcaaaaataaacaaatgcaa

SEQ ID NO: 770 - DNA, 121 bp, Artificial Sequence
  Synthesized
  misc_feature (61): n=a or g
gctatggctatcctgctgtccagcttactgcagtaccaccaccacctcctcaatctatacnccaaattgaagaatttaggaagtcgggaccatggcgagctcacgaaaagaataaaacaat

SEQ ID NO: 771 - DNA, 121 bp, Artificial Sequence
  Synthesized
  misc_feature (61): n=t or c
ctcctggctgcattccacctccctgcccgctttccatgtcttgcctcaggtattcctgctngccttcgtgtgacgatgatcttggggctctaattgtgagcataggtaatttaaaggctgt

SEQ ID NO: 772 - DNA, 121 bp, Artificial Sequence
  Synthesized
  misc_feature (61): n=a or g
aggtggtcttgaggtatttttcaaccttaatgattctatgaaaactttcacaaactgctgncactacgtatttgcagaataattctgttttggctgaatcattctttattttctatagcca

SEQ ID NO: 773 - DNA, 121 bp, Artificial Sequence
  Synthesized
  misc_feature (61): n=a or g
gtagaagcaccatcatcagtgtagaatcatttcacttttcagacatcttcccaaatttctntttagtgagactgaatatatattatacactgaattaataccctgagtcttattcattctg

SEQ ID NO: 774 - DNA, 121 bp, Artificial Sequence
  Synthesized
  misc_feature (61): n=a or g
tcttgtttactgcattcaaaaacacattgctttttcaaggagaatttagtctctttctttncccttctcttcattttccacactggtggaatggagaatattttaaagctgtgtaagcagt

SEQ ID NO: 775 - DNA, 121 bp, Artificial Sequence
  Synthesized
  misc_feature (61): n=t or c
gaagagccattttctgattagacttgaagacttctcaccttttataaccagtcttatctantactgttgtgattcttctcacattgctggtgcatgttaaacacttgtattcttcgtccca

SEQ ID NO: 776 - DNA, 121 bp, Artificial Sequence
  Synthesized
  misc_feature (61): n=t or c
aagtaaatacatgtgctgtgtggcaattcgtattttattaagttgcccaacacttctgaanctcgataaggaaatggacctgttctgggggcaacacagatatctgctgcagagattattc

SEQ ID NO: 777 - DNA, 121 bp, Artificial Sequence
  Synthesized
  misc_feature (61): n=t or c
tgatagttcatagaagaagctggcaacagtgcactctaaaatagcaatttagctgagatgnttgaggattttagagtatccactgatgacagaaaataactgtctgaaagctgcttctctc

SEQ ID NO: 778 - DNA, 121 bp, Artificial Sequence
  Synthesized
  misc_feature (61): n=t or c
tgtgtttgtgtgtctttgattttcttacaagaaatatgtaaaaaacttcctatttttctgnggtctctttggttctattttggatggagcaggatgctgtccctcaatgaagtacgctggc

SEQ ID NO: 779 - DNA, 121 bp, Artificial Sequence
  Synthesized
  misc_feature (61): n=t or c
tcccaacatatgaaatacagaataattacactttgcagcccagttacttataactttcaanactttaacaaactccagcttaaagaaaatactgacaaaaacggacaaacaaaaaagcaca

SEQ ID NO: 780 - DNA, 121 bp, Artificial Sequence
  Synthesized
  misc_feature (61): n=t or c
atgctatatatctacagctatgctaatatttattagcttcttatccaaggagagtttgggncatttgctggacaatagcctactaagccaaattcatccattaaaggaataaataaatata

SEQ ID NO: 781 - DNA, 121 bp, Artificial Sequence
  Synthesized
  misc_feature (61): n=a or g
acagaagctaatcagagaactgtaagggaaaactgtgggcttgttacagtttggctgtacnaatgagttgagttcttttggcagtgtggcagccttgtacgctgaacaaacgttatttgtg

SEQ ID NO: 782 - DNA, 121 bp, Artificial Sequence
  Synthesized
  misc_feature (61): n=a or g
tctgaatcaaaattaatcttcaggaacaattacctttagcacatcttgaagatctttctcngcaatatctggaaattctatttcataatgaggatcaacgatagcatacagttttttacgt

SEQ ID NO: 783 - DNA, 121 bp, Artificial Sequence
  Synthesized
  misc_feature (61): n=t or c
caggaggattgcatttggatgtgtatcatgaaatttaaacaagcaggtttagagaagtcancctcatccttcctatgagatcactaaagctgccattgcccatgaaccatttaaaagaccc

SEQ ID NO: 784 - DNA, 121 bp, Artificial Sequence
  Synthesized
  misc_feature (61): n=t or g
actatttcatctgcattataaagcaacagcaattctagcaaatttatttctcattgtttgnctacatacacagtttttagataaggtatctaaaggggaacaaagaagcaaatgaacagca

SEQ ID NO: 785 - DNA, 121 bp, Artificial Sequence
  Synthesized
  misc_feature (61): n=a or g
ttctattaaatacaaatacaaaaataccaaactttgctaatctgaaaatgcttgatttcantagtgatggaacattcaactgtaaaagaagcctaccacaggctgttggtttatccaagtt

SEQ ID NO: 786 - DNA, 121 bp, Artificial Sequence
  Synthesized
  misc_feature (61): n=a or g
tggaaccagtagtcttgtttttctactgaaaaaaaatcggtagaagctgtaatgaatgacngagttagtagagacatgatgtacaatgtaaggggaaagagtgaaaacagattctgtaggc

SEQ ID NO: 787 - DNA, 121 bp, Artificial Sequence
  Synthesized
  misc_feature (61): n=a or t
cgttttttaaacaaagcaaagtgacgagaagcttaagacttgatcaaattgcctctacccntaatctgtcagccttccatgctaaacacactggaagtaccaggtggtactgcccacatgg

SEQ ID NO: 788 - DNA, 121 bp, Artificial Sequence
  Synthesized
  misc_feature (61): n=a or g
cacaaggaccgcagtctcaggtataggagcggcccagcaaggcccttcgttcttcaaacanctcaaagtcatgctgcccttattgttggctttcagtactcaaggtttccctcatgtctgg

SEQ ID NO: 789 - DNA, 121 bp, Artificial Sequence
  Synthesized
  misc_feature (61): n=a or c
tgaaggagataaaactacttgtagcaatatgggcattcagtaggaattaaatacattgtcntcttatttgatttttttgaatgacgtgggtatgaactatttatcttctaatgtattagag

SEQ ID NO: 790 - DNA, 121 bp, Artificial Sequence
  Synthesized
  misc_feature (61): n=a or t
ctcagtccactccactgtccactcacctttgtgtattatattcttcttctctcagttctanttttggaaaaggagatgactgttaggctgacttttctgttaaaatgtgggtagcaaaggt

SEQ ID NO: 791 - DNA, 121 bp, Artificial Sequence
  Synthesized
  misc_feature (61): n=a or c
ttctctagagtttggcttactagtaaaatatttggaaacatgtaaaaatatttcatgtacncagtcatatctcctgtcacataaaattcctgtcctttcttcaggggcctgacagaaatct

SEQ ID NO: 792 - DNA, 121 bp, Artificial Sequence
  Synthesized
  misc_feature (61): n=a or t
ttgtcctttggatagcatccctataattaatttacatgcaagacgtaacaaatgaaacganaccttgttctgacattttgtacttcatattcaatgcctcatttatatgtttagtttttct

SEQ ID NO: 793 - DNA, 121 bp, Artificial Sequence
  Synthesized
  misc_feature (61): n=a or g
aagcagccaacagagccatcagtgacatctcagggtctcttttcttcactgttggcttcanagaagtcctggcgaaaggacacctcggtgtcattatcagaaggaacagatcagctcttct

SEQ ID NO: 794 - DNA, 121 bp, Artificial Sequence
  Synthesized
  misc_feature (61): n=a or g
aagccaagcacagagcccaggctctacttcgcaggatagcacggtcaaaagttcagtagcncagtgcctttgcaaagttttaatatgcttaaatctgaagtagtttccaattttgttgaaa

SEQ ID NO: 795 - DNA, 121 bp, Artificial Sequence
  Synthesized
  misc_feature (61): n=t or c
tcttcattttgcacaagtgagagtctttttgtcaacaagagtgcaggattcctcttactgnttttgtccatttgttatatcctatgttcagatatgacagctgcaagaatgaaagggcaac

SEQ ID NO: 796 - DNA, 121 bp, Artificial Sequence
  Synthesized
  misc_feature (61): n=a or g
tgttgctgccgtttagccaagagattgcaggttcaaggttgtgagaacaaaggcaggatcnggtacacggcaggcacaggctgaaagtgctgcatggcatggcactgctgggaatgcgggg

SEQ ID NO: 797 - DNA, 121 bp, Artificial Sequence
  Synthesized
  misc_feature (61): n=t or c
gatttattccttgctgttaacttgcccagtatatgaagctactgcatgttcagaaaatttntgtcaaggtaactggtagaaattggaggtaaatttattactgttgattgcaaaagcaaca

SEQ ID NO: 798 - DNA, 121 bp, Artificial Sequence
  Synthesized
  misc_feature (61): n=t or c
atttttgaacaaatgcttcctgttttatgtaatctttcttcctgaagatactttattgtcngaattaggatacgctttttaattctgagttgtctcatttctgcattcattatgttttctt

SEQ ID NO: 799 - DNA, 121 bp, Artificial Sequence
  Synthesized
  misc_feature (61): n=a or c
tccactagccatgacacaggatgggaagcaaactttgatcacagtagagcacttcagctcncaaaagggaaacggcagtagggttagatattcacagttcagtctgtagctctgccatata

SEQ ID NO: 800 - DNA, 121 bp, Artificial Sequence
  Synthesized
  misc_feature (61): n=a or t
gatccaggcccttcacagtgctgatgatcagctttggtcaagagtagcttctgtgacactngcaaaatgacaaatatccaacggaggtggtttgaaaaacatctaggatgccaagctgaaa

SEQ ID NO: 801 - DNA, 121 bp, Artificial Sequence
  Synthesized
  misc_feature (61): n=a or c
gaagttacaaccatttaattagctgagcagaaacctgagcagaaaaatagactgcccctcngacttgcaatggaggagaaagaagtttcaattttcttactactccctgtcccatgcaaat

SEQ ID NO: 802 - DNA, 121 bp, Artificial Sequence
  Synthesized
  misc_feature (61): n=a or g
tgtagcaactgtatgtttgagctttttccctgctgctggaaaaacttctcagttttggtcngggttttaggaagacttatgaagtttagttttgttggccagaagaccaatttttctttct

SEQ ID NO: 803 - DNA, 121 bp, Artificial Sequence
  Synthesized
  misc_feature (61): n=t or g
atcactttttttaaagacaaaaagtatacttcaagagataaatacaatatcagtgtagccnaggtgtgcattctagtcttggagagcaacaaaaaaataatagtaatgtcagcattcctat

SEQ ID NO: 804 - DNA, 121 bp, Artificial Sequence
  Synthesized
  misc_feature (61): n=t or c
gataacttcgatttgacacggctatagctggagaacaaattccactgcaagcattcctgcngcatccgttcttgtgtaacattgcttccagttcctccatcctgtaaattacattgctttt

SEQ ID NO: 805 - DNA, 121 bp, Artificial Sequence
  Synthesized
  misc_feature (61): n=a or g
tcaggccttgatgccccagctaaaagctctctctccaaacacaaggtcccatatctatacngtgaaccttgcagtgagatggcatggaaatgaagtttccatcccttcctttgctttcttt

SEQ ID NO: 806 - DNA, 121 bp, Artificial Sequence
  Synthesized
  misc_feature (61): n=a or g
taaattttggacatacgaaaacagtgaggtttttctgagttgctggggttgcaattatatntgccttagaggtttctagagaaaataactgttttgattctgtggccatctcaaatggatc

SEQ ID NO: 807 - DNA, 121 bp, Artificial Sequence
  Synthesized
  misc_feature (61): n=t or c
ctctgggagctagaggcctgaggagcaatgctgggaggacagcacgagaaacacaagccancgagatcactgcagagacttctgagtaaaatcctgaagagttactaacagcttggaggga

SEQ ID NO: 808 - DNA, 121 bp, Artificial Sequence
  Synthesized
  misc_feature (61): n=t or g
tcagctgtgaacttctcatggcctgactgggacagggcaatttccaggacactgatgctcntgatgaagcagcttctgtctctttccccagaagggtctgcagtttgttagtttggcatac

SEQ ID NO: 809 - DNA, 121 bp, Artificial Sequence
  Synthesized
  misc_feature (61): n=t or c
cctcaagacaccaggaaagtggattgtcaataatcccacaaagctcagcaagggcaaatgnagaatcctgcatctgtgatgtaataaagccctgaaaaaggagggggctggaggccattgg

SEQ ID NO: 810 - DNA, 121 bp, Artificial Sequence
  Synthesized
  misc_feature (61): n=t or g
cacttgtcaggctacagtggtacaagaacgcagtggtactgacatgattgtgttgttatcngtgtagcttcatccgtgcactgacatcaagtcagtaaggataagtgactctttgaagcaa

SEQ ID NO: 811 - DNA, 121 bp, Artificial Sequence
  Synthesized
  misc_feature (61): n=t or g
taaatgcaggaaaaccaaaagggaaagttagcctacatgtgttttgttcttagtgaacagntagcattacaaagatgcaatgatataaaataataaatatgtatgtgcatatgaatgtaat

SEQ ID NO: 812 - DNA, 121 bp, Artificial Sequence
  Synthesized
  misc_feature (61): n=t or c
gattcattgattaacaaaagttttgcagtcatgaacacatcacaatggaaaatttagcaanggaaaaagtctggtcatttagttccttcttcaatcaagacagagaatagtatgagaactg

SEQ ID NO: 813 - DNA, 121 bp, Artificial Sequence
  Synthesized
  misc_feature (61): n=t or g
gaaaagcctggctggcatttctgtgtcctcatccaagccaattttcacatgcgaaactcancagttgcatggaagggacaggaaaaaggatgagacttccccccaaaaggagtgactttct

SEQ ID NO: 814 - DNA, 121 bp, Artificial Sequence
  Synthesized
  misc_feature (61): n=c or g
cccaagccattctatgattgtatgcatatgaactctatatatgcaactttgcagctgatcnataggttaaacaagtacagttaaggtcatatgtctaccaaaccttaacggcgttcggtag

SEQ ID NO: 815 - DNA, 121 bp, Artificial Sequence
  Synthesized
  misc_feature (61): n=t or c
ccctcccttcacttccctccccctctgccccatcgcctcccactccacagctctgaaattngggatggaggagagcaccacctcagtcatctcagtgcacagctgagcactacagcactcc

SEQ ID NO: 816 - DNA, 121 bp, Artificial Sequence
  Synthesized
  misc_feature (61): n=c or g
ttaaaaagtaattacacacagccctgtaacaggatcagctgctggatgtctgagggctggntcatgataaaattttaaacatttcttctggtcatgtttctgtttttcaagtctgtctctt

SEQ ID NO: 817 - DNA, 121 bp, Artificial Sequence
  Synthesized
  misc_feature (61): n=a or c
tgggtgagcttccctagaccttttccaggtacacaacaatgacgcccagtgtcaatcgggntccctttcttgatgttagattcaggaaacaattacttctcctgtgtgattttttaaattt

SEQ ID NO: 818 - DNA, 121 bp, Artificial Sequence
  Synthesized
  misc_feature (61): n=t or c
gcagaggggtgccgtggggtctgtaaccatgggcgtgctgtagggtcgccactcattggancgttgttttcagtgattcagcctgaaacagccagactttgcattttttgaacttgtgacg

SEQ ID NO: 819 - DNA, 121 bp, Artificial Sequence
  Synthesized
  misc_feature (61): n=t or c
taagacacggttatgaaaccacctgcagactgcacatacagcagtggtaatgcaccaaagnctgcattctgccagcgcttgagtaaagagcacccatcctctgccaacacccctcctagct

SEQ ID NO: 820 - DNA, 121 bp, Artificial Sequence
  Synthesized
  misc_feature (61): n=a or c
attttgaccaggcttcctgctttctaccttcactgatgccattttttttcatgtaactagntacacacatctgacagccataaaacttccaagccctgttctttctgacatgcataccaaa

SEQ ID NO: 821 - DNA, 121 bp, Artificial Sequence
  Synthesized
  misc_feature (61): n=a or g
gaagccaccctgtactcaagtttcatatatcagaggcagactatacagtatttctcacccncactcttccctccagccccccaaaaatcatgaaacaaaccaacaaccatccggtccagaa

SEQ ID NO: 822 - DNA, 121 bp, Artificial Sequence
  Synthesized
  misc_feature (61): n=t or c
attctgatttgatgcattgtggattactgttcagtttctttataaacctacagatggtctnttaaagtccagttcttgttaatgtcagaatacaaaatgtgagctaatactttgtgagtac

SEQ ID NO: 823 - DNA, 121 bp, Artificial Sequence
  Synthesized
  misc_feature (61): n=t or c
agctcaataagacaagcagcaaaagacttgcatcaaatccagatggatattgccaattaanaatcttcaatgtggagacaggctgtatgtataccaactttgttaaaataaaccttaacat

SEQ ID NO: 824 - DNA, 121 bp, Artificial Sequence
  Synthesized
  misc_feature (61): n=a or g
caccacttacagcagacttgcatgccatcttttccctcctgtctaggagctataataggangaaaatacaaaaatgcttccactaatttgccacaaaatctcacaacaaatacaacaacta

SEQ ID NO: 825 - DNA, 121 bp, Artificial Sequence
  Synthesized
  misc_feature (61): n=a or g
gaaatttaggcttacgtccttatgtcagttgtacaggcgcatatttaaataaagtctatantatcatttgcatttctgtgatttacccacttgatcctacactgtttgtgtcttttaaaat

SEQ ID NO: 826 - DNA, 121 bp, Artificial Sequence
  Synthesized
  misc_feature (61): n=a or g
gtttgtgatgaatactcagattgtcatttcacgatgaagactctatcaatcagcttaaaanagaaaacaaatctaaataaaacaacagaagtttttaaaacaacacagcaacagaaacaaa

SEQ ID NO: 827 - DNA, 121 bp, Artificial Sequence
  Synthesized
  misc_feature (61): n=t or c
tcatacagtgcagctccagagcagtttgggttacacaaagtttttgtgacaacccataccnaacgatgaaatagaaagtgacatccttaggtaacagacatcataaaggaaaaaatatgca

SEQ ID NO: 828 - DNA, 121 bp, Artificial Sequence
  Synthesized
  misc_feature (61): n=t or c
acaaaggatgttccacatgaacatgagaaataatttctttactgagagggtgacagagcantggatcaggctctgcagctacaacctcatgtagggaacctgaattagccgggggttggac

SEQ ID NO: 829 - DNA, 121 bp, Artificial Sequence
  Synthesized
  misc_feature (61): n=t or c
tgcaattttgtgcagactgtatcctcacctgactaggaatgctgtaacaggaaactcttgnctctgtcctgagatctgccattttcagggctgaagcttttctccctgagagggagaggtg

SEQ ID NO: 830 - DNA, 121 bp, Artificial Sequence
  Synthesized
  misc_feature (61): n=t or c
ccactgtgcttctttgcactgtacgcagcagtgctgccttatagggtatatgtgtcaggantgtagtttatcttcacaagctctcccattgactccataggaagtgtgggacaaatctctc

SEQ ID NO: 831 - DNA, 121 bp, Artificial Sequence
  Synthesized
  misc_feature (61): n=t or c
aatgatctcaggatttcacctcataccacagacacagagccaaaatgcagtaaacaatctngaatccagcagacatgaaggagtttgggatcagataagatcaagaaatgaggttaactac

SEQ ID NO: 832 - DNA, 121 bp, Artificial Sequence
  Synthesized
  misc_feature (61): n=a or g
tctcagattgtgctttagactgttgtatattggagagggagtcaggaattaagtttaggtnttagatggggatatgtggattaactgtgttacttctgagactgaatgtttcctgagcttt

SEQ ID NO: 833 - DNA, 121 bp, Artificial Sequence
  Synthesized
  misc_feature (61): n=t or c
ctgtccaaaaagtcaatacactcccaagtttagaggcatataaagaaacaaaggaatacanctcttttgcactgttttaatacactgcattgtaagtgaggcttcagattcttaccgttgt

SEQ ID NO: 834 - DNA, 121 bp, Artificial Sequence
  Synthesized
  misc_feature (61): n=t or g
gcgcattactaagtttataaacaaagaattataaacagaatgacatcataggcaggagtancacctttcataagacaattaagaaagtaaatggtatcttaagaatgacactgtagtaaga

SEQ ID NO: 835 - DNA, 121 bp, Artificial Sequence
  Synthesized
  misc_feature (61): n=t or c
ggttgctttacaatcaatacctctgcctcaggcgccaaagagcgtatgagaaaatgagttntctgtttttataaactctatcttcaagctcactttgatccattcttctacacaaatgaat

SEQ ID NO: 836 - DNA, 121 bp, Artificial Sequence
  Synthesized
  misc_feature (61): n=t or c
agtatagaggcaaaactctcctgcaaaccctgcttgtcttttactttccttgtctcctacntacgacccttcctttaacttgtcccattagaagaaaaattaataaacaactattgaagcc

SEQ ID NO: 837 - DNA, 121 bp, Artificial Sequence
  Synthesized
  misc_feature (61): n=a or g
ttcaattgcagtggtagatgcatgattgcacatgatgactttgaggtttgttggtcaccangatgtttgtctccatcctggaaaagtcagatgcttcatcagcagaaccaactttgttttt

SEQ ID NO: 838 - DNA, 121 bp, Artificial Sequence
  Synthesized
  misc_feature (61): n=a or c
attctgcaagaatataattaaagggttggaaaagcctaacacaggacagccactatgttanctctctagagatttcattgcttgagaatcaagtttgactcctcccaaaaaagtgaaattc

SEQ ID NO: 839 - DNA, 121 bp, Artificial Sequence
  Synthesized
  misc_feature (61): n=t or c
taattttcacatcacatttattgaaagcttaatgaaagctaatatgtgagaaatataacanaggtattggatgacactttaaagaaaatctctgttgtatgaggacgtgttcttctcagat

SEQ ID NO: 840 - DNA, 121 bp, Artificial Sequence
  Synthesized
  misc_feature (61): n=a or g
actgaaatacatacatgcataaaaccaacaactctccaagttatgttttgcagcttacttntgtagaaagcttttcactcagcaaaggcaagcccagagggaggcttttctgctcccatca

SEQ ID NO: 841 - DNA, 121 bp, Artificial Sequence
  Synthesized
  misc_feature (61): n=t or c
atagaaagcccatttccctagctctagaattcctaatttccctcagcatacgcagtggaanaaggctgaaatttcctgctagccatactgatcagaaagctttgactaggttatcccacat

SEQ ID NO: 842 - DNA, 121 bp, Artificial Sequence
  Synthesized
  misc_feature (61): n=t or c
cacacatgaagctctgctgtacacatctctgcactcctgaaaattatagggaagatgctgnttgatacatgaactgatattaagcaaacagcatctgctcagttcatacgttaattgaagg

SEQ ID NO: 843 - DNA, 121 bp, Artificial Sequence
  Synthesized
  misc_feature (61): n=c or g
tctctatgtctggagctcgttgtgctagaaattaacattgaggctttgcctggtctgtctntgcttccagggcaaacctgtacctccttgcagttacttgacgttgcttatttctctcttg

SEQ ID NO: 844 - DNA, 121 bp, Artificial Sequence
  Synthesized
  misc_feature (61): n=t or c
ccctttaaatcattttagatttggttgcaattcaaggtgatggttaataagaactcaagancaaggtcttgcaagtcagatagattcatgcagtttcagtcgggacttatattttttgtca

SEQ ID NO: 845 - DNA, 121 bp, Artificial Sequence
  Synthesized
  misc_feature (61): n=a or g
atccaggaatccatagaacactacggagcagtggtatggcctggggtaagtactcaatatngcatgcagggagttgacctgacagatcagtcagtcatgacagtggcagacaaacctcaag

SEQ ID NO: 846 - DNA, 121 bp, Artificial Sequence
  Synthesized
  misc_feature (61): n=t or c
aaatctcgccttgccttgtttccttcaaacaggtatacactccctggaatcagcaagaagncactctctttctgtttcacttttgctctttgttagcttcaagcaccactgatttagtatt

SEQ ID NO: 847 - DNA, 121 bp, Artificial Sequence
  Synthesized
  misc_feature (61): n=t or g
catttaatatatagatgcttttcgtaacaactaaaggtatactgccctttcctttaactgnatatagaggaatgggcatgaggtgcaacatcctcagtgtcactggctagctctgccaaat

SEQ ID NO: 848 - DNA, 121 bp, Artificial Sequence
  Synthesized
  misc_feature (61): n=a or g
actctggcttgatcactctcctttggaaaaattactacacaacaagagttccctccctccnaccaaggagtcgcatttttcttgcgctcatttatttagtcagctttgtattttcaaagaa

SEQ ID NO: 849 - DNA, 121 bp, Artificial Sequence
  Synthesized
  misc_feature (61): n=a or c
aagaaagacatttgtccaaagaaaacctcttcctttttctgaatggacattgaaaggaagngggttcccaagcactccagatttaaagtctagcagattttttgctgcacagatgaaaggc

SEQ ID NO: 850 - DNA, 121 bp, Artificial Sequence
  Synthesized
  misc_feature (61): n=a or g
gaagggaatagatagaaaaatgcaatatttctgaaccaccaacaaagactaaactactacngcactgcatgatgtattggacagactccatagaaaaataaagaaaatattaggaagtata

SEQ ID NO: 851 - DNA, 121 bp, Artificial Sequence
  Synthesized
  misc_feature (61): n=a or g
ttctagcatattttgtcgatacagtagtttttaaagaccaagattggcaaaaatgttaatnttttctaagtgactactcagggaaagcgcaataaccattattgttaaagatcctgcattg

SEQ ID NO: 852 - DNA, 121 bp, Artificial Sequence
  Synthesized
  misc_feature (61): n=c or g
tgtcttgcattgtgtccagtggtttgaaatgactttccccaacattgccatgagtccacantgtgcagagcaacacttttacacagatgagtgtctcagcttgcactgagacaatattata

SEQ ID NO: 853 - DNA, 121 bp, Artificial Sequence
  Synthesized
  misc_feature (61): n=a or g
gcagtattgccccgctggtttctgttgtgctgtaagagtatgcctgcctagcttggtgccnttctgtgttctccaaatgggtttggttggtgccagctcagagggaggagtatttaccttc

SEQ ID NO: 854 - DNA, 121 bp, Artificial Sequence
  Synthesized
  misc_feature (61): n=a or t
tatttaccaccgtctctttgtacaccaaataatagggtagcgtaaatgccacttagggccngatctgtctactttattcacacaaacaactgcattgacttaaataagatcaatcaagcca

SEQ ID NO: 855 - DNA, 121 bp, Artificial Sequence
  Synthesized
  misc_feature (61): n=a or g
ccctcctctaattgttactgagatgctgcttccacttggaaaggagcattttgtgtgtgtntatccagagcatggtgcatagatcccttaagtcataagcatccacagatgcaaggctcag

SEQ ID NO: 856 - DNA, 121 bp, Artificial Sequence
  Synthesized
  misc_feature (61): n=a or g
attacttgcaaatgtacaggacatatgcacttgaaggcacttggtcatacttcctgtatantattccagaccataggatcacagataagtttgggttggaaagaaccttatagatcataga

SEQ ID NO: 857 - DNA, 121 bp, Artificial Sequence
  Synthesized
  misc_feature (61): n=a or g
aatgggtctgaggtttttgctgttgtttaaatttgtgataacagaagcgagcatcttctgngggattggtgctgaaaaatgtgctctgttcaaatagaaatgttttcattctgctgttttc

SEQ ID NO: 858 - DNA, 121 bp, Artificial Sequence
  Synthesized
  misc_feature (61): n=a or g
cagctcaggtgtgggctgcaaagtcatacggataacgtccaagaggaattaagattttacntcctgcaatactacaccggttcacattaaattcatagggaggatgaaatactttctccta

SEQ ID NO: 859 - DNA, 121 bp, Artificial Sequence
  Synthesized
  misc_feature (61): n=a or g
tgcacttcacaggactaccaacatgcctttattcagtaagccagttatggccatcatagcnacttcttttaataccagtgaatctatctggggagctgagatgaccatcacagatggcagt

SEQ ID NO: 860 - DNA, 121 bp, Artificial Sequence
  Synthesized
  misc_feature (61): n=t or c
ggttctcacaaaggaaatatgcaactcagtgcttccagagcctatctgctgcttgcactgngctccttgctcacagcccagcagaagctttatctgacaggggccgcaaagacggagtgtg

SEQ ID NO: 861 - DNA, 121 bp, Artificial Sequence
  Synthesized
  misc_feature (61): n=t or c
gggcaaacaaatgccaaacagttaagataaaaccatggctgaagcactgcagttaactccngctatcgtgttttctcagatgtgctctggagcctccctagattttcctcattaatctcca

SEQ ID NO: 862 - DNA, 121 bp, Artificial Sequence
  Synthesized
  misc_feature (61): n=t or g
ctgggaagctttcaggcagagcagcaatgagtggcaggaaaaatccagccgtcacttctcnccatccatcatttcatctctgtgcacgtctcacatgtgccccttgcttatagcaccgtcc

SEQ ID NO: 863 - DNA, 121 bp, Artificial Sequence
  Synthesized
  misc_feature (61): n=t or c
caaggatgagactccaaggacagaggacctctgtggaggtgactccacattccaggctccntcctagagcaaaagaaatccatcacgcagctccagcactgcagtactgctcctaaatctg

SEQ ID NO: 864 - DNA, 121 bp, Artificial Sequence
  Synthesized
  misc_feature (61): n=t or c
tattcttgatgttaaggtgtactgttgaagtgtccctgattccagatatcttatggttttngagccttaatttctacaacagccattgcataggctacagaaggtcagggcagaagtgaac

SEQ ID NO: 865 - DNA, 121 bp, Artificial Sequence
  Synthesized
  misc_feature (61): n=c or g
actgtcattctccagattctgaaggatgttaaatcttaatatttgtgaaaaactcaaagantaaatgagaggcaccaaaaaatggcctttcaagaagctgatttcattttcaaagcaatct

SEQ ID NO: 866 - DNA, 121 bp, Artificial Sequence
  Synthesized
  misc_feature (61): n=c or g
atcaaagttcccttcccaagaaaagaccattcaagcttatgctgactattagtgtggaaanatcagatctatttcctaaaatgttgtaatgtcctggtgccttttgaaagatgagctctca

SEQ ID NO: 867 - DNA, 121 bp, Artificial Sequence
  Synthesized
  misc_feature (61): n=t or c
acaggcaacatagtagtatcagccaaaagtcagaaatgacttccctgcttaggacagctcngtgtcataccatgtaccaccaggatactcataaagaccttggcagcctccctggctgggc

SEQ ID NO: 868 - DNA, 121 bp, Artificial Sequence
  Synthesized
  misc_feature (61): n=t or g
taaccatggcattaatgcagtggcaaccattctttcccacactaatacactcgtgacagcnttatatgttctgcattatgcattgccaagcaactctttgcaagttgtggctgataactac

SEQ ID NO: 869 - DNA, 121 bp, Artificial Sequence
  Synthesized
  misc_feature (61): n=a or c
ctattaccaggttcttcaatcattcaatctccacagtcactctgaatttattgaccacttnttttggtattgttcctatttgaccgttcgcatttccttctttttcacagagaagaagtgg

SEQ ID NO: 870 - DNA, 121 bp, Artificial Sequence
  Synthesized
  misc_feature (61): n=a or c
taaataacatctaaagctctgcctggccttgtgatgaatgcaactgttgcttttgccagcnggaagtacagatgaattgtaccacttctgctatctgctcaagttaccttttctctgctcc

SEQ ID NO: 871 - DNA, 121 bp, Artificial Sequence
  Synthesized
  misc_feature (61): n=c or g
aatgcaattgttcccttgcaatatggagagaacttaggataaaaatgaagatcttcctaantatttcatagttagcagtaatttctcagcagctctcactccttttaacaaatgctcaagc

SEQ ID NO: 872 - DNA, 121 bp, Artificial Sequence
  Synthesized
  misc_feature (61): n=a or t
aggtttgacttcagagcttatgaggtctcggtgaaacgacagtacgagagcatttgacacnattttccagtcattttgtactttgaatgcgtttttgtactgattaaagtcttacctgaga

SEQ ID NO: 873 - DNA, 121 bp, Artificial Sequence
  Synthesized
  misc_feature (61): n=t or c
tcagtgactgctgatgccaggtgatgggtgattgcatggccttctgagcttgggatgggangacagttgttgggagtgtaccttgcaaagtgaagtgcctaatgggctgttttttttttct

SEQ ID NO: 874 - DNA, 121 bp, Artificial Sequence
  Synthesized
  misc_feature (61): n=a or g
aataagtgccttttgtggtctcttggtggtgtaacatgatttggttaatgtgtttgtctcnggacgttttctagcctcctgaggtgctgtggaggtgcacttaccagttctgaggcttacg

SEQ ID NO: 875 - DNA, 121 bp, Artificial Sequence
  Synthesized
  misc_feature (61): n=a or t
agagttttcatgttgttggaattaatctaataatgataaaactgtggaagaaagaagacangaggctgcagtttcccagcctttctctttcctttttttgtttttgaccaagtgcgttagt

SEQ ID NO: 876 - DNA, 121 bp, Artificial Sequence
  Synthesized
  misc_feature (61): n=t or c
aggttattggttggagctcaagtcaggagaggaaaaaatgcagcatacctgctgtaatcanttctcactggcattccgttaggtctcttgatttcatgtttatattactgagcttccttat

SEQ ID NO: 877 - DNA, 121 bp, Artificial Sequence
  Synthesized
  misc_feature (61): n=t or g
cttaaaggagcaggacacataagcacggcagcaagcagagacagagcagcacaccagcaangctgcacgctggcagagcccaggctgactaacattcagctacaatgcaggtctcaaaccc

SEQ ID NO: 878 - DNA, 121 bp, Artificial Sequence
  Synthesized
  misc_feature (61): n=c or g
tgcactgcaaaggaaagagatgtaattgaaactggatagagaacagccatggtttttcatnactgcatatgtaaaacatgtgattgtgcaatctgatgctcagccacattgcttttgcagt

SEQ ID NO: 879 - DNA, 121 bp, Artificial Sequence
  Synthesized
  misc_feature (61): n=t or c
gcctctgaaatgggtagttaatctttggctcctggtaggggatagacagaaatttcttatnggaaatcaaagatggaggccctggcaatttggggcaatgaagttgtaagaaaattttcca

SEQ ID NO: 880 - DNA, 121 bp, Artificial Sequence
  Synthesized
  misc_feature (61): n=t or c
gcattgtttggtgttccgaacacaccagtggatgctcttcttcagtttacagataagctgnggcactcattgctattgtgctgttcaatttgaatgacatcttttgtctcaggaagtccct

SEQ ID NO: 881 - DNA, 121 bp, Artificial Sequence
  Synthesized
  misc_feature (61): n=a or g
ccattgttttacctctccaacctataggctctacataaacaaatgcaatgagtaggtaaantactatagggtaaattataaagaactgtaagacttattctgctatagccatgtgataatc

SEQ ID NO: 882 - DNA, 121 bp, Artificial Sequence
  Synthesized
  misc_feature (61): n=a or g
ttattattaaattctttattgagacgtctgaaattgaattttgggtgactgaaaactgcancctctttgaaaatcacattgtttgccatgtcaaagcaaacccaaaagactcttcagagca

SEQ ID NO: 883 - DNA, 121 bp, Artificial Sequence
  Synthesized
  misc_feature (61): n=a or c
acacttagtgtgggcaggctgcattcccagtccttatcttgtatctaatctagccatgatnttcctccagctcacaagtcgctggtagttccttcttcgcgaagctcacccggccgtcacc

SEQ ID NO: 884 - DNA, 121 bp, Artificial Sequence
  Synthesized
  misc_feature (61): n=a or g
aaattaccctgatatcactgtaacttcctaaccatataaaaagtaagatccaggggtcacncagaaggatgtcctcactggaaatcaaggtaaagcacagatagcgtggctgggaaaagca

SEQ ID NO: 885 - DNA, 121 bp, Artificial Sequence
  Synthesized
  misc_feature (61): n=t or c
gttgagtctgactgttggcaactgtgctacctccccatccaagcctggcagttgcaaatancaccctgcgcccccaagagaggcagaggcagtcagagaagggtgctatccatggtggtgg

SEQ ID NO: 886 - DNA, 121 bp, Artificial Sequence
  Synthesized
  misc_feature (61): n=a or t
ccagcaaaatgtctgttgctctcaggggctcacaggtccttctcccaggcgtagtaatcgnggaagcggatttagtatgagacagctcatgcagggtttggagcagggtaagccacctctc

SEQ ID NO: 887 - DNA, 121 bp, Artificial Sequence
  Synthesized
  misc_feature (61): n=a or g
agcattttccctcctttgggctgctaaaaggctgtctgagaaaagcccttgcttgccctcntaagtagcatttccaagtgctgaaaccaggtcttcaagttttgaaagcattagagcttga

SEQ ID NO: 888 - DNA, 121 bp, Artificial Sequence
  Synthesized
  misc_feature (61): n=a or g
ttttttttttttttttttgcaagtatctggtagcctatgatgccgtgtcaggaaaggctcncgaaaagtgctatttgtggcactgggtgctgggcagaacagctatgagcaggggagcacg

SEQ ID NO: 889 - DNA, 121 bp, Artificial Sequence
  Synthesized
  misc_feature (61): n=a or c
tcaatcaagtttcaacacatacactataagtacacacaagtttacatatgaaaaaaatggntagcatggaagtgtgttagttcagtgggacttatctgtcagcttgtaacaccctttgata

SEQ ID NO: 890 - DNA, 121 bp, Artificial Sequence
  Synthesized
  misc_feature (61): n=a or t
gggcactgtaccgttgcaagctataaaatgggaagctcttatttagacaacctctttaaangctatattggaaaacgtttgtctataagttcctagcaacagtcagcaattttaatgatgt

SEQ ID NO: 891 - DNA, 121 bp, Artificial Sequence
  Synthesized
  misc_feature (61): n=a or g
tggatccttaaggtctgtacaagcaacttgttgactcaaacaataactaacattaacaacngtgagaatagaagaatggagccttaaggacccaagctggaagcttgtaaggtctatggaa

SEQ ID NO: 892 - DNA, 121 bp, Artificial Sequence
  Synthesized
  misc_feature (61): n=a or g
gcgagtcttcttctcaaatgactaagtaaaagccaaagtggcactcacctctactggcttntcccacagcgtactcagccactgactgattccatcaatttcatgttctattctcagcatc

SEQ ID NO: 893 - DNA, 121 bp, Artificial Sequence
  Synthesized
  misc_feature (61): n=a or g
tgacgtctcgctcttgttagcagtgtgacaccattgtttgtgtgctgcagtgggctctgcngctcagagccggtacaaatcagccgtgctgcccacccccaggctttgccatggtgggaac

SEQ ID NO: 894 - DNA, 121 bp, Artificial Sequence
  Synthesized
  misc_feature (61): n=a or c
atcctgtatagcaatttgtatgcctatagaaatacaggaggtatcaaatcacctggcttcntctgccctacacaaccttgactcatttgtagcacatccagctgctctctctctcctcctc

SEQ ID NO: 895 - DNA, 121 bp, Artificial Sequence
  Synthesized
  misc_feature (61): n=t or c
cgggttgtatcagtctcaggtcctgcagacaccccatggaggcacttttcagcatgactcngtgatccacagagtaacgttcagccaagtgcatgttaagtcacagatcggggctcttccc

SEQ ID NO: 896 - DNA, 121 bp, Artificial Sequence
  Synthesized
  misc_feature (61): n=t or c
ctccttatccagacggaaaagatcagaacaaaataagtcttatccagagctaaaaaatcanggcagcatccaacagagaagtaatccaaatagaaagaaataaccatgatggaaggagtga

SEQ ID NO: 897 - DNA, 121 bp, Artificial Sequence
  Synthesized
  misc_feature (61): n=a or g
cttggaagcgtaaggcagcacggaggcgtgaactaaactaatttcagaacatccaaaaacnaaccgcaactcaatgagtctctgggtggacagcctctaaatttacccaggctttgcactt

SEQ ID NO: 898 - DNA, 121 bp, Artificial Sequence
  Synthesized
  misc_feature (61): n=t or c
taatccatgttctttccttccctgcatcctagctccatacaggcagtccctggctttcccnagtttgctggttccacctctaaagccccagggcatgcattaagctccccgaggctgccca

SEQ ID NO: 899 - DNA, 121 bp, Artificial Sequence
  Synthesized
  misc_feature (61): n=t or g
attccagcacaaaccagaagaaaggcccccaccacaacccacggcaaagcacaggggaatncttcccaaaccacagccccagtcagggctctgggacccgaccagcatggcttgggcagac

SEQ ID NO: 900 - DNA, 121 bp, Artificial Sequence
  Synthesized
  misc_feature (61): n=a or g
ataaaactgtctagaaagtctgcagtaacaccaacacattaattagagaatgtttgattanatacctgcattgtatatactatcagagacctctagtcttctaatggagtgatttccttct

SEQ ID NO: 901 - DNA, 121 bp, Artificial Sequence
  Synthesized
  misc_feature (61): n=a or g
tttgcagtggagatttctgggaccacagtgacaatcacatgtccctcctctggagacgacntaaaatggaagccagatccgaaaatggtagtcaacaataagtacattatacagaatcatg

SEQ ID NO: 902 - DNA, 121 bp, Artificial Sequence
  Synthesized
  misc_feature (61): n=t or c
gagcaggtagaaacctcacagctctgcagggatccagcagatcacagccagtgcacacctnctccagtgactgcatggctccccaggccttaacatgactgatagagcagggaggccatag

SEQ ID NO: 903 - DNA, 121 bp, Artificial Sequence
  Synthesized
  misc_feature (61): n=a or g
ttggtgccctgcccattaacttaagtgtgattatatttattgtccatcagacagctcaacngaagcttagtcagaaaatgcaatttttgtattgtagtataaagagaggaaaggttgggag

SEQ ID NO: 904 - DNA, 121 bp, Artificial Sequence
  Synthesized
  misc_feature (61): n=a or g
gaaagcctcagccttgggttaacgtggggaaggcaaaacagagccctaatggggtgtgacnggcactgctgtgttggagctgtgcagtggtgtctttggagcacaggtcagtaattcctaa

SEQ ID NO: 905 - DNA, 121 bp, Artificial Sequence
  Synthesized
  misc_feature (61): n=t or c
gtagaaaacttatgaaagacattgctgactgtgaggagtgaagaccattaccagcagctgnacagattattacaaacacccttttcccagtggttgaagaagaaaagcttgcctcatctag

SEQ ID NO: 906 - DNA, 121 bp, Artificial Sequence
  Synthesized
  misc_feature (61): n=t or c
tacctttgtgtctatctgtcacaaatcttttgtgcttacattcacactactcattaagctnaagattaagtcaaatagggcatgtcacagtctgctgaagagtattctctctacctgattt

SEQ ID NO: 907 - DNA, 121 bp, Artificial Sequence
  Synthesized
  misc_feature (61): n=t or c
agtctcagggtaacagtcaatgcttggtagtagtagtttagaagatgcttgcattttccangcattgtctttaccactaatttgatggactcctttggcagctttagcactaacacagctg

SEQ ID NO: 908 - DNA, 121 bp, Artificial Sequence
  Synthesized
  misc_feature (61): n=t or c
atttaattttataaatatgagcaaataaataaataaaatacctcctcagtcaaacagaagntctttctcccaactgctttcattaaaagttaagtaaacagatgggtttcctggcatgtct

SEQ ID NO: 909 - DNA, 121 bp, Artificial Sequence
  Synthesized
  misc_feature (61): n=a or g
agttggatgattaccacattcccttcaaggctcccttaaaccaggcacaggaacaggcttnccacccacagaacacagccctcagtagcttatctctaaaacagaaaatctgtccaatttt

SEQ ID NO: 910 - DNA, 121 bp, Artificial Sequence
  Synthesized
  misc_feature (61): n=a or t
ctcatacttcactcccaaatcaacctaaaaaacatgattttttttaagcacagaactctanatacagagagaagcgttttcagtaagctactgaaatattttagatacttctaacgagttg

SEQ ID NO: 911 - DNA, 121 bp, Artificial Sequence
  Synthesized
  misc_feature (61): n=a or g
gaatctccatataaataagctagaactgtgtttgtctgcagatgtatatgtacctgtcccnagtgaatgaccttcatcttttagtcacaaaaggaaaggcagagtcaacaggtatgaaaca

SEQ ID NO: 912 - DNA, 121 bp, Artificial Sequence
  Synthesized
  misc_feature (61): n=t or c
cgatctcatcaagcaaaattgaaagacctatttctacttctcttaaacctgtaacagtccnccccttttggctccaatgctggctcccacgtgagttttctagcagagtgggagtcatttc

SEQ ID NO: 913 - DNA, 121 bp, Artificial Sequence
  Synthesized
  misc_feature (61): n=a or g
ctcatgcaggtgaccagcgaggactgcaggctgtgcatcgttgcaccccttcaggaaaagnaggtgtgggtagatatgggacgggatgtgcctgcctgaagtcagggctgggtgccccttc

SEQ ID NO: 914 - DNA, 121 bp, Artificial Sequence
  Synthesized
  misc_feature (61): n=a or g
catgctagagaatgcatcttgttcagatcctgcttcttccagcagtggcagaaagctcccntgtctctgtagagggatattttcactgctgctctctgcccatcacaggtgacactgttgg

SEQ ID NO: 915 - DNA, 121 bp, Artificial Sequence
  Synthesized
  misc_feature (61): n=t or c
cacagatgtgctacattctgaccacttctttctgaaggcagggaaggaaaaactttaagancttttttgtgctgacctcaataactatggcagatgtttctgatttatttatttattttat

SEQ ID NO: 916 - DNA, 121 bp, Artificial Sequence
  Synthesized
  misc_feature (61): n=a or c
tgtctccatacccagtgctggcggatttcaggagccagcagtcaaggagcaggggataaanttccaaggcaagacagctgaagtgaagatatctcaacaagaggccatggcaaagcaaacg

SEQ ID NO: 917 - DNA, 121 bp, Artificial Sequence
  Synthesized
  misc_feature (61): n=a or c
caggctgtctccttcagaagcagaatgatccttgagctacaggttgaacttttcatactcnacttttaggcttggtgaatgtgtttttttccacccattgaacgtgcccatgcagaagctg

SEQ ID NO: 918 - DNA, 121 bp, Artificial Sequence
  Synthesized
  misc_feature (61): n=t or c
agtgctgtacactaaacatttaacactatcttttggaaagaagggtcaataatattgttgnatacattccttttgttatagtagagttgtctctcaccatgaaacatataattaagagcca

SEQ ID NO: 919 - DNA, 121 bp, Artificial Sequence
  Synthesized
  misc_feature (61): n=t or c
tatgcagtctatcataatgtgaataagtatatccatcctaagtttccaggattctgggatngagaaccatctgaagcctagcatgttcccagaaagactcatatcacaaggttataaattg

SEQ ID NO: 920 - DNA, 121 bp, Artificial Sequence
  Synthesized
  misc_feature (61): n=a or g
aaactagctaaaatttatagaccctacattttgcaaactgctatctgtagcacatcagagnatacagaaaaacaagcagtaaattccaatagaaaaaataagaaagaagatacgaatgata

SEQ ID NO: 921 - DNA, 121 bp, Artificial Sequence
  Synthesized
  misc_feature (61): n=a or g
cagttttggaggggtagtgaaaatgataccgctgcagtgctggagagggcaaggagaaganacccagcagggttggacttggctatgtgggctgtgacagggatggcacgtttcctacagc

SEQ ID NO: 922 - DNA, 121 bp, Artificial Sequence
  Synthesized
  misc_feature (61): n=t or g
ttgttcctttccaatatgtgacataatctacttccagatgtcatttcatgaagctgtcaanggttcagaactatctgaaactgcagtctgagttttccacacgtggaaaagagtgtgtgtt

SEQ ID NO: 923 - DNA, 121 bp, Artificial Sequence
  Synthesized
  misc_feature (61): n=a or g
ccgcttgatttctgatgatgccgcagagccctgggaatccattagcaggaccgtgtaggcngtcaccctataaatcagtataaggtgttttacttggatatgatatttcaaatgcaaaaaa

SEQ ID NO: 924 - DNA, 121 bp, Artificial Sequence
  Synthesized
  misc_feature (61): n=a or g
tcaggctgctgcacgctgctctcggggggcaccacccagcagcatgggccggtgctaccangaagcaaagggacagcactgggtagcaactgcctctgctctgctctgctctgctctgctc

SEQ ID NO: 925 - DNA, 121 bp, Artificial Sequence
  Synthesized
  misc_feature (61): n=t or c
aaaagtcaagtgctactgttgttcttctctccaatcgtttaaaaggaagtcaggaaagccngtatgctcccatcctaatctcctctgagcaagtgccaaggcacgccttattcctaaatgt

SEQ ID NO: 926 - DNA, 121 bp, Artificial Sequence
  Synthesized
  misc_feature (61): n=t or c
atcaggagggaacattcttacacaagtgatgtcaattccagcctataacattaaagaattnggcctctccttcaatccctttattcccatgttagtcccatgagcctaggcctctttccat

SEQ ID NO: 927 - DNA, 121 bp, Artificial Sequence
  Synthesized
  misc_feature (61): n=a or t
taacaatcacaaatatcaaatattcaccgtagacctctgccacaaaacatggcaagcacancattagtttggatcaaacactgaaattctctactccattatttagcataaccagttattc

SEQ ID NO: 928 - DNA, 121 bp, Artificial Sequence
  Synthesized
  misc_feature (61): n=t or c
agccttgaccaagaagcctgcaatcagttcatgtgcttgtgagcatggggcagtgagcagnggactttgataaggctgagcttggatagaacaaatattattttatccttcagcatctgga

SEQ ID NO: 929 - DNA, 121 bp, Artificial Sequence
  Synthesized
  misc_feature (61): n=a or g
tcaccttgaaattctcctttgctcttctgtcagttctgctctagaagaaaagggagagaangaataatgtgctttaacaggaactccagagatcagcaggtacaaatgcagccctccagaa

SEQ ID NO: 930 - DNA, 121 bp, Artificial Sequence
  Synthesized
  misc_feature (61): n=a or g
ttgtgattctgacatgcattgaacaggcactgcttgctgatttgtgttggtttcaataganttttgcaattctctgcctcccagtttgcattctttgctaacatacccattaatacctagt

SEQ ID NO: 931 - DNA, 121 bp, Artificial Sequence
  Synthesized
  misc_feature (61): n=t or c
tatttttaaaatgaggaatttaaaagtctcataggccatttcggcaattagcctgtgaatnttgatttaggaacagcctcagattattccacaactgtctgcttacagttcttcaaaaaag

SEQ ID NO: 932 - DNA, 121 bp, Artificial Sequence
  Synthesized
  misc_feature (61): n=a or g
acagcagctgatagtgccgttgtacagagttcatgtaccctataacgttatgtacgacatntgtcatttatcacatcactgtgggcagattacaaacctaaatgccagccgacagccccat

SEQ ID NO: 933 - DNA, 121 bp, Artificial Sequence
  Synthesized
  misc_feature (61): n=t or c
gctcctgctccaggctctttagattctggagggctccaggccaccagctcatgtacaggangtgctgaagcatatgctgtggtctggctggagagctgatggatgttcgagcagtcccagc

SEQ ID NO: 934 - DNA, 121 bp, Artificial Sequence
  Synthesized
  misc_feature (61): n=a or g
tcacagaatagtgtacgagttggcctttcaccctgtcatttaatgtgctgaaaattctganacatctgagatttctatggcctgcaaagtctgctggttgaaagtgttggaaacggtagca

SEQ ID NO: 935 - DNA, 121 bp, Artificial Sequence
  Synthesized
  misc_feature (61): n=a or g
gccaagccctttggcaaagcggctggtaaactccaccgccaaaggcaagtgctgagcccangctctttcttcccgtgaccagaactgctataaaacagctttttcaagtcctgtcttgcct

SEQ ID NO: 936 - DNA, 121 bp, Artificial Sequence
  Synthesized
  misc_feature (61): n=a or g
ggcatgatttgacccaagaaaagtctctgtggatgtttctatactcactgcataaggaccngcttgctgcatctctcagtactcatctctagggattgcttcttcctgggggacattttgg

SEQ ID NO: 937 - DNA, 121 bp, Artificial Sequence
  Synthesized
  misc_feature (61): n=c or g
tccagggaatatctgtttgggcgcagcagagataagtgagggtaaagcaacactacgtagncaggctggtggccagcacattgtttggttgatctcagacacttactatactcagcaccat

SEQ ID NO: 938 - DNA, 121 bp, Artificial Sequence
  Synthesized
  misc_feature (61): n=t or c
cagccctggcagctctggcaaagacgaggctgcttacttctccatggagagcatctgctgnttttggtgctggtagtggtacatctgggcgctctgagccagcgtcttgtccccaggctgc

SEQ ID NO: 939 - DNA, 121 bp, Artificial Sequence
  Synthesized
  misc_feature (61): n=a or g
atgctttccttctgcttggtttgtctagtacctgcaccaggatgttctcaaacacactccnggggtctttcagtttgccacgctgctttcccagcagatatccaggtggttaaaatccccc

SEQ ID NO: 940 - DNA, 121 bp, Artificial Sequence
  Synthesized
  misc_feature (61): n=t or c
agctctaatcctacctctaaatgcaatccctcaccccaaaaaggagtcactactttaaacngctacctcaaatcttgccttcacaacaaagtccaaacccacagtccctgacccttactct

SEQ ID NO: 941 - DNA, 121 bp, Artificial Sequence
  Synthesized
  misc_feature (61): n=a or g
gcagacgtgcctatgctaagagctctgccatgtgtttgagcacaggggaggcacaggaccntcaagaccgatgacagccttccaaaagattaaaagccacagcagcatgaataatggatgc

SEQ ID NO: 942 - DNA, 121 bp, Artificial Sequence
  Synthesized
  misc_feature (61): n=a or g
cagtacaagatctatgcatagcttaagacacttaaatctgtaaattaggtctgagatagcnttagactgatggcaagtctacccaagggttcatttcactcactggatgattttgaagata

SEQ ID NO: 943 - DNA, 121 bp, Artificial Sequence
  Synthesized
  misc_feature (61): n=c or g
agcccaaagggaaatggagctgtgagatctagtgagcaacgcactgatgaatctctggtanccattggcctctgctaaccccaccatgccaccacaggctccttctactgaaatgcatcac

SEQ ID NO: 944 - DNA, 121 bp, Artificial Sequence
  Synthesized
  misc_feature (61): n=a or g
aatccacttaggaagagtaattcagaagcctgtaattctaataaagcagagatcatgatgnaagaggtgaaatagaaccacactcacgtgcagttaaaccgagttcttactaaagtagcat

SEQ ID NO: 945 - DNA, 121 bp, Artificial Sequence
  Synthesized
  misc_feature (61): n=t or c
aatatttgcaagggcaaagcaggtagccagcagtgagaacactgagatctgtcagctacantttctttagtgggattagctgggtttctgtttcagaaaaggtaaattcaattttagtttt

SEQ ID NO: 946 - DNA, 121 bp, Artificial Sequence
  Synthesized
  misc_feature (61): n=c or g
ctacggctggcagtctcgtgtaaatccccttcttgacacaaagcacgatcccacatgccancacagctcttcaacagactcagaattctttagttacactggaagtcgtctaattgagtgc

SEQ ID NO: 947 - DNA, 121 bp, Artificial Sequence
  Synthesized
  misc_feature (61): n=a or g
gagctggcctgagtgggggcagccactgcgcaagaactgcctgggcattgttgatgaaacngtccagctgcaggttctattggatgctgggtatagcatgtgcatttattatttactattt

SEQ ID NO: 948 - DNA, 121 bp, Artificial Sequence
  Synthesized
  misc_feature (61): n=a or g
tatgaatcactggcaaatcagccgttgcacaagaaggaagacaagtgcaagctgcagtcangatgagatcatgtttgggatgcaaaggtcagtgtttcacggggcttacagtttaacatca

SEQ ID NO: 949 - DNA, 121 bp, Artificial Sequence
  Synthesized
  misc_feature (61): n=a or g
aagcaccagactatctgtaactgggctctggtcctgcaaaaaggagtttgtagcaagaccnggccatctattacaagaacaggtctggccctgaagcaaccagctacattagcttttggag

SEQ ID NO: 950 - DNA, 121 bp, Artificial Sequence
  Synthesized
  misc_feature (61): n=a or g
gttgcacagagctatcttttcagtctagtggagaatggaggggctagtattaatatctctntgggatgcttagttgggaactctggggactaacatctgtttcttctttccactgcttagt

SEQ ID NO: 951 - DNA, 121 bp, Artificial Sequence
  Synthesized
  misc_feature (61): n=t or c
gaatttttcttcatcaagtgaaaatggtgcactttctgcttttcaggacatgcatctcttngaggttaacacaagaattaagtttccattaatgcccacttttcataaactagtaacttaa

SEQ ID NO: 952 - DNA, 121 bp, Artificial Sequence
  Synthesized
  misc_feature (61): n=t or c
atcatcacttgttcaaatcctacatctggacggctctctcagctcacctgtaaagaccagnctaatatattatcttgataagaacttcttaatctagctaattgcctccacagatactcct

SEQ ID NO: 953 - DNA, 121 bp, Artificial Sequence
  Synthesized
  misc_feature (61): n=t or c
ccagaccaacaagcatatcaaagggtgatacgaacaagtgagctaaccctctactgcagancgcttccccatttcccattcatctcttgataaggtgtgatttccaaaatttaggtctgac

SEQ ID NO: 954 - DNA, 121 bp, Artificial Sequence
  Synthesized
  misc_feature (61): n=t or g
cagccaagaaggtcaagtgaaagtgaactacatttttaatcaggaagtatttttgatcatnagtatatcaacacatgcagcagttacccacttcttatcagcattcaccaaaactattaat

SEQ ID NO: 955 - DNA, 121 bp, Artificial Sequence
  Synthesized
  misc_feature (61): n=a or t
cctccaaatcctcaagtcttaagtgcaaacgctgctgcaagcatctgacaaatggtgcaangagcaggctccatctgcagaggtgtcacctgcaacagcaggatgggaccctctgctgcca

SEQ ID NO: 956 - DNA, 121 bp, Artificial Sequence
  Synthesized
  misc_feature (61): n=a or t
gaagaagtcacaaggaacttgagcttactgagaaaaaaaatccagtatgttggaagtgctncttactttattgttctttgtgctcctcttgtaggcagaggcagaatttgttcatccaggg

SEQ ID NO: 957 - DNA, 121 bp, Artificial Sequence
  Synthesized
  misc_feature (61): n=a or c
gttctccattcccttgagttgtgcactggggtctgtgcacaccaaggaaaggcttcagatngctttctcactcaagtaaaaataatttaatgcagcttaatcgtttcacagaagcaccctt

SEQ ID NO: 958 - DNA, 121 bp, Artificial Sequence
  Synthesized
  misc_feature (61): n=t or c
atagaccaactccagatgcatgctggatgcacctggccgggatgactgcagctcttcccantcctacagcctcttcctgcatacctcacagctaaacactagcacagctccctcccgacca

SEQ ID NO: 959 - DNA, 121 bp, Artificial Sequence
  Synthesized
  misc_feature (61): n=a or g
ggaaaacctctaactaatcttgaagctgaggatgggctttcagtagtgccatgctttcacntaacagtgtaatgccttcctgcttatccaaaaaagaaaaaattcagtgacaaatgatgga

SEQ ID NO: 960 - DNA, 121 bp, Artificial Sequence
  Synthesized
  misc_feature (61): n=t or c
agctccacttctctgtagcttcacagaagctcagcagctcccaagcaatgccaagcacttnctttccttgttgtatctgtctttgtcccagttcttaaccacactgtgctgtgttgctgta

SEQ ID NO: 961 - DNA, 121 bp, Artificial Sequence
  Synthesized
  misc_feature (61): n=t or c
tgcatggactgcatccacttcagtgactgtgtttctgcagaccttatgtagacttccacangcaaccattgttttcaaacattggtcttctcacaaacactgactgtggcatttctttatt

SEQ ID NO: 962 - DNA, 121 bp, Artificial Sequence
  Synthesized
  misc_feature (61): n=a or g
ctgggtattgataataacggggatcacagctctccctgctcagcacaagctgagtgctgtntgtagcaagatgatgaataataaccacaactgcagctgtgatacgactactccttgcagt

SEQ ID NO: 963 - DNA, 121 bp, Artificial Sequence
  Synthesized
  misc_feature (61): n=t or c
gcagacatggacatgccctggacagggagctgtgggtgctgcagacctcacactggggtgngagaggtgtgtgatgctcttcagccaaagatctctctgagaagggccatccctggctggg

SEQ ID NO: 964 - DNA, 121 bp, Artificial Sequence
  Synthesized
  misc_feature (61): n=a or g
tactttgtgagaaattgaaaacctgcatataaatggcaaataaaaggtttctcaatcaaangctgtgtgaaaacatataaaaagtagttttctggtgcagtctaagttagacacaggattt

SEQ ID NO: 965 - DNA, 121 bp, Artificial Sequence
  Synthesized
  misc_feature (61): n=a or c
acttctgtgtgagtgaatgaaaacaaaaaatgaagaacatttctcatacagagagagaagngaccccagaatggcctcacccagttctaagacattttcacaacatgcttaccttagaaac

SEQ ID NO: 966 - DNA, 121 bp, Artificial Sequence
  Synthesized
  misc_feature (61): n=t or c
acggttagactagagatgcccagggttgcaaaccggtgctctcatcttccttaaagccctnttctaatcacttgcagagcctggggacatttcatcaacccagcaagaggagattctctat

SEQ ID NO: 967 - DNA, 121 bp, Artificial Sequence
  Synthesized
  misc_feature (61): n=a or c
atgtgggtagcatggctttggttgctggctgatgaatgatgccctgatgtttctttttcantcctggctgtgaaagggctttaatgggctacacactcttctctggcctatgctgtcagaa

SEQ ID NO: 968 - DNA, 121 bp, Artificial Sequence
  Synthesized
  misc_feature (61): n=a or g
atttctaagtactgtagcaacctgataacaaagttttcttgcaggcaggatcaggaaggtntgaagttcccctgaacctatgctaactcaccaattcccccatgacccccaaccctggagc

SEQ ID NO: 969 - DNA, 121 bp, Artificial Sequence
  Synthesized
  misc_feature (61): n=t or g
aaacagaaagccgcgtggacagcctcaagacttgcagcagcaacacagacttgtagcatcntgattacttacactgttcatctccatcaagattcaatgtagaataagcattttaaaaagc

SEQ ID NO: 970 - DNA, 121 bp, Artificial Sequence
  Synthesized
  misc_feature (61): n=t or c
gggaagaaaaaaaccggagtacaaaagagtcaacaccaaaaggagcattaatcattactancactgaaaacaccatgaagcttctcttaaaagttaaacaacccctagagatgattaacag

SEQ ID NO: 971 - DNA, 121 bp, Artificial Sequence
  Synthesized
  misc_feature (61): n=a or t
ttgagaccaagttgctgagtagctgtcttcccaagtttcttaccagagaaatggtactacntactcaacctccaagaatatagaccaaaaaaaaacccaaaaacccacaaccaaacagcac

SEQ ID NO: 972 - DNA, 121 bp, Artificial Sequence
  Synthesized
  misc_feature (61): n=a or t
ctgagggatggagcatgtatataagagagggattactctccctgtggcactttccctaatnggctttcatcttggaccccagtgtgtcctcatatttttatacatatctttgtttgctact

SEQ ID NO: 973 - DNA, 121 bp, Artificial Sequence
  Synthesized
  misc_feature (61): n=a or g
tctgaagttagcttcgtgtgtacttgggagctctgtttgatgtgtgtcactcaactttctntaccagtacaaaaacattggagactgaagagcccagggagagctgagtgatgaaactggc

SEQ ID NO: 974 - DNA, 121 bp, Artificial Sequence
  Synthesized
  misc_feature (61): n=a or g
taacggtccagctctgtaatccttattccaatgcaagtcctattgatttgttaagctgcantgggcacttcagtgggcactgccttgaaagctgtggaaaatgtagggcaaaacagaaatg

SEQ ID NO: 975 - DNA, 121 bp, Artificial Sequence
  Synthesized
  misc_feature (61): n=a or g
aagatgtaatatgtttataggatgcattttacagctgcatgagaagagcaggttacatgcnttagttctagcagtagtaatgccattttggcttggccttggatatttgcaataatttcta

SEQ ID NO: 976 - DNA, 121 bp, Artificial Sequence
  Synthesized
  misc_feature (61): n=t or c
actcaagtgaaaatcatccaagcccaccaaaatactgatgagtctgggctaagcactgcancacatacaaagatttatgattaataaaagaattactgtatagtacatgctaacatgtcaa

SEQ ID NO: 977 - DNA, 121 bp, Artificial Sequence
  Synthesized
  misc_feature (61): n=t or c
ttaagacagaaacagtccaaaacatctctgcctgcagatttcttatacttcttatctctcngcacaggcgcttattacctctcacctgctgctgataagtacctcctgctgcagcagatcg

SEQ ID NO: 978 - DNA, 121 bp, Artificial Sequence
  Synthesized
  misc_feature (61): n=t or c
gtaggagaccagactgcaatgcagctcagaaatgcaaaggaaatggtatctgcatgtcacnggcgatactttcaaatgggtacccaactcatactaattctggaaaacatcagacgctgct

SEQ ID NO: 979 - DNA, 121 bp, Artificial Sequence
  Synthesized
  misc_feature (61): n=a or g
ttttgtcagagatcatggaagcaaaataggaatggaagatattttgaagaaattcgatggntaagtacagacacctggaacttgacatctagcacggaagtcctttccctgcacaacagtt

SEQ ID NO: 980 - DNA, 121 bp, Artificial Sequence
  Synthesized
  misc_feature (61): n=t or c
gatggatggtcaagagaagtgaacggggtggccaactgccatggggatcatcgtgcatcangagacttgttagccagagaagcataaaaaaatgatgacaagcatgcagataaagcaaacc

SEQ ID NO: 981 - DNA, 121 bp, Artificial Sequence
  Synthesized
  misc_feature (61): n=a or g
atcttagtttccctgttcttctacagggacccacgttcataatttatattgattaggaganaaactgtcaccatgcttttttttaaagtccattgtgataagaaagaataaatacagtgaa

SEQ ID NO: 982 - DNA, 121 bp, Artificial Sequence
  Synthesized
  misc_feature (61): n=t or c
aagccacagccaaaagacatgtgatgtgctcacaccaagggagcaaacacccagcccatgngagatccagggtgctccagcttcacttccacagcatcttggaatatcctgagctgaaagt

SEQ ID NO: 983 - DNA, 121 bp, Artificial Sequence
  Synthesized
  misc_feature (61): n=t or c
aatttgcacagcctttgaaaactgttgttttggaacatcctctttgtgggatctcaggcangctgccggcggggagaaggagcggtggcagaagggacttcccttggcttgtgaggaaaca

SEQ ID NO: 984 - DNA, 121 bp, Artificial Sequence
  Synthesized
  misc_feature (61): n=a or g
gagtgcattagagtcgaggcagcagtaggaggctttataagactgtctagatacaagtatncaatattagggcattttgcatttattactgatatactgctttatttgatcaaaaaggaga

SEQ ID NO: 985 - DNA, 121 bp, Artificial Sequence
  Synthesized
  misc_feature (61): n=t or c
tcctacaggactgagtcttaattgataccttactcccagctgtgaatagtgaagcactcangcatttaacacacgagcctacacagatagataggttccacgcttatttatcttactccaa

SEQ ID NO: 986 - DNA, 121 bp, Artificial Sequence
  Synthesized
  misc_feature (61): n=t or c
ggggtggatctgcaggattcattgccgtgcatggatgctcctcagttggttcaccttcctngtggaggaagaccccagaggtccatctctggtcaaacaattctttatttctatgatttaa

SEQ ID NO: 987 - DNA, 121 bp, Artificial Sequence
  Synthesized
  misc_feature (61): n=a or c
ccaggcattcctttctggatcaggatagttaatttagcagaagacattaccaattcttacncagagagacttcttaaattccttgatagcacattagtctgtccttctttagtacatgcac

SEQ ID NO: 988 - DNA, 121 bp, Artificial Sequence
  Synthesized
  misc_feature (61): n=t or c
gggaatacttcaaattcagtcgaggaacttcctgcatcccagagcctctttgttgaggcantcagccccgatgaaagcatagggacgcacaggagctgacacacttaccaaataggccaaa

SEQ ID NO: 989 - DNA, 121 bp, Artificial Sequence
  Synthesized
  misc_feature (61): n=a or c
taaaagtaatcagaatcctcctttttccttgctactgttttacctcaaagattttcacctnatttcaaaagtctattgtaccatctacagcactggtcagcacaactaccagtagaccgct

SEQ ID NO: 990 - DNA, 121 bp, Artificial Sequence
  Synthesized
  misc_feature (61): n=t or c
aagaaactggaaacaaaaatgcaatgatagcattagatgtagccataggacaggagtgaantagaagcaaatgcaaactattagtagatacagtagatcagtttataactcatacaactgc

SEQ ID NO: 991 - DNA, 121 bp, Artificial Sequence
  Synthesized
  misc_feature (61): n=a or g
ttgaaaaaaaatgtaactagctgggaataggagcagatagtccagggagatcataaactcngagaatttccaaggaaaagggaaataatccaacttattgtttttttaatgcaactctatt

SEQ ID NO: 992 - DNA, 121 bp, Artificial Sequence
  Synthesized
  misc_feature (61): n=t or c
tttcaacagaatatttaataaccagaatgttccatttataaacccttctctgtatgaaaanacattaagcatacctatgctatcaatactttccaccagttttgaacaaatatgtcaccct

SEQ ID NO: 993 - DNA, 121 bp, Artificial Sequence
  Synthesized
  misc_feature (61): n=a or t
agaccagctgacacttgttttggcactagaaagattataaataaggatcccgcttttgtgngtcctgagcaccttcaattcttcttgaccttgatgaggaggaagaagaaattagaaatac

SEQ ID NO: 994 - DNA, 121 bp, Artificial Sequence
  Synthesized
  misc_feature (61): n=t or c
accactgttgatgtcacgggacttcaagttcagtttctcactctgtctgctcagagatctnggattctgtctgcaggaagcttgacaaggtaggtgttttgactgggaaagatgttttgtt

SEQ ID NO: 995 - DNA, 121 bp, Artificial Sequence
  Synthesized
  misc_feature (61): n=t or g
tctttaaatggtctgtcctgcgcactaaaaagtgcactacttcaacctttttacaatttanaaataactagcaattgtggatcatctagtgctaagatctatctacataaatagtggtgta

SEQ ID NO: 996 - DNA, 121 bp, Artificial Sequence
  Synthesized
  misc_feature (61): n=t or c
cagctcgcttgccttcccataattgctctgtcattgtcagttggcagttcgggctcattcntggaagctgtgccgtacaattggatacaattactcccatttaccaccactattatgccac

SEQ ID NO: 997 - DNA, 121 bp, Artificial Sequence
  Synthesized
  misc_feature (61): n=t or c
taaaaatttttaaagactctaggtaatcaatacagtatttttccataatttctttaaggantgggaccaagtaatacaagatgggtttcaacaatggaaaacaacactatgtgaccttttt

SEQ ID NO: 998 - DNA, 121 bp, Artificial Sequence
  Synthesized
  misc_feature (61): n=a or g
ggtgggggtggaggctgcaatgtggtgcagctgctggtgctggcatgtcagttggtccgcntgatgctccaagtgttgttaatgggaagggatgccaccgtcccctcacacccccctccaa

SEQ ID NO: 999 - DNA, 121 bp, Artificial Sequence
  Synthesized
  misc_feature (61): n=a or g
gcatacttattacaattatttattgtattcagtataacaggtgaactggtgcaactttccntagtaaagattcgagatggattattctatgagatgatctattcgtttatccttggatttt

SEQ ID NO: 1000 - DNA, 121 bp, Artificial Sequence
  Synthesized
  misc_feature (61): n=t or c
tctttacatatttgctcccccatgatttcctcctcaagtcccttgatgttttgaaaggcanagacctaaaagatgtgaggactagttcagtgagtgtaatgcttgtgagcaatttccatgt

SEQ ID NO: 1001 - DNA, 121 bp, Artificial Sequence
  Synthesized
  misc_feature (61): n=t or c
cgaccagcagcaagtagagaattttattagcacttactgtgacattatcagccttcctgcnttccagaactttctggtccgcatgtaaggcatgcaggtggcttgtcatcgtcatgctatt

SEQ ID NO: 1002 - DNA, 121 bp, Artificial Sequence
  Synthesized
  misc_feature (61): n=a or g
atttattgactgtggtcctttgcaacaagactgaatttaagcacagatcttaaggccactnttgtggttgtagagaaccaggctatagaagccgttggaccattccattttaaagaaaatc

SEQ ID NO: 1003 - DNA, 121 bp, Artificial Sequence
  Synthesized
  misc_feature (61): n=a or g
gtctaatctctgctcaacatacacacaaaagataagttcatgagcatctatgcacttgggngccaaatatgcaaaatgctgtgaactcagctcagatatctaaactggaacaaattgttgt

SEQ ID NO: 1004 - DNA, 121 bp, Artificial Sequence
  Synthesized
  misc_feature (61): n=a or g
agatgttaatttccacctaaatatcactctgattgtataaaaaagatggttatttcagtgntcctactttgagttattcaaaccaacagcgtattaatttttaaaatgatattttgcagga

SEQ ID NO: 1005 - DNA, 121 bp, Artificial Sequence
  Synthesized
  misc_feature (61): n=a or g
aaacacttgaacacatgtgcactgtaggtccttctactgtgagcagcatttattccacaanaagagcaaacacaatgctcgataaagaaaagcaacccacagatttccataactgtagcag

SEQ ID NO: 1006 - DNA, 121 bp, Artificial Sequence
  Synthesized
  misc_feature (61): n=t or c
atttcttcatctgctggactggaacctgtagaccacagccccacaggttaacaacagcagngcagacctgtgcctccctaacagaatgggtcatttctaatacatattttgcggagacaga

SEQ ID NO: 1007 - DNA, 121 bp, Artificial Sequence
  Synthesized
  misc_feature (61): n=t or c
gtggtatttttatagatacgtgtgtgtgtgttatatatctatccacatatactatatatangtacgtgtgtaaagatgaagtctttatgaaggcgtgcaaggagtatttgagtattgcatt

SEQ ID NO: 1008 - DNA, 121 bp, Artificial Sequence
  Synthesized
  misc_feature (61): n=a or g
ggggattcaaataagttatttggtgtgaaaaagtttgtaatgatttgtatctgcttgttgngtaatcctatgggtacttcttaccaaccactgtcaaataaatcttgtttttgcttaccta

SEQ ID NO: 1009 - DNA, 121 bp, Artificial Sequence
  Synthesized
  misc_feature (61): n=a or g
atcaaccttccgggtgtaaggctggataggctatttgaaaaagatttaagctaataaatanaaggaaggatacactgcatcatcacagagaagctttatgaacacatatgaagcacagagc

SEQ ID NO: 1010 - DNA, 121 bp, Artificial Sequence
  Synthesized
  misc_feature (61): n=a or c
tctatgttcactgtcaattgtgtaggccttaaaatagtactacaaagatgaaataaacttnttttactggaactaaaaatgctgcttttgttcatctttgattctgcttcaaaatgtgatg

SEQ ID NO: 1011 - DNA, 121 bp, Artificial Sequence
  Synthesized
  misc_feature (61): n=a or g
tgccactgtggaccattttagaaatgctatatacgtaactgattttataagtgaatatatncgtatgggcttgtgatttttctgtcaactctcgggtacccattttaatggcttccaagca

SEQ ID NO: 1012 - DNA, 121 bp, Artificial Sequence
  Synthesized
  misc_feature (61): n=a or c
agttggagcgttcctcacactcggtgacaaattctcccctctaggcagtacaagaaggaanaaaaggagaaaagcaaagatagtgggaacctggaaatgggcagtgagtctgcagggaagg

SEQ ID NO: 1013 - DNA, 121 bp, Artificial Sequence
  Synthesized
  misc_feature (61): n=a or g
atagagcatactacctaaggaactggaatcgctgcgttcaccaaacagagcacgtttaacncacacctatatgatgcacagcaagtgtagtgatggatctatgggaaatatgtgtaggcag

SEQ ID NO: 1014 - DNA, 121 bp, Artificial Sequence
  Synthesized
  misc_feature (61): n=a or t
gcaccagcagcacaaataaggagctctgctgcaagcagtccaaggtgcatcaagatggtgntttttttaaatttctgttttgactttgcctaaactcctgttctgggcagtaggtaggttc

SEQ ID NO: 1015 - DNA, 121 bp, Artificial Sequence
  Synthesized
  misc_feature (61): n=t or c
gaaggaacaccgagctaaaatcactgcttaagtttgatggaggggcaaatcaccattcaantgcttgttgctattacttggcattttgacaaacagaagcaatttgtcccatttaaaagaa

SEQ ID NO: 1016 - DNA, 121 bp, Artificial Sequence
  Synthesized
  misc_feature (61): n=t or c
caaattaagaaatgcgtgtagcctcaaatttctggcaaccaaaagggaggaaaagaacttnactctcaaaagaaatctccacgttccatgagaaactctcacattctctagttgtatcaga

SEQ ID NO: 1017 - DNA, 121 bp, Artificial Sequence
  Synthesized
  misc_feature (61): n=t or c
aacataatgatggaggatatttggaaggaatctgaagaaactgggcataccatactaaaangaaggtgatggcagatgttaagtatgaggtctgtgtttagactgacttcctgtttaaaaa

SEQ ID NO: 1018 - DNA, 121 bp, Artificial Sequence
  Synthesized
  misc_feature (61): n=a or g
tccaaaccacacgcctttagcagcagtgcaaagtgtgagctgtgggtcatgctcaccagcncatgcctgtggcagaccgtggccaaggacaccttcagttgtgccaccacctgaaggcagc

SEQ ID NO: 1019 - DNA, 121 bp, Artificial Sequence
  Synthesized
  misc_feature (61): n=t or c
gtttcttgtcactcctgtcaggaagaatccagcatgcattttgtggttggaagtcaaaacngagagctttccttccccaaactcagcagctgcagtgttgtctgttttgctttctcagcct

SEQ ID NO: 1020 - DNA, 121 bp, Artificial Sequence
  Synthesized
  misc_feature (61): n=t or c
ctgactgcaccagttccttggtgctctgattaggggaggcagcaccacaaacgtgcatcgnctctgttctctgcttgccatttagagagagtgagtgaccaggcataaagcccagaaaaag

SEQ ID NO: 1021 - DNA, 121 bp, Artificial Sequence
  Synthesized
  misc_feature (61): n=t or c
tgaatccatccactttccatcacacaaatgcgttcactataaagtctctgggttagctgtnaaattctctctgctggcagaactccctggaacctgtggtagctccgcaagcagcgagctt

SEQ ID NO: 1022 - DNA, 121 bp, Artificial Sequence
  Synthesized
  misc_feature (61): n=t or c
aagtaaaagccagtaaaaagtttgtgaaagggagtgatgaacatgaatatctctaagttantgttttctgtctctttaagaaattatgaaatggattcaattccttttacaacttgctggc

SEQ ID NO: 1023 - DNA, 121 bp, Artificial Sequence
  Synthesized
  misc_feature (61): n=t or c
gttttctttcacttgacataatccagtgaccttatttttttcccccttgagtaaatatttnagcaaaggcaagccaaattgatgcactttgtcttcccttaaaataaccagcaagcccatc

SEQ ID NO: 1024 - DNA, 121 bp, Artificial Sequence
  Synthesized
  misc_feature (61): n=a or t
tgttcccttttgagatgaggcattcactgtatacatggtgaaatctctgtaccaaagagcngaagatggtatatagatgaggagaccatagttcagtggaaagcgcagacatttatctgaa

SEQ ID NO: 1025 - DNA, 121 bp, Artificial Sequence
  Synthesized
  misc_feature (61): n=t or c
actgctattggacatttcccaagttctgagatggaatagttttgtttccagtgcaactgcntgaataatatgctggctagattaaacacaaaaggttgtggtagcaactgaacttatcaga

SEQ ID NO: 1026 - DNA, 121 bp, Artificial Sequence
  Synthesized
  misc_feature (61): n=t or c
attacttccccctggggaaaggatagggcctagaggctcacgtagagccacagacattacnagagctcagcaggaccatatggagtcaggtgaggaacttctgctcctgcagcagctgtcc

SEQ ID NO: 1027 - DNA, 121 bp, Artificial Sequence
  Synthesized
  misc_feature (61): n=t or c
agtatgacattcatgtaaaggactttttcaagctacgtaatccctggcaaaatgaggcacntctttaccttgaggaaacaaactgcacacacatcagcctaccagtgttacggcacagact

SEQ ID NO: 1028 - DNA, 121 bp, Artificial Sequence
  Synthesized
  misc_feature (61): n=t or g
gctgctaaacaaacttaataccttgggctccttttctactttcttttcaaagacaactatnatgtatgtgaatattattcatttcataggagctctgtaactataatacatcattttacta

SEQ ID NO: 1029 - DNA, 121 bp, Artificial Sequence
  Synthesized
  misc_feature (61): n=t or c
aatcacaaatatttaggagtctgatttatctctaaggccctcttgtatctaacttttgatnctcttaagtagaagcaagctgtaccagtgaggcaggagagcacaggttgaaccagcgact

SEQ ID NO: 1030 - DNA, 121 bp, Artificial Sequence
  Synthesized
  misc_feature (61): n=a or g
ctggcttccttgcttatgaacaaagcttctgcaccttaatctacttctgtctctttcaccnttgcttgctaccatccagaagccagagttgctaaactaaaaatcaaataactgagaaaat

SEQ ID NO: 1031 - DNA, 121 bp, Artificial Sequence
  Synthesized
  misc_feature (61): n=a or g
agcccctctccccaggctttttaaatccccagcacctgggtgcattcacacccagatcccntttccacctgggtacactctcctcctctctaagcagcttcagctggggcagatgggctgt

SEQ ID NO: 1032 - DNA, 121 bp, Artificial Sequence
  Synthesized
  misc_feature (61): n=a or g
ccgctcccacgcagcacaaaccacaaaaccaatccacacgagccctgtgtttgtaacagcnccgaggagcttctccctgagcaacaccattttgtccccttcttgaagccaacagctaaat

SEQ ID NO: 1033 - DNA, 121 bp, Artificial Sequence
  Synthesized
  misc_feature (61): n=t or g
cagacaaatacacttgactaaggtatctgccagtgctagctggagtataattttttaacgngaccttccttaaatggttttgcatggaaatcacatccattttccacttgtaaagcttcct

SEQ ID NO: 1034 - DNA, 121 bp, Artificial Sequence
  Synthesized
  misc_feature (61): n=t or c
ccactcactacaaagcaatgcaacagaacccatgccagtggggcacacacatgactagcantttacctaaggtcgctgaaacgagcccaactattttctcactgacttccatcagtccctg

SEQ ID NO: 1035 - DNA, 121 bp, Artificial Sequence
  Synthesized
  misc_feature (61): n=t or c
gagcacaaaacgataacgaagatcacaaaaattcagagaacctctgaaattcaataacttntgcccacatatatccaagaagcatcaagtatctctcacataaattgcatttgcactgaaa

SEQ ID NO: 1036 - DNA, 121 bp, Artificial Sequence
  Synthesized
  misc_feature (61): n=t or c
agtttgactgcatacactgggtactgggttttgactcattcccaatttgagaagcatgccnaaaatcactggcatggtagagaggtggattttgctgctgcagctgcaattgttgctttcc

SEQ ID NO: 1037 - DNA, 121 bp, Artificial Sequence
  Synthesized
  misc_feature (61): n=a or c
agctctgctacagcctcgggatagtggtgatggtgaaataaagactggggctgtgatctgnacaagcaggaacagctttctctgagcctagaagcatttgactgcaaaattaagtgtgtga

SEQ ID NO: 1038 - DNA, 121 bp, Artificial Sequence
  Synthesized
  misc_feature (61): n=t or c
ctccatttccagaaagatttgtcctatttcatgaatatctagagggaaccagacagccaanagggagatactacctgtggggaaatactgaaatcattatctccttcagagaactgagcaa

SEQ ID NO: 1039 - DNA, 121 bp, Artificial Sequence
  Synthesized
  misc_feature (61): n=t or c
cagagaggaaaagttccttgatgtctacacctgtcttcacacagaaagaactgtttattcngaaaataaatcttatttaatacacctagaatttctcacaaatgtttagaatcaaataaat

SEQ ID NO: 1040 - DNA, 121 bp, Artificial Sequence
  Synthesized
  misc_feature (61): n=t or c
ccacagtttctacaggcaggctatgtacatgcctcactgtatattttatctacgtttactnctgtctctagccattttctgtcaacagaaaccacttccattttaccctaggatagcagtc

SEQ ID NO: 1041 - DNA, 121 bp, Artificial Sequence
  Synthesized
  misc_feature (61): n=a or g
cccctccacacattatccttagcaataaaacccaaacccagagccatggccaagaccctangtacatgtccaaaggcattatgttcttgagagagaaagcttgtggctggaagaggaccag

SEQ ID NO: 1042 - DNA, 121 bp, Artificial Sequence
  Synthesized
  misc_feature (61): n=t or c
acttttcatctacataagaaatagttaaatatcaaacacatccagtccagctcttagcacntcttaaaagtcaacttagatcagagcaaattcacttactagaccaaggtttgaaacagtc

SEQ ID NO: 1043 - DNA, 121 bp, Artificial Sequence
  Synthesized
  misc_feature (61): n=a or c
ccatgcttcaaaattctgacagatctgctaactaagactgcctttcataagctttcataanaaatgttttaatactccagaatgcataccttaatattattgaatctgttgctacattttt

SEQ ID NO: 1044 - DNA, 121 bp, Artificial Sequence
  Synthesized
  misc_feature (61): n=a or g
gtcttcccaacagccagcggtggtgctgagaacaaaaaggaatcttcttttcatctacatnaaaagaaggtgtctggctgatctgaaagagcctttttacaagggtaggtatggtgcagag

SEQ ID NO: 1045 - DNA, 121 bp, Artificial Sequence
  Synthesized
  misc_feature (61): n=t or c
ccactcccagcttcagcagccatttgaaactctttctgcagattaccacattctacatatngtgtccatgaggaaggtttaattaactgaagtgcataaagcacaaggagctcgtcagata

SEQ ID NO: 1046 - DNA, 121 bp, Artificial Sequence
  Synthesized
  misc_feature (61): n=a or g
gtttgtatcacccttcacctctttctcagggctctcagccaatgagaaagatcttctctcncggctctcttttcagatgtgtgaatgggctccacagaggttggagaaatttgcagctagc

SEQ ID NO: 1047 - DNA, 121 bp, Artificial Sequence
  Synthesized
  misc_feature (61): n=t or c
ttaattgcttgtttttcttgcataaaggtaagagataaaaaggtaggtttttcccacttanagagacctggactaatttccaggctgtgactcttcataggagcttgtgatttgagatgaa

SEQ ID NO: 1048 - DNA, 121 bp, Artificial Sequence
  Synthesized
  misc_feature (61): n=a or g
atcttcacattaatctctttgcactcaatttcttcagaaactaatgaggttagtatcctcnaggagtattgtgatacttcatagtggcaatgctctgagattcttaaatggaaaatgctag

SEQ ID NO: 1049 - DNA, 121 bp, Artificial Sequence
  Synthesized
  misc_feature (61): n=t or g
ctacgctacagacgagtgtacatcattcctttacataactttctttatggaagtgaaaatnatcttatggaaagcttctgcattctgtttttgtttttttttaaacatgctgttcattgaa

SEQ ID NO: 1050 - DNA, 121 bp, Artificial Sequence
  Synthesized
  misc_feature (61): n=a or g
tgtcgctgctccagtctgaaactgcagatagacttaataacagtgctgagttatgcttaantcggctttgcgtcacagcagtgcacatctgtattaaatacagatcatagaatagaatcat

SEQ ID NO: 1051 - DNA, 121 bp, Artificial Sequence
  Synthesized
  misc_feature (61): n=t or c
ctgagttcattttctcatggtttcaccttcataggttcagaacacaaggactcccatcctnttactgatcatgtgtcctgccacatagataaacagaatacttcattttccagtgctgtac

SEQ ID NO: 1052 - DNA, 121 bp, Artificial Sequence
  Synthesized
  misc_feature (61): n=a or g
attgctagcagtgtcacacttctacatgctcttctgtgttattccttttttaaaagaccanttgatgacagagatcacacctaagctgtataacctacacagacatgttactttccaaccc

SEQ ID NO: 1053 - DNA, 121 bp, Artificial Sequence
  Synthesized
  misc_feature (61): n=t or c
ctcttctcctagagatccttgcatctaggtattccctcccagtcattttatttacaaccancttcactcaccaaaccaagaatagtgtgatgctgcctcctcctctacatcaccctattga

SEQ ID NO: 1054 - DNA, 121 bp, Artificial Sequence
  Synthesized
  misc_feature (61): n=a or g
actgtgatatcagtggttctgctggctttcatgacagacagtgttccagctagagtaaagnggtttcattttagaaaaaatggagtattttcttttggccattacaatctttagcagtgaa

SEQ ID NO: 1055 - DNA, 121 bp, Artificial Sequence
  Synthesized
  misc_feature (61): n=a or g
tatgctgaagtcgacagataatacatttaccaacatgaaccagtccatcttaagatgctgncctgattcttctgcctgataattcagtaagtattttatgaatactgtggtatatctgatg

SEQ ID NO: 1056 - DNA, 121 bp, Artificial Sequence
  Synthesized
  misc_feature (61): n=a or g
aaagtgttagtgtgtctggaagagatgatggtgaggatccaggcacatatccatgcattcngaacaataccctgattgtttcaggaaaggtggcagtgtcctgatcattaatttcctaaaa

SEQ ID NO: 1057 - DNA, 121 bp, Artificial Sequence
  Synthesized
  misc_feature (61): n=t or c
catgacattttcctgatagaagatgtgtcacagctctgaactatagctgcaagtttccacnatgccaagaggcacagagtaaatgtccatgctgctgcaggaaaatattcagggatgttct

SEQ ID NO: 1058 - DNA, 121 bp, Artificial Sequence
  Synthesized
  misc_feature (61): n=a or g
atgtattccgtgtttcaaaacacagagttatacttctgcattatcttcaaacataaaaagnaaatcaagagacagtgctgcttctctgttattcagtttgatgaacttagcattatgattt

SEQ ID NO: 1059 - DNA, 121 bp, Artificial Sequence
  Synthesized
  misc_feature (61): n=a or c
ctttcatgcagaaagcctttgtgtgtgtgaatactaccctaaatattgtaatcatgctgcnttccatagcaaatggtctttctagactgaatcaaactttccatggagtcatctcaactgg

SEQ ID NO: 1060 - DNA, 121 bp, Artificial Sequence
  Synthesized
  misc_feature (61): n=t or c
gcctcaattctcatggcactcatctagtctttgctgtagaattaacctgatctacacctangtggaagaatacccagccacactgctattcattaatttacacactgttgagcacttggaa

SEQ ID NO: 1061 - DNA, 121 bp, Artificial Sequence
  Synthesized
  misc_feature (61): n=t or c
attccgctccaataaaagtaagtgaacgaggattgaacaaatgaattcagcagtgctagantgcagccctaacggtgcaatccaatgcagaggcaggctgagatgtgagcctgtgccaggg

SEQ ID NO: 1062 - DNA, 121 bp, Artificial Sequence
  Synthesized
  misc_feature (61): n=t or c
aaacatcttccatctttttcatttcctgctgcttgctgtctttcataccctggttctgganaagatcaagtggctttctagagcccaggcactgcacctgaaccatttctcacttctcttt

SEQ ID NO: 1063 - DNA, 121 bp, Artificial Sequence
  Synthesized
  misc_feature (61): n=a or g
gtggttcaatactggctgcttgcactttcattccaaaaaaggcttcaactctcttccccangagacggcgtggtctctgtgcacacaaacccatttggaatgaggaacggaaactgcagaa

SEQ ID NO: 1064 - DNA, 121 bp, Artificial Sequence
  Synthesized
  misc_feature (61): n=c or g
cttactttaatgaacagaaacagtgacagatgcacaaggagcatccttacccataactcgntccttttatttctgtaactcagatctaattgctcaagcagactgcagaagttaggaggtt

SEQ ID NO: 1065 - DNA, 121 bp, Artificial Sequence
  Synthesized
  misc_feature (61): n=t or c
tgcaagagagatctactcccactaaaccaacctcccgaggtgagtcctggcatggcagttngggcatgaagcaccatcctcattctggaaatcactccaacagcaacaaaaagggcagcga

SEQ ID NO: 1066 - DNA, 121 bp, Artificial Sequence
  Synthesized
  misc_feature (61): n=a or g
ggatgctggggggcagtagctgcccagatccattgaagacgtctctgactgtccgggagcnaattgttaatgctatctacaggagtggcggaggaaccagcggtaggttttagggctcatc

SEQ ID NO: 1067 - DNA, 121 bp, Artificial Sequence
  Synthesized
  misc_feature (61): n=t or c
cacaataatttcttgttgtttgtttttgtgtctttgactcttcgctcttcaaattccatcncaggcccctcaggttccttctcacacgtcccactctggactgtgcctctgtctctagcat

SEQ ID NO: 1068 - DNA, 121 bp, Artificial Sequence
  Synthesized
  misc_feature (61): n=a or t
atggcgaaggacatccctagaacagagactgatggaaactctgagaatacattgagggagncagcaagtacatacttgcaagattttcgttagagataaattgaagagacactcagatctt

SEQ ID NO: 1069 - DNA, 121 bp, Artificial Sequence
  Synthesized
  misc_feature (61): n=a or g
acttatttcccatttaccttcctgaccctgcttcagcatgttccaattagtgttcctcaangctgatatacttcagaaggaattgcttctcaaaacgtgtgctaggagctgatgtttctcg

SEQ ID NO: 1070 - DNA, 121 bp, Artificial Sequence
  Synthesized
  misc_feature (61): n=t or c
ttgattttagccataattttcatgcctgttttagaagtgcttacaactacatggtcccctntagagccttgcaccagaaattccgtgtgagtaggaaaacaatgatgaaacaaagcactga

SEQ ID NO: 1071 - DNA, 121 bp, Artificial Sequence
  Synthesized
  misc_feature (61): n=t or g
agccttcctcagtgctgcagctgttacttgcagtgctgaaagatgtggctgtgtgaaatgnagtgcagcattttagctgtctgcagcttgagttctttcacaaacaggtttggttttgttt

SEQ ID NO: 1072 - DNA, 121 bp, Artificial Sequence
  Synthesized
  misc_feature (61): n=t or g
aagatcttaaacatcaaaaacaaaaaagcaactacaactgactggaagacactgggacttncactcactcagctttgctctcacttccagaatagaaatgccattaaaaagcattaaacgg

SEQ ID NO: 1073 - DNA, 121 bp, Artificial Sequence
  Synthesized
  misc_feature (61): n=a or t
tcctcccacagtttttgattcttatcttgcattgagcccctcaaaaactaatcagagaggnctgaaaggcacagaaccagctggagaagttcagggtgtgtaggcacaggacttctttctc

SEQ ID NO: 1074 - DNA, 121 bp, Artificial Sequence
  Synthesized
  misc_feature (61): n=t or c
ttctttcctctctgctgggaatggctgtgatgtaaacgaaaagcttcttcacacctgtgcnccaccagtagcctgatcacatgtaattggcatggcctcactccttttgttactcctgcat

SEQ ID NO: 1075 - DNA, 121 bp, Artificial Sequence
  Synthesized
  misc_feature (61): n=t or c
tggtaattcccctggataaatgctttgctttgcaccagtgtgagataaggcttatcccacngtaacttccctgaaagatttctgaggtaagcatcctcataataagcctcttctgttacag

SEQ ID NO: 1076 - DNA, 121 bp, Artificial Sequence
  Synthesized
  misc_feature (61): n=a or g
tgccctttcatattcatgggactgtgatgaggtgttcacagggctaaaaactcagttgtcnggaactagcaaaggttgggagagcaggtacagaatgacacagcctgtcctaaccttgttc

SEQ ID NO: 1077 - DNA, 121 bp, Artificial Sequence
  Synthesized
  misc_feature (61): n=t or c
ttccttactgatgcacagccaatgagttgagaggtaggctggaagggtgacattcaggggnaaggctctaactatcgtgaggtaggagtgattcatcaaaacttgctttgcagtatttact

SEQ ID NO: 1078 - DNA, 121 bp, Artificial Sequence
  Synthesized
  misc_feature (61): n=a or g
ttaccaatggtcatactgtcagcacccatgctcagtgggcagcagtttgcaagactcaggnaagaggaaatggccagctcagcactaagctgaagcaatcaaacaggacctgattccttcc

SEQ ID NO: 1079 - DNA, 121 bp, Artificial Sequence
  Synthesized
  misc_feature (61): n=t or g
caaatgtttcaagaacttttttttttttctggtagtatgggcatgtttgaataataacttnctggacagcttctggacaggatgtgtttttggtagcaagctatttgacgtggtgctctgg

SEQ ID NO: 1080 - DNA, 121 bp, Artificial Sequence
  Synthesized
  misc_feature (61): n=a or g
cggacttccagcacagcacaatgaaatttccatagtgtggtaagcacaagcatgtgttctnatctatagaaaatacattttccttttaatccttcctcacatcaagaagctcagtctagca

SEQ ID NO: 1081 - DNA, 121 bp, Artificial Sequence
  Synthesized
  misc_feature (61): n=a or t
cattctatgaatacaaaccgtatcacgtgcatctcatttcagatggaacattgaatgcagntagaaacccatttatctccattcctccaaaatttggctcaatcacattagtctttgtaaa

SEQ ID NO: 1082 - DNA, 121 bp, Artificial Sequence
  Synthesized
  misc_feature (61): n=c or g
gaaatcatatgttcagaaaaagttgacgaactgggaaggtaagtgcactctgacagaactnctttacacacagtaggcctggaagtaaaaaataagtaaacacaaatgcaatatatatgta

SEQ ID NO: 1083 - DNA, 121 bp, Artificial Sequence
  Synthesized
  misc_feature (61): n=c or g
tttggactactgctgctttgaggaaattttctggtttctgacattagtctgttactgaacncgggcaaaggttttgttaaggcattttttcttcagggctaatatgccactctacaggacc

SEQ ID NO: 1084 - DNA, 121 bp, Artificial Sequence
  Synthesized
  misc_feature (61): n=a or g
taaaaaagttcaactatgaatgtttttacctggggattcttcacaggtctggtttagcaangtaagttcacagataagttgagataagctctcagaatgaaggctagtgacctgtccataa

SEQ ID NO: 1085 - DNA, 121 bp, Artificial Sequence
  Synthesized
  misc_feature (61): n=a or g
taggtagaggcttcctgctctcttctacttttcaactataataagggtattcgtcatgaanttgtgtgtcagcagctacagacttgctgaagtgttgcatttggccatcaaaattaggatc

SEQ ID NO: 1086 - DNA, 121 bp, Artificial Sequence
  Synthesized
  misc_feature (61): n=t or c
gaaacatatagcaacccctctgggtccacctttgccagacaggttctaactgctacaccantgaagtaggacactttcttatatatttaggaactaaaggatctccttacaacttctaaaa

SEQ ID NO: 1087 - DNA, 121 bp, Artificial Sequence
  Synthesized
  misc_feature (61): n=c or g
gaattctgcctgatggtaagaggccacgggtaggacatgaaacagtgagctgggagaacanatgggcttctctgatggaaggcttgcgcatccctttgcagtgatgaggtgttgtgcaagc

SEQ ID NO: 1088 - DNA, 121 bp, Artificial Sequence
  Synthesized
  misc_feature (61): n=a or g
agctgctcaggtcaagcaaccaaatatgaatgctgtctagaagaaggtttttcttcaggcnagcatgaacaatccccttttttgtattcaaaaagatcccccaagccatttcctgggctcc

SEQ ID NO: 1089 - DNA, 121 bp, Artificial Sequence
  Synthesized
  misc_feature (61): n=t or g
acttgccataacttcagctgacattgcactgtggcccatgtcttgttttcagcccagatangtttcgtagtacactgaagtttgcttcaagctgagtgatggttgcatacctggggcctgg

SEQ ID NO: 1090 - DNA, 121 bp, Artificial Sequence
  Synthesized
  misc_feature (61): n=a or g
aatactaatttgaatttgctttgtttcttgtttccactttgtgattttatctttagcaganaaaaaaacagtcagtttatcaatgtttcttgtctgagaagaaataatatagtcaactttg

SEQ ID NO: 1091 - DNA, 121 bp, Artificial Sequence
  Synthesized
  misc_feature (61): n=a or g
aaaaactaggtcaaaactagatctaacataggctgtcctaaggcacacgacaccaggagtncaagcagattaacagctgatgaatgaaaactaatttcttctgataaatatgcgctaaatc

SEQ ID NO: 1092 - DNA, 121 bp, Artificial Sequence
  Synthesized
  misc_feature (61): n=t or c
acctctcccatctccttcagctctcatccccattggccggaggaaaatggcacctagagangatgaggtgtgtgagtggagaagaacagcaagaaaaaagatccaagtctcaagaagggac

SEQ ID NO: 1093 - DNA, 121 bp, Artificial Sequence
  Synthesized
  misc_feature (61): n=a or g
ctttcagagatgacacaatcttatattctcatttattatgaggcttgatactgccttttanaaaactttaaaggttcctcaaataagcacagctatctgtatacacacacacacacactga

SEQ ID NO: 1094 - DNA, 121 bp, Artificial Sequence
  Synthesized
  misc_feature (61): n=t or c
ctgctttcttagcaaaaggatctaggcaatagctactcctcaaactctggatagagcaaanagctcctgacttttttccccctttcaatcttccactacaggtgctctcagttattcacag

SEQ ID NO: 1095 - DNA, 121 bp, Artificial Sequence
  Synthesized
  misc_feature (61): n=t or c
ataatatatcagttcctgtttaattacaaccgagctactgtcgcatgcagcattataaganatagcctccctggagtaagaaggatcagatgtaagattctctttgagctctatttattag

SEQ ID NO: 1096 - DNA, 121 bp, Artificial Sequence
  Synthesized
  misc_feature (61): n=a or t
tctgacagagctggcaataagaccagggaatggagggcaaggaacaaattatcccttcagntaaaaacgattctgatggaaagctacctgctgcttgctcccatcaccttgagctcaaact

SEQ ID NO: 1097 - DNA, 121 bp, Artificial Sequence
  Synthesized
  misc_feature (61): n=a or g
gctgaagtaaattggaaagcagcgaaatgtttgttctatatagaagttgctttgctgtgcnaggcaagaagcaaagtgaggccaaaattccaaacatccgtctggtttgttctcacagcgc

SEQ ID NO: 1098 - DNA, 121 bp, Artificial Sequence
  Synthesized
  misc_feature (61): n=a or g
atacaaacaaatgtgataacattcactaagtggtgctttctcctttaatagttgatccagntagaagataatttactcactgaacagaatcaaaacaaaaaggaacctctttcatctgtat

SEQ ID NO: 1099 - DNA, 121 bp, Artificial Sequence
  Synthesized
  misc_feature (61): n=a or g
aaacctccactgtggaaacagtatctctctttgtatcctttatactttgaaccttagaganaccattaccctcattctcatttacctttttcaccatcttttccacttgtctctaatctgc

SEQ ID NO: 1100 - DNA, 121 bp, Artificial Sequence
  Synthesized
  misc_feature (61): n=t or c
attggtgtattagaaacaaatgtgttgggagtacagttgttcaacatgattgtattgctgnctgatggcactggctggcagaagtgtcaggagcaatctgactcctccaactgcatgcaag

SEQ ID NO: 1101 - DNA, 121 bp, Artificial Sequence
  Synthesized
  misc_feature (61): n=t or c
ctttctgcagtttggggtgaagctttcccctaacaggttattttcattcctgactgatganattttgtaatgaactcagcagtgcactgaccatggctgtgatatgttctgtttctacaga

SEQ ID NO: 1102 - DNA, 121 bp, Artificial Sequence
  Synthesized
  misc_feature (61): n=t or c
atagggccaggttcaagtacccttaagagtgagtgcgttccttgttctttaaggcatcctnggtattgtttttccccagggacagatacacagcgtgaccagcaagtagacattatcattt

SEQ ID NO: 1103 - DNA, 121 bp, Artificial Sequence
  Synthesized
  misc_feature (61): n=a or c
ggtaataaggactattgcctctggtccaacatacatgttccttcccctttgcatccacacntgaatgattctggcactgtcagctagatcagcctgcagtgtgaagcaataagtacagaag

SEQ ID NO: 1104 - DNA, 121 bp, Artificial Sequence
  Synthesized
  misc_feature (61): n=t or g
aataataaaaaatgggcattctacagcccttgaactggcactattctggagtgctaaatgntcttaataagtaaataaaatgcaagctatttacagagaaatcagaatggcacctttgcat

SEQ ID NO: 1105 - DNA, 121 bp, Artificial Sequence
  Synthesized
  misc_feature (61): n=t or c
aacacaagacctctcacaactgttgaaaaaacaggaatgctttgctaccttcttctttacnctgatttatgacacaacacgaaatcaggtatttgtagcaccaaagcaagaattgtagaat

SEQ ID NO: 1106 - DNA, 121 bp, Artificial Sequence
  Synthesized
  misc_feature (61): n=a or t
gcttatctgattgcttagttagtgctaccttcattcagatccagtgggcagatcgcaaatntggttttaaagactactggcagcaatagtctcagggggagaatcatgaaggggaggactt

SEQ ID NO: 1107 - DNA, 121 bp, Artificial Sequence
  Synthesized
  misc_feature (61): n=t or c
acagcaggcttagagaaatcttcaggcagactttatcctaaataattcccatccccgattntggtcccagattcagtagtgagctgtgttccagagaaaatgccaccactacaaaatgaaa

SEQ ID NO: 1108 - DNA, 121 bp, Artificial Sequence
  Synthesized
  misc_feature (61): n=t or c
ttcagcctggccaatctgaccaccaaacttagctttgagatacactcactcctggccaaangcagaacccaaagctgccaagaaattctgcacgtgaggagatgaagccctatttaatttg

SEQ ID NO: 1109 - DNA, 121 bp, Artificial Sequence
  Synthesized
  misc_feature (61): n=a or c
gttcagaaaacacttacactatcacaaacagacttggtcctacctttcttgctattacagntagttacactccttgtaaatcctgtgctttaggtcttccctgaaatcatgttgttttgga

SEQ ID NO: 1110 - DNA, 121 bp, Artificial Sequence
  Synthesized
  misc_feature (61): n=a or c
actgattctctttctttcaaacagaggttctgaaaatctgctatgttttatataaattaangaggcagatcataccttctgttgaaaaactggcatgggttataaaaactagaatttaata

SEQ ID NO: 1111 - DNA, 121 bp, Artificial Sequence
  Synthesized
  misc_feature (61): n=a or t
agtcagtcagagatttcagaattgttatcatggtgtaaaactatgacaaaggtttcagcgnggacagatttaaagtgacatgtcagagtgtaaaaaggtctatatttcataggattggcta

SEQ ID NO: 1112 - DNA, 121 bp, Artificial Sequence
  Synthesized
  misc_feature (61): n=c or g
ttgcaaagctacatgtttgggggtattattccaccatctttcaaaccatttttgcagaagncttcagttttcatctgagcataagctgctagcagccaaagcaggacagcccagcacccct

SEQ ID NO: 1113 - DNA, 121 bp, Artificial Sequence
  Synthesized
  misc_feature (61): n=a or c
ggattattctcattaaagtgtggcagtaaggatctagctctcactaagaatttttccagantaaagaccagaccaagttgcattatcatagaaatgcatttataaatatcatccctctaaa

SEQ ID NO: 1114 - DNA, 121 bp, Artificial Sequence
  Synthesized
  misc_feature (61): n=t or c
caaactcaaggtatttccgggcactgacaaaccactgtgctgttctcctcctggtattggnatcctatccttagaacaggtaaagaaccttgcttcaaaggaacagaaaaatattagaagt

SEQ ID NO: 1115 - DNA, 121 bp, Artificial Sequence
  Synthesized
  misc_feature (61): n=c or g
gtaagtttatttactatgctttctcctaaaatggtcagtactgtatagaaatacacattantatgtttctcaatcaattatgagaataatgtatagacttcaaacataaaaaataaaaatt

SEQ ID NO: 1116 - DNA, 121 bp, Artificial Sequence
  Synthesized
  misc_feature (61): n=a or g
aagagtaggatttctcttaagagtttgaatcaaaactttttgtccattttctaacatctgntactttctaatctgtagatgcattgaacaaaagttcaagcgttgcccgccattgccaacc

SEQ ID NO: 1117 - DNA, 121 bp, Artificial Sequence
  Synthesized
  misc_feature (61): n=t or g
tgaaaaaaaaatggagccatacaaagactgatagggttggcctgtgcatttgacgtgaagnaagggaaggaagaagcagtgttatttctaaaaggtaatatgcagttccagtgtctattcc

SEQ ID NO: 1118 - DNA, 121 bp, Artificial Sequence
  Synthesized
  misc_feature (61): n=t or c
ataaactaaatctaccattttgtacacagttttgcctcaaaaacgaaggtaggcgtttganataaaactaaggatatgggaataggaaaccacctgcaaaatgtgaaggaaagcagttact

SEQ ID NO: 1119 - DNA, 121 bp, Artificial Sequence
  Synthesized
  misc_feature (61): n=a or g
taactccagctggacttactggtttatgcagctacagtgaaaagcagatctttgctatctntccttaaaggtgtttgctccaagaaacattcctatgtcataactaaatgtcagactttgt

SEQ ID NO: 1120 - DNA, 121 bp, Artificial Sequence
  Synthesized
  misc_feature (61): n=a or t
ccctcaggtttctctgccttgatctttacatctctaacgctgaataagggacatttactcnttgtgactagggaattgtttaaagttttgagtgctttgaataacaaaataaaaggtttag

SEQ ID NO: 1121 - DNA, 121 bp, Artificial Sequence
  Synthesized
  misc_feature (61): n=c or g
attcactccagtgcaaatccatgcttccagaggtacctggaaagcttgagccagccaattnaatgtgtgctatcaccaatagcatcattcaggtcctcttaaaccttaatttctttccatc

SEQ ID NO: 1122 - DNA, 121 bp, Artificial Sequence
  Synthesized
  misc_feature (61): n=a or g
aggcagtctgttgttcgataggacactatcttcatagtcctctaaactatgtgctctatcntatgtgttcgtttttaagtagcagaggaaaattaaaactaatatattacttctggtttct

SEQ ID NO: 1123 - DNA, 121 bp, Artificial Sequence
  Synthesized
  misc_feature (61): n=a or g
tcaggccaataactttctaaggggaaaagcacccttccaaacagctacattcagatgtcanaaggcacacagagcacccaaacggcctacagccaaacagagcattcccatatgcatgtac

SEQ ID NO: 1124 - DNA, 121 bp, Artificial Sequence
  Synthesized
  misc_feature (61): n=t or c
ttatcattttttacttcacagattgttcctttgagacatttcctgcatactatagactccntttcccccagaatatgcaagattcagttcaagcatagttagggactgtgatccacacatg

SEQ ID NO: 1125 - DNA, 121 bp, Artificial Sequence
  Synthesized
  misc_feature (61): n=a or c
cctccttgacctcctcccaactagagctccttgctgcaggctgcttatggcagtctgcagngtgctggtccaggtagctttagctaagaagggtaaagatcccacacatcagcaggtgttc

SEQ ID NO: 1126 - DNA, 121 bp, Artificial Sequence
  Synthesized
  misc_feature (61): n=t or c
agaccctcctgctgatggtctttccagtggtcagcagctttctgggtaaacaaggaactgnatttattttcgtttgccttcttctgtgactcagcagcaaccaggctgagattcacaaaca

SEQ ID NO: 1127 - DNA, 121 bp, Artificial Sequence
  Synthesized
  misc_feature (61): n=a or g
aataacttaggagataccaaggaggctgttgaggagtagaaagtataaagacaaaataaanctgtattagactctcatcctgcctctgtatcacactgttgaagacctacaggagtaggtc

SEQ ID NO: 1128 - DNA, 121 bp, Artificial Sequence
  Synthesized
  misc_feature (61): n=t or c
caccgcatttatcacagcttcctgttttggatcttccttcatttgcagagtcaggtaatanggtctattttaaagtctgatttaatgaacagttcaaattaagtttttaagttttacgcgc

SEQ ID NO: 1129 - DNA, 121 bp, Artificial Sequence
  Synthesized
  misc_feature (61): n=t or c
agaaacaaagctttttcacctgagaatgagctttaactgtcctatttctaaattggcagcnttgatacatgtacatcagttaaattataataattaaactttatatacacagacaaaaggt

SEQ ID NO: 1130 - DNA, 121 bp, Artificial Sequence
  Synthesized
  misc_feature (61): n=a or t
atcacctaatataagccctcattactcttacattaaccactgcaaccacttgtagttgtantacacctgatgcagaccacaataacatatatagaaaaaaggaatggtgagtgatttttcg

SEQ ID NO: 1131 - DNA, 121 bp, Artificial Sequence
  Synthesized
  misc_feature (61): n=t or c
agccatttgctacaaaactctgcatccatttcctctgaaatgctattaattttccaattanctcattcttgaatgcagagcaactgaatcttacttagctgttgatcttgcacaaggacat

SEQ ID NO: 1132 - DNA, 121 bp, Artificial Sequence
  Synthesized
  misc_feature (61): n=a or g
aaccaaatgtgtagtaagcttattaggaatgttttatatcacaaattaagtcctttagganaaatgaggttgtcacatcctggctatgacaacgatattgacaataatggatagtgctgtg

SEQ ID NO: 1133 - DNA, 121 bp, Artificial Sequence
  Synthesized
  misc_feature (61): n=a or g
tttggagactgtttttagccaggtgattaaatactgttcacaagacgctttcatttgtaangaagcttaattggaatgtcctcctaataaccttgtgagtaaaaaaaatcaggtgtctcca

SEQ ID NO: 1134 - DNA, 121 bp, Artificial Sequence
  Synthesized
  misc_feature (61): n=a or g
aaaaattatctcaacttcctctctgtgcatataatatctagcaatgcgctgtactgaatancatattgagaaatgttattgattatttggagtttaacatgataagccattccattcttct

SEQ ID NO: 1135 - DNA, 121 bp, Artificial Sequence
  Synthesized
  misc_feature (61): n=a or g
tcatcaccatggtatcagaataccttaaaaaagtgtgtcatttctatgtagcttctctacntgtctgtcttccactaaactgttaagaaaattctcatgacaacctctttcatgaggctaa

SEQ ID NO: 1136 - DNA, 121 bp, Artificial Sequence
  Synthesized
  misc_feature (61): n=c or g
ttttgtttgttttagatagctgcctgataacagtatctgctgatctcaagtgagtatttantgatttaggaaatcagtctcttagttcttcaaacaaaagactgaaggttttcttacactc

SEQ ID NO: 1137 - DNA, 121 bp, Artificial Sequence
  Synthesized
  misc_feature (61): n=a or t
aaaatgtcagcgtgtgtgctctgcatgtgagtaagacctggaagattctcttccttgcagngtgcacccagtaagtgatttcaagcagcatgtgggaggttaaagggaactctcctgcagc

SEQ ID NO: 1138 - DNA, 121 bp, Artificial Sequence
  Synthesized
  misc_feature (61): n=a or g
ccccattctgcagaatggtgctttgaaaaccttttaagagaagaactcactcaatgattcnctcatatcacagtattgactgatggtatgaacagactatcaaggaagccaggtgagccaa

SEQ ID NO: 1139 - DNA, 121 bp, Artificial Sequence
  Synthesized
  misc_feature (61): n=t or g
aatacaaatttctattccatctttttaccctatctataaataccttcagttacaccaagtncaggaataaagttctattaaagggaattgagaattgcagctatatttttagatctgagct

SEQ ID NO: 1140 - DNA, 121 bp, Artificial Sequence
  Synthesized
  misc_feature (61): n=t or c
gctgtgttgttctctgacagtagtcatgttgtgtagagctctgccaccatgcatatgggtntgtctgggtgcagtgatgcaaggctgtgctttggagagcgcagtgaatgtctccacacca

SEQ ID NO: 1141 - DNA, 121 bp, Artificial Sequence
  Synthesized
  misc_feature (61): n=t or c
gctacaacaactttggtgctcatatgatagatgatattgatgagagaaggaaattcaaaanatggaatcttgttcataattttctgggaacaatgagagatgtttgcacaactttcactgg

SEQ ID NO: 1142 - DNA, 121 bp, Artificial Sequence
  Synthesized
  misc_feature (61): n=a or t
aatgctgctgcataaagcttgcacttcgctgtacagttgtgctctttttgaggaccctctncttcttggtactcctttcaacccttgagaatccccatggagtcccctggaagctggagga

SEQ ID NO: 1143 - DNA, 121 bp, Artificial Sequence
  Synthesized
  misc_feature (61): n=t or c
ctataaagattaaccagtacatacaaataacagttacccaccaccccaagaatgaaaggtnacacacgccagagaggttgctcttctcagtaaggtaattgatggcataacctaaaaaggg

SEQ ID NO: 1144 - DNA, 121 bp, Artificial Sequence
  Synthesized
  misc_feature (61): n=a or g
aaaatgaattacttaataaatttttaaggtatccccatttcagctaggttcaatagcagtnaaatgtgtggatgtgtacattgcctctgaccctgcttcattagtcttgccagcagaccta

SEQ ID NO: 1145 - DNA, 121 bp, Artificial Sequence
  Synthesized
  misc_feature (61): n=t or c
tataaaataaatcactacttttctcattagccagcagctttaaagtacacaagtagttagntgtgtcatcccaaggatataatctgtggacattctaactcccataggcattatttagaga

SEQ ID NO: 1146 - DNA, 121 bp, Artificial Sequence
  Synthesized
  misc_feature (61): n=t or c
tactgtttcacttcaaatgcatctccacacaccacactgaaactacaggttgcagcgtgcntcctttttatgagaaggctactttaaaaggttagagggacatagcaccagaagagaagag

SEQ ID NO: 1147 - DNA, 121 bp, Artificial Sequence
  Synthesized
  misc_feature (61): n=a or g
actgaagcgtacagtgcatatttcaggagatgtgagataggtcagccctatagctgtatcncccccacatctttcgtggctgcacacacactcacccttcccaaaggtaaggagaaatgag

SEQ ID NO: 1148 - DNA, 121 bp, Artificial Sequence
  Synthesized
  misc_feature (61): n=a or t
cctgtgtcccagctggaggagccagtcatgaatcattacagcttaatgaacactgtgctgnggattatgcactgatgcaggaggtagcatccaaattctccatcagaaatgaactgattac

SEQ ID NO: 1149 - DNA, 121 bp, Artificial Sequence
  Synthesized
  misc_feature (61): n=t or c
ttcctctcagcatcgccacttctttgacttcagaagggttctacctatctaaatttagttnctgctttttgaagtacttcagtcccgaagagacacgctatttccttcagaatcatccagc

SEQ ID NO: 1150 - DNA, 121 bp, Artificial Sequence
  Synthesized
  misc_feature (61): n=t or c
ctcctgaaggatcttcttcacttaatcttgctcctgaagagaccgcgtagtaaactgaagncattgcaggtctcaaagaagtgaaatttagagcaagactgttgaattaaataataaatta

SEQ ID NO: 1151 - DNA, 121 bp, Artificial Sequence
  Synthesized
  misc_feature (61): n=t or c
caccactctactcattctcacttctccacttcagcctctctctccttgcctgcccacagtncaagtcttttatgtgcattccaggccgtagccctcctctgaactcacacaaaatcctttt

SEQ ID NO: 1152 - DNA, 121 bp, Artificial Sequence
  Synthesized
  misc_feature (61): n=t or c
tctggggcgagttggtgcagcccactgctgtcagcttgcttgcaggaacccccagatatgnaagcactaagaaatgaaatctctatttaagttgcaaggactcaaacctctttctcaagag

SEQ ID NO: 1153 - DNA, 121 bp, Artificial Sequence
  Synthesized
  misc_feature (61): n=a or g
tcagcactgctattgtttcttcagaggcaaaaacacactgtaggtatgcagctaacaaaanctctcagcatgcaaacctgataacgtgcgcacacattcccacacacagggaactactcct

SEQ ID NO: 1154 - DNA, 121 bp, Artificial Sequence
  Synthesized
  misc_feature (61): n=a or g
tgttggcagtcccacttgtgcaatttcatttctccccaaaccagatttccattcttttacntaaagttaaagtctaattggacgatacgcttcttgttgcaactcttgctattcagcagta

SEQ ID NO: 1155 - DNA, 121 bp, Artificial Sequence
  Synthesized
  misc_feature (61): n=a or g
tgctcaggcttttctttttgttccctgtttgttcttcagcacttaaagcctagaactctcnaagaaatcattgcttcactgcttcttacaggcaacaaaatgcacctgaggatcaaatggc

SEQ ID NO: 1156 - DNA, 121 bp, Artificial Sequence
  Synthesized
  misc_feature (61): n=t or c
tgctatgctgaacctcctgccagctaatccaaactccaaggagttggacatcgggcttaanagcaccctttttgtcatttcagctaaaagtagttggactgctgaaaaatctggttcagga

SEQ ID NO: 1157 - DNA, 121 bp, Artificial Sequence
  Synthesized
  misc_feature (61): n=a or c
ggagatggtgatgtcccagcctacatgagaaagtagtttagcaaccaggcaacttctgccntgtctcctcccagctattttgtagatgctaaactcacatatggcacctcttcagaaccca

SEQ ID NO: 1158 - DNA, 121 bp, Artificial Sequence
  Synthesized
  misc_feature (61): n=t or c
tattgccatttcacactattgagtcaagagagttaatactgttgaaagagttaataatacngatgatggagttaatactgtcaacaagttctgtaaaagcaacagtggtgatgaaacatga

SEQ ID NO: 1159 - DNA, 121 bp, Artificial Sequence
  Synthesized
  misc_feature (61): n=a or c
gttaattcatataagtattaaacttcttcatactttcgtgacagataaagctgctgtgaanagactggcctaaaatctcatttatgtcatttatgaatataaatcacatttattttgttaa

SEQ ID NO: 1160 - DNA, 121 bp, Artificial Sequence
  Synthesized
  misc_feature (61): n=t or c
tgagggctgccacaacaaccaaccgttacagtattagcaccctagtgtctagcttatgacntgggccaattgttgctcagtcagatgttacccaaatgcatctggagatagcatggccaat

SEQ ID NO: 1161 - DNA, 121 bp, Artificial Sequence
  Synthesized
  misc_feature (61): n=a or g
agaaaccagccctgtaatgatgcctgcttgtgagatgcagtgagggtgaggagctgaggcngaagggacgctgcttagagaagacacaaggccgttacacatggcagtcagaccccttccc

SEQ ID NO: 1162 - DNA, 121 bp, Artificial Sequence
  Synthesized
  misc_feature (61): n=t or c
cttggcttttgaccttgtctgccacaaattcagcatctatgaatgactaattgaatgctgnataccaggtgtgacatgtcagtgtatgctacagtgaatctatggcagtcaagctgctata

SEQ ID NO: 1163 - DNA, 121 bp, Artificial Sequence
  Synthesized
  misc_feature (61): n=a or g
gacactcataaaaagtacttctgtactcagtgtccacttaatcagtgtgacagcattagcncctaatgcctgctattaagccagttttgaatttatcctactgctctactctgaaagaagg

SEQ ID NO: 1164 - DNA, 121 bp, Artificial Sequence
  Synthesized
  misc_feature (61): n=t or c
agcctctgtgcagctgtcattacatgtatcagtgcaaggaggaaaacagatgccctattanctaagtgtattcacacatatctatagtttcgaatatatatatacatacatacacgtgtac

SEQ ID NO: 1165 - DNA, 121 bp, Artificial Sequence
  Synthesized
  misc_feature (61): n=t or c
gcctggttgctttataggcagaaatttctcatatgtaaacagcaagtaattccatctgtgncattacttagttgactaagggtctcaattatgtggggtacccagtgacgtatctctttaa

SEQ ID NO: 1166 - DNA, 121 bp, Artificial Sequence
  Synthesized
  misc_feature (61): n=t or c
ccagttcagtcattaaatcatgttgaagaaaagcccaggctacaaacagaatgactgacantaacttttctagaacaaagtattgttgttagacctagtgtacagtcagtttccaaagagc

SEQ ID NO: 1167 - DNA, 121 bp, Artificial Sequence
  Synthesized
  misc_feature (61): n=a or g
ttttcaattccttactgcagttttgcaggtatgttttccttgcagacatgggggtgatgtnggtgttctcccattgcaggagttcttctatgacatcaaacacagcgacctggccaagaag

SEQ ID NO: 1168 - DNA, 121 bp, Artificial Sequence
  Synthesized
  misc_feature (61): n=c or g
tggcgggcagtgcagggcttccaccttgggcgacgaaaccccatagtctggtgagtaatanccaggagacagacactggaacttctcagcgggaacagaaggaaggggaaccttctcctcc

SEQ ID NO: 1169 - DNA, 121 bp, Artificial Sequence
  Synthesized
  misc_feature (61): n=a or g
actactatttatcttaattatgagttagatgtacccccagcaagttggttaattgtaaagncaatgattggtaaattggagtttatggctgcctttcagagacttcaaaaaaaacctgaag

SEQ ID NO: 1170 - DNA, 121 bp, Artificial Sequence
  Synthesized
  misc_feature (61): n=a or t
cttttttttttctccctttgggaacagaacataattttaaacctacaagagactggaaacntgtggaaatgataatgaaatacagttgttgattgtcagcttctcagctgatgactcaaaa

SEQ ID NO: 1171 - DNA, 121 bp, Artificial Sequence
  Synthesized
  misc_feature (61): n=a or g
aaaatacgaactgggtgctcactgtgggcttaaaattggtaaatggaaaagaaccaccaancttataagacattttaaaaccagtttcacagtttgtagggacttgactcatgagtgtatt

SEQ ID NO: 1172 - DNA, 121 bp, Artificial Sequence
  Synthesized
  misc_feature (61): n=t or c
tgatgttatgatttattataggcagtaaactgaaagccaaacaaggtcttatttgagctangtaagacttttcaaatctgtataatcgtatttctcgtgtccttgattcctatgtgtaaat

SEQ ID NO: 1173 - DNA, 121 bp, Artificial Sequence
  Synthesized
  misc_feature (61): n=t or c
catgccatgcttcagtctgtgtgacctcagcagacctctgctgggactgatggttaacagnggagaatcacaatacggtgaatattgtttgctgtacttaacatatttgattgcagtagat

SEQ ID NO: 1174 - DNA, 121 bp, Artificial Sequence
  Synthesized
  misc_feature (61): n=t or g
tcactgtactgtagcacattcacagtcatttaaagtcagttgaagcattcaaattagcacntatgctagaatatggcataaatactaacgtaaaatgaattctttacaagtttacatggat

SEQ ID NO: 1175 - DNA, 121 bp, Artificial Sequence
  Synthesized
  misc_feature (61): n=a or g
cagtcattttatagcttttctcctttcttctctgtgagattcatagtgcatgtacacagcntacactgttaacttcaaaaccattggtctttaatcttcctggttgaaccaattctgttag

SEQ ID NO: 1176 - DNA, 121 bp, Artificial Sequence
  Synthesized
  misc_feature (61): n=t or g
gatttgtgatgttgtcaagagggtgaagcagcttctttagctgcacaggcacacagtccangttccagatcatgttgctatcacatgaaatagggcacattttctattatctagtacataa

SEQ ID NO: 1177 - DNA, 121 bp, Artificial Sequence
  Synthesized
  misc_feature (61): n=t or c
actgccatctaaaggccagcgtctggacctttttagaccatttgggttctaaactctctgnttccactggtgctcctcactgcattaaaccttgaaatttgtaaaatcagaaagttgaaat

SEQ ID NO: 1178 - DNA, 121 bp, Artificial Sequence
  Synthesized
  misc_feature (61): n=a or g
gaagtaggtgtagttcagatagaatcagatgtttcaaggagggaaaccaggcacacttatnatttgtagggaaagttggtgttaccatgtggtgtaacccctgtgatctcaccagagctat

SEQ ID NO: 1179 - DNA, 121 bp, Artificial Sequence
  Synthesized
  misc_feature (61): n=t or c
agatgtaaaagaaaacattgtagtggtatccctgcatcatagtattgtttttcttgaatangacctcattacgttctcactactaccatatcccaatcagatagttttatttataaaaatg

SEQ ID NO: 1180 - DNA, 121 bp, Artificial Sequence
  Synthesized
  misc_feature (61): n=t or c
atctctttcctcgtaataggactaatctgcttagctcagtatcaccctttgatttatttangtacacttacatatattttacagacattcaaaatattcagtaatatttatttcatatgac

SEQ ID NO: 1181 - DNA, 121 bp, Artificial Sequence
  Synthesized
  misc_feature (61): n=t or c
aggagatagactggtggagcaactccctgccatacttgcaagaaagtcagcgaggtgatanatcccaatcagtggtagaccccctgtcttgtcactgagggaggctttggatctaaaagac

SEQ ID NO: 1182 - DNA, 121 bp, Artificial Sequence
  Synthesized
  misc_feature (61): n=t or c
atttctgcgacagtctttccatgtgactgtgaaaaaatgtcatttaatttattagtagtangatttcctaactacagagcaatgataatacctttctacttcactcagtagatagtaagac

SEQ ID NO: 1183 - DNA, 121 bp, Artificial Sequence
  Synthesized
  misc_feature (61): n=t or c
ttttgtaataggggtagtaaggctgtgctggttggcctgcagatgcaccatccagagctantcttccacagactgcaaaccggtttttgtcatggattctttcaaagactgctatttatcc

SEQ ID NO: 1184 - DNA, 121 bp, Artificial Sequence
  Synthesized
  misc_feature (61): n=a or g
ggtcgtgccaagtgatgcagcccagcagctctggatgatttataccatatccaatggcacncgcagaccgagcacgagggtctgactgcaggcggttccaattccttctgctacgctgggt

SEQ ID NO: 1185 - DNA, 121 bp, Artificial Sequence
  Synthesized
  misc_feature (61): n=a or g
actgaattatattaccctaaattaattatcctgtaagacttatgaggcaacagacatcttnaccctagtattactgtatgaagactgcttttccagaaacctcaagcagacagctttagag

SEQ ID NO: 1186 - DNA, 121 bp, Artificial Sequence
  Synthesized
  misc_feature (61): n=a or g
atgaatttcatcagatactttggaacaagcaggctacacaaattcatcgttcaatcaatantcttcattatgaataatccaatagtattttaaaaatcaatagaaagtgagatttccaaaa

SEQ ID NO: 1187 - DNA, 121 bp, Artificial Sequence
  Synthesized
  misc_feature (61): n=a or t
ttctggctcaatgcagaacttagaacaaatggtattaagctaaggttagcctggaaatgcnactagtatggtgttacaaccaaaggcatctgtagctggaagttatgcactgctacaaata

SEQ ID NO: 1188 - DNA, 121 bp, Artificial Sequence
  Synthesized
  misc_feature (61): n=t or c
aaattctctaaaaaggagcgaaatttgaaaacatacagatgtacatctgctatgtgcagantgcatcaggattatgggcagattctgttctcagttatgctttttcctccttgatccatta

SEQ ID NO: 1189 - DNA, 121 bp, Artificial Sequence
  Synthesized
  misc_feature (61): n=t or c
actcaacccctgatagcagtatggcactgttcagcagtcacgaaagcaaagtctgtccatntctacaaatcagttactagaaactgaggaaatgtcaagacggtgcattttatctctttgt

SEQ ID NO: 1190 - DNA, 121 bp, Artificial Sequence
  Synthesized
  misc_feature (61): n=c or g
ccttttatggttaagcagctgctttattgaagcactctatttccctacccaattacagtantgttataaattgattcaatcctaatttcaatcttaacaccaactgaaacaccaaagcagg

SEQ ID NO: 1191 - DNA, 121 bp, Artificial Sequence
  Synthesized
  misc_feature (61): n=t or c
ggtttggcctttggtttaactatctgacctccctttcttgcaagaggttatgggaatcttnttccattaacagatccagcttttaacctcagcacagttgaaactgtgcctaaggttacat

SEQ ID NO: 1192 - DNA, 121 bp, Artificial Sequence
  Synthesized
  misc_feature (61): n=t or c
tttctttcagagtgaagttaataggggaaacttatcccttcacctgaaaaatgtcatgctntccgataaagggaaatacatctgctttgtctctttggagaactggtatgatgaagtggtg

SEQ ID NO: 1193 - DNA, 121 bp, Artificial Sequence
  Synthesized
  misc_feature (61): n=a or g
gctactgctgttctgtggattttctgtttttgtgtctgtttggattttttttcttcttccntcttaattgtcttacgtatacttgacttcttaattgcctgattggcagtattccctgatt

SEQ ID NO: 1194 - DNA, 121 bp, Artificial Sequence
  Synthesized
  misc_feature (61): n=a or g
aggcaatgggagattgaagtgacccatactgaagtgtgtcggggctgtctgtggctcacangcccggggctgtgtctggttctttttggtttaaggcagacacttgttccacagaggagct

SEQ ID NO: 1195 - DNA, 121 bp, Artificial Sequence
  Synthesized
  misc_feature (61): n=a or g
tgtacgcgtgccacactgtaggaacagcacctggtggggatggggtacactgaggtcatcncatggggacagcagagcaaaacccaaagccgacgtggccataaggacatgggtcagagtg

SEQ ID NO: 1196 - DNA, 121 bp, Artificial Sequence
  Synthesized
  misc_feature (61): n=t or c
aggaaacctgtatgctagagccacagtgcacgagctggggctgggttaccccatctaaacngagtagctccctgatttgaggagcttacagacccctcacaaccgctcgacctttgagctc

SEQ ID NO: 1197 - DNA, 121 bp, Artificial Sequence
  Synthesized
  misc_feature (61): n=a or g
aatgccaaaaacggatcactcagacccaaatccccactcagggttttgaggggttcattcnaggcactggaaataatctgcaagagcagcacacacaaacatacatacaaatcaaactgct

SEQ ID NO: 1198 - DNA, 121 bp, Artificial Sequence
  Synthesized
  misc_feature (61): n=a or g
ctctcctgatgggtctcacacataacgggctcatacgcgggatattcgggctttgttctcnccacctattgtcgcagggccactaaatcaaacagttgctgccacgacaaaagcactcaca

SEQ ID NO: 1199 - DNA, 121 bp, Artificial Sequence
  Synthesized
  misc_feature (61): n=a or g
atcctcaacatctgctccctccttgcctcatcacggattctgcggattgctgggtgaactngaggacatccataggccttccagtagatctctctgggatcttgcagtcttgatggttctc

SEQ ID NO: 1200 - DNA, 121 bp, Artificial Sequence
  Synthesized
  misc_feature (61): n=t or c
taattaaatgcaattattttgaattatatttaaaattctatttcttccaagtacataaaangcaaacctatacagtggaaaggagcggtaaagtcaacagttaaatattcacatttattta

SEQ ID NO: 1201 - DNA, 121 bp, Artificial Sequence
  Synthesized
  misc_feature (61): n=a or g
ctggatgccagtgctggaaaagaacagcctgaagcttggcatggcaaacttccaaagagcngctttagcctgtgcgtggtcatattgtgctcttctggggcactgctctgtggatgttatc

SEQ ID NO: 1202 - DNA, 121 bp, Artificial Sequence
  Synthesized
  misc_feature (61): n=a or g
ggcatttattttcccaagttgggagtgtccagggttagcagaggtgcagaaccctatgagnaagtcctctgtcctctgccatgaatgaatgctcaatctttcgttcttgctatgctatact

SEQ ID NO: 1203 - DNA, 121 bp, Artificial Sequence
  Synthesized
  misc_feature (61): n=a or t
agggcagctgtgaatggtggcatcttgatcctttacattcatgacagaacactgaaatccngccacaggacataaaggaattgatgaatcagcttccacataagaagacatggaaaaaaga

SEQ ID NO: 1204 - DNA, 121 bp, Artificial Sequence
  Synthesized
  misc_feature (61): n=a or g
tggatggcaacacatggaccatgctgacacagcagctgtcaagctttaggagggaaacagnatgccacttgtcctccttatatgatagtagggtggaggaataattaactatggacacagt

SEQ ID NO: 1205 - DNA, 121 bp, Artificial Sequence
  Synthesized
  misc_feature (61): n=a or g
gagatgatgtctcctatgccccagcagcagtgggagaagcagatgaccccatgcacaaatnctcaccccactcagaggtaaattggctggtgtaaatgggatctacaaaacgatccaaaag

SEQ ID NO: 1206 - DNA, 121 bp, Artificial Sequence
  Synthesized
  misc_feature (61): n=t or c
cacgcagccccggatgcttgcaagctgtgtgcagcacagatgctttgggcgatgccagatnttctatgtttcttggcccccagctcctcggccatctcgccaggtatgtaactatcccagc

SEQ ID NO: 1207 - DNA, 121 bp, Artificial Sequence
  Synthesized
  misc_feature (61): n=c or g
tttatccaagcattctgtccctttgttctgcaaattgagctagaacttgctgctgctgctntgcagggcaggatgccttctggttgcgctgggagctgcggaagcacagtgtcaggctctg

SEQ ID NO: 1208 - DNA, 121 bp, Artificial Sequence
  Synthesized
  misc_feature (61): n=a or g
tcaaagcaaaatgggctcacagcacagcacgtgctcacatttatggcaatggaaagcagtncaaagtgctcacaaaccaccacttctgaatctggatcctctcagctccaagtaaacaaac

SEQ ID NO: 1209 - DNA, 121 bp, Artificial Sequence
  Synthesized
  misc_feature (61): n=a or t
ccaggaaatgggtgagattaaataaaactgagtgctgcatagtctaaaaccttcatctccnctaggaatgtttcaaatacagccctgctccaataaaaagcaacagcaaaagacctccggt

SEQ ID NO: 1210 - DNA, 121 bp, Artificial Sequence
  Synthesized
  misc_feature (61): n=a or g
tacacaagcatcaagggaagctccaatgcccagtgtgaggagcctcaagtggctgggttcnctcgaacatagtatcaaagcccttgtgatgtgcactggggtgcaggccagcctgttttga

SEQ ID NO: 1211 - DNA, 121 bp, Artificial Sequence
  Synthesized
  misc_feature (61): n=t or c
acagcgaaatgctgtgaccaacaattcccacctcagagggttccccgtgcaggtgaaagcnccattgcagcccaattgttgcaacggttttctgccggggaagactttgggaagggagagc

SEQ ID NO: 1212 - DNA, 121 bp, Artificial Sequence
  Synthesized
  misc_feature (61): n=c or g
ttattgcactcttacactcttcaatatattactgtctccttattttttaattcctctgttntttttttcctccctcctttgtctgttcgtttctatcacagacagagcaactatatggaaa

SEQ ID NO: 1213 - DNA, 121 bp, Artificial Sequence
  Synthesized
  misc_feature (61): n=t or c
ctgctgcaagaaggtcaatgacagacaagaaactgaagcaggaagaagttcctttatccangaatacatgctggctggtactatttcctcctgtcaagagcatctcgaggagcaagatagc

SEQ ID NO: 1214 - DNA, 121 bp, Artificial Sequence
  Synthesized
  misc_feature (61): n=t or c
gaatgagctgaatatatttgtgaacttgttttatattacagtgatgaagcataaaagaagnaaatctgttttctacgtgctcatacctaccttccatttctgcccatgacatattctgtag

SEQ ID NO: 1215 - DNA, 121 bp, Artificial Sequence
  Synthesized
  misc_feature (61): n=t or g
gaatgacttgcaggtatccgtcactgaatacataaccaaaagatggatcccactgttaatnttagctctgaacctgctaagtttaaattcctgttccatattaaactttctggaagaaatt

SEQ ID NO: 1216 - DNA, 121 bp, Artificial Sequence
  Synthesized
  misc_feature (61): n=a or g
taacaggtccacagggactgactgaggagacagtctagtgtgtacatttactactataacngaatgtttgaattcctttgataatgtgttgagctgtttgtctccgtgatgctcagtttag

SEQ ID NO: 1217 - DNA, 121 bp, Artificial Sequence
  Synthesized
  misc_feature (61): n=a or g
gtcttttatgtccctcctctggaccctcactaacagctccacaaccttcttgtgctggagnccccaggagccagacatcccaaattatttcctagaaatatgaggaattagcagttttctt

SEQ ID NO: 1218 - DNA, 121 bp, Artificial Sequence
  Synthesized
  misc_feature (61): n=a or g
ctgtacgttacatcctggggaggagtggctgctgggctgggacaaggacactaccccagcngctgttccacttccacttgtctgcatgctggggaacacggccactgaaaccaaaaggaga

SEQ ID NO: 1219 - DNA, 121 bp, Artificial Sequence
  Synthesized
  misc_feature (61): n=a or t
cagttgcagaaaaattaatgtcttgctacctgttttataatcgagtttgacttctctgtangtcttgtctagcaactgtgtccaagatcagcttttttatctggaaaataaaaaagaggaa

SEQ ID NO: 1220 - DNA, 121 bp, Artificial Sequence
  Synthesized
  misc_feature (61): n=t or c
agccactgtcaagctgacatccatcagatgatcgaatgtctgcaatgaaatggaatggatnatgcttcagaagtgcctggatgtctgtagtgcacatcccaagtttccatcaaaatattta

SEQ ID NO: 1221 - DNA, 121 bp, Artificial Sequence
  Synthesized
  misc_feature (61): n=a or t
ttaggaaaatcactcaccggctcatgttagcacactgacaccactatttgctatcattgcncagaaaaaaatagttgccctcagccaaaaattgggctcagacactctcatagacatgtga

SEQ ID NO: 1222 - DNA, 121 bp, Artificial Sequence
  Synthesized
  misc_feature (61): n=c or g
gtggcccgattaagatctaatttgctttctgcataccctagcaatatccttctactcttcntgagctgtgtgcccctccttccaaaggtggtgaaccttttgcttttttttttttcctgga

SEQ ID NO: 1223 - DNA, 121 bp, Artificial Sequence
  Synthesized
  misc_feature (61): n=c or g
acaaaatcattaggaaacagtcctagcttgctgcatttgctgtatccattccttacctttnagtaccattgagagctgcagctggaatttggtagctagggctaactggtcatcctgggga

SEQ ID NO: 1224 - DNA, 121 bp, Artificial Sequence
  Synthesized
  misc_feature (61): n=t or c
tctgtgcggaaaatctccttgtataaatcctgcgtagcatttctgttgcaagaaagtatcngattgtcctgagtgctttaaaagtacaaacaccaattatgtatggtttgatacattttaa

SEQ ID NO: 1225 - DNA, 121 bp, Artificial Sequence
  Synthesized
  misc_feature (61): n=t or g
tctgtttgcccagatttcgccatcacttttatgattgtgaatcttcagagggcagttcagnggcctacaaaataacactgttcagtagctgtagtgtgggacagctgggcgtactgaaagc

SEQ ID NO: 1226 - DNA, 121 bp, Artificial Sequence
  Synthesized
  misc_feature (61): n=t or c
ttcaatcccctgctccttgctctagcagtcttgtagtttctttgtcttgaacatgacagantgaggaagatcacaacagaaatctcacagggtagactgtgaagacagtcggtctgcaaag

SEQ ID NO: 1227 - DNA, 121 bp, Artificial Sequence
  Synthesized
  misc_feature (61): n=a or g
tatagagggtatcacagtaatttgagatgtggactttaagtgtcatttctatcctctctcnctccacttgatggtcagagctatctattcttatcacacacagacaaatttcctctgctgt

SEQ ID NO: 1228 - DNA, 121 bp, Artificial Sequence
  Synthesized
  misc_feature (61): n=a or g
tgaggggccagagccaagcttctgaaacctgaacaccatcagacgttaactttacggtggnttgaaccagaaacccacatcccaagcttcatcccaacacatctctgggacccaggtctct

SEQ ID NO: 1229 - DNA, 121 bp, Artificial Sequence
  Synthesized
  misc_feature (61): n=t or c
gtccctgactggtggtgaggctgaagaaactgtgagcttcccacacaggtgatgcttgtcnttcagtcaccacggcagctcagtgaaagcacctgggacacaggtggttttctggtttgat

SEQ ID NO: 1230 - DNA, 121 bp, Artificial Sequence
  Synthesized
  misc_feature (61): n=a or g
ctatgtgtagtaaattctttccccctcagttttctcccccttccctctggggtaaagggantgagcaaacagttttgtggtgcttagctgcctgctgggttaaaccacagtaggcttggcc

SEQ ID NO: 1231 - DNA, 121 bp, Artificial Sequence
  Synthesized
  misc_feature (61): n=c or g
tcacacctctggttccttacacctgggcttgtttcacctttgtcttagcacaagatggganagcagtgggtgtgctgcgcctaaatggagaaataaaggaaaaatggagcgggattggggc

SEQ ID NO: 1232 - DNA, 121 bp, Artificial Sequence
  Synthesized
  misc_feature (61): n=a or g
ctctacaacagtaattttcgaaattctcaagtcagaaccctgcaagtctggcagagtttcntagggatgcctgttctcactttgcaaaattgatactgtttcattaagtttgaggaaggaa

SEQ ID NO: 1233 - DNA, 121 bp, Artificial Sequence
  Synthesized
  misc_feature (61): n=a or g
agcatcatttctaaatgtctcatgaactgtcagaattgagagataaacatttccaaagagncattttagatgatagttggtagaaatcaatattgagacatcccagtctctctccattgac

SEQ ID NO: 1234 - DNA, 121 bp, Artificial Sequence
  Synthesized
  misc_feature (61): n=a or g
ctattgtttttaagattgctttcattgtgctgaatgatttatctgttgttcctatcttgtntaaatgccagaaaaagccaaaagttgggcatttcctttaagaatgtacgcattcagtgct

SEQ ID NO: 1235 - DNA, 121 bp, Artificial Sequence
  Synthesized
  misc_feature (61): n=a or t
gagctacagatttactgctttataacagctgagaaaattctgctagtgttaaaaaaaatcntatctcaaaagtgctacagtgttagttaactaggataacaggattctgtactgcaattct

SEQ ID NO: 1236 - DNA, 121 bp, Artificial Sequence
  Synthesized
  misc_feature (61): n=t or c
gagggaagttgttgtggaagagatgctctcatggaaggcacagtcttctacagatggcttngctgatagtccctgcacctccagacccacagagaagcagcgtggcactcacagcatccaa

SEQ ID NO: 1237 - DNA, 121 bp, Artificial Sequence
  Synthesized
  misc_feature (61): n=t or c
aactaccaatcaatccatgcgtaactgaatttgaagtaaagtttgacattgtagaagaagnttgaaattaaatataatatatgcgtaactcccatgggcagttcaatccctaagactttag

SEQ ID NO: 1238 - DNA, 121 bp, Artificial Sequence
  Synthesized
  misc_feature (61): n=c or g
aaataaagatttttatcagtggaataaccaggactcctttatttcagttctgttgaaacangaggccagtgatgatgggaggagttggcagcctgtacaggatgacatgaaaaacaatttg

SEQ ID NO: 1239 - DNA, 121 bp, Artificial Sequence
  Synthesized
  misc_feature (61): n=a or g
attaggaaatagaggaaagtcagaagtttgctcacaccatacgtagaaaggcttgtttcanttttaagattgggaatgttacttggatttcttcaggattaataaaggtggaagaaaacac

SEQ ID NO: 1240 - DNA, 121 bp, Artificial Sequence
  Synthesized
  misc_feature (61): n=a or g
acctgaaacccaccgggcttgttggagcacacccagacactgagacgggctcacttacacngcaaacattgccacctaacttataaaatagctagcagagaattaaaagtgtgagggaagg

SEQ ID NO: 1241 - DNA, 121 bp, Artificial Sequence
  Synthesized
  misc_feature (61): n=t or c
gaattttggacagctaaggatgagctgcctgtcttctttcttgttgtgctgcaatgctttngtgttgaagcccatcgtttcgctgcattgcagggtggttgttaggaaaatgagaggagag

SEQ ID NO: 1242 - DNA, 121 bp, Artificial Sequence
  Synthesized
  misc_feature (61): n=a or g
tctccgtcttctagaggacttaatcttatgtggatatatcataatttaatgttgttaaccntgtctatacattgcattcagggatccttctcccagatcactgagacagctacctctggag

SEQ ID NO: 1243 - DNA, 121 bp, Artificial Sequence
  Synthesized
  misc_feature (61): n=a or g
ttcaacagagaaaagctgagagcggaaggtaagatcggagtggagcaagtggagctcaganggataatgtcagtatgaggaaatgtgcaatactgggctgtcatttgtgacaaagaatgct

SEQ ID NO: 1244 - DNA, 121 bp, Artificial Sequence
  Synthesized
  misc_feature (61): n=a or g
aaaaaaaaagtgtgaactaagtagtcagatgagacaataaagaaagataagaatatcttcnattttgagatatagtagagagaaaaataaaaatgtagtccaaaatatttaaaagagcttt

SEQ ID NO: 1245 - DNA, 121 bp, Artificial Sequence
  Synthesized
  misc_feature (61): n=t or c
gcaaattactttttctaaatttcaggtttgtttctaagctatatagttctttatcttgtgnctgaggactgtagtacaccccagaaactttagcagtactctaagatgagaaacagtatct

SEQ ID NO: 1246 - DNA, 121 bp, Artificial Sequence
  Synthesized
  misc_feature (61): n=t or c
attagccaaaagcagtagtctttctgctacagtgtgggaatcctgtttattattacagctntgtgtatttgctgagctacaatcttctctttaacagttttggtgatgtactgaaaaaatt

SEQ ID NO: 1247 - DNA, 121 bp, Artificial Sequence
  Synthesized
  misc_feature (61): n=a or g
gtagaaaaggaaataaaaggaaatcaatgtgcagcagaagtgaagatgacttaaaactacncctcccaagaccctaactttgtattctcatgatcactagatgatggttatttggtcattt

SEQ ID NO: 1248 - DNA, 121 bp, Artificial Sequence
  Synthesized
  misc_feature (61): n=t or c
tttgctcttgtagccacccaggtgccctacgagcgtgccctgaacttgcagaaccagctcnaaccaagacagtacgcagcattgacatacagcttaatgagttccggcattaaaaaaatta

SEQ ID NO: 1249 - DNA, 121 bp, Artificial Sequence
  Synthesized
  misc_feature (61): n=a or c
gcaaaaggatgccacatcaaggttccttcatgcgtgtaggatgggagtgaagggttgcttntagacacatttgcagcttggcctctgagcgtacagtgaagatgttcagcaaaagctagtt

SEQ ID NO: 1250 - DNA, 121 bp, Artificial Sequence
  Synthesized
  misc_feature (61): n=t or c
agtgttagtacacatttggggttgggcttggctcttttctttgaaggaagacattttgatntttgaaagatttttctcataccggttgagggctgtgtgttgttagctcggccaaaggggc

SEQ ID NO: 1251 - DNA, 121 bp, Artificial Sequence
  Synthesized
  misc_feature (61): n=a or g
aaatgtgtttgtgttactttggctttcatttgctcccagctatgctgttgcaaagtaaggnaaattgtagctaagatgagtcatgttccgtgtttcttcctgggttctttgccataactac

SEQ ID NO: 1252 - DNA, 121 bp, Artificial Sequence
  Synthesized
  misc_feature (61): n=a or g
gtcttaaatcacaaaaagtttctccttatttcagtcagaatttcatagaggagagacaggntggaattgctagaagttcttatgtgaacaataaatattacttatattttgatttattaag

SEQ ID NO: 1253 - DNA, 121 bp, Artificial Sequence
  Synthesized
  misc_feature (61): n=a or g
ttctgttaaattctaaagtggactaaattacccgaacaaagaaattttaggactaatggantaagagtgtctgtaggagaagctattacagattgttttccctggatagataagcctggag

SEQ ID NO: 1254 - DNA, 121 bp, Artificial Sequence
  Synthesized
  misc_feature (61): n=a or g
agaaagaaagaaataaggggggtcagatattttggaaaatatttcttttccccttgttggncagttgtttgttcttctttttattgactgagttttgagccccattgcttacatccaggat

SEQ ID NO: 1255 - DNA, 121 bp, Artificial Sequence
  Synthesized
  misc_feature (61): n=a or t
tttcttctccagactgcagcagatcagggtattaaaactgtttccttagggtgacacttcnctctaaggagaggcccagcaggcacgaaagccctgctagcatcattctcttggaagcctt

SEQ ID NO: 1256 - DNA, 121 bp, Artificial Sequence
  Synthesized
  misc_feature (61): n=a or c
atccgctctctacaaccacaacagtttttcactgatgagtaaggaacaccttgattatggnagtaatcagctttggtaaaaagtactgatgaatgtaacttgaaatatggattgatcaaga

SEQ ID NO: 1257 - DNA, 121 bp, Artificial Sequence
  Synthesized
  misc_feature (61): n=a or c
ggcccatcatatcctctccagatatgttccctttccagagggaaacaaccagcttctctgntctgccttctactctttctttattctgggagaagacaaagtctacagtcagtttttctcc

SEQ ID NO: 1258 - DNA, 121 bp, Artificial Sequence
  Synthesized
  misc_feature (61): n=a or g
accaacacgtgattttcttacatagggcagaaattccatacggagacaggaataaacaaantccaacatgcaaaactaaaatacacttccaattctaaactttttcaaagcctgctgatga

SEQ ID NO: 1259 - DNA, 121 bp, Artificial Sequence
  Synthesized
  misc_feature (61): n=a or g
agcacacaaggaaacactgagtatcaccagaacatgcagagactttaaaatctaagttaanggcaaaaaaggtaactaacagggttgggagggacgggggttgggggaaagcaatggagag

SEQ ID NO: 1260 - DNA, 121 bp, Artificial Sequence
  Synthesized
  misc_feature (61): n=a or g
agccccagaaacacacagggtcatcgtgccaggctcaggtgccctccatagccaaaagctntcaaatgagagctgtgaaataagcttcaggcaccctgtactgtgaggagaaatgtgggcc

SEQ ID NO: 1261 - DNA, 121 bp, Artificial Sequence
  Synthesized
  misc_feature (61): n=a or g
tgagggctgcaggtattctatatagctgaaagcaaaattagcaacaatatgaactcagatncaactactgatgatacgtgaattcttacatctgattgtgaactgtgagtcaactagacat

SEQ ID NO: 1262 - DNA, 121 bp, Artificial Sequence
  Synthesized
  misc_feature (61): n=t or c
gtccagctcctcctgggaagtatccagggagaggtgtcagcatggcaaagcctgcattgcnagagctggcactaattaatgaccttattatccatcctgagagaggtcaaagactaatgag

SEQ ID NO: 1263 - DNA, 121 bp, Artificial Sequence
  Synthesized
  misc_feature (61): n=t or c
taccttcgcatttgtagtctgccatttctctatatatcccatggcaaaacctttataatcngcatatgttatgcttagctctttgccttgtgagaacaacataaattctttcatacttaac

SEQ ID NO: 1264 - DNA, 121 bp, Artificial Sequence
  Synthesized
  misc_feature (61): n=a or c
tgttatcaaagctgtgctcagagagaaatcattacagcagaactgcagaactggacaaaantgaagctagcaggcatgagcaaatacactcatacggtgttttctgtccactgaaagatat

SEQ ID NO: 1265 - DNA, 121 bp, Artificial Sequence
  Synthesized
  misc_feature (61): n=a or g
aatttagcttttatgaagaagctcgtatagaaaagctacagttcagatacccagagagctncagttaagtcattttagccctccgaagctcagttaggcttcagacagtgacaaatccaaa

SEQ ID NO: 1266 - DNA, 121 bp, Artificial Sequence
  Synthesized
  misc_feature (61): n=a or g
ctcttcaagctctgcctaacagtcaaaatctaatttgtctcaaaaataaacagtacataanaattgtaagaactgctactacttctcttttgaaattccaaaagtgacaaaagatgggttt

SEQ ID NO: 1267 - DNA, 121 bp, Artificial Sequence
  Synthesized
  misc_feature (61): n=a or c
ctaagttctttacgttctttgttaggattttcatacatcaactcattgatgtgaaaaaaanctctccaaaataatagttctttttcctccttttatcacacaggcaagccattagtttgag

SEQ ID NO: 1268 - DNA, 121 bp, Artificial Sequence
  Synthesized
  misc_feature (61): n=a or g
aaggacttcatatttcagaaggatggagggaatgactgtactcaagtgtgatagtatcccnaaaggagactatctgaaccatcagtaagtggagacctggcattggatacaataaagtgct

SEQ ID NO: 1269 - DNA, 121 bp, Artificial Sequence
  Synthesized
  misc_feature (61): n=a or g
atactgaatatttgcacatctttcagagagcgttcagttattagtttggtcagtgctcctncttcagacaaaagtgagggtgaacatgtttatctcgcatcccatcgacccaatctagctg

SEQ ID NO: 1270 - DNA, 121 bp, Artificial Sequence
  Synthesized
  misc_feature (61): n=a or c
acagtggtgatatatgactttgaaatactgaagtggcaccaagcgttgtacaatctggctnattggatcctatcttgatgtgcagactgcctcttcaaccactaaagtcccttccagaaaa

SEQ ID NO: 1271 - DNA, 121 bp, Artificial Sequence
  Synthesized
  misc_feature (61): n=t or c
ttcacatattcagaaaataaatggaaaataatttcagaaacacaggtgtaatctctacagntgttattgtagacatcagtcaatctctacaatgcgtaattgagctggagtggaaaattct

SEQ ID NO: 1272 - DNA, 121 bp, Artificial Sequence
  Synthesized
  misc_feature (61): n=a or g
ttggactaagagtaagaacatttctccctatgtttcaggtctttagtggaagaggaaaaantaaaatccacataccagccttactggtttgactttaattatgtgaagtcaaaatgaaggc

SEQ ID NO: 1273 - DNA, 121 bp, Artificial Sequence
  Synthesized
  misc_feature (61): n=t or g
ttgttgttgtggaatggagtttctaattcaagagcaatttagattcccgtctgtgatttcntactgtgtgatttgacttggacacacatcctccatgtgacatttctttcacctgggaaaa

SEQ ID NO: 1274 - DNA, 121 bp, Artificial Sequence
  Synthesized
  misc_feature (61): n=t or c
tgaattgcacggaattctaagtatttcctcattctctactatgacctgtcaaaagagaatnagagacacatagagtgtgttaagaaaacatgtagttctggtgtcactttatctattgaga

SEQ ID NO: 1275 - DNA, 121 bp, Artificial Sequence
  Synthesized
  misc_feature (61): n=a or g
acttatgtgaagtgattgtaaggtgatcttcttaagaagggtttccagacaatgctttttntgtaattttcatagaagttagatttgttataatgacagaaataatcagattaatcactat

SEQ ID NO: 1276 - DNA, 121 bp, Artificial Sequence
  Synthesized
  misc_feature (61): n=t or c
gctgcggcactctccattgcttcactccaggaactggcaatttaagctagggataaactantgcccagactagtgacagaaccatacagaccagcaacaacctttgagacacctctccctc

SEQ ID NO: 1277 - DNA, 121 bp, Artificial Sequence
  Synthesized
  misc_feature (61): n=a or g
tttcatatttcattgacaggctggaagcaccattacttgagaaagaggttgcagtaaagancttttgagtgtctgtcaccttaccttaatatcagtttagaaagtttactaaagctattca

SEQ ID NO: 1278 - DNA, 121 bp, Artificial Sequence
  Synthesized
  misc_feature (61): n=t or c
tctctcttttttgtcttttttttcctttcaaattgcctggttaaaataacactttgactangtttttcccttcgtactgtaaaggatgacatagccatagctaccataagatatgtctgat

SEQ ID NO: 1279 - DNA, 121 bp, Artificial Sequence
  Synthesized
  misc_feature (61): n=a or g
tggacaacatggaaagagttggtgtctgttactatcacacagcctttgtttggaccatcanggactgggatgtagaacagttttcttcttatctccatctcagaaaagtatgtcaaacacc

SEQ ID NO: 1280 - DNA, 121 bp, Artificial Sequence
  Synthesized
  misc_feature (61): n=a or g
gcttaatcatgcataataacggcaagatttattatggacggcctgtttatacaactgcacnattgcttatttacttgtgggttgttggttttttgttccttacccatttgtaatatcttct

SEQ ID NO: 1281 - DNA, 121 bp, Artificial Sequence
  Synthesized
  misc_feature (61): n=a or g
atgggtaaacaaatattcagtttggatcattattaaaatagctttatccattttatattcnttcccttctctctttccactttcctcacaatgtgttattcccagaaaataatgagcttca

SEQ ID NO: 1282 - DNA, 121 bp, Artificial Sequence
  Synthesized
  misc_feature (61): n=t or c
tagttaaaaaaagtacaaaggaagtagccatctctctggctttatattgtatcactttctnaaatcagtgagggctttggagtctattccttgaaatgttatgtgccaggttctgcaggtt

SEQ ID NO: 1283 - DNA, 121 bp, Artificial Sequence
  Synthesized
  misc_feature (61): n=t or g
tttttaagggcaataagaaatgtgtcagagtgcagtccctaactgagtgccatccttattnatgttataagatccaggctcatactcatcctacttaaactaaattaagaatatagatttg

SEQ ID NO: 1284 - DNA, 121 bp, Artificial Sequence
  Synthesized
  misc_feature (61): n=t or c
aggcaaccactgaaaaggtctatgtgtgttcacctaggacctagggtattaaaaatgaagnagagctaacatcatggatcttattatttaaaaaaaaataccactgttgagagttatgtgc

SEQ ID NO: 1285 - DNA, 121 bp, Artificial Sequence
  Synthesized
  misc_feature (61): n=a or g
gaaaattgacatcacttttcactgttttggcagaccccttaatttttctgcaatctgcttncagataaagggagcgatagattagtgaaatggagccttctgcaacactaggatgacactt

SEQ ID NO: 1286 - DNA, 121 bp, Artificial Sequence
  Synthesized
  misc_feature (61): n=t or c
cttcaaaagaactactgtttcatgctccaggtagttacagataaggaagcaaaaggttcangtgtccatttcatcagcatttaaaatgaatgaaactttgcctgagatcatttattgatca

SEQ ID NO: 1287 - DNA, 121 bp, Artificial Sequence
  Synthesized
  misc_feature (61): n=c or g
cacaatcttccctgagtcagttttgtatctcagagggtgaagcaccagcaaatacttattnctaaatggaagaggatccacaagacagcccttgtttgaagtcactgtttggtactgtaga

SEQ ID NO: 1288 - DNA, 121 bp, Artificial Sequence
  Synthesized
  misc_feature (61): n=t or g
ttgtcactgcctttgtacttggcgtggaatgttgttagtggaagaataagttctggtgttnaagccataggttgactaaatatcactaataacaaatatgttcttgtttagtaattgtcat

SEQ ID NO: 1289 - DNA, 121 bp, Artificial Sequence
  Synthesized
  misc_feature (61): n=a or g
tgttgtcaccaaggacattggacagtcttcatcctctgcaatcactggttcttccttgacntggatagaatgtctgaaagacattttgacataaaacttattagtgaaatcattaacacaa

SEQ ID NO: 1290 - DNA, 121 bp, Artificial Sequence
  Synthesized
  misc_feature (61): n=t or c
aggctgaagaagaaatgggagcaaaggagttttacctttgattgcggatttattggctacntcagttgcaagaagaggtaagttttgtgggttcaccaatgatcttgcagctacaggaact

SEQ ID NO: 1291 - DNA, 121 bp, Artificial Sequence
  Synthesized
  misc_feature (61): n=a or c
gataccccctgttacactgccacacacttacacaacttctgcctaaactggagaactctgntgcttttattaacaatagacattaaaggacttgacctgaaaactgtgtaaaatttgtaat

SEQ ID NO: 1292 - DNA, 121 bp, Artificial Sequence
  Synthesized
  misc_feature (61): n=t or c
tgaatcttggggaatccatacagttcaaaaagtacatacattaggaaaatttgtgctcttngcttgttggacctgggagccaggataccctggagctacaggaacttttctgttctggcac

SEQ ID NO: 1293 - DNA, 121 bp, Artificial Sequence
  Synthesized
  misc_feature (61): n=a or g
ttcctgtgaagagtcaggattaagccagggtaaatcttggattgtactcttagtcaaaagncttcatgggaacatagtatcaagaagaatataataatgatcaacaaatcagtaagaaaag

SEQ ID NO: 1294 - DNA, 121 bp, Artificial Sequence
  Synthesized
  misc_feature (61): n=t or c
gtggttaataattaattgactgaacagaagatcatcttgttgtttgatcagaaagcagaangaagagtttcatgcttgtgcttcttgaaggtttgtggcgccatctgaaccagctgcattg

SEQ ID NO: 1295 - DNA, 121 bp, Artificial Sequence
  Synthesized
  misc_feature (61): n=a or g
ggttagacctaatgactaatgaggctggtgaaaattgttgatatatttttggcacgtttgncttagaactgcagccctcgttatatgcttgggcatatgcagcaagtagtacaattcaaaa

SEQ ID NO: 1296 - DNA, 121 bp, Artificial Sequence
  Synthesized
  misc_feature (61): n=a or g
ctcagaaagctgataatactggcagctgaacttcaacagagtatttgaaccaagcccaggntctcttggctcaggacatgaaatggtcagaaaaaaaaaattatcagtgctatttcatgca

SEQ ID NO: 1297 - DNA, 121 bp, Artificial Sequence
  Synthesized
  misc_feature (61): n=t or c
tgccttgggaaaatccagccagggacaatccagtgctgcatgaatgcaaggttcccagcangtgaagaaatgtaagatttactcagtgtatgtgtttctcttcttattctgtctaaggagc

SEQ ID NO: 1298 - DNA, 121 bp, Artificial Sequence
  Synthesized
  misc_feature (61): n=t or c
gtatttttttatataccgtttggactacatttgtacctaaaccagtacaattaaccccacntacataaaaagcgtgcattgcatccctatgaaaacacgctccagcttcacttcacacaat

SEQ ID NO: 1299 - DNA, 121 bp, Artificial Sequence
  Synthesized
  misc_feature (61): n=t or g
agcatttcagggagcatttctgagcatcccttttgcatgtttatgaggaacgaatggcagncactgcgttcagccctcactcaggatgatggtgcattttcctcctgcccactctgcagtt

SEQ ID NO: 1300 - DNA, 121 bp, Artificial Sequence
  Synthesized
  misc_feature (61): n=c or g
caagaaacgacatttacagatggtgatcagagggttaggttaaaagcattcacttgtaaanaaccttacttctatatatttgctcaactcccagctgccactgtttttactgacagtcctg

SEQ ID NO: 1301 - DNA, 121 bp, Artificial Sequence
  Synthesized
  misc_feature (61): n=t or c
tctaaggcttggctgaggagatgctgcttggagtacgctggcctgtgctgaattgcacatnaccacaaagaggttattacgtgcaagccataacaagccatatatattctaaaggtatttt

SEQ ID NO: 1302 - DNA, 121 bp, Artificial Sequence
  Synthesized
  misc_feature (61): n=a or g
tgctttcaaaaaacaagttgcagtgcctcagaaaagaaacctcaggagattaaatgcaaancagtccactgaacacaccactgactacacacagactaattttgttgatttttttttttct

SEQ ID NO: 1303 - DNA, 121 bp, Artificial Sequence
  Synthesized
  misc_feature (61): n=t or c
aatttcttctctctctctttttttttcttggcaggcatttctgtgactgaatagaaagaanttttaaaatgacaggttttacaatggcagcctccccaggacagtggccgtagcactgcat

SEQ ID NO: 1304 - DNA, 121 bp, Artificial Sequence
  Synthesized
  misc_feature (61): n=a or g
atatgcatttcacaatttggacttttataccagtgagtactatatgaaaaaaatgacatanttctcatcatggttttgttgaacatgtgttagttggttctttccccctaacaagaggcta

SEQ ID NO: 1305 - DNA, 121 bp, Artificial Sequence
  Synthesized
  misc_feature (61): n=a or g
aggtgaatttatttttacatgtaaacactgctgtgactattattaatggtttatctacagncaattttgctatcagtagttgaaaaactgtagtaagcacagaagatgagaagctggttca

SEQ ID NO: 1306 - DNA, 121 bp, Artificial Sequence
  Synthesized
  misc_feature (61): n=t or c
ggggggcaagctgcctggggatcccttcttctgcagccctctctgtatggctatagctttnagtatcctgccagccactctactgcacagctcattgagcccctcagtagtgtttaagaga

SEQ ID NO: 1307 - DNA, 121 bp, Artificial Sequence
  Synthesized
  misc_feature (61): n=a or g
ttgctcaaatgaagcaaattctactgacttttgtaggaattagctgatgactctagacacntatcctaaaatgcctctagtttatttgtctgcataatccattatctttataacgactctg

SEQ ID NO: 1308 - DNA, 121 bp, Artificial Sequence
  Synthesized
  misc_feature (61): n=t or c
attattgtgaaatcttaacaaataagcatctccaaaattgtcatgttcaactgtcatcacntgccaagagatggattttaaataatgcatggctgttattctgtctgtgtctgctagcagt

SEQ ID NO: 1309 - DNA, 121 bp, Artificial Sequence
  Synthesized
  misc_feature (61): n=a or g
gctcaaaagtgacccagccttttccacagggacaggtcccccttatctcttgatgtctgtnctttgttggccagaggtgcacccacactgaaggcattcctccggcacccaaccccttgtg

SEQ ID NO: 1310 - DNA, 121 bp, Artificial Sequence
  Synthesized
  misc_feature (61): n=t or c
acttttggttaagcccctgctctaaaatatatgtcaatttaagggatcatttttgcatagnaaagtccaactaaaagcagtggagtttaaaaatcagtaggattctctacatttcaacatg

SEQ ID NO: 1311 - DNA, 121 bp, Artificial Sequence
  Synthesized
  misc_feature (61): n=t or c
gggtacgtacagttctttgggcagaagcagcatgtctgagtcagcaggcacagaaagaaanggatgctttaacacagctttgggactcacacgatgcataggatgagagctgcctggtaag

SEQ ID NO: 1312 - DNA, 121 bp, Artificial Sequence
  Synthesized
  misc_feature (61): n=t or c
agaactctgaaagttttagcacagtcgtaaatccaagatcagactctcaatttgtctgtangtaggaatatgtgctgcactgaatgcaggtatcattaaactgataaactttgtattgata

SEQ ID NO: 1313 - DNA, 121 bp, Artificial Sequence
  Synthesized
  misc_feature (61): n=a or g
ctgtattctagctactatgagcatgtactcagattttctgcaatccttcctgaaacatacntcaactaccattttcgatcttgtggatgagtatgaaagtatatgtaataatcaggtaaat

SEQ ID NO: 1314 - DNA, 121 bp, Artificial Sequence
  Synthesized
  misc_feature (61): n=a or c
gtttttcctccatgaacagccaccctcactggggcacagcacacccacgtttatgtggcangttctcgtgtgaatcttgcaaccatggctgactcctgcccggtggtcccaactcatgggg

SEQ ID NO: 1315 - DNA, 121 bp, Artificial Sequence
  Synthesized
  misc_feature (61): n=a or t
ctaaatagcatctgaacttttggttatgatatacattcttctgagatgccttttccatctngatttcttctcaaaagaaacagttaatatgttctggaattgttctataattgttttcttt

SEQ ID NO: 1316 - DNA, 121 bp, Artificial Sequence
  Synthesized
  misc_feature (61): n=t or g
acattgctcgtgcaatatgtgggaaccaagtaagctttgcaagacacctgcctgacagatncattgtaccactgaaacatgcatatttcagtgcatggatgctgtatgatccttccactgt

SEQ ID NO: 1317 - DNA, 121 bp, Artificial Sequence
  Synthesized
  misc_feature (61): n=a or t
taaagctgaatatatttatggctgctgtactcaaagcagaaattgtgaccactgcaagaantcataggcaatattcatcattatcacgtcagttgaaatatgttgcaacgctaagatattg

SEQ ID NO: 1318 - DNA, 121 bp, Artificial Sequence
  Synthesized
  misc_feature (61): n=t or c
tttgtgttactaatgggcatctatcattacgatttttgcttgacgcttctcagcatctccnatcaggacagatattaggaattggcatttttaacagtcttaacataacttctgtatgatt

SEQ ID NO: 1319 - DNA, 121 bp, Artificial Sequence
  Synthesized
  misc_feature (61): n=c or g
tcttttctttcacgtggagagaacaaagaaaatgaaaagagatttcaaaattactccaagntttttaacaaatagtgagcaaaccattgtatttcagtgtatttacttcaaccagtgactt

SEQ ID NO: 1320 - DNA, 121 bp, Artificial Sequence
  Synthesized
  misc_feature (61): n=a or g
ctattaaatttgcctgcagaatacctacagaataccttggaaggtaaaatttgtaagaagnaggaatgtttctcatgagtatatgttatttatttatttatttatttgtttatttatttat

SEQ ID NO: 1321 - DNA, 121 bp, Artificial Sequence
  Synthesized
  misc_feature (61): n=a or g
caaaccctcccaactgctatttgtcattgctgttgcgcttttacaatgtcatacaaggatncacgaaggctctgaagtactgataataatatggaaaaagaatgtcaattctttctgtatg

SEQ ID NO: 1322 - DNA, 121 bp, Artificial Sequence
  Synthesized
  misc_feature (61): n=t or g
agcgcatgtaaaacatgccataaagggacacaggtgggtagatgtgtggttgctgcctctnctgtcctctccttcattaagtctgtgtatcacatagcagctgtgttaaccaggggtgatt

SEQ ID NO: 1323 - DNA, 121 bp, Artificial Sequence
  Synthesized
  misc_feature (61): n=a or t
tcatcatcccaagtctgggatgacttggtcttattaaaggcacttcaagcaactatatgcnagatatggctggtaccagctgaaaagttagagaaatcagctagtcacttggctctgtggc

SEQ ID NO: 1324 - DNA, 121 bp, Artificial Sequence
  Synthesized
  misc_feature (61): n=a or g
actaaggagaactaaatgcttctgtaagaatactgcctgtatagaaaattaaaaagcaaanggcacttcgaaaacatatccacttcactaattaccaaactttgtctgctttgcacatagg

SEQ ID NO: 1325 - DNA, 121 bp, Artificial Sequence
  Synthesized
  misc_feature (61): n=t or c
aaagatcagctcatattttggcatttaatgctgcagtgctgttgatgcagttttcaaaagngtctagcatttgatttactgtctcactctgagatcagtggaaagactcacacgaacttct

SEQ ID NO: 1326 - DNA, 121 bp, Artificial Sequence
  Synthesized
  misc_feature (61): n=t or c
aaaatatctcatcatgttttttttaatttgtttttcagtctttcccaaaatgcagttgaancataccagcttctaaagtgtctggttcatccggtctctgtgcaatctgtaaataataaag

SEQ ID NO: 1327 - DNA, 121 bp, Artificial Sequence
  Synthesized
  misc_feature (61): n=c or g
atcctgctgactgctagctgcggtgtgtcagcatagttgctgattgcaaactcactgtcantgagagatgctagaaataggtctatgactgctaggcctttgtacagatagcattaaggat

SEQ ID NO: 1328 - DNA, 121 bp, Artificial Sequence
  Synthesized
  misc_feature (61): n=t or c
ggcatcctgtcctcccagccatcctttgatcctggtgtatggtgctcctgtagaaaggagnatgtggtccagattttattcatattttcatttggagtgctgttttatctccattcttcca

SEQ ID NO: 1329 - DNA, 121 bp, Artificial Sequence
  Synthesized
  misc_feature (61): n=t or c
accttcctcagcaaacgattggattgacctttctgctcacaaggattacacaagacatacnatatgggctggggaatgttgaggtaagtcttggttcacagcaggctgtgcctgtgccact

SEQ ID NO: 1330 - DNA, 121 bp, Artificial Sequence
  Synthesized
  misc_feature (61): n=t or g
gcatgtgcctgttaaatattagtgaatatgtggtgcttcagtcagagttgacatgttaganttgtcatgcttgaagtaaattctatttttacaagaaagaaaaaagttcctaaaatacaga

SEQ ID NO: 1331 - DNA, 121 bp, Artificial Sequence
  Synthesized
  misc_feature (61): n=a or g
tcctgcatgatgtcctgaggtcactaccaggccagtggcttcacagcttgctcaccttctntagctccttctggagctacaaccacagctaacatgatttgctgcagtcagtggatggtgt

SEQ ID NO: 1332 - DNA, 121 bp, Artificial Sequence
  Synthesized
  misc_feature (61): n=t or c
tattggacaacttcatttatattcactgattccccaattcccaccaatttccggaagaganctgtgcaatagacatagccatcagcttttgagactcttcgtttacgaatgtcatggatag

SEQ ID NO: 1333 - DNA, 121 bp, Artificial Sequence
  Synthesized
  misc_feature (61): n=c or g
attgctccagaatcagttgacttgttgaatgaatttgaccacgtttacctcaaatgacctnaagctgcatcagtcaaagcacgtttttctctgtattccaacgtggggctttggtcactac

SEQ ID NO: 1334 - DNA, 121 bp, Artificial Sequence
  Synthesized
  misc_feature (61): n=t or c
acaagagaaacctgcacaggatgatgtttccacagccactcagacaccaattagtgctagnggagcaaaggaagctgggcacgcagggccacagccagaagctcaaggaggtactaagggg

SEQ ID NO: 1335 - DNA, 121 bp, Artificial Sequence
  Synthesized
  misc_feature (61): n=t or c
ttgaaagcaacaaagaggtatgtgcatattcttgttgctggaagctgcagcaccacaacgngatgttgcttagcctcttttcttgatatccatttccatttttaggtcatccttttgatcc

SEQ ID NO: 1336 - DNA, 121 bp, Artificial Sequence
  Synthesized
  misc_feature (61): n=t or c
gaaggcaataaaagtacaaagggtgggttatggaccttctcataaaggtcctttaaagganagcctctggtctctgcaggtaagtatgctgtactccagcacatcacttgaaagatgcaga

SEQ ID NO: 1337 - DNA, 121 bp, Artificial Sequence
  Synthesized
  misc_feature (61): n=t or c
cctgtatcaagactgaagctattgagggacacctcctctgtgcattctatgtccttagcangcctagctcttgctgtactcacagcagactttgagcaggaaagagaaatggtccagactg

SEQ ID NO: 1338 - DNA, 121 bp, Artificial Sequence
  Synthesized
  misc_feature (61): n=a or c
tctttatatgctcagagtgatatatgcatgtgattgaggacggcaaaaaggcatttggtcncctaaggaatctggaagagaagctggctccataagaaaattaagttcagggctaagaaat

SEQ ID NO: 1339 - DNA, 121 bp, Artificial Sequence
  Synthesized
  misc_feature (61): n=a or g
aggttgactccatagttaattatctatttgctgctacagtgtatactgtcttccaaagtgntcgtttttataaggagagtactgtcacaatgccaaacatccagaagttagaaaattctac

SEQ ID NO: 1340 - DNA, 121 bp, Artificial Sequence
  Synthesized
  misc_feature (61): n=t or c
tgctgccatgaagtgaaattattttaagagacagagggggtgcatggtcagacacagagcngtgcccctgctcttcctggccagagcccaataccactgcttttgctgaactacccattct

SEQ ID NO: 1341 - DNA, 121 bp, Artificial Sequence
  Synthesized
  misc_feature (61): n=c or g
tctccgttggtttattttggctctaaccaaccactgtaaactacacattggagtgtgagtntggcaaagaagagcctggtggccaatggcaccgctttgggcctgcggggctgagcagacc

SEQ ID NO: 1342 - DNA, 121 bp, Artificial Sequence
  Synthesized
  misc_feature (61): n=a or c
tagacattaactgatagtacgaaacaaatccctggaaaggtatggaaatggaacaggattngatgtcttacttaagggctggaaggagacaggggttcaaaagcggaattagaggaaagat

SEQ ID NO: 1343 - DNA, 121 bp, Artificial Sequence
  Synthesized
  misc_feature (61): n=t or c
atgacagacgtgctgcagtgctttgctagcatcgcaggggtggccttgatattcaggcctngctggaaagaggaattccccactgcaaatgaggtactctcatcaatagatgatgtattat

SEQ ID NO: 1344 - DNA, 121 bp, Artificial Sequence
  Synthesized
  misc_feature (61): n=t or c
tcccagggcattctgggaacatagataatgtttctgatgccaggccaggttaaacgcatcnggcataatagaccctgcagatgctcacttggacagatgcagaaaacttgatgttatccca

SEQ ID NO: 1345 - DNA, 121 bp, Artificial Sequence
  Synthesized
  misc_feature (61): n=t or c
tctctggcctctctcttctcagccatgtgaaaacggctctcagtggtaacactccctgcanatggctctgtccctccagatcccacaccacgttcctgtcaggctgcatgatcaggatggc

SEQ ID NO: 1346 - DNA, 121 bp, Artificial Sequence
  Synthesized
  misc_feature (61): n=c or g
gtcatttgcttatagaaagtggcatagcattctgtcaagatttatagcaatgttacacagncatgataaatatgttgtacgaacagaactaggacgtgctactgtactatgatgtctattt

SEQ ID NO: 1347 - DNA, 121 bp, Artificial Sequence
  Synthesized
  misc_feature (61): n=a or g
atttttctagacatgaacagccattgcttcagtatattttgttcttcatctgtgttggacntgaaattttacagtttggtgttaagcattatggagaggctggaagggaaggttgttctct

SEQ ID NO: 1348 - DNA, 121 bp, Artificial Sequence
  Synthesized
  misc_feature (61): n=t or c
acttcttctcttgtacctagcagtttcaacagttactggcaacttgtattctgaaaaatcntattaattcctatagtatactcaagttaggaaataccacaacattaaattgtaagaaaag

SEQ ID NO: 1349 - DNA, 121 bp, Artificial Sequence
  Synthesized
  misc_feature (61): n=a or g
gtaaggtggaggcctggattttattcacggtaggcagacatactggagacttcactgttcngtacagtatggtgaggtcatggcaggcctcctgtcccacaggtgagataaaatacaaagg

SEQ ID NO: 1350 - DNA, 121 bp, Artificial Sequence
  Synthesized
  misc_feature (61): n=a or t
taatcttttcacagggcttgtccacacgccacagtcctgactttaactacagtgacacagnagcactaagccacgtggcccaaacctctgtaatactctcacgtaggacgttcagtgtatg

SEQ ID NO: 1351 - DNA, 121 bp, Artificial Sequence
  Synthesized
  misc_feature (61): n=a or g
gagagaaatcaggtgtgctattagacggtgttttacacagaattattggtgttcttgattntactgtaagaggcagcctaaataattatcaagtcatccaagtctcctcttaagacctgta

SEQ ID NO: 1352 - DNA, 121 bp, Artificial Sequence
  Synthesized
  misc_feature (61): n=a or g
tgtcagagcccactgcctcaaggtagtcaggacataaggcaatcagggcatgagtagcaangcagctctaggtcctgctcagcaggcagcactcagtgggcattacagccagctagcagat

SEQ ID NO: 1353 - DNA, 121 bp, Artificial Sequence
  Synthesized
  misc_feature (61): n=a or g
tgatatggagagttcacgttttcttttcacgtcaatgcaagtcggttcttggtttcagganaaccttaagctaagtcatctatacgttggctgtatattccagcctctgttgatcggtgaa

SEQ ID NO: 1354 - DNA, 121 bp, Artificial Sequence
  Synthesized
  misc_feature (61): n=a or t
gatgagaaattcagaccatctcttttgtgcccaagactaaatggatgaaataaatgatccntgattttcacaaaagtattcatcaggagtgaaaaaatgactagacttttatttttccagc

SEQ ID NO: 1355 - DNA, 121 bp, Artificial Sequence
  Synthesized
  misc_feature (61): n=a or t
ttacagttcagaatggaactggtatcattccttatttaaaaacaaaggattctgaccggtnaacatttaacagacgtgatacttgatgccaaagcccaacttaaccatcactctagcaatg

SEQ ID NO: 1356 - DNA, 121 bp, Artificial Sequence
  Synthesized
  misc_feature (61): n=a or t
gtgatgccgttatggtaatttgcaccacaatgccaaagactgcttctttaatgacaataangtcttagttagaccagtggcttagtaactgcctcttaagatgcattggatgaatcagaga

SEQ ID NO: 1357 - DNA, 121 bp, Artificial Sequence
  Synthesized
  misc_feature (61): n=t or c
ccagcagccagctgtgctctttctcatctcttctaaaggatttcttagatgaccttttccngctgtctcagacaaactaagaatattattattattaatggtagagctaagaagactattt

SEQ ID NO: 1358 - DNA, 121 bp, Artificial Sequence
  Synthesized
  misc_feature (61): n=c or g
tagaatggtgacctgcaagctagaggtgagatgcttatcctacaagcagccattctcctgnagctgaaatgcaaagagtttttctccagtaggatttgtggtgttttacgctacgttggat

SEQ ID NO: 1359 - DNA, 121 bp, Artificial Sequence
  Synthesized
  misc_feature (61): n=c or g
atttttatttttttcaaaaattaccattctggaaaagcacttacaccatcgctatagatantgttctcagtcccaatattttgttatcaccagattttgcagtgttattatcttagctttt

SEQ ID NO: 1360 - DNA, 121 bp, Artificial Sequence
  Synthesized
  misc_feature (61): n=a or c
cacaagcctcgcattttaaacttttccaatttcacctaaaaagttttatttcattgaaaangataacagatctaataatgataccaaccttaaaaaggatacagggcatgtttcttacttg

SEQ ID NO: 1361 - DNA, 121 bp, Artificial Sequence
  Synthesized
  misc_feature (61): n=t or c
cactttctcttatatcctgggcatcctgtattggtgaataatttgggatgtcagagctggnaagttttgtgcccttcttactaagttacatctgatacaatctaaaccaggtatttttcag

SEQ ID NO: 1362 - DNA, 121 bp, Artificial Sequence
  Synthesized
  misc_feature (61): n=t or c
tttcagggactgaggtgagtcttccattggaaaagctatttatgggtcgtgatatagaccngtgtggtgtacctttttctgtgagctgtttggccatttgccctttgatgtaaatgcaaaa

SEQ ID NO: 1363 - DNA, 121 bp, Artificial Sequence
  Synthesized
  misc_feature (61): n=t or c
tttattgctacaacagttgctacaacaaaagtcaggagttgccatgaactgacgaatcccnttctgccaccctaaggggacattatcccaagaactgaggagctacgactactgactcacc

SEQ ID NO: 1364 - DNA, 121 bp, Artificial Sequence
  Synthesized
  misc_feature (61): n=t or c
ccaagattgttaaaacaattaatatatagcatgtggccctgtctgctataatgaaaacacngaggagaacacaagagaatgcagtgtggtggcagcaagcaatattcttctgacctgagag

SEQ ID NO: 1365 - DNA, 121 bp, Artificial Sequence
  Synthesized
  misc_feature (61): n=t or c
aagacatttccatcgctctttctgtcatttcagaaaggacatttcccacttgttgctatangggtgtttcagtttgggcacatcagttgagctagttttctataatttaaaggcatatcct

SEQ ID NO: 1366 - DNA, 121 bp, Artificial Sequence
  Synthesized
  misc_feature (61): n=a or g
gtgaaattgagaaatagaattacatcaaattcgtgggaaaactgaaatagatccatagagntattgtaatgaatgagacagcttagagtcaggtgcattttgaatcactggcataattcaa

SEQ ID NO: 1367 - DNA, 121 bp, Artificial Sequence
  Synthesized
  misc_feature (61): n=t or c
taggctgcgtgtcttggctgggagtatctttggcttaattaaaggccctcaaatctgcagngatgtccataaaagcagaagcccttacagacacagaggggagggagacgctgagagcagt

SEQ ID NO: 1368 - DNA, 121 bp, Artificial Sequence
  Synthesized
  misc_feature (61): n=a or g
ccaactcacactcatgtcctggaaccccaaacacgcagcagtcacaggacacaagggaatntttaattgctgctaattagcttatcttcaagcaaaataagtcagcaagtagtaaaatgac

SEQ ID NO: 1369 - DNA, 121 bp, Artificial Sequence
  Synthesized
  misc_feature (61): n=c or g
taattccaaagcatttatctctgcccctttggctgctctgagaggaccaaccatgctggantggggagtcccagatgcctcccttagaagccaggtctgcagaggagcattgtgttatgtt

SEQ ID NO: 1370 - DNA, 121 bp, Artificial Sequence
  Synthesized
  misc_feature (61): n=t or c
tggcacaggcgactacaagacagttgcttaatggtggttgtatgtggtaaaaggtgaagcnactctacttagagttgactgaaacagtcaatgctttacccacattaattgccatttctaa

SEQ ID NO: 1371 - DNA, 121 bp, Artificial Sequence
  Synthesized
  misc_feature (61): n=t or g
ctgtttatgcagtgtcttcagtgccattggttctaagtatcaagtgtaaggacagtggtgntactcagtccctactacatagtatatctttctctttgccttcatcagtttttactacatg

SEQ ID NO: 1372 - DNA, 121 bp, Artificial Sequence
  Synthesized
  misc_feature (61): n=a or c
ttaacctctgcaatcatctgtaaaattgctataataggggcttggcagctcaacagccaanagtagagctaaatagattaatgaagtgcctctagaattatgcataggaatgttatgaggt

SEQ ID NO: 1373 - DNA, 121 bp, Artificial Sequence
  Synthesized
  misc_feature (61): n=a or g
gttgatatcaaataaaacagtatttgctttggtgccaaaactacataaagcagttaggaanggcagagctaaacacatcaccaaacaacccgaggatttccagggtgcctagaggatgcaa

SEQ ID NO: 1374 - DNA, 121 bp, Artificial Sequence
  Synthesized
  misc_feature (61): n=a or g
aatcacaggtaaattgtcctgtaagatacaattagctgtagtaatgctccaccattcccancaatgtacagtgacttgctctcctctcttgcacatttaatataagctttttaaaactcta

SEQ ID NO: 1375 - DNA, 121 bp, Artificial Sequence
  Synthesized
  misc_feature (61): n=a or g
gctacaattaaccatctcctctccttagaaagtagcttgaagccaccttttaaaaaagctntagaaaagaattaaatgtgtggtctccatatctgtgaaattgcaatgtctacgataacag

SEQ ID NO: 1376 - DNA, 121 bp, Artificial Sequence
  Synthesized
  misc_feature (61): n=a or g
attaggacacagtcactcatttcaaccagattgtttttgagaacgcagcttattttaaatncttcttgaacatttcctgccgggatttgttgaggatatagcttatgatgagcactgattg

SEQ ID NO: 1377 - DNA, 121 bp, Artificial Sequence
  Synthesized
  misc_feature (61): n=a or g
cctgtcttataaagagaccagctttcttgtttgtgctgttattattgtcagcgtgggtacnacttgatgttggtggaggagcagcacaaggcacagtttctccttcatcaaagcatatggt

SEQ ID NO: 1378 - DNA, 121 bp, Artificial Sequence
  Synthesized
  misc_feature (61): n=a or g
atgatcgggaaaacttttcaagctttatagtttaagctaagaatcttctctttcatttttntggtgcgttgtgttggacaagctatagagacactggaaaaaagacacttctctttttgtg

SEQ ID NO: 1379 - DNA, 121 bp, Artificial Sequence
  Synthesized
  misc_feature (61): n=a or g
tcaccacgggttgctccatggttgcatggtcaaatctgctctgtttgttgcccacaggctncagaggaactgcctactccaccgtgggcctctgttgggctgtagagagcttctgctcctc

SEQ ID NO: 1380 - DNA, 121 bp, Artificial Sequence
  Synthesized
  misc_feature (61): n=a or c
agtatacaaaatatgggcagtacaatttatgctggatccctgaggaaaataagcagaatanatttcattgtgcttaggctcatctctgctggtataacagcgtagttaacatatcccatag

SEQ ID NO: 1381 - DNA, 121 bp, Artificial Sequence
  Synthesized
  misc_feature (61): n=t or c
gatcattgatggaactgatagaaactggattcagtgaggtttaggtacacagaacattttnatatgtccagactgtaataacattaatcatattactctgccatcttaacagcaatggatt

SEQ ID NO: 1382 - DNA, 121 bp, Artificial Sequence
  Synthesized
  misc_feature (61): n=t or c
ataacacagtgttagggctgcagtctttaaagggtttgagaaatggcagaagaccattttnctgaagtaactcacggttacatgacaatgtcttgcagccttttgtgatggagcaggcatg

SEQ ID NO: 1383 - DNA, 121 bp, Artificial Sequence
  Synthesized
  misc_feature (61): n=t or c
aaataaaatactttcatccttcatatgatacagagcacaattcaggagcggtatgtcagtncatggaacctccctgacttgttctaccaggctgtgaatacagtgaatttcacttacgtat

SEQ ID NO: 1384 - DNA, 121 bp, Artificial Sequence
  Synthesized
  misc_feature (61): n=t or g
tggagtataaacccttccatttttacagtatttatttagggaatagtattggtgaaatganccttgactacacggagggaattattcagttaatactatttcatagcaatattttgatctt

SEQ ID NO: 1385 - DNA, 121 bp, Artificial Sequence
  Synthesized
  misc_feature (61): n=a or g
atatgcaacccattgaaatcctgatgagtagatactgatccataggggaaggcttaataanttgggacaagctaaaatatttccacatttttcctccctccagattaatttctaagagaag

SEQ ID NO: 1386 - DNA, 121 bp, Artificial Sequence
  Synthesized
  misc_feature (61): n=a or g
ttctggatttgtttgatttcttcactatttacatgaattacatttaacaaaagcctggacntgcaactaacactgaatctatgatgctaaacaaatccattccttgaattaatccctaaat

SEQ ID NO: 1387 - DNA, 121 bp, Artificial Sequence
  Synthesized
  misc_feature (61): n=t or c
agccctggtgctccctggagctttaattttctctcctaaagttcatcttattctctctctnctatcataacatttctagcggttttcttttatttactcctaagcttctcataaatcacag

SEQ ID NO: 1388 - DNA, 121 bp, Artificial Sequence
  Synthesized
  misc_feature (61): n=t or c
ccctgtcccctttgcaacctacagctgctcacgagtaggaatttggtttacttgcaaaggnttcttaggttcctggtgggacaaataaaacaaaaccggtgccagcagcaagggttcttaa

SEQ ID NO: 1389 - DNA, 121 bp, Artificial Sequence
  Synthesized
  misc_feature (61): n=t or g
gcaaagttggagcagcgcccagctcttaatgcaaagggataattgcagaggagataacctntgatagatgcattgaaatgcaaggcaggcgagacacagatttatatttatacacttctgc

SEQ ID NO: 1390 - DNA, 121 bp, Artificial Sequence
  Synthesized
  misc_feature (61): n=a or g
acatggtttacctgatgaaaaaggtgtaatttggtattaccttcatttggtaatctgtaanctgaatttgtttgtgaggtatctaatggaaagacagctctgaaaacaattatcccccaga

SEQ ID NO: 1391 - DNA, 121 bp, Artificial Sequence
  Synthesized
  misc_feature (61): n=a or g
ctactgaccaagactcatcacagcccctttccccttggctgaggcacttgccttgcagttngatacagcttcaccatgcacgcagataggagcagtctctgggtaccatttgaaaagtgct

SEQ ID NO: 1392 - DNA, 121 bp, Artificial Sequence
  Synthesized
  misc_feature (61): n=a or g
caggaaaatgctttttaaaacatctattagcaaatgttaaagtaagtgtgcctgcgagttnatgttgtataatcatatgtcctcattaaatactaagaattctctttataagtctaaactt

SEQ ID NO: 1393 - DNA, 121 bp, Artificial Sequence
  Synthesized
  misc_feature (61): n=c or g
atgaggaaatttcactttgaatattatgttatagaaagatgctcgaaacacggactgagantttcattacattttctgaacaggataaataaaacaaaagtgatttgagacaactacacag

SEQ ID NO: 1394 - DNA, 121 bp, Artificial Sequence
  Synthesized
  misc_feature (61): n=c or g
ttgtgttgcattgttgcgttgccttgttgcattgcagcgttatgcaatactccagttctcngcctagcaaaaacttactcattggcaccacggcaggtagtgcaagaggaatacaacagct

SEQ ID NO: 1395 - DNA, 121 bp, Artificial Sequence
  Synthesized
  misc_feature (61): n=a or c
acacttacataggcatatatatgcatgcatacgtgtatatatgtatacctacacacatagntagagcacatatagaataggggcattatccggcaaacctattgcctaaaagttcagcact

SEQ ID NO: 1396 - DNA, 121 bp, Artificial Sequence
  Synthesized
  misc_feature (61): n=a or t
aaaatttgctactgaaaaatctctgcaacaggtacttttcccattcccttggaagaaatgnctgtggctagtgattctagttcaaagaggcacagaggaggtcaggatggggaaaggatac

SEQ ID NO: 1397 - DNA, 121 bp, Artificial Sequence
  Synthesized
  misc_feature (61): n=a or g
gactggagaactcaccatggcccagaccatctgacgtgttttgaacgcactttttgagaancagcggtgttgattgcttctggagctcattgtcagagataaaggggtctgcaaatatgtt

SEQ ID NO: 1398 - DNA, 121 bp, Artificial Sequence
  Synthesized
  misc_feature (61): n=a or g
atttgagttatgagttagattctgaggaagctacactaatttggctagcgtcaacaacaanccagttcttcagaaccattaccagccagtatatattacaatattgctccaagacatcact

SEQ ID NO: 1399 - DNA, 121 bp, Artificial Sequence
  Synthesized
  misc_feature (61): n=t or c
tgtgtagctgcaggagacagtaggttattagccatgctatcttacatgggagaatgtccangtaaatgttatcagatgtgtacagtggagacaggacctgaggagacagaaggagtatggg

SEQ ID NO: 1400 - DNA, 121 bp, Artificial Sequence
  Synthesized
  misc_feature (61): n=a or c
aagtgacagagtccacacaaaatgctactgctgtctgatttacaaatgcaaacagagcctnctaggaagataaacagagtactcatacttcccagataggaagtggcccaacagttatttc

SEQ ID NO: 1401 - DNA, 121 bp, Artificial Sequence
  Synthesized
  misc_feature (61): n=t or c
attttaatagaaatagtatagaactttctttgaggaaaataaaatcttttgagacatcttntctgtaacagccaacggagtagtcccagctcctcagcacttaaaacgttctgcaactgtg

SEQ ID NO: 1402 - DNA, 121 bp, Artificial Sequence
  Synthesized
  misc_feature (61): n=a or c
catacctgagcatagaactccagcgtcttctttgtgttggcagttgtgatgaccccatacnctagagggacatgcccagatattggattcagacccagtgcagttcacatcatccagccag

SEQ ID NO: 1403 - DNA, 121 bp, Artificial Sequence
  Synthesized
  misc_feature (61): n=a or g
tcttcccagcctgtccttcctggagacactgtatccctcctttgcaacattccagttacangaaacacctcaccatttctttgtgattccagcacattcatagccctgcaacagcacacac

SEQ ID NO: 1404 - DNA, 121 bp, Artificial Sequence
  Synthesized
  misc_feature (61): n=a or c
ttggattctgcccatagccacaaaaagtcctgctgacctaatttcctagtttaaagtttanatttcctagttcaaagtttaactagatacttaaagagcatgagcaggggaacttgccaag

SEQ ID NO: 1405 - DNA, 121 bp, Artificial Sequence
  Synthesized
  misc_feature (61): n=a or c
catcaccctactccaagcactgctaaaggagcactggcactgagatcacaagtcctcacanaatgaaatatgactccttgagcagacaacagcttacctttgtgaagcaactattctggca

SEQ ID NO: 1406 - DNA, 121 bp, Artificial Sequence
  Synthesized
  misc_feature (61): n=t or c
gggttttgttctggccttcttctctgatgcttgtagggcttttagcacattcattgcatangattgcaccgttgataaccccagtgatgcatgttataaaattaaaaagcaatcacctata

SEQ ID NO: 1407 - DNA, 121 bp, Artificial Sequence
  Synthesized
  misc_feature (61): n=a or t
tcaggagtcctgagttcccttctggaagcactacttccttctctccagtaacaaaatctcntgaactccagattttggtcctctgaatcatgtttgttagatgccctattaggactatgtg

SEQ ID NO: 1408 - DNA, 121 bp, Artificial Sequence
  Synthesized
  misc_feature (61): n=a or g
tcaccctagtgaatcacattgaaccatcggcaaaagacactgtcactcagcatgtggacantttgggtaacgggtgctttatgaacccgttggagtggcagacagacagacagatagagct

SEQ ID NO: 1409 - DNA, 121 bp, Artificial Sequence
  Synthesized
  misc_feature (61): n=a or g
agactggatgataggaacattaaaattctttctccctttactaaccaaagggaagatgacntgaatttttttctgattaattttgaaatatctgagggaaaaaaacagcattgccctgcat

SEQ ID NO: 1410 - DNA, 121 bp, Artificial Sequence
  Synthesized
  misc_feature (61): n=a or g
tctgtacctgctcacaggaacagagttccaggtgctcccgttccattcttggagatagtcngtaggctctgtggaacagcatatgcagtaaaaaaaaaaatggaaaagaacaagagaaaga

SEQ ID NO: 1411 - DNA, 121 bp, Artificial Sequence
  Synthesized
  misc_feature (61): n=a or c
gctgtgttttaagatcacctctgctgcctacctctccactagccttctgccttctgagcanattagtgccaaaaatggagctgtaaatttccacttgcacagtgggatactgagcactgca

SEQ ID NO: 1412 - DNA, 121 bp, Artificial Sequence
  Synthesized
  misc_feature (61): n=t or c
gtggcttttaagggcttgacacctggaagtgcttttgggaagatgaccgtatgccagtggnttttggaaataacaaagcatttagtctttgtatcggtagttcattcagctggtagttgat

SEQ ID NO: 1413 - DNA, 121 bp, Artificial Sequence
  Synthesized
  misc_feature (61): n=t or c
tcaggaaatatccaccctgcctgtggtggaccagataagatagatgctggccaccttgccngttgatggtatttgtctagtggtgatgttcagaagctgtattccacagtgaaggcctcat

SEQ ID NO: 1414 - DNA, 121 bp, Artificial Sequence
  Synthesized
  misc_feature (61): n=a or g
agatctgtaactttatcttaaagtgcaaattgacatcaaaggagcaaaaaggaataagtgntatctaaatgtgacgtttcagtgacagtcttcccttatgcaagactgtactcccagaatt

SEQ ID NO: 1415 - DNA, 121 bp, Artificial Sequence
  Synthesized
  misc_feature (61): n=t or c
tcattggcctctagcactgaatgaccacaggcttcaagggagagactcacctggctgggcngtcctcagctgcaccatggcttgtgcacttccaacctcattctctgccatgcactggtaa

SEQ ID NO: 1416 - DNA, 121 bp, Artificial Sequence
  Synthesized
  misc_feature (61): n=a or g
tgtttattttttggcaggagggaccaaaagaggccagggtagggattgagcatgtgttacntgtgctggagaaagcacgtctcctccaagtcagctgtcttctgtctgctttcacatgtgg

SEQ ID NO: 1417 - DNA, 121 bp, Artificial Sequence
  Synthesized
  misc_feature (61): n=a or g
tgtaaagcatttctgtatccttttttcgctatgtaaacattcttacagttcaccggcagcncttcatgaggccaaagtaaggtctgctgtaggctctgtgttgctggtggactccactgtg

SEQ ID NO: 1418 - DNA, 121 bp, Artificial Sequence
  Synthesized
  misc_feature (61): n=a or g
atcctttgatggattacaaaaccattttctttcaaaagactctttcctgtgtatgcatgcngagatcgtacccaaggtgtggctgtgccttccccacagttagcttgaccttttcccacct

SEQ ID NO: 1419 - DNA, 121 bp, Artificial Sequence
  Synthesized
  misc_feature (61): n=t or c
aattggattctgtcttacggtcctggaagggaaccgctccaggaaggaagctgtggtagtnctggagagcatttaaagactggtgctgggtatttatgggggggggggggggcagaaatat

SEQ ID NO: 1420 - DNA, 121 bp, Artificial Sequence
  Synthesized
  misc_feature (61): n=t or g
cctgataacttcacaacctagtctttaggcagatttccccaggctaagaagtccccagttncactttcattaacaagttacttttgcaaagttctgcacttgttttagccactctgttcca

SEQ ID NO: 1421 - DNA, 121 bp, Artificial Sequence
  Synthesized
  misc_feature (61): n=a or g
taagtaagaatatgggacatctataatttaaaaaactcctaaatgcttgtattattcaganctgttattacaactgttatggtactcgttaccctatatggtacttgttaccttacagata

SEQ ID NO: 1422 - DNA, 121 bp, Artificial Sequence
  Synthesized
  misc_feature (61): n=a or g
aagtaagttagcatgttgtcagcgtaacattgctgtacttgaattctgacacattcgcacnttggaataacaatatattgtatgttcaggactagaatattcaatatttcgtagcagtggg

SEQ ID NO: 1423 - DNA, 121 bp, Artificial Sequence
  Synthesized
  misc_feature (61): n=a or g
tgagcaaagtgacttggcagctcagagggcactgatggaagttgtgcttctaaactcctcngtcatggctgagagttctgttcccagagtcaagcaatacaaagagcgaactcaaggaaac

SEQ ID NO: 1424 - DNA, 121 bp, Artificial Sequence
  Synthesized
  misc_feature (61): n=c or g
caggtgccagcagtaggtgcctttgaaacatgaagattgttgatgtcagaaatatcagganctttgccttcctcgtgcaactacaaaacttactgtcattgtatagtatgtcatgggcacg

SEQ ID NO: 1425 - DNA, 121 bp, Artificial Sequence
  Synthesized
  misc_feature (61): n=a or t
ttatgctgacctggtttgtttgtctgttctgagactttgaaaaataagtcacttttcagangctttctgtggggaaatcatgagtcaaaagacattatggtctccaatgaatattgttggc

SEQ ID NO: 1426 - DNA, 121 bp, Artificial Sequence
  Synthesized
  misc_feature (61): n=a or g
ctttccttcctgctggcttttccaacagtctccctttcttccctgtcttgtatgtgctgcntagtggattcccagggcttgataaacaaacaaaatgaacaacttcttggtctgatcagca

SEQ ID NO: 1427 - DNA, 121 bp, Artificial Sequence
  Synthesized
  misc_feature (61): n=t or g
actctgaaaaatcttctgtccttatggagagtattacctctctaccctaggcttcacaagngaaggggagaattggtttgtgtttgtgggatcagagaactcaggatattgagtgctttta

SEQ ID NO: 1428 - DNA, 121 bp, Artificial Sequence
  Synthesized
  misc_feature (61): n=a or t
gaagcagacatacctagatcaccaagaagtgttctatccaagatcacaagccaaactaatntatgcctctcttgaagatgtagagatcatgttgacacgtatgtaccatcgcttcactcgt

SEQ ID NO: 1429 - DNA, 121 bp, Artificial Sequence
  Synthesized
  misc_feature (61): n=a or g
tccatgataattccaggtcaaatgcaaggaaaaatactgaaaaaagaattcttatgccttntactaccttttaaacctgcaagtgatttgtcactcctcatccataaaaccttgccccaaa

SEQ ID NO: 1430 - DNA, 121 bp, Artificial Sequence
  Synthesized
  misc_feature (61): n=a or g
cttgtgttgtaagtaaagcatatttcagtcattcaggtctggctgacctatgaggaatgtnggattactgaagctatgagctacttctatttctcatctcccaacaaactaaataagaaga

SEQ ID NO: 1431 - DNA, 121 bp, Artificial Sequence
  Synthesized
  misc_feature (61): n=t or c
caccatagatggaaatttgaaaaagtcaattctgatcatgatttgaggtatttatacattntggagattcaaacatacatacgagtgtgtttgtatatacatataactgaattcaaatatg

SEQ ID NO: 1432 - DNA, 121 bp, Artificial Sequence
  Synthesized
  misc_feature (61): n=t or c
accacacgcaatcacttacacaagcaagatgtaaatactcccaaacttttgtcacttaccnaggtataaagagctaacacatgaagagatttaacacaaagtcatgcaatttcatccacgc

SEQ ID NO: 1433 - DNA, 121 bp, Artificial Sequence
  Synthesized
  misc_feature (61): n=a or g
gactcagagcttatcaccctgctaattttcagtgttactggcaatagtcttcaagcagcantagctgtgagtggtatggtgagagaggctgtgtgttacgtatttcatcacacacagtgct

SEQ ID NO: 1434 - DNA, 121 bp, Artificial Sequence
  Synthesized
  misc_feature (61): n=t or c
ttttatttccccactagcttttaaaatcacttttagtaaatcagacttatgaaacagatanggattgatttatgcattaacattttctggatgcttttctggacagagttggtggcatctc

SEQ ID NO: 1435 - DNA, 121 bp, Artificial Sequence
  Synthesized
  misc_feature (61): n=a or t
ttaataacaatattacaacgaaattttatgtaggtgtcttgagtctctacagtgataagtnaacaaatactattcaatgttcccaaaaggatgtaatagtaacatactattttaaattatt

SEQ ID NO: 1436 - DNA, 121 bp, Artificial Sequence
  Synthesized
  misc_feature (61): n=t or g
gtcatattcttatttggatgttgcaaacacattggggcccatttgtgcttgccactgtgtnttcacagatctaaagtattcataccctaaacgagatataattatctgtaaattaaaaaaa

SEQ ID NO: 1437 - DNA, 121 bp, Artificial Sequence
  Synthesized
  misc_feature (61): n=a or c
gaaactttttataaggttgaatggaaacagtggcagaagtgtactaaaatattccagcttnctgcatgctaattattgtcagagcccatgagaaaacgtacatatatgtacgcttatttta

SEQ ID NO: 1438 - DNA, 121 bp, Artificial Sequence
  Synthesized
  misc_feature (61): n=a or g
tggacagaacaagaggcaatggacaaaagttaaaaatcaggaaattctacctgaacatgtngaaaacactcttttactctaagtgtcaccagatttctgggtacagatgggacagctaaag

SEQ ID NO: 1439 - DNA, 121 bp, Artificial Sequence
  Synthesized
  misc_feature (61): n=t or g
gccctgggtaccgcagtgctcctgaggtatctgtcacaaatccgtcttctgccctcttctncatcgactgccaccgaactgaagggaatcaggcctcgtggccccctcgtttatggggtta

SEQ ID NO: 1440 - DNA, 121 bp, Artificial Sequence
  Synthesized
  misc_feature (61): n=a or g
ggcatgtgtttgttctatggtattagtctggtgcaacgatgatttctgtcttcatccctcncaacctatcctggagtggtggacagcaacaagagcggtaccaagtgcctctgttccactc

SEQ ID NO: 1441 - DNA, 121 bp, Artificial Sequence
  Synthesized
  misc_feature (61): n=t or g
ggctacactccttaacaaaacagtttgttttggacatttttgatgtatgtacaaaatgcanttagaggataaactaagcagaacaaagacactggaagtctaggtcataaaacaagtcttt

SEQ ID NO: 1442 - DNA, 121 bp, Artificial Sequence
  Synthesized
  misc_feature (61): n=a or t
atggtaagcagagtaattgacctaaaagcttttcccaggaaggactacactctttactggntttgttgtcacatccatctgcttatgcactatggaggcacctcaaaggtatttcataccc

SEQ ID NO: 1443 - DNA, 121 bp, Artificial Sequence
  Synthesized
  misc_feature (61): n=t or c
gtatttcctgtcttactgcatacttcccagtattttgcctcatacttcttgttacaatgtnatctctattctggttcttatctaataatctcaagatcgaaggtctttccctaggctttgc

SEQ ID NO: 1444 - DNA, 121 bp, Artificial Sequence
  Synthesized
  misc_feature (61): n=t or c
tgaatgtaggcatgctgtggttttgtgctcttccctaagcaactgctaatggccagtaccngcagcaggctttacacttgatctgattttatatgaatatctcctccatatcagtaaaagc

SEQ ID NO: 1445 - DNA, 121 bp, Artificial Sequence
  Synthesized
  misc_feature (61): n=t or g
tttagcttcagtgaaatggagcatactatgcaacattcgtggtgccttgtgaggctgaacnccaaacgaactgtagaaagcttccagggtatagctgttcccccagtgcccatttgctctg

SEQ ID NO: 1446 - DNA, 121 bp, Artificial Sequence
  Synthesized
  misc_feature (61): n=a or c
tttcttaaactttccctgaaataaaaattgaaaaagagccatttactaagccatgtctctnaatgactctgatctgtcaagtcctctacttgactactgcgctataactaaaagccaaaat

SEQ ID NO: 1447 - DNA, 121 bp, Artificial Sequence
  Synthesized
  misc_feature (61): n=c or g
caacacatactcttgtcacattactttcattgttacagtaatctaggaagcacctgacatnttctgcagttctaacagcagaattgttgaaatgcaattaagaaagcgacagtactcataa

SEQ ID NO: 1448 - DNA, 121 bp, Artificial Sequence
  Synthesized
  misc_feature (61): n=t or c
gagtttgttactgaccagtgtgaaaagcattctttcaggaagctgcaatacactgatagantgtatagggaccccttaacttacttcattacagattgacaacatcattgccagcgtattt

SEQ ID NO: 1449 - DNA, 121 bp, Artificial Sequence
  Synthesized
  misc_feature (61): n=c or g
ttgtatctaaataccaatgactttcattgtaaggaaaatgaactaaaattaggctgctacntctatgcattaggattaccttgggtgggagactaactttgttgttactgtgaaaaacgca

SEQ ID NO: 1450 - DNA, 121 bp, Artificial Sequence
  Synthesized
  misc_feature (61): n=a or g
gtaaccaattcacagctttgattctactttaacgtcagtcattcagggaaagtttgtgttntagttctagctggaaggccattggcatacttttttgggatgtctcctatgttcgctttat

SEQ ID NO: 1451 - DNA, 121 bp, Artificial Sequence
  Synthesized
  misc_feature (61): n=t or c
actggaatttatacaagtgatcctcgcttatgatcatgctgtctactctggaaggctccantgtcgcacagcagaaatggcactgacttgcaagaggcagtcagccctccacagcctttca

SEQ ID NO: 1452 - DNA, 121 bp, Artificial Sequence
  Synthesized
  misc_feature (61): n=t or c
cttgcttactccaacaaaggagatggcctctctatcttttccagtgctggaactcttgctncaaaactgtattacaagatttattttcttgctgaaaagaatgaaaaaaacaatgagggaa

SEQ ID NO: 1453 - DNA, 121 bp, Artificial Sequence
  Synthesized
  misc_feature (61): n=a or c
tgttgacaaaaaggcacaaaggagccagaagatgctgttgaaactaggtctgtacctgatngcatcaagacggataaaggagcatatgagtcataaatgcagttggatttgacaatatgtc

SEQ ID NO: 1454 - DNA, 121 bp, Artificial Sequence
  Synthesized
  misc_feature (61): n=t or c
acatgaaagtggacatgggttcatgttttcctctataaaaccacaaaatagaagtagtatngcaagcactgttccctgcctgctaacctttcattcaggagaaaatggggaaaaaaagcac

SEQ ID NO: 1455 - DNA, 121 bp, Artificial Sequence
  Synthesized
  misc_feature (61): n=a or g
cctctcatattaatcagcataacaggaaatataaacatcccctaggtgctttagtgcaggnttaattcaaatccttcaccgacaggtcgaactaacctggcagccagcatagtggtaggct

SEQ ID NO: 1456 - DNA, 121 bp, Artificial Sequence
  Synthesized
  misc_feature (61): n=a or g
tttacgtagaagttgacctgcatatatctgatagtaaaatctatgtagttgacttttttanggtacttgccttccaatcattactgagtgtagcagaaataatacatataccgtatatggt

SEQ ID NO: 1457 - DNA, 121 bp, Artificial Sequence
  Synthesized
  misc_feature (61): n=t or g
aagcctgcaacaacttcattttcttgctctttcaactccctagggtacaaagtgaacctgncagcttcccagttaacatagctgctgtggaattctctttgcaatttgcaagcaagaaaac

SEQ ID NO: 1458 - DNA, 121 bp, Artificial Sequence
  Synthesized
  misc_feature (61): n=t or c
tgttgttgttttttttcctaccactattatcaggatgctattattctcttgtctaaaatgntttgaaagagttgaaaaatatgcaagaattacaaaactaagacttcttccaaatctcttg

SEQ ID NO: 1459 - DNA, 121 bp, Artificial Sequence
  Synthesized
  misc_feature (61): n=t or c
cagctggcagcagttctgagccagatcccccaatagcaaagacacaacagacaccaagaangtcagggtcaaagcagtaacactcaaatagctccattaaaagcataaggctgtaattgaa

SEQ ID NO: 1460 - DNA, 121 bp, Artificial Sequence
  Synthesized
  misc_feature (61): n=a or t
accaatctctttccttactttttgactcagaggaaggatttgaagtgtatcaagcactccngttaacgtggctgtgatacagtaatcctttcagacaatttatccacgtttgtgtgatagg

SEQ ID NO: 1461 - DNA, 121 bp, Artificial Sequence
  Synthesized
  misc_feature (61): n=t or g
ctaccatcacttctgcctatgtacttcagagattaaaatggcacacacatgaacaatgcancaaccattgctgtgaacgtggaccagaagcatttattaccaatccagttctatagcctca

SEQ ID NO: 1462 - DNA, 121 bp, Artificial Sequence
  Synthesized
  misc_feature (61): n=a or c
gctcagtcaccctcataataaaagaaaatcaaacagacaaaactgttccttaatgtttggntggagacttctccattccagtttgtgcctattgcctcttttcctgtcacttggcaccact

SEQ ID NO: 1463 - DNA, 121 bp, Artificial Sequence
  Synthesized
  misc_feature (61): n=t or g
tggtcctattttcaaccattaactatataagttactataaacagcatacattaggttgagnttgcttgacttttatttataaagcagttgggtctatttttccctctctctctcttacata

SEQ ID NO: 1464 - DNA, 121 bp, Artificial Sequence
  Synthesized
  misc_feature (61): n=a or g
tgttcatctgttttatagagggagcatctgagacacccaaagcccataatccttgctcccntgcctttggcaagggtagggttacaatcttggtcccttgtcaactagagctaccatccct

SEQ ID NO: 1465 - DNA, 121 bp, Artificial Sequence
  Synthesized
  misc_feature (61): n=a or t
ttgaccccaagcctacagacctcttgcctacatcccatcctcactaagcccttggcacaangtccagatcagtgacagtgaagcgggtaccgttgagaccagcctccaccttatcagatca

SEQ ID NO: 1466 - DNA, 121 bp, Artificial Sequence
  Synthesized
  misc_feature (61): n=a or g
aagatgccacgtgtcttctccttttacacagtggattatagcacttgtctttacctactgnaagaaaacaatttctttattatagtgaagaccactcagctgttaatattgctttgctctt

SEQ ID NO: 1467 - DNA, 121 bp, Artificial Sequence
  Synthesized
  misc_feature (61): n=t or g
gcctgtaacatcatttaacataacatggagtggactacctaagaggtacattgccaaagcnatagtttttctgaggtaaggatggcattccgataaggtacacaaaataaacccttcccgt

SEQ ID NO: 1468 - DNA, 121 bp, Artificial Sequence
  Synthesized
  misc_feature (61): n=t or g
agttttgaatattttgtattatttacttgaaatagtatcctttcttatcacagattataantggaaagctcacatctctgcattgcctactaaaatataattatttaaggtgatgtacaag

SEQ ID NO: 1469 - DNA, 121 bp, Artificial Sequence
  Synthesized
  misc_feature (61): n=a or c
tgtaggtgacctctcttaccaaaaacgaagtactgcttaataatttgcaggtgtgactttncagacttactttgtgattctacttctctacttcccagaggaaaacactcggctctactga

SEQ ID NO: 1470 - DNA, 121 bp, Artificial Sequence
  Synthesized
  misc_feature (61): n=a or c
atgaaatattccatgatacctggagaagtaaagatggttggaattttgctatgccacaagntccatcctggggccatttaccacagaaattcctttgcttgaggatagcactttctttgaa

SEQ ID NO: 1471 - DNA, 121 bp, Artificial Sequence
  Synthesized
  misc_feature (61): n=t or c
gactggcagcaagagaaactgaatggcatcttttggaatggactactaatttgaatgactnacttgtgatctttgtgtgttcatctctacatgtgtcaggttaatttaaaaaagagaacat

SEQ ID NO: 1472 - DNA, 121 bp, Artificial Sequence
  Synthesized
  misc_feature (61): n=t or c
aaaaaaatctcttttttataaaaatatgaacatgaactgtgccatctgcgaggcctcaagnacacggtacagttgaaaaggcaggtttgattcttatctgtctcttctcaggcacttctca

SEQ ID NO: 1473 - DNA, 121 bp, Artificial Sequence
  Synthesized
  misc_feature (61): n=c or g
tacacagaactctgttctttatgctcactacagcagaggactctgccatttacacacaacntctctgtagacagggaaaattacttgattttgttttctagggctttatatgagttaacaa

SEQ ID NO: 1474 - DNA, 121 bp, Artificial Sequence
  Synthesized
  misc_feature (61): n=t or c
cccttttcccagataacttaatgcttttacattctatgtactcttaccgttactgtagttnttttcttgaagtgtagaatgaatcatgaaagaattatgagccatgtaaaatacactgata

SEQ ID NO: 1475 - DNA, 121 bp, Artificial Sequence
  Synthesized
  misc_feature (61): n=t or c
caagtgtagcttccaatatatagagcagcataatgcttagactgtttgtctatttgaaacntttagttgaaagtttatttaaaaataactgaatagggcttacaggataatgagaaaacat

SEQ ID NO: 1476 - DNA, 121 bp, Artificial Sequence
  Synthesized
  misc_feature (61): n=t or c
aggcaatggcctgaatcacaaaactctcctttcaaccaaaagcccccaaaatgaaaatggngacactcagacagccacctgaagaaacccaccaccagaaaaggggctgtgttctgtcctt

SEQ ID NO: 1477 - DNA, 121 bp, Artificial Sequence
  Synthesized
  misc_feature (61): n=a or g
ggctccagttgtccttacagacagattcttgattcctacctaaatctcagcaggagaatcnttccacatcgaatgcaagtacccttctgcctaaagatcaaggtactgatgcacagatgtt

SEQ ID NO: 1478 - DNA, 121 bp, Artificial Sequence
  Synthesized
  misc_feature (61): n=t or c
gacagctgtctgtgttgaacacatctaaagtaagatgaaaaacactccatagagatgatgngactgttcgttagaatacttaacatcctggctttcacacaaatgtgtgcctctatttctg

SEQ ID NO: 1479 - DNA, 121 bp, Artificial Sequence
  Synthesized
  misc_feature (61): n=t or g
acaataaataactgcaattaaataaataacctcttaagatcaggacttgttgcagttgtcncactgggagatgaaatgccaataaataaataaataaataaacaaagcaagcttaaaattt

SEQ ID NO: 1480 - DNA, 121 bp, Artificial Sequence
  Synthesized
  misc_feature (61): n=a or t
gagataaaatcagtatggtgtattcccaaaccagacgtattttactctgactttcacagtngggttttgcctccaggcttccaggcagctataaagcacactgttgtagcctttttcttgc

SEQ ID NO: 1481 - DNA, 121 bp, Artificial Sequence
  Synthesized
  misc_feature (61): n=a or g
caaagtcctcagtcactgtttgggacaggccctgtgctgagttggggttttataagatatnacttggagattttagtgcctgttacacacaaaatttgctgcttaacaagagctgacatta

SEQ ID NO: 1482 - DNA, 121 bp, Artificial Sequence
  Synthesized
  misc_feature (61): n=a or t
cttgctctggtagccataggctgagaacagcaataaaggagaggaggaatcataagagaanagacactgctcaaggtgacggagagaaaccgtaagggtcactcaactatacgtcgctcag

SEQ ID NO: 1483 - DNA, 121 bp, Artificial Sequence
  Synthesized
  misc_feature (61): n=a or g
atggacactgcacaggctctgcagacagcctgctccatcacccagctgagctgaccgtgtngcataaagacagaacctcctcgctttgcagactaactcagagcttgctgaaagcacagac

SEQ ID NO: 1484 - DNA, 121 bp, Artificial Sequence
  Synthesized
  misc_feature (61): n=a or c
acagtccttagtttagtgggattaatagtgataactggacctgcttgaaaagcatttgatntcttcatagctgttggctattcaatttaatctcattttcatacacttccacaaatgagag

SEQ ID NO: 1485 - DNA, 121 bp, Artificial Sequence
  Synthesized
  misc_feature (61): n=a or t
ttcatctctgtgaatgattctaacagttctggattctgacatattctggccattaggtttnggaatggattagcaagagatgactccatttcctggtagaatccatagttttcctactctc

SEQ ID NO: 1486 - DNA, 121 bp, Artificial Sequence
  Synthesized
  misc_feature (61): n=t or c
taagtcatcaaaaaaaaagtttggaagagtcttactgtactcttacgctattaaacagccntatttttctaaatcatcgtgcatgacatttttaaaatacagttgttacaacttttatttt

SEQ ID NO: 1487 - DNA, 121 bp, Artificial Sequence
  Synthesized
  misc_feature (61): n=a or g
cacatctaggaaagccatttaatcaatctctcatgttgccacacatctcctaagctcattntttgtccccttgcccacctggcaggtggcagcacacctttcctgctcacctctggcatgt

SEQ ID NO: 1488 - DNA, 121 bp, Artificial Sequence
  Synthesized
  misc_feature (61): n=a or g
ctcatctgtgaaaacatgtgcccccttctattgtaaatcaaaaacatttgtaattagaacnttttctagactggattctatctaaaaatgtatataatggtcctcataaacattactaagt

SEQ ID NO: 1489 - DNA, 121 bp, Artificial Sequence
  Synthesized
  misc_feature (61): n=a or t
atcttctggttcattaaaaccagatttctctgcttgtttacacgaggccatttttgtattntactgtcagcatcaggaatgcatatgctatgatggtgatttatggtctgatttttgggtg

SEQ ID NO: 1490 - DNA, 121 bp, Artificial Sequence
  Synthesized
  misc_feature (61): n=t or c
gtgcccaatatcccaggctgctgcagcagaaacacaagtctattgcaactgcaggacctgntttctaaagcacagcctgcctatgcctattgtgccttctgtcttctttgggtcttccatt

SEQ ID NO: 1491 - DNA, 121 bp, Artificial Sequence
  Synthesized
  misc_feature (61): n=a or g
tctttcataatttcttctatttctttcaaatgtgccagctaagaaataagcctaagcaganattttagccagagtatttggttctcaaggcattgataaataccttttattaatccttgtc

SEQ ID NO: 1492 - DNA, 121 bp, Artificial Sequence
  Synthesized
  misc_feature (61): n=a or g
tagctgcttagctttttttgtttgttcagttgatttaatggtaaaaataattaactcagancaagggctggactttataccttcttttctataatgtatatgttctaaaaatattccatat

SEQ ID NO: 1493 - DNA, 121 bp, Artificial Sequence
  Synthesized
  misc_feature (61): n=t or c
aacgtccacaggctctactgttccagacatatgttcttttgtttgattttctcccacaagnctgaaaaatattcacttctgtcttagagaatcttcttttttaattcttttttttttttcc

SEQ ID NO: 1494 - DNA, 121 bp, Artificial Sequence
  Synthesized
  misc_feature (61): n=a or g
gcacaaaacaatagaaaaatcttgagagacaatctttcaagttcaaagttctgtagcagcncatcaaagcttgcctggttcctcacccagaacagtgagaaccaagagcctctggttaaga

SEQ ID NO: 1495 - DNA, 121 bp, Artificial Sequence
  Synthesized
  misc_feature (61): n=a or g
aagcaaagacagaaatggagctttactctggttttgtaatacctgtgccttctctgtttcngaaagagagattgtagtgtttgtgtaatcattagatacattagagttcacataggaaatg

SEQ ID NO: 1496 - DNA, 121 bp, Artificial Sequence
  Synthesized
  misc_feature (61): n=t or g
tggctaacaaggatcaagtttctatgttactttaagtccaggtacagatgtgttatcaacnaacgactaaaaaaacatagaaagtgtctctttgcatatatacagtgaagatctgaggtct

SEQ ID NO: 1497 - DNA, 121 bp, Artificial Sequence
  Synthesized
  misc_feature (61): n=a or g
ggatctgaaatattcttatctctgccaccaaacctgaaggcccagcaacatctttggtggncacaaatagaggggcagaagatacgtctgtaaccttgcattagaggagaggtatctcctc

SEQ ID NO: 1498 - DNA, 121 bp, Artificial Sequence
  Synthesized
  misc_feature (61): n=a or g
agccatggaggatggcagagctatacaccacaccaccttggactcatttgccactgtggtntcccaaagtccttctttgtcatggacaagtaggtggcccagggctgtttagatacagcta

SEQ ID NO: 1499 - DNA, 121 bp, Artificial Sequence
  Synthesized
  misc_feature (61): n=a or g
aactaaaacctgtaaagatggaagccttgtcagtacagcagagtcccccttttgtaggctncagtgctagtagtgcaagcaccgcccatattccctttaaaaaggagccatccttcttggg

SEQ ID NO: 1500 - DNA, 121 bp, Artificial Sequence
  Synthesized
  misc_feature (61): n=a or g
cagtgctatcatgtaaaactcttcagttttgaaatcttctgaataacttccacagtcagtnaaacgttaagctcttcagaaaaacttggggttgtgccatctgtgttataatcatctcata

SEQ ID NO: 1501 - DNA, 121 bp, Artificial Sequence
  Synthesized
  misc_feature (61): n=a or g
gccattgagatccaaggtatatcccctatatcagtcggacaagagacatcgtaaaaaatantggtggcccatcactctccaaataatccttcatccatacctctggaactgttacgagcag

SEQ ID NO: 1502 - DNA, 121 bp, Artificial Sequence
  Synthesized
  misc_feature (61): n=t or c
gattcgtgtgcgcacgccctatacatttcaaatagacttcactataatagcactacgtttncagtagtggaagaaaacagctactgagcttttcaaccttctcttggtttcttggttttcc

SEQ ID NO: 1503 - DNA, 121 bp, Artificial Sequence
  Synthesized
  misc_feature (61): n=t or c
tgtgtcacccacaccacacagctgtcatcccatttatttatccaaggagggtgaatgtagngtacaacctcagctagataaggccgaaaagtgaaaaacagacttttgtgctagaaacttt

SEQ ID NO: 1504 - DNA, 121 bp, Artificial Sequence
  Synthesized
  misc_feature (61): n=a or g
gcaaatgtaagaatttgtgactagaactttaaaaaagtatagataagttggtttaggcctntgctaagcatagagcttttacttggaagagtgctgatctattttgttgacttagactgct

SEQ ID NO: 1505 - DNA, 121 bp, Artificial Sequence
  Synthesized
  misc_feature (61): n=t or c
aaaaaaaaagaaagaaaaaaaagggaaaatcattgtgtgactctcaagagtgcttcatttnatgttctcaagtgggtgaagagacatttgagttgtgttattattcctattgggcaagctt

SEQ ID NO: 1506 - DNA, 121 bp, Artificial Sequence
  Synthesized
  misc_feature (61): n=a or g
ccaagagcacaggggcacttccctgtctctcagtagcacagagaagtttgttatgtcaacncacttaaaaagaagttgtactgcaagcatatgaagtgctcggcatggattgatccagctg

SEQ ID NO: 1507 - DNA, 121 bp, Artificial Sequence
  Synthesized
  misc_feature (61): n=a or g
taaacatgtgattcattttcaggcagaatggaaggacagtacctataaaactgttcttgcntgtggatctctgaaatcacctttccacctaattttgtctaagccttcttccgtcatttca

SEQ ID NO: 1508 - DNA, 121 bp, Artificial Sequence
  Synthesized
  misc_feature (61): n=a or g
atttttctattttccataaaaggggctgaacactgggatgataaattttgcagctaggacngtcaaatgtaaagtcaaattattcaaggagtagcagaaggataatgccatgtaatgaagt

SEQ ID NO: 1509 - DNA, 121 bp, Artificial Sequence
  Synthesized
  misc_feature (61): n=a or g
tgaactgacaaagttataaaagtatgaaataaatatatagtcccagcctgcttcctctcanaaactggcagctagaatataaatactgagagagatgtctgagtgtttggactgaccagat

SEQ ID NO: 1510 - DNA, 121 bp, Artificial Sequence
  Synthesized
  misc_feature (61): n=a or c
ttttatgattagtgaatatacattttgcattcatatattgtaatactacttcatatgcgcntgggtggtttcaaaatattgtaggactacatttaaaccctccttgtaaaaaacatttatt

SEQ ID NO: 1511 - DNA, 121 bp, Artificial Sequence
  Synthesized
  misc_feature (61): n=t or c
tcacagtcctggcctgcccctctagcctttttttcttgtctaagattttaaagcatgttcncacatagactaaattgaacatcacttctactgttctccagagaatataaaaagaatgaag

SEQ ID NO: 1512 - DNA, 121 bp, Artificial Sequence
  Synthesized
  misc_feature (61): n=a or t
gagcattcatggtgaggtttagtgccatttatgtactgtaaattctcctctattacatggnaccgtagacattcaacttccttagattgtgctctgtctgttctcagttaggctggtctat

SEQ ID NO: 1513 - DNA, 121 bp, Artificial Sequence
  Synthesized
  misc_feature (61): n=t or g
tgatagagatttacatgcaaagattgttttaaaataatcaaattccaacaaaggaatgtantaattttcaccttgttattgccagtaagtcttattcctcttcctttctctattttatttc

SEQ ID NO: 1514 - DNA, 121 bp, Artificial Sequence
  Synthesized
  misc_feature (61): n=t or c
cttctaactttgatcagtttgttaaaatgaatttgtgtcttcaatcagatagtgatatcantatgcagataagcaatcacagataaatgacacttgcaaattgtgttgcagaaaggatggg

SEQ ID NO: 1515 - DNA, 121 bp, Artificial Sequence
  Synthesized
  misc_feature (61): n=t or c
aaaataaaacaaaaatcaaagaggacaaaaccaaaaagaaagagaatagtagtttctgcangtagagttgaaagttattcccgaaaataaagaataaattagaagatttatggattcagat

SEQ ID NO: 1516 - DNA, 121 bp, Artificial Sequence
  Synthesized
  misc_feature (61): n=a or c
ctttcataatgccttacagtcagtacacacatcacttatgtatctcagacactttactganagttttacaatttgaatattatcattgcacattgactcatctggatgttgtgagaccaca

SEQ ID NO: 1517 - DNA, 121 bp, Artificial Sequence
  Synthesized
  misc_feature (61): n=t or c
ctgcagcagcttaactgagtaatcattaaatactcacttctcaggtatgccaaggtcatanaagtagctacaacatttgtttcagaagggctgtgatttcgatacaatctcttattgcttt

SEQ ID NO: 1518 - DNA, 121 bp, Artificial Sequence
  Synthesized
  misc_feature (61): n=t or c
tctattaggatgcagctaatgccacagctccaaaaaatgaactatgaagtgcagttcttcngcagtaccatggcaagagttgttatctggactccacttcagtgtgtacttgttggagact

SEQ ID NO: 1519 - DNA, 121 bp, Artificial Sequence
  Synthesized
  misc_feature (61): n=c or g
tcttctctgatagtctttcctttattgctgcaaaaagaggacatattttacaatattacanttagcaagcactcagctcattgaaatggggatgtgcttaacccaaaagacaatttaatgt

SEQ ID NO: 1520 - DNA, 121 bp, Artificial Sequence
  Synthesized
  misc_feature (61): n=t or g
actacactatatggcttgctcatttaggaaagagagcatcatggcttccctttgcatgacntgcctattccagatcctgtgagctgcactaaagggtagaatggaagtcctgcatggtaca

SEQ ID NO: 1521 - DNA, 121 bp, Artificial Sequence
  Synthesized
  misc_feature (61): n=a or g
ctttggcagtcttgacatttcaagtggctagtcttgtaccttgtctgcagcagaattgctncctaatatactttaatattagaaacaatgctaagtacaaagcctggcagacatgagttgt

SEQ ID NO: 1522 - DNA, 121 bp, Artificial Sequence
  Synthesized
  misc_feature (61): n=a or g
tgttatagggacatatagggacatataaggtaatccaaggaacagcacctcaaaaaaactngtttattttgcatttaaaataaattctacttaaatacacaaatgagcaaatacattgcaa

SEQ ID NO: 1523 - DNA, 121 bp, Artificial Sequence
  Synthesized
  misc_feature (61): n=t or c
aaaaccaggcatctgcatcctaagggatacatttccattacctttgatactgggtaaaggntgaagctaagggtgtctggatctttaaggcaaccagaccttaactgctgtggatttcacg

SEQ ID NO: 1524 - DNA, 121 bp, Artificial Sequence
  Synthesized
  misc_feature (61): n=a or g
agaaaaagtgtgcataccgatctttccagtgtgcacatcatagttgaaggcatgcacagcntacgccaggctgtcaatgtgaaagaaggtcctgtggtccagggaccagtccagaccattg

SEQ ID NO: 1525 - DNA, 121 bp, Artificial Sequence
  Synthesized
  misc_feature (61): n=t or c
tgcaacagacttcttaacttctggcctcatttatattgtctcgcccttcctccccagttcntccaccacaaggacaggcaggactgaagctctacctctgctctctacagaccagttatac

SEQ ID NO: 1526 - DNA, 121 bp, Artificial Sequence
  Synthesized
  misc_feature (61): n=a or g
ccaaaaaggagagagcaagctctactctagcttctcagcattgacctacccactctttacngtggtttagacgggcagggcagggtagaaggaaggagagtggccaagggtctgttctcag

SEQ ID NO: 1527 - DNA, 121 bp, Artificial Sequence
  Synthesized
  misc_feature (61): n=a or g
taaaggttgaattttaagcttactaggggggaaactgaaactgttttctaaagaaaacaanttcttaaaaatgccacttctgagggcatcggtccttttagctgtcagtcacaggtgttcc

SEQ ID NO: 1528 - DNA, 121 bp, Artificial Sequence
  Synthesized
  misc_feature (61): n=a or g
aatccattttgtattttgccccatttttctttgtcagacctgctgggtcacctgaagatgntctccagctaacctaagttcactgtcaccctggaaggctagccagcttttctgttcatca

SEQ ID NO: 1529 - DNA, 121 bp, Artificial Sequence
  Synthesized
  misc_feature (61): n=a or t
cccaaagaaatcatatctactcagcatgatagggagccatttcactcgtgaagatctctgncttggcagcatgcaaaagttctaggaataattaatgtttagtcattatctaaaaagcctt

SEQ ID NO: 1530 - DNA, 121 bp, Artificial Sequence
  Synthesized
  misc_feature (61): n=t or c
atgcctccggctcacactggtggttcccatctctctgtgagcagttgctctatttctttcnactgatctcacaagtgtgcctaagccatccagacagactttcaatgccctggccttttct

SEQ ID NO: 1531 - DNA, 121 bp, Artificial Sequence
  Synthesized
  misc_feature (61): n=a or c
tcagtgaggtctcacatgaggactcaagaggctgcatcggacaagatcctggtggtcagcncttctggtagccatctacgggcagatgccaaagatggagctggagtttattgggaacata

SEQ ID NO: 1532 - DNA, 121 bp, Artificial Sequence
  Synthesized
  misc_feature (61): n=a or g
ggacaggcagagggggtcattcgctctttgcgctatcctattgctttgttagcatttagcntgcctctgaagtagggctaaatgctttattatctcccacatttcctgaggctgcatgttc

SEQ ID NO: 1533 - DNA, 121 bp, Artificial Sequence
  Synthesized
  misc_feature (61): n=a or g
gattatgcaggagtagtattttcagcatctctttacatggaaggggtggaacgtgtctggntaggaaaagctccattttctgattcacttttgtgtttactttgcattcagttatattttt

SEQ ID NO: 1534 - DNA, 121 bp, Artificial Sequence
  Synthesized
  misc_feature (61): n=t or c
ttccattacaaatactgctcccacctgcatttagtcctgtctttaccacattcaaacacanacacttttttatgaggtggactttgaactatctttccatagttattcggaaacgcacaat

SEQ ID NO: 1535 - DNA, 121 bp, Artificial Sequence
  Synthesized
  misc_feature (61): n=a or g
cacaaccaggatggaagaaagaatggccttgcaatgacttatgctatttcttgaatgttantgggtttctttgtttaatcttcatccagcaaacaaaaagtgactcagcttcaaaacgctg

SEQ ID NO: 1536 - DNA, 121 bp, Artificial Sequence
  Synthesized
  misc_feature (61): n=a or g
aaggagaattgtaggattttttcctctgaagtctttacctcataattgtacctaaggcacntaacaggacatatttttaaaggcaagaaaggcaagcacagcgcaggattactgcagaggg

SEQ ID NO: 1537 - DNA, 121 bp, Artificial Sequence
  Synthesized
  misc_feature (61): n=a or t
gttttaatatcagtgtactgatgggcagtgaggtggcttggcagggtatgtttttattgtnaatgttaggaactcggatgctaaggaataaatctcgattagagaatagcaactggttgca

SEQ ID NO: 1538 - DNA, 121 bp, Artificial Sequence
  Synthesized
  misc_feature (61): n=t or c
tctatttttgtatccaacatctatgggctgcacttcccactttttctactgagctgcacangttttctctcattgcttttctccgcatttttttctatgacaccaatatataccaataaat

SEQ ID NO: 1539 - DNA, 121 bp, Artificial Sequence
  Synthesized
  misc_feature (61): n=a or g
cgttaataatcattaatgttgtgtcaatcttcagtaacaggctactgtgttgtattctcanaaggtctgcagcagtgtgtgagaaatgggatatactaagagaaatggggtctactaacat

SEQ ID NO: 1540 - DNA, 121 bp, Artificial Sequence
  Synthesized
  misc_feature (61): n=a or g
acgattggatgttcgacttctggaggtttgttgcatcatggtgactctgacctgaaacatnagtgaataaaaatgcatatagtgtttgtgtacgcagatatctatgtgaaacaaaattttg

SEQ ID NO: 1541 - DNA, 121 bp, Artificial Sequence
  Synthesized
  misc_feature (61): n=a or g
gggaaccttttcatgataccgctcagcccaaatggatctttcctcagcttgtcaaaggctntgccgagaaacaagggtaaccgaggactgaattcaaacataaataaaaaggcaaaacaag

SEQ ID NO: 1542 - DNA, 121 bp, Artificial Sequence
  Synthesized
  misc_feature (61): n=t or g
ctgccactcaactctaaccctcagctgttgactttttttttgctacccttctcaggctgangtacattcatgaatcagcacctcagatttttgtaaatcataagtaaggaggaataccaga

SEQ ID NO: 1543 - DNA, 121 bp, Artificial Sequence
  Synthesized
  misc_feature (61): n=a or g
gtatgtaattgcagtgtgaagcaaaaatacacaaattagctcaactacccggagcagctcngccaaagcagtgtggaactgactgtgtgtctccctaggtttgagatttgtgcaccataac

SEQ ID NO: 1544 - DNA, 121 bp, Artificial Sequence
  Synthesized
  misc_feature (61): n=a or g
agcaacccttctgccctctgccccacaccagcaagtcagcatgtctgactacaagctcacntgcccaaggcacactacttcccagctgtccagccgctaacacacattccttctgacatcc

SEQ ID NO: 1545 - DNA, 121 bp, Artificial Sequence
  Synthesized
  misc_feature (61): n=a or t
gctattgccaaagcagtaactctctcctctacctgcttatggctttgttccttcatccagntggagaaagaaatccactgcctgaaagtttgttcaaagctgggtgcctggcctgaaagca

SEQ ID NO: 1546 - DNA, 121 bp, Artificial Sequence
  Synthesized
  misc_feature (61): n=a or g
tttgggattggcaaagggcagataggctaacttgaaataactcttgattcttcggtgctcngtatctaggattaccgaagttgcaacaacttcccgacctgtccttttagtacagctctgt

SEQ ID NO: 1547 - DNA, 121 bp, Artificial Sequence
  Synthesized
  misc_feature (61): n=a or g
taatgtcctcctacaatatacatattcacgtcccattggtgggttccccagacaaagttgnaaaatggttattctgaattcattcagataacatcataattttgcttattttcatgggtac

SEQ ID NO: 1548 - DNA, 121 bp, Artificial Sequence
  Synthesized
  misc_feature (61): n=t or c
ctaggcatttcatgaaagacaatgtggacagctaatctaagtcttaggaaaagcaaagtantaaatgatctttccaagtctttttatactggtaaataggttttgcacagcgcaaacttgt

SEQ ID NO: 1549 - DNA, 121 bp, Artificial Sequence
  Synthesized
  misc_feature (61): n=t or c
gaacatgcacttttcaacagcactttctgtattccaccatacagacctacagtggaagtantgtgacaagtgctgccagcaacagccacaagcaatatctgcaataccagagacattagta

SEQ ID NO: 1550 - DNA, 121 bp, Artificial Sequence
  Synthesized
  misc_feature (61): n=t or c
gataagaacttcagatatatttattttcctctgatacacatctgatgtagtctgttagtangcagactcatatttagctaatgattaatctgagtgggtgtcagtcagtcagttaagatat

SEQ ID NO: 1551 - DNA, 121 bp, Artificial Sequence
  Synthesized
  misc_feature (61): n=t or c
ctcatcttttccatccctgcagctggtctctctctcctgtcacctctttggagtctaaaancaggcatgtgtcatcaaagaaatatctcatatgcattgatttttttctgagtgcatctgc

SEQ ID NO: 1552 - DNA, 121 bp, Artificial Sequence
  Synthesized
  misc_feature (61): n=t or g
taacatcttcattgcaaactgattcaatatatctaaaaaataggaatgtttgatttcacanagaattttctcatcaaatccaaaagacgttattactggaaaactgcactcaccttgaaga

SEQ ID NO: 1553 - DNA, 121 bp, Artificial Sequence
  Synthesized
  misc_feature (61): n=a or g
gatgacattgcagggaggtcagctttccatctgcatgaggtgtgcgcaagtggactatttnctccacctggtgacagaactcaaagggaaggtggagaggttaaggagcatcaaggtgtgt

SEQ ID NO: 1554 - DNA, 121 bp, Artificial Sequence
  Synthesized
  misc_feature (61): n=a or c
catctgccctcacaagtcagaacaaggagcgagcccttcccttccgtttgattttaaaagngcagtgcctgtgctcagcactaatcccagtgccaaagctgaaggcagagcactggcagca

SEQ ID NO: 1555 - DNA, 121 bp, Artificial Sequence
  Synthesized
  misc_feature (61): n=t or g
actgagaagaagacaggtttttctaggatgggttgttaaatcagtaatctgatattctacnaataaaacagaggaattcctatacacgtgagcagtttgatgcttataagtagcctcagag

SEQ ID NO: 1556 - DNA, 121 bp, Artificial Sequence
  Synthesized
  misc_feature (61): n=a or g
ttcagactttctcctcaaaagcactatttttgggtagcatgcatttcataattctaatatngaagtcattttgatgttttttttctgaacacattcttgggagcacctacaaattaaagga

SEQ ID NO: 1557 - DNA, 121 bp, Artificial Sequence
  Synthesized
  misc_feature (61): n=a or g
caactttctcagtcaacttaaaaactgatacattagcactcctttattgcttatttcaacngaaagactctgttagaaagcttattccaaacctaagtcaaattttatgctcttttaaaag

SEQ ID NO: 1558 - DNA, 121 bp, Artificial Sequence
  Synthesized
  misc_feature (61): n=a or g
atcgctaattacataaaaaggttgctattttattttgcttgatatagctcatgcagatgtntaagtagtgttgcagaataatatgtcaataaacacaggtgaacagcctgttccttaaaat

SEQ ID NO: 1559 - DNA, 121 bp, Artificial Sequence
  Synthesized
  misc_feature (61): n=t or g
gagatgagcagggagaagggaaggtgtgtaatgaatgtgtggaaacgaccaaatccagtgnttgtttaaagtggtaaggtttaagatctatctgtctggtcttacaagtaaagccctgaag

SEQ ID NO: 1560 - DNA, 121 bp, Artificial Sequence
  Synthesized
  misc_feature (61): n=a or g
ccagttctgaggttttgaccattggattagatgctcaggacgttcttgtatgctttcagcntaaaggcaagagttgttatgctacatcactctttggcagggattaaagagaaatttcttc

SEQ ID NO: 1561 - DNA, 121 bp, Artificial Sequence
  Synthesized
  misc_feature (61): n=a or g
ggttcttgccttgagcctcaaaaggctgaacacatccggatcaccatcaaattatttccantgactattttgaaaagcatgtctgaatgtggtctctggacatctgttggaacactgtaga

SEQ ID NO: 1562 - DNA, 121 bp, Artificial Sequence
  Synthesized
  misc_feature (61): n=t or c
aggcttctgcttgatgtttagttaccataggctccctgtttattcggagtagagaagtagntgccacccaagggcaattcagttcatctggctctggaattatctcagggaatacctcact

SEQ ID NO: 1563 - DNA, 121 bp, Artificial Sequence
  Synthesized
  misc_feature (61): n=a or t
gagaagtgttttgcattgaaagtcatcatccattcacttgctaccacttggacacttgtcntccattttgctttgcagaatcccatcttctttgggttgatcaattagtagtgttcctgta

SEQ ID NO: 1564 - DNA, 121 bp, Artificial Sequence
  Synthesized
  misc_feature (61): n=a or g
gcaaagcatacaggtgctagaagaaccacaaaatcctgccctgatataaaccagtgaattnttcagctggaaaacaggagctttttattttcacttcctagaaacaaaaaaatatgctagt

SEQ ID NO: 1565 - DNA, 121 bp, Artificial Sequence
  Synthesized
  misc_feature (61): n=t or c
ctgagtgctgcaatggagcacagagacagtgagatgatttctaacacgagagagaaaatanattcctgctttgagtcagggctgtactccgggacccagagggagaaggggcaaagtcagt

SEQ ID NO: 1566 - DNA, 121 bp, Artificial Sequence
  Synthesized
  misc_feature (61): n=t or c
tgtctggaactagttttgattaaaagtgattaggattatgaggaagtaacacatcaggaanggcagtcattttttagtaaagccactgataaacactgaccttctgcaaagcaaaagtatg

SEQ ID NO: 1567 - DNA, 121 bp, Artificial Sequence
  Synthesized
  misc_feature (61): n=a or g
gtgtatttttctcaaaacccagttagattttgtgaatgctgctttgcactatttcccaaancagcaactctcactctgtctatagcttccctcctttgggtttaagtgcgccggaatatag

SEQ ID NO: 1568 - DNA, 121 bp, Artificial Sequence
  Synthesized
  misc_feature (61): n=a or g
aaagatgcttaagcactccgatctctgaagtggtctcttgccacaaatgggaattattctnaattctaaagtctctcagaaataaacaatcaaaacaagtatatgctaaagcattttcctt

SEQ ID NO: 1569 - DNA, 121 bp, Artificial Sequence
  Synthesized
  misc_feature (61): n=a or g
ctggacacaggtacagactggcagacaaatcactgagagacttctgatcatcgctcccagntctctttctgtggggttgtataaagggatctgtgagagatgtttaacagcaggcttaata

SEQ ID NO: 1570 - DNA, 121 bp, Artificial Sequence
  Synthesized
  misc_feature (61): n=t or c
cttcatattgatgttacaaagaggagtcttaggacttgtcaatgctcattttggctgtganaaagatttcttcactctaaatatcaagcactgaagtgtatgtttcttgctctgctacagc

SEQ ID NO: 1571 - DNA, 121 bp, Artificial Sequence
  Synthesized
  misc_feature (61): n=t or g
catctatttgttcttcccctgaaggagacacctaccaaaagtacacggtagtagcctactnttatcagtgttcattatctgcttatctggataactgtgtatactgaaagatactttagtt

SEQ ID NO: 1572 - DNA, 121 bp, Artificial Sequence
  Synthesized
  misc_feature (61): n=t or c
ccctccccttggcccttactcatagtcactcaacattataattcccaataatgagcttaangctttgaaacactctctaacatagacagccatacaagcacacctccttccttttctatcc

SEQ ID NO: 1573 - DNA, 121 bp, Artificial Sequence
  Synthesized
  misc_feature (61): n=t or g
aaactgaatgtcttcatttttgttccctgtattctgggaaatctaccattcacaacacctncatgaaatacaggcttcagttatcaccccactgcagaaagaattttctatatataatagt

SEQ ID NO: 1574 - DNA, 121 bp, Artificial Sequence
  Synthesized
  misc_feature (61): n=t or c
tgagatgaatgagttcacactatcctgagtgaagaacagactcaattatagagctcaaaanactgtagtgaatctggctggtggccactcacttaagtggtgttcagtggtgtttgtctct

SEQ ID NO: 1575 - DNA, 121 bp, Artificial Sequence
  Synthesized
  misc_feature (61): n=t or c
ttatttgaatggtgtatctctttcctttccgattttaaatcaggatgtaaagcatgactgnggtatttttaactttctgggcttgtacatgatgacacttgtggaatctgtcgttcctgag

SEQ ID NO: 1576 - DNA, 121 bp, Artificial Sequence
  Synthesized
  misc_feature (61): n=a or g
tgtttatggactgaggcaaattaagtctacgttcactaacactaccttgtttgccttaggnactcttgattgatgagcactgcagatatctttttacaataaagtttgtcactaagctgac

SEQ ID NO: 1577 - DNA, 121 bp, Artificial Sequence
  Synthesized
  misc_feature (61): n=t or c
gatttgaattcagcagatgcagcagtgaaattatccactttcctcaattttgatgctcttnccttttaatcctagactgatgtcttgtcattccttattttcattaagtccattcataata

SEQ ID NO: 1578 - DNA, 121 bp, Artificial Sequence
  Synthesized
  misc_feature (61): n=t or c
tagaatttccattttgttcactctagttgtgagtgtctttttcagtcttaaggcaatgtanctagcctaagacatccctagaggaatagaacagtgactttttttctctattgtttctctt

SEQ ID NO: 1579 - DNA, 121 bp, Artificial Sequence
  Synthesized
  misc_feature (61): n=a or c
gtattcagtgatgcacattttcatcatatcaaatgtaaccaaagcaaatgtctgttacacnaactaccacaagtatcagtgataactacatggtattgattctgtgttgctgtgtatttac

SEQ ID NO: 1580 - DNA, 121 bp, Artificial Sequence
  Synthesized
  misc_feature (61): n=a or g
cacaaagttccaacaaacattttttttcctgtggaagccacatggaagctgtcatgcaatntccctcatccatattattcctctggtggtgttccgtcactagaaactatatgtcagatga

SEQ ID NO: 1581 - DNA, 121 bp, Artificial Sequence
  Synthesized
  misc_feature (61): n=t or c
atgaactgcccagaaggtgagagctgaattgcaggcctatagccatgactgttttccacangcagcaaaattcaccatcttgcagcagatggaagatgaaataacaacaaggtctctcctt

SEQ ID NO: 1582 - DNA, 121 bp, Artificial Sequence
  Synthesized
  misc_feature (61): n=t or c
ttttgaattgtttgttcaggaggaaaaaaagccagcaggaactgttaaactcagctgtcantgagttttgcgctgtgctctgtacagctacatcgtctgattatacattggattttgtgta

SEQ ID NO: 1583 - DNA, 121 bp, Artificial Sequence
  Synthesized
  misc_feature (61): n=a or c
atcaacaataatttcagtgtcatacgagcagatgactgagtgttccctttttgcattcaanttcataagaaaacatgagtaatgttaatgtctttgtgactgtatatacttagtccttgtg

SEQ ID NO: 1584 - DNA, 121 bp, Artificial Sequence
  Synthesized
  misc_feature (61): n=a or t
tcagtttttcacagtatatacatcatcataatgctgaaccataaattggttgtcagccaantcgttgaagtcataaagccatgaaagcttcatcatgcatgcaaggtcctactgaattttg

SEQ ID NO: 1585 - DNA, 121 bp, Artificial Sequence
  Synthesized
  misc_feature (61): n=a or g
atgtagaagtcttcccaggatgtcccttttggtgtgaaatgcaatggattcattttgaacntgaatctcagtctagtacctgagctaggaatgggtgagcagttttcccgcttcatgtggc

SEQ ID NO: 1586 - DNA, 121 bp, Artificial Sequence
  Synthesized
  misc_feature (61): n=t or c
atgaaactcccgcggtgactccttagtagctcagtacattctgtacacagggaattctagngtggacagtttgtgtgcatggctcttcagcaatagaaatgagttttattctcttaagatc

SEQ ID NO: 1587 - DNA, 121 bp, Artificial Sequence
  Synthesized
  misc_feature (61): n=a or c
agacatagctggtgtaggtaggaaatcatttccatcgttttacgcagtgtaacggagccangtgttgggaataaatatgtgatttatacaggcacaatttcctattatgttctaatgagaa

SEQ ID NO: 1588 - DNA, 121 bp, Artificial Sequence
  Synthesized
  misc_feature (61): n=a or g
tgaaaaacaggcttctcagatagccctcttagttctttgcatgattcatgaaatgaggaangtgcatgggaaagcctcaagagagagaaaccaactatttaagaagaggcaacgcagctgt

SEQ ID NO: 1589 - DNA, 121 bp, Artificial Sequence
  Synthesized
  misc_feature (61): n=c or g
agtaataagactctttctttctataccgtgcaagtcctgggaccactgatatatggaggantttagtcaaaaactcaaatgagtaacaaagaagaggtttgtaactttaacattgtgtgtg

SEQ ID NO: 1590 - DNA, 121 bp, Artificial Sequence
  Synthesized
  misc_feature (61): n=a or g
gctacagatctttttctatatgttatgagtctatcttctctctcagtgctgaatactggtnaattgaactagaatatttggcttgcaacctccttttaagcactagcaagtagttacttca

SEQ ID NO: 1591 - DNA, 121 bp, Artificial Sequence
  Synthesized
  misc_feature (61): n=t or c
ggcagctaaatgtccctcagccatttgctcactccctccaggcagaataaaatagagaatnagaatcaaaataaaatttgtaggtggaaacaaaagctatttactaagacagaaaagaaaa

SEQ ID NO: 1592 - DNA, 121 bp, Artificial Sequence
  Synthesized
  misc_feature (61): n=a or g
ttcataacagaaactgaggactacaacttttctgaacagtttagcttagtgctcttttcanatgggcagatcctctgcgccagactgtcagagcaaagtgccatcagtcaaaccatttttt

SEQ ID NO: 1593 - DNA, 121 bp, Artificial Sequence
  Synthesized
  misc_feature (61): n=t or c
ttgaggcaaattgtcatagcactattaactttattgcttgtgcagtgtgacttaaattttnagccgtttttgctgtttttatgtcagaatgagttctttcactcagcttgcttttctttct

SEQ ID NO: 1594 - DNA, 121 bp, Artificial Sequence
  Synthesized
  misc_feature (61): n=a or g
atccagagagctacaactgtgtctaaaaactgtggaaagaagggagtttaaaaatatatcntaggagtacaatgttatcaaagagctacagggagagcaaatagtgtctcttcctcctatt

SEQ ID NO: 1595 - DNA, 121 bp, Artificial Sequence
  Synthesized
  misc_feature (61): n=t or g
aagggaagcacagctaggctttaagtcatgcatttctccaacaatgtaaatattaactgangggccttaggcgaatgaatagcaatcttcatcaaccgctcccaatgaaccgtggcattat

SEQ ID NO: 1596 - DNA, 121 bp, Artificial Sequence
  Synthesized
  misc_feature (61): n=a or g
tctcaacgctggtcagtaaattacctctctgtctgctccattaaagctccatacttggtgntgtcaagtcttctggctctgcatgtgttgctttctgtagacttcccttgggaaactcaag

SEQ ID NO: 1597 - DNA, 121 bp, Artificial Sequence
  Synthesized
  misc_feature (61): n=a or c
ttgcctatcagtagtgactctagtacaatgatgcatgacaacatatagagaaaggaaaagntgtgtaaagctctaaattaaccaaagttagattctacttcattatatagccaaatttgcc

SEQ ID NO: 1598 - DNA, 121 bp, Artificial Sequence
  Synthesized
  misc_feature (61): n=a or g
tcatagattcataaacacatgagtaagctttagaaatacattggtcggttttaaaaacacngaaatgatatttagaaacagctgtgttctgcagttcattcaactgcaggcagtctgcctt

SEQ ID NO: 1599 - DNA, 121 bp, Artificial Sequence
  Synthesized
  misc_feature (61): n=t or c
ttccacaactctactagcatgttatcaactgttaaatctgcagatattagtgctgagatanacatttcttgttaacagcacagaagatgtcttctactacaggaaaatttaaaaataaatt

SEQ ID NO: 1600 - DNA, 121 bp, Artificial Sequence
  Synthesized
  misc_feature (61): n=t or c
tagatgcaagacagatccttaagagtactgtgatgttacaagggtgctttgagggcaccantgtccaataaaatagaaattatactcttgtttgtacacaaagtatatggttttcagctca

SEQ ID NO: 1601 - DNA, 121 bp, Artificial Sequence
  Synthesized
  misc_feature (61): n=t or c
ctttgtttagataaacttaagccatatctccaaaagaaaatcctcaaagttacaggggaangcaaagttattctttcactagttataattgttctactttaagcagagtaattgaagagag

SEQ ID NO: 1602 - DNA, 121 bp, Artificial Sequence
  Synthesized
  misc_feature (61): n=c or g
gcaccttgtaaaattacttaatcaactcttctctaaagttaagggttgtgtcatcttcaanctagactattcttttttgaatattcttagtattaccattagtacattaaaaatatgcaat

SEQ ID NO: 1603 - DNA, 121 bp, Artificial Sequence
  Synthesized
  misc_feature (61): n=a or g
ttattgtggtgttagcaacaacagcaccacagaatcgcagagttatttaggttggaaggancctctttgatctattttggtctaattctcctgctcaagcagggacatgtagagtaagttg

SEQ ID NO: 1604 - DNA, 121 bp, Artificial Sequence
  Synthesized
  misc_feature (61): n=a or c
aagcaattgggccctttctggcacagatagcaccacgggtcagcatattgccctaaggcantacctaggggcctgaactagcctgtgcttcctattctgaaagttctaccatcacctctat

SEQ ID NO: 1605 - DNA, 121 bp, Artificial Sequence
  Synthesized
  misc_feature (61): n=t or c
aatctgaactgcagcagataagctgtctacaggaaaatctggaagtcccagtgtagaggantcttgagaacagagagttgtagcaaaagacaggatctgagaaattctgcataggaaaaaa

SEQ ID NO: 1606 - DNA, 121 bp, Artificial Sequence
  Synthesized
  misc_feature (61): n=t or c
gcatctttgaggcagaaccgcatcgttcttcttcgtatagatcatatcgaccactttcttnggtgtgagctttgtcttgaaatggggacaaagggagatttaggtgaggaactgcatgggg

SEQ ID NO: 1607 - DNA, 121 bp, Artificial Sequence
  Synthesized
  misc_feature (61): n=t or c
ctgccacgccatgaaagagacttgtagcaatgtatttcactgccgtggggagagcatgcanatgaggtggactgagaactgcagggcctgaagcactgtggccagcgtcaaaaagttcagc

SEQ ID NO: 1608 - DNA, 121 bp, Artificial Sequence
  Synthesized
  misc_feature (61): n=a or g
gactcaggatgcttctgttgtcttgaaaacttaataactggtcacaatcttaatgggaaangtcctctcactgcagaaaacactttcaaaaatacaacctttctggtataatcagtagaga

SEQ ID NO: 1609 - DNA, 121 bp, Artificial Sequence
  Synthesized
  misc_feature (61): n=a or g
gtacaatctggaagtgggtacaacttgtccccttttggaatctaataaccatgagtgatcnaggaggacatgtgtcacttcagggcattcatgaacaaggccaaattaacctctgcagtga

SEQ ID NO: 1610 - DNA, 121 bp, Artificial Sequence
  Synthesized
  misc_feature (61): n=a or g
aggtcctttttaatctgaacagctctcatctcctgaaaagcatgcaagcaagaatgcaacnttatgtacaaaaaagccatttcacccttccttttggaaagaaaagctcctgccttcacta

SEQ ID NO: 1611 - DNA, 121 bp, Artificial Sequence
  Synthesized
  misc_feature (61): n=t or c
tggagaatgccatctggaggtctctcactctctacagtcattgtagagagcataagccacngtgttcttaaaaatgcatgccaaatttaggcaacttctctgagtgtcagaggtaaggtgg

SEQ ID NO: 1612 - DNA, 121 bp, Artificial Sequence
  Synthesized
  misc_feature (61): n=t or c
caaaacaattcattccagcagtattacaacacaacaagctgagaagtctacactttctttnggtctcaagtgaaattttggtcaaacggagcctgtttcactgagaggcttcagttttgac

SEQ ID NO: 1613 - DNA, 121 bp, Artificial Sequence
  Synthesized
  misc_feature (61): n=t or c
tcatttcatcagtcatcttacaaaaaaaagaactaatgcaacacgagcaagtatcccatanacttagggcaacatccttttgttctgcatgcagcttctcctttcacataaaatcacaagg

SEQ ID NO: 1614 - DNA, 121 bp, Artificial Sequence
  Synthesized
  misc_feature (61): n=c or g
gcatggcttttctaattactcagtcgtatttctttctgtgcagttgagctattcttttagntgatagttctgccattgtataaatatattctataaatatttcaatgagttttttacttgg

SEQ ID NO: 1615 - DNA, 121 bp, Artificial Sequence
  Synthesized
  misc_feature (61): n=t or c
ggatattctacaattctgtggttctatgaatctatgaacaacctgggataatctgctccanacctctgatggaggagtccaaacagcctgctcaaccttagacggggcagagggaggacac

SEQ ID NO: 1616 - DNA, 121 bp, Artificial Sequence
  Synthesized
  misc_feature (61): n=a or g
ccactgctctgatcacaatggcaaaaacagcttgataatgtggcaggaagggactcaaganactgtttagttcatcccccttctgagcagacacgtctctgtttcacttcatttatcagtc

SEQ ID NO: 1617 - DNA, 121 bp, Artificial Sequence
  Synthesized
  misc_feature (61): n=t or c
agctcgcaaagggttatgaaaccaaaggggttgcaccgatggggagctccttctggtcagncctcggtgtttgtcccgctgcttagcattgtaaaacttcaacaaaccaagcctcagatcc

SEQ ID NO: 1618 - DNA, 121 bp, Artificial Sequence
  Synthesized
  misc_feature (61): n=t or c
aagaccatcaatttcaacccatcgccaccacgtgcacttagatcagtaagttcagaaatantggctaagtttatcatgtgaggctctcatccatcggagagcatcctgaattccttggtgc

SEQ ID NO: 1619 - DNA, 121 bp, Artificial Sequence
  Synthesized
  misc_feature (61): n=t or c
gagaaaaaaaacacctatgggtatctcccagtaagctaaaggatatcctccagtgccttcnagttgtctgagctatctgaccgtaaacattcccagtgctggactgcctcttgattaaata

SEQ ID NO: 1620 - DNA, 121 bp, Artificial Sequence
  Synthesized
  misc_feature (61): n=t or c
actgtttatacacagagctgcatcataaacttattggaagtatttgcatatatttgccttngtaagtttgcattgtttttcacaagaagtgcagtgtgccacattgttcacacaaataatt

SEQ ID NO: 1621 - DNA, 121 bp, Artificial Sequence
  Synthesized
  misc_feature (61): n=t or c
agcacagctcaaaaaatgcgtgttgacattaagcctgtgagggtggatagatggaggcatncctaattggtgtatcactgctcaaaaggtaatccagcttttagacattcatcactgagaa

SEQ ID NO: 1622 - DNA, 121 bp, Artificial Sequence
  Synthesized
  misc_feature (61): n=c or g
tttatttcttaaaaattcaatttgtcttcttcatcaggaactgctgacccatctcaccgcnaaaggattatgtaagcagtgcttttctcaccacttactcattacccttgttttgaggcag

SEQ ID NO: 1623 - DNA, 121 bp, Artificial Sequence
  Synthesized
  misc_feature (61): n=t or c
agctgtgtgagacagcgtgccagcatgcttgtgaaaaatcccttctggatgcttgtcactnctctgcttagcatttacctttggcacgtccttgaccttgcatttacccccatggcactta

SEQ ID NO: 1624 - DNA, 121 bp, Artificial Sequence
  Synthesized
  misc_feature (61): n=a or t
tttcttttatttaggcacaaaattacaaacaataggtaagtggagccaggtgaactcctcnggatggtgttttgtgttgtgaaaagcgttttgtgaatcacatatgaaacctaggaaacag

SEQ ID NO: 1625 - DNA, 121 bp, Artificial Sequence
  Synthesized
  misc_feature (61): n=t or c
aagtaatatgattgtgtgaagtcattagaatatgaacttctgcacttaaactgaacagaangtagtgtgtttttttcccactcttgaaagagaggatactgtacaaatgagatttaagtgc

SEQ ID NO: 1626 - DNA, 121 bp, Artificial Sequence
  Synthesized
  misc_feature (61): n=a or c
tggcgaaggcatcttgatcgattgacttgtttttcaattgcaagcttggatagcgtgttcntgagacaaggataaaagaggggcagtgcaccctcctgcatcagcttaaggttacagcagg

SEQ ID NO: 1627 - DNA, 121 bp, Artificial Sequence
  Synthesized
  misc_feature (61): n=a or c
agtaaaaaaactgagtttgtctcccaaaatttacatctggatatttttctacactaacttnactctgtttaaccttttgttttctggagaggtatcattttgttgtattacttttttgctt

SEQ ID NO: 1628 - DNA, 121 bp, Artificial Sequence
  Synthesized
  misc_feature (61): n=a or g
tggccaaaggccagaaatgagtaatgcttctcaaaagatatttgctttttcctctgttccntcacacttccaccttaatttcttctttaaactatttttttttttcagtctttctccaaac

SEQ ID NO: 1629 - DNA, 121 bp, Artificial Sequence
  Synthesized
  misc_feature (61): n=t or g
ctgagcagtgtaggagcacgcagagcatttcaggctggatgtgatgttttccactcaattnctgaacctgtggagtttcttttagggctaaggaagaggtgacagctgctattgcttcaac

SEQ ID NO: 1630 - DNA, 121 bp, Artificial Sequence
  Synthesized
  misc_feature (61): n=a or g
acaactttgtctgaattttcagcagcctcaacaaacctgaataaaatcacacctttaaccntcacctttcaactctttcttctcccagttctaaccgtaaacagaaagtctgctataccgg

SEQ ID NO: 1631 - DNA, 121 bp, Artificial Sequence
  Synthesized
  misc_feature (61): n=a or g
ttattgttacacacaaggagaatatttggcaggatttcataacagtagggaaaaacagtcngaaaacaagagcttactacttaaatggaaggatgctaaatatggaatgaaaagtatatag

SEQ ID NO: 1632 - DNA, 121 bp, Artificial Sequence
  Synthesized
  misc_feature (61): n=a or t
ataggttagccagctttctttcctcacaagttgcagaaagcaagattctagaggagaaaanggtagcttccagtttcacacttataaaacttcagaggttttttaaaattattattttgtt

SEQ ID NO: 1633 - DNA, 121 bp, Artificial Sequence
  Synthesized
  misc_feature (61): n=a or g
aaactagtttatgtgggagtgcagtggtaaaactgaaagaaaatagctccatatatcacangttctgtcaaacacataaatctgatgagctgaagcatacaatgtatagggctgtctttgc

SEQ ID NO: 1634 - DNA, 121 bp, Artificial Sequence
  Synthesized
  misc_feature (61): n=c or g
tatttgttgtattacaaagacagcagaatatgatcctggagtaagatagccactcatgagnataccatgaagacacccatgaagataccatgaagacacctacaaccaattagaaacttta

SEQ ID NO: 1635 - DNA, 121 bp, Artificial Sequence
  Synthesized
  misc_feature (61): n=a or t
aacttagttttgttaccaagtgtcatggaatcttcttgctaaccactgtccaccccaactntctgtacaatgtatgcttacaactaatatcacctcatgcagacagtgtctaaaaacccac

SEQ ID NO: 1636 - DNA, 121 bp, Artificial Sequence
  Synthesized
  misc_feature (61): n=t or g
gtctagaaagcagaaactgtattgccccagctccactctgtcattaggcaatacttctgtnttgcctctgcagtatgatacaacaatactttacctgctatcttcagcaatcataaaatca

SEQ ID NO: 1637 - DNA, 121 bp, Artificial Sequence
  Synthesized
  misc_feature (61): n=a or g
ggtttccatgtaaccccctgccctgctatgccatttgtgagggttcaaaagctcctccacnaagagctgaaccacccctactgaaaggcatggtggggacaccatggaggcccagcctgac

SEQ ID NO: 1638 - DNA, 121 bp, Artificial Sequence
  Synthesized
  misc_feature (61): n=t or c
ggcaggactaccatgcaataacgttaaataataatgcattttccaacgttagcataaaagntgctgtaacatgcaaagggacctctattttgagcccagtacttgaagtcttccaagcacg

SEQ ID NO: 1639 - DNA, 121 bp, Artificial Sequence
  Synthesized
  misc_feature (61): n=c or g
aaaatctcactaaaagggcaaagaagaagaagatgattaacttagcacatgtcctaactantatcatccttcccagtcagcctgagacactacgctcacctttgcagaaagctgcagttga

SEQ ID NO: 1640 - DNA, 121 bp, Artificial Sequence
  Synthesized
  misc_feature (61): n=a or g
aaaacaaaatggactcaactaataaatggctggtttagaatttcctttcgaacgtatccanaagttatcaaatcagtatcctaacattaacgcttctttgttttaagggcactgccttgac

SEQ ID NO: 1641 - DNA, 121 bp, Artificial Sequence
  Synthesized
  misc_feature (61): n=a or g
caagagaatggttttcctagaaggctgaatattgtgtgccaacctcttggttatactgggnttcagattgttgctgaaatgttcttgtccacagtgtttgtagactgtaaagtactgatat

SEQ ID NO: 1642 - DNA, 121 bp, Artificial Sequence
  Synthesized
  misc_feature (61): n=t or c
gcaactcccagtcctaacaggctgtgtggtttctgtctctttcacaggaattgggttatgntatcaaggtatctgattatgtggtatctgtatcactgccttgttagtgctagttactgcc

SEQ ID NO: 1643 - DNA, 121 bp, Artificial Sequence
  Synthesized
  misc_feature (61): n=t or c
ctacagtgaattcatggaagagctttcaaaagctgagcctgctattgtcagcttggagtanggagtggccaggatgacctgttgaaatctggcacagtgctcctctgtcttagactggctg

SEQ ID NO: 1644 - DNA, 121 bp, Artificial Sequence
  Synthesized
  misc_feature (61): n=a or g
ggtcctgcatggctttgacctgcctattgctgcaggctctctactttcatgaaaccagttnaagaaacaccaggctaggaagtaatgtcagtcacagaaggatattttatttcctccctca

SEQ ID NO: 1645 - DNA, 121 bp, Artificial Sequence
  Synthesized
  misc_feature (61): n=t or c
cctgcctccttagaaaatcttcttagttcagtgctgtgtgatactgtctctagttgtgtangtgaagaactgtagtcactggacagtggaaagtacataggaagggatgacttttttcttg

SEQ ID NO: 1646 - DNA, 121 bp, Artificial Sequence
  Synthesized
  misc_feature (61): n=t or c
agaccagaggcatccctgaactcaatcatacatgaagctcagaacccatacggctccatcngtacttcataaacaacagcatgggacagccggtgtactcccagctcctgcagcttctgtc

SEQ ID NO: 1647 - DNA, 121 bp, Artificial Sequence
  Synthesized
  misc_feature (61): n=t or c
cttgccttcctctcacagcaggggaaaaaaacccaaaacttcaggagccatttgcaaatgntagaatctgtgggacatcttgaagtactgtgatcctccatggctgtctcaggatatgaaa

SEQ ID NO: 1648 - DNA, 121 bp, Artificial Sequence
  Synthesized
  misc_feature (61): n=t or c
ttcagagtgcagtgtgtgtttgtggcgaactgttatgacttgcttatttctgggtataatntgtctttactgttggattcctgcaattataaaactgcatcttaaagtaggtgcttcttat

SEQ ID NO: 1649 - DNA, 121 bp, Artificial Sequence
  Synthesized
  misc_feature (61): n=a or g
tttttcccagattatggggctttggttttcccaaggatatgccaatgttatatgtacttgntgtcaatggttttgagttgagtcattactgaatccaagagctggttcatctgcatgctgc

SEQ ID NO: 1650 - DNA, 121 bp, Artificial Sequence
  Synthesized
  misc_feature (61): n=t or c
tctggctgaatgaaaacagaacaaaactgttttttaccatctggctggccaacattgcaangcacaaacaacccaggaagtttctagagtacactgatgacagtttcttgatactggtgac

SEQ ID NO: 1651 - DNA, 121 bp, Artificial Sequence
  Synthesized
  misc_feature (61): n=t or c
attttgcaatacatcctaatgcggaattacctttgcttcctgctgcagatcccaagaagtnatttgcactaaatacgagacaaattagtctcactgaatattccatggagagagagagaaa

SEQ ID NO: 1652 - DNA, 121 bp, Artificial Sequence
  Synthesized
  misc_feature (61): n=a or g
taaagattagggaaatgttctcattatctgacaaaccataatatatggcaacaagatacantggaatctgctaaatgggtcattttaaagaaaagtggaggagaaaatatttcgagatggc

SEQ ID NO: 1653 - DNA, 121 bp, Artificial Sequence
  Synthesized
  misc_feature (61): n=a or g
taaaaaaaaatgcataaataaatgaacaaatatgctatagctcatggtaattcccctttgnagatggcctgaaaaagcacataaacatagaaatgggagggaaaaattgtgaaaaaaaaaa

SEQ ID NO: 1654 - DNA, 121 bp, Artificial Sequence
  Synthesized
  misc_feature (61): n=t or c
acattgtggccccaaagaagaaaacttgcaagtaatcaaaacaatcagatctagtctaaanatgaaacgttggcagtaagttttaaattgagctgcttgctctggctgtttctactgtgac

SEQ ID NO: 1655 - DNA, 121 bp, Artificial Sequence
  Synthesized
  misc_feature (61): n=a or g
tcataagaagctcaagattctcccttgcttaatgtgagtttccactgtgatacagccaggntgagcccacagcagaacctctgatgtccaattctgccatgcagggcagcgtggaggactg

SEQ ID NO: 1656 - DNA, 121 bp, Artificial Sequence
  Synthesized
  misc_feature (61): n=a or g
acctgaacacactgaaaatgaaattgggaaacagtagtgtcgagactcagtgcaaaacacngacgtcaagattaggtatgtgtatgggatacggctccaagtcttcccactgcatagagct

SEQ ID NO: 1657 - DNA, 121 bp, Artificial Sequence
  Synthesized
  misc_feature (61): n=c or g
aatctgacctatttctctccactgactgtaacggaaaccctgaacgtaattgtgtatttanaggactgttctttagacacccaagggcaaacccagtcatggtgaccctatggcagcagag

SEQ ID NO: 1658 - DNA, 121 bp, Artificial Sequence
  Synthesized
  misc_feature (61): n=t or c
ttttaaacagacatgaaataaaagaatttggttcaggaactctcatcagcaacttgtgtgntaacatttacctgtaaaattcttcaaaataccaaaatgctcataaacatttaacatctta

SEQ ID NO: 1659 - DNA, 121 bp, Artificial Sequence
  Synthesized
  misc_feature (61): n=t or c
gaccacaagtagatgtacgtgatgatcagaatgaaaagcaaagtcttctggtgtgtagtgnggaaacagaaaaaaagaaagtaggaggaagaactcatcttcagtgcttgagaatgactaa

SEQ ID NO: 1660 - DNA, 121 bp, Artificial Sequence
  Synthesized
  misc_feature (61): n=t or g
atcatgtaaatgctcaattctgtaacctcagcttcatatgggaactctcttcagtggctgnctggtgtagagctggttagtttttctacttaagtgaaagtgtacgaatgaagctcacagc

SEQ ID NO: 1661 - DNA, 121 bp, Artificial Sequence
  Synthesized
  misc_feature (61): n=t or c
ctatataacaagtaagttgaagtaacttcacaagcaatgtacatataaatatattttctantcagaatccaacttaaaatttaaaggtgctttttgcacactgaggcgtacccatcttaat

SEQ ID NO: 1662 - DNA, 121 bp, Artificial Sequence
  Synthesized
  misc_feature (61): n=a or g
gtatgagatccaaccagatgactgagataactaaaaaagctctaacaggtgaaactgtacnaaatactaaatgaacattatttgtattccaaatcagaatcagtggaatgcacacaaagat

SEQ ID NO: 1663 - DNA, 121 bp, Artificial Sequence
  Synthesized
  misc_feature (61): n=a or g
ttctcatactgatgccctggcagatacacccatattagctttctgagttcatttatccagnagtacttcaaatgatctcaaacactgatgagaaaaacaatatatttgttttaccttaacc

SEQ ID NO: 1664 - DNA, 121 bp, Artificial Sequence
  Synthesized
  misc_feature (61): n=t or c
ccatgtttacgctttatttaaagtttacaatcaacctcatttgtagaagtgtgactaatcngttacattaaagaatgggtgaagttggaaggcacctctgggtccatgtggctcaactgct

SEQ ID NO: 1665 - DNA, 121 bp, Artificial Sequence
  Synthesized
  misc_feature (61): n=a or c
cactttgcaggaatcttgtacttctcagacaaaataaggagctttaattatcttttctgcncaggtctgtccaatcaaatcacttctaagaagcaccaactaggcatttacatatctcatc

SEQ ID NO: 1666 - DNA, 121 bp, Artificial Sequence
  Synthesized
  misc_feature (61): n=t or c
catcctattaaatgctgttagcttataaaacatagcagcagaacatggacaaaacatgganagtctagcaagaatatcttttggtctgcacaaactcctaaaatgcaaggactgcttaggg

SEQ ID NO: 1667 - DNA, 121 bp, Artificial Sequence
  Synthesized
  misc_feature (61): n=a or g
atgctgtgatataaagatttaacttatggagttaccgcttatactgtacatgccttacaanagatttatccatatctttaagtgtttatacaattaagtattcctttaaagagctatttaa

SEQ ID NO: 1668 - DNA, 121 bp, Artificial Sequence
  Synthesized
  misc_feature (61): n=a or g
acctggaccatcattgtccaattagtcattttagaactgtggtactgcgaagacctccccntacttccttgattccataaatatctgttcctcaaaatcccttagctttagccttggtact

SEQ ID NO: 1669 - DNA, 121 bp, Artificial Sequence
  Synthesized
  misc_feature (61): n=c or g
acagagactgaggttgatgttttcaaatgtttctagaagagcagaatcttccatttgttgnttttaccaaatccttagattaaaaaaataataataattactactgacatttttatgtgtc

SEQ ID NO: 1670 - DNA, 121 bp, Artificial Sequence
  Synthesized
  misc_feature (61): n=a or g
ttagtggggggagttagagagaaatctttgatattacatgaacactgttcagcaacagcanaaacagcaatatgttgtgatcactgtttagccacagatgtgaagtaaggcattatgtgga

SEQ ID NO: 1671 - DNA, 121 bp, Artificial Sequence
  Synthesized
  misc_feature (61): n=t or c
agtttttaacaatcagaactgcatttggaaagtaatgaaatgtattagttctgagcaatangaggtagttttatgaagccaaacacaagcggtggattaagaagtgtgcaaaattctattc

SEQ ID NO: 1672 - DNA, 121 bp, Artificial Sequence
  Synthesized
  misc_feature (61): n=t or c
gttaactcgtttaagctccctgaccacctgaccacaagttcctccagcagagaatcctttngtaagaggcaccaggtgaaatttttaggcacttttgggtagggaggatttgttttgctgg

SEQ ID NO: 1673 - DNA, 121 bp, Artificial Sequence
  Synthesized
  misc_feature (61): n=a or g
tccatattctaaccagtctttgcaacgcaacatgggcaaccagcattttcctcagcgtgcnttggcacctcctaatcagttaacagcaggagtccaaatgagacctcctctgaaccaaatg

SEQ ID NO: 1674 - DNA, 121 bp, Artificial Sequence
  Synthesized
  misc_feature (61): n=a or g
gttacgtgatttcagtgagattctggccacgtaccacagagtgaatgcaagctcacgctcngtagggtcagctgatgtaatctggcctttggttccctatgtcccagtctgcctaaaaact

SEQ ID NO: 1675 - DNA, 121 bp, Artificial Sequence
  Synthesized
  misc_feature (61): n=t or g
gagactgttgtccatttcctgaacttcgcataggacaatcagagattgagaaagctccacnaatcgtaaaaatcaaatgtatcatttaagagtgtttgcattgattgtttattgtggctta

SEQ ID NO: 1676 - DNA, 121 bp, Artificial Sequence
  Synthesized
  misc_feature (61): n=t or c
tgtggtgttctcccccttcccttaggtttttttttttaattattgtagtatcagctttccngtaagtgctcgttaaagccgagaagttaccttcctttccgtccatatgggaaacagttat

SEQ ID NO: 1677 - DNA, 121 bp, Artificial Sequence
  Synthesized
  misc_feature (61): n=a or t
acttggatttttttttacttaaaatacccattccaacagctgtcagtgcaaagtgctgggngtactgtagttgtactatattgctactgtattccagtctgtatagctgtatatcccaccc

SEQ ID NO: 1678 - DNA, 121 bp, Artificial Sequence
  Synthesized
  misc_feature (61): n=c or g
tgagaagtctctatggttttttttctcatgctgaataattctgtaaagacaagaactggtntgctttcctttggcttaaacatccccttgctctgcagtctttgcaggtcttcattggact

SEQ ID NO: 1679 - DNA, 121 bp, Artificial Sequence
  Synthesized
  misc_feature (61): n=a or g
tatttcaagcagcctagaaatgaggtggtgattcgcagtctcctgtgcaaatacccatccnaagtgaaagtccagctgtcaaacagctcattcctttacaccatcttcccctacataagga

SEQ ID NO: 1680 - DNA, 121 bp, Artificial Sequence
  Synthesized
  misc_feature (61): n=a or g
ttcaaactgaatgcccattggaatggaaggaggcaagatatatgtgcctgttcagtgaccncagtaatgtctactctcttaaagtgatttataaggtctttaatgatcaagaaaatatact

SEQ ID NO: 1681 - DNA, 121 bp, Artificial Sequence
  Synthesized
  misc_feature (61): n=a or c
gtgctgcaatctatcccttaaagcctgaagcaagtttattttaccttacagtttgctgtancatgtagggtgtgccagagaccattttatttgttgtttccatgttgatctaatcctctca

SEQ ID NO: 1682 - DNA, 121 bp, Artificial Sequence
  Synthesized
  misc_feature (61): n=a or g
cagaatttccatactagagtcccactggaagttttagagccatgttagatgatgcctaacnccacaggaaaagtcttcattaatgcttaagaggaaatactgtagtgcacaaataaagcct

SEQ ID NO: 1683 - DNA, 121 bp, Artificial Sequence
  Synthesized
  misc_feature (61): n=t or c
tgattcccaggaaggccacaagtataggagcagcatctacgtgaagatgggatcgagcagnagtgatgatgaggctaccattttaaaagataagagaactcactctttggaagagctgaca

SEQ ID NO: 1684 - DNA, 121 bp, Artificial Sequence
  Synthesized
  misc_feature (61): n=a or g
aaatgaagctaggggagatggaaatggtgataggcaaccccaccacactgttgggagacangaggcattcaaaggttaagagaatatctaaaaatagcaatgcctctaagccatgtatgaa

SEQ ID NO: 1685 - DNA, 121 bp, Artificial Sequence
  Synthesized
  misc_feature (61): n=a or g
cagatctctcattctcacagcctctaaaactggaagcaaatattgtctccacacatagtcnttacctgtcagtctcactggcttcctaaaggtctattttgaacatacctcaagatgtcta

SEQ ID NO: 1686 - DNA, 121 bp, Artificial Sequence
  Synthesized
  misc_feature (61): n=t or g
caacagctctgtgttcttctagagggggacaatcacctccatctctacctttcttttgatncagtcaagacacttatcagaactgggtagatgggcctggaggaccctggagtgtcttcag

SEQ ID NO: 1687 - DNA, 121 bp, Artificial Sequence
  Synthesized
  misc_feature (61): n=a or c
tggaaggggtggtccgaatccttctggagcattattataaggtaatgaagctgggagccanacatgctgccagaaaccccattctggccttgttatcttgggatggggttggaggtgggtt

SEQ ID NO: 1688 - DNA, 121 bp, Artificial Sequence
  Synthesized
  misc_feature (61): n=a or g
ggaaaaggtctttttatacaactctgtctggactctgagatccatctacacgaagttagtntttatttaggtatgacagtaactgcatggtaactgaaaatctaagaatttctttcaaagc

SEQ ID NO: 1689 - DNA, 121 bp, Artificial Sequence
  Synthesized
  misc_feature (61): n=a or g
aaggtggcattaccttctcaaattctgctgctttacccaacctttcatctccaatattatncagtccttgatatgacagcctctttccatcttaatccagacacaacttcttccctgttcg

SEQ ID NO: 1690 - DNA, 121 bp, Artificial Sequence
  Synthesized
  misc_feature (61): n=a or g
accaagtatttataggaatatcatttttatttggccacagaattctacacacagcccttanccattggattaatgaatggttttcctcattgtgttggaccatagcataaatcctctgctt

SEQ ID NO: 1691 - DNA, 121 bp, Artificial Sequence
  Synthesized
  misc_feature (61): n=a or g
ttactctgtatcagagcaaccagtctttgagcagttagagcctctgcacagctagaatgcnagtgaatagagtgtggttggatatatttttttcagacactgttattattgcccagtgtgt

SEQ ID NO: 1692 - DNA, 121 bp, Artificial Sequence
  Synthesized
  misc_feature (61): n=a or g
cagtaccactctttattgaaaattggtttataagagaaactttagttttgtgtatttaatncagatgcatggcagaaactcagttgtgcatagaatgtgggtaactgagcatgcaacagct

SEQ ID NO: 1693 - DNA, 121 bp, Artificial Sequence
  Synthesized
  misc_feature (61): n=a or g
cagctctgtttatggagccttcctgcacctctgcaagtttcacttgatttctaaaccttcnaaataattcagggaagtgctgcataacactaaaggatattttactttccttggcacagtg

SEQ ID NO: 1694 - DNA, 121 bp, Artificial Sequence
  Synthesized
  misc_feature (61): n=a or c
aagagttcacagacaatcattaccatttccctcaactaatgacaatcagaagttgttgctnttcataaagatgcaaattcctgtagctcactttgctgaatttctctgctcaggagaaaga

SEQ ID NO: 1695 - DNA, 121 bp, Artificial Sequence
  Synthesized
  misc_feature (61): n=t or c
tagatacacactgaattatatggtttcaacactgttcgtgtatgtcacatatgtggctagngttataaggcacataaattgccatatgactgcaaggggatgaattgtcatcactgaaagt

SEQ ID NO: 1696 - DNA, 121 bp, Artificial Sequence
  Synthesized
  misc_feature (61): n=t or c
tcttatgcttaacttcaccttgctgtgtataaacaacctcagaatccttgagagctcatantcataaccccaaggagccagataagcaggtattcatagcaaggtgtgcactgtgctgcag

SEQ ID NO: 1697 - DNA, 121 bp, Artificial Sequence
  Synthesized
  misc_feature (61): n=t or c
tccctgtattacaagggcatgtaaaagggtcagcattatcagaaatatgcaaaggatcaangttctcaatggaaaacctccactcccctatcacaatccttcaaggtactgcaaaaattat

SEQ ID NO: 1698 - DNA, 121 bp, Artificial Sequence
  Synthesized
  misc_feature (61): n=a or g
accctgaatgtctccagaaatggggcaccaccaccacctctctggtggtttaaagtctcanaacaggataatggattaaataaagccctcacgtctcatggcaaggagaggatgtataact

SEQ ID NO: 1699 - DNA, 121 bp, Artificial Sequence
  Synthesized
  misc_feature (61): n=a or g
ttggccatacaagtgaaccagccaattgccatcagatgtggtgacaactgccacatccttncaaaatccttgatgatgaatatgctctaatcagatagtccagatagtcccttgcaaggaa

SEQ ID NO: 1700 - DNA, 121 bp, Artificial Sequence
  Synthesized
  misc_feature (61): n=c or g
ctacctggcgtggtctacacactccaccactttgccaaaagtgccttcgccaaggctgccnacaatttcatctaggagagaaaacaggagcagatgtgaacttgaggggagtggcgagagc

SEQ ID NO: 1701 - DNA, 121 bp, Artificial Sequence
  Synthesized
  misc_feature (61): n=c or g
atcacaaccggtacgtggcacgggcagctcgctgcttctccagcaagtgggctggatgtgntagcttgggacatgcccacgtcttcaacattccctttcctggccgcttgcttttgagacc

SEQ ID NO: 1702 - DNA, 121 bp, Artificial Sequence
  Synthesized
  misc_feature (61): n=a or g
actcctttccagtgtgcagttttttggctttacttggagccatctgagctcgcgtgggtcntgggagtttccaggggaagcaccaatgagcatgaatatttccttttgatctacaaacatc

SEQ ID NO: 1703 - DNA, 121 bp, Artificial Sequence
  Synthesized
  misc_feature (61): n=t or g
ttttccttccccaaagtccagctccctcctcccacagcagacccttgtctgagctacccanattcctcctggtggcccctcagtatttccagatccacccattttctgtccatcagcgatg

SEQ ID NO: 1704 - DNA, 121 bp, Artificial Sequence
  Synthesized
  misc_feature (61): n=t or c
cctacctagtaggtctacctaccctgtttaggtgctggtaagggcactgtgctggagccanccttgcttcctggctcatacactatcatggagcagccctacccttgcagctgctccctga

SEQ ID NO: 1705 - DNA, 121 bp, Artificial Sequence
  Synthesized
  misc_feature (61): n=c or g
ggggatgctgctcccatgcttcctgttgttgtgtcctagccatggcagtactatgctcttntttctgcgttgtagatgtgggggtgacagtgctgtgctccccatcattgtgttctaggcg

SEQ ID NO: 1706 - DNA, 121 bp, Artificial Sequence
  Synthesized
  misc_feature (61): n=t or c
tccctgtttctgcagatcatcatcccagtctttactacatcttactaatggtgcatgccgntgtttccgaactcttaaattttcggactgaagtacttctgttcatatttacaatgctgcc

SEQ ID NO: 1707 - DNA, 121 bp, Artificial Sequence
  Synthesized
  misc_feature (61): n=t or c
aaacaaggcagcttgcatgccacttgtctgcacgctgggaagcatgttcctgcctttatgntttaaacacaatatttagctccccaaaggcctccctttccccaggcgggtccctccagaa

SEQ ID NO: 1708 - DNA, 121 bp, Artificial Sequence
  Synthesized
  misc_feature (61): n=a or c
cggggcagagccccaatagcccccgagaacaggtaggagactgcatttcctcttcccttcntctttcagctaaattcatctttatctggagttcaggtttatggcatatccaaagaaagca

SEQ ID NO: 1709 - DNA, 121 bp, Artificial Sequence
  Synthesized
  misc_feature (61): n=t or c
cacaaccacagtgagagggaggtgggttggtacagcacttctctctgcgttagggcataanggtcccaaaaacaagaactcctcacaggggcctgtggggtcctggcagggaggtggtggg

SEQ ID NO: 1710 - DNA, 121 bp, Artificial Sequence
  Synthesized
  misc_feature (61): n=t or c
acactggctcggcttcaagcctgtggttttcaagcgtggtcagcagcgccttaattaggancagagagctttgccagcagtcctgcccatccatggaagggacagtgcagggggtagcgga

SEQ ID NO: 1711 - DNA, 121 bp, Artificial Sequence
  Synthesized
  misc_feature (61): n=c or g
taatcagctatgtggtgctcgtgcactaaagtcctaatactggtaagtttttatagtccanttgttagaacatgggaatattttaggaattttcaccttaccctccaaattgcttaaaaat

SEQ ID NO: 1712 - DNA, 121 bp, Artificial Sequence
  Synthesized
  misc_feature (61): n=t or c
cacaaagaggactgttgatgggttttaggttcctaatagagagatgggcacagaaatcccngcttcatattaggtacctgttctacagctgtcctgtactgggatgagttgcctctcctcc

SEQ ID NO: 1713 - DNA, 121 bp, Artificial Sequence
  Synthesized
  misc_feature (61): n=a or g
tctgcatcacagatgcattcaatcttgagcagtttcctatgggcaacttccatcagtaacnttaaatggaaaaaacatgggagaaggacactttttgtccttcatttgtaatctcaaggta

SEQ ID NO: 1714 - DNA, 121 bp, Artificial Sequence
  Synthesized
  misc_feature (61): n=c or g
gaaatgtaaataaacagccttgtgttgctgtttttctcactaatgtccaaagtgtgtgagnaatacaaatgataatgccctctcataatttattgtgaaatacaaatgcagcttcttccaa

SEQ ID NO: 1715 - DNA, 121 bp, Artificial Sequence
  Synthesized
  misc_feature (61): n=a or t
tcccttgtgtttaactaccatttcaagtttattgcttcctagggtggatataaatcacatntagatttcttgtggcacctgaagcttataataccacaccataaatgtactatgctgccca

SEQ ID NO: 1716 - DNA, 121 bp, Artificial Sequence
  Synthesized
  misc_feature (61): n=a or g
aaaaaataacatgtgaaagtaaaaaagctcagggaaaaaaagttgaacgaacacttctcantaactgtattttcatagcagtacataaaataagaacacagcttcatttttgcctgatttt

SEQ ID NO: 1717 - DNA, 121 bp, Artificial Sequence
  Synthesized
  misc_feature (61): n=a or c
atacattgaatataacattgtatctaaggtaaacagaaccagaaatgtctgatttagtgtnggtaactccagatctttaaagattgcctttgacttttatccctttatagttctgaatttg

SEQ ID NO: 1718 - DNA, 121 bp, Artificial Sequence
  Synthesized
  misc_feature (61): n=t or c
attttagtaagaatgtatttatggattgtggatccataacacaagggtttgtagcagtatntcactattctttctattgtatgaactgtttggttatcacttgttccccaggtactactaa

SEQ ID NO: 1719 - DNA, 121 bp, Artificial Sequence
  Synthesized
  misc_feature (61): n=c or g
gttttaagtttggaggctaccatgtgtcgaattccttcttcagacttacctgtgattttgncgataaatggctagatgataatgtccatgttggagtgggagggcagaaagctagaaagct

SEQ ID NO: 1720 - DNA, 121 bp, Artificial Sequence
  Synthesized
  misc_feature (61): n=a or g
tcaaggcaggatggaatacagaggtatcccatcatgcagctttgagtaccattgctcccantgttttgtcatacaaacaaaatgaggttctgctacataacttagagaacattcttgatta

SEQ ID NO: 1721 - DNA, 121 bp, Artificial Sequence
  Synthesized
  misc_feature (61): n=a or g
ttgcagaaagcatagctaaggtgggttgccctgaatcctgatttgccagtcttgttgaaantaaatttatagcccaaagtgtcaagaatgtttgtaaagcagatggtggtatatggacatg

SEQ ID NO: 1722 - DNA, 121 bp, Artificial Sequence
  Synthesized
  misc_feature (61): n=t or c
tttctttacatttttgcaccttaccttggaagcattaaatgcaaacagctttttggcttgnctgcctgcctgaaggtgaaagtaaagcaattctagtgccaaaatggctaaataatcagaa

SEQ ID NO: 1723 - DNA, 121 bp, Artificial Sequence
  Synthesized
  misc_feature (61): n=c or g
cggtcctttttatttataaaattattagcacgcaacagtgctgtggactgcagagataccntaacagtgggcacagagcacttaaaaacttaaggacgctgctgtccttctccaaggcagg

SEQ ID NO: 1724 - DNA, 121 bp, Artificial Sequence
  Synthesized
  misc_feature (61): n=c or g
tcgtagcagccaacgctgaccctgtgctgcagctgcagagaggactgtggtctgagtgctncctgtcatgtgtgctgccctggcaggatttaaaaagaagaaaggagagaaagggattcct

SEQ ID NO: 1725 - DNA, 121 bp, Artificial Sequence
  Synthesized
  misc_feature (61): n=t or c
gactagagaagtttgtacggagtttttaagctgaacattctatcttgttaaacttgcatanatattatttatttttgttataaaaattctattcagttttcagaggaaagatggctgtcca

SEQ ID NO: 1726 - DNA, 121 bp, Artificial Sequence
  Synthesized
  misc_feature (61): n=c or g
gatcaaataacaaggagtgactgcaattccagacacggcttctggacgatgagctctgctnttcccaaaagttgggtaaagcatccaaagaaatcgttcaagcacaggagatggcacctca

SEQ ID NO: 1727 - DNA, 121 bp, Artificial Sequence
  Synthesized
  misc_feature (61): n=a or g
aaatatgttcctgctatatatctatagtttgtggctgggaatgctaagtgctgatatcacngttttcagtggtgctttattttgcccttctcagtgggcagaagggaaagaatggttccct

SEQ ID NO: 1728 - DNA, 121 bp, Artificial Sequence
  Synthesized
  misc_feature (61): n=a or g
ccaggcaccattccactttttgagcacccagaacgctgactgactttcagataagtcctcnaagaggaaatacgtatttagggataaggacaattaaaactcttattagcttgtgacaaaa

SEQ ID NO: 1729 - DNA, 121 bp, Artificial Sequence
  Synthesized
  misc_feature (61): n=t or c
aattatatttagagatggaaaaagttaagtttctgggaggagcacaaaggtaccaaacttntggcatctcagtagaaccctgagacagcttgagtcttttctttttgtccgtgttagaggt

SEQ ID NO: 1730 - DNA, 121 bp, Artificial Sequence
  Synthesized
  misc_feature (61): n=a or c
tgcagaaaaagtaaatagtttttcactttaagtaggaatacagaggggtttatttttgccnatgtggatagtgtcaggtttatttggcttgcctctattagatttgcattacagatttgtt

SEQ ID NO: 1731 - DNA, 121 bp, Artificial Sequence
  Synthesized
  misc_feature (61): n=c or g
tttattttagtgaatttaagcatgatccaataataacaaacttagcaggaacatacttcantaaaacctcattaatcagggcagtgggatgtagtatatatgatatctgttatattcaatg

SEQ ID NO: 1732 - DNA, 121 bp, Artificial Sequence
  Synthesized
  misc_feature (61): n=a or g
ggcttttcttatgagagcttggattagagagtgaaaacttgctcaacatacactattaacntcgttatttaaaaacagtgttagaaaccatgcccttttcccctatgacaggaaaacgtac

SEQ ID NO: 1733 - DNA, 121 bp, Artificial Sequence
  Synthesized
  misc_feature (61): n=a or g
tgtacacagctgctcccgtagcttttccacgtcgtctgggtgaacctgttcatataaggtnctgccaaaccattcggactgcggctggttgagcaccggagtcactgagtccgatacgtag

SEQ ID NO: 1734 - DNA, 121 bp, Artificial Sequence
  Synthesized
  misc_feature (61): n=a or g
aagcagaggatggaaatgcagcatttgctttctttccaggctcatattagctgtgttttcntccatgctagctttccccttccattcctgattttctttccttaagtgtccatctgctaca

SEQ ID NO: 1735 - DNA, 121 bp, Artificial Sequence
  Synthesized
  misc_feature (61): n=a or g
taaaataaaaattcagagggcgctttcacctgtaatcttctggacttgataggtacaaganagaagtctgaaactgatgtgagtccatgctacaatgccccaaaataaggatagtccctct

SEQ ID NO: 1736 - DNA, 121 bp, Artificial Sequence
  Synthesized
  misc_feature (61): n=a or g
gaaggagtatgtgggacgtggagctgggacatacctctcttgtctatggggtctgagggtnctcagcacccatattagtaagggggctggtttcctgctgaccttgcagctggataaggga

SEQ ID NO: 1737 - DNA, 121 bp, Artificial Sequence
  Synthesized
  misc_feature (61): n=a or g
atcaaaacttcaaattggacaaatcagaactttaaactgtttaagagatgccatcagcatntggcagaaaacacgcacttaaggattcttaggtactcattcttctctgaaagagggtctc

SEQ ID NO: 1738 - DNA, 121 bp, Artificial Sequence
  Synthesized
  misc_feature (61): n=t or c
actttattcttgttccatggtggtgctccacagctacatttagaagagtcatatacatgangttgggcatctccttgaggacatccctgttgacttttacatgtgaccatgcccagatctt

SEQ ID NO: 1739 - DNA, 121 bp, Artificial Sequence
  Synthesized
  misc_feature (61): n=t or c
ttagcttgtagatggggaaggagaaccaggaagaggtgaagggttatgaaagtccgtgaangtgggcaaaattcggcctggtctgcaggtgtaattgagcatctagagacaaccaggagat

SEQ ID NO: 1740 - DNA, 121 bp, Artificial Sequence
  Synthesized
  misc_feature (61): n=t or c
tgggcagtcccactgacttgaagggcattaggtgtcctgggatagcacagctacacagcanggcattcctggatgtgttcctatgtgacttagaggttcttctacatatttgaagtgtgtc

SEQ ID NO: 1741 - DNA, 121 bp, Artificial Sequence
  Synthesized
  misc_feature (61): n=a or g
agtattccaaagtgagctcttgaactgtgctttgctgggtttgcttttcaaagtctaggtncactggggtgagtttccattttggaatgcctattttcttgacttgtcgtggctctttgga

SEQ ID NO: 1742 - DNA, 121 bp, Artificial Sequence
  Synthesized
  misc_feature (61): n=a or g
ttcctattaaactccgcctatgctttgagtttatcatggcagggtataatctatgtgtgtntgtcaatcaactttgaaaaagattacaaagaagcagttctgctggcaatgtgcagttgga

SEQ ID NO: 1743 - DNA, 121 bp, Artificial Sequence
  Synthesized
  misc_feature (61): n=a or g
taacacgtgtaggattgacagcttatatggaaaaccagttgtatggctataggtcgtatcntcttcacaaaaatacttccttagtttctccttgtgaagaatgtaatgtcaagtcagtggt

SEQ ID NO: 1744 - DNA, 121 bp, Artificial Sequence
  Synthesized
  misc_feature (61): n=t or g
cacatgcattttgtccgtgtagtctcatttctttactcacccactgtggaacacatttganatcttaagattgggtattaggaaagaattccctcagtgttgaggcattggcacggctgcc

SEQ ID NO: 1745 - DNA, 121 bp, Artificial Sequence
  Synthesized
  misc_feature (61): n=t or c
gggagccttgcactaggtccagctccttggaccatgcttttgttacatacgtgcagccagnacccacaccagcaagcaatgctgtgtgctgatggaaggttcctgctctatagctgcaagc

SEQ ID NO: 1746 - DNA, 121 bp, Artificial Sequence
  Synthesized
  misc_feature (61): n=a or g
gacctccagtacattaatttccttccttttttggaggccttcagcatctcaaggagagagntgtgtggcttcactactcctcttgtctgcttaactcagctgacactgatttttacctaca

SEQ ID NO: 1747 - DNA, 121 bp, Artificial Sequence
  Synthesized
  misc_feature (61): n=a or t
gggtgggaaaataaaagtctcctccatcagatttgtcactccttattcagaatgggcaccnggcccctgtgaaggattaactgcttgcttgtaaaataccgtgttttgatattaagccatt

SEQ ID NO: 1748 - DNA, 121 bp, Artificial Sequence
  Synthesized
  misc_feature (61): n=a or g
gctgtgttggtgacagggaggaaaaggttctgctagaatcgagcagaggtgactctgcccnaattggtgggagcagcacagccaggcgcagtgaggggctcagggcaggggaagtgtgaaa

SEQ ID NO: 1749 - DNA, 121 bp, Artificial Sequence
  Synthesized
  misc_feature (61): n=t or c
atgaagaggaaaatatgactgtttctccatttggagattcagttgagaaggtcagtgctgncgacatctctgtcacattggtcagcgtagcttggggactatgggaactcagtttatacgc

SEQ ID NO: 1750 - DNA, 121 bp, Artificial Sequence
  Synthesized
  misc_feature (61): n=a or g
tctcgtttcgtatggttcgtgtgaaggcactgcacaaaaactgaagctgcacttagtcccncatccttagatgcagagtgcaacctccaccactcatttccttgaaaggtcaggcaaaatg

SEQ ID NO: 1751 - DNA, 121 bp, Artificial Sequence
  Synthesized
  misc_feature (61): n=a or g
aaaaccagaagcaacatgaaaaggagatgcttaaataattaaatgcctcccgcctttcccnaaagagagctgaggagcagtgtgtttttctttcttcagatttttagttctcctacaagtg

SEQ ID NO: 1752 - DNA, 121 bp, Artificial Sequence
  Synthesized
  misc_feature (61): n=c or g
gaaacatattctagatcaaaaaatttaattcttatttcagcacacttcttcttatgctganagtcacttcgagcagaggttaccagaaacaagttcaagacagcaggtggaatgttaccta

SEQ ID NO: 1753 - DNA, 121 bp, Artificial Sequence
  Synthesized
  misc_feature (61): n=a or g
gcatatgttgctccttcatatattctcagagagctcttagcagtgtctagggcactctgtngacaacattctgctgaggcactgctccttggcccatctgctaatggtgccagggccaaaa

SEQ ID NO: 1754 - DNA, 121 bp, Artificial Sequence
  Synthesized
  misc_feature (61): n=t or g
gtgtttgacttggtcttcagctgtgtgcagctatgcatcacgagcacttcacaagaatgantttggtgctcgtattcctcttagtgtcagtgttttgcattttggaaagcattgtttgtac

SEQ ID NO: 1755 - DNA, 121 bp, Artificial Sequence
  Synthesized
  misc_feature (61): n=a or g
cttcccatgggctcagtttgaggttcattttgtggctctggaatatttcagggcaatgggngaggtatcagtgtgatgcagagactctggttctgcacatcagatggacacctcacctctg

SEQ ID NO: 1756 - DNA, 121 bp, Artificial Sequence
  Synthesized
  misc_feature (61): n=t or c
gtcatttgacctccatgtgcctcagtccatctggctggaaattaggtaaaaatacatgatnagatgctgcacgtgagccaggtgttcctaagtcagctatttagcaagaagcaaatgctac

SEQ ID NO: 1757 - DNA, 121 bp, Artificial Sequence
  Synthesized
  misc_feature (61): n=t or c
aagcgtacctaaattatacttaaagttagtagttcatcactaatgaattcaatcttggctnatagagcctgaaaaaattggagtacaagaatgttggatacgtgtgttttacgtgacagaa

SEQ ID NO: 1758 - DNA, 121 bp, Artificial Sequence
  Synthesized
  misc_feature (61): n=t or c
ctagtcacagcagcatgagatctttgacttcacgtacaaagtacagcctggctgcaagttnacatacccctctgaatggcatttccattcagaattaaccaacaacacaactaagaagcaa

SEQ ID NO: 1759 - DNA, 121 bp, Artificial Sequence
  Synthesized
  misc_feature (61): n=t or c
ctttttggaaagcccttaggcaggtgcaggtgccacatcaatatgtcagcgctcccatgangagttcataatattttctgctcgcattccgctgtctccccatattagcaaacaggctgct

SEQ ID NO: 1760 - DNA, 121 bp, Artificial Sequence
  Synthesized
  misc_feature (61): n=t or g
ttccagaaacattttgcacagatggtgcctgttatgtgaagcatttgttttattagcgtangtaaaaactcctaatttttttgtagtgtcagccatttttccagcccccatatgagtcact

SEQ ID NO: 1761 - DNA, 121 bp, Artificial Sequence
  Synthesized
  misc_feature (61): n=a or c
ataaaggaaattctgaaaattaattatataagactcactccaactcagaaaagccaaaaanatacatgtaacagaagagccttaattacactgcaagtaaagggaaaaaaaaaaatccttg

SEQ ID NO: 1762 - DNA, 121 bp, Artificial Sequence
  Synthesized
  misc_feature (61): n=t or c
gcagccacttaattctgggggataaatcatatccacaacctccttcttttcaactctgcanatgtatagagtcattccaatttctccagaagttgtctcaatttctgcaagtgattctagc

SEQ ID NO: 1763 - DNA, 121 bp, Artificial Sequence
  Synthesized
  misc_feature (61): n=t or c
acaaatatttggtcttgctcatcaagtaaacactgtgttaaatggaacattgtcactgatntactttcttggttttttgttttacttctttcacaatcccagcagtacttccttttccaga

SEQ ID NO: 1764 - DNA, 121 bp, Artificial Sequence
  Synthesized
  misc_feature (61): n=t or c
cggtatgttaggtatagccaaggcaaggtgtttgaatttggagcactgcaaaaagcatatnagatacttctgatgtatctgtgatgagtatcagtgacttggatccatggattcctcctca

SEQ ID NO: 1765 - DNA, 121 bp, Artificial Sequence
  Synthesized
  misc_feature (61): n=a or g
tacgtatttaaagataaaccttgatcctcttaggggatatagattcagctcccagactgantttttttttctcatagaaaacttagtttgttggcagctttgtttgaaacagtgtggactt

SEQ ID NO: 1766 - DNA, 121 bp, Artificial Sequence
  Synthesized
  misc_feature (61): n=a or g
aaaactcgctgtagaaagcaaaccttaaaataaggaataataattcaatgaacatccacangtagataaattttctattagactgcattcctgctactgcaatcaatacttgtgatttagg

SEQ ID NO: 1767 - DNA, 121 bp, Artificial Sequence
  Synthesized
  misc_feature (61): n=a or g
aggaagagagtgggaaggggtggctagtgtgttacttctaatattaagccacaggctttgntcaaactcagagtaaggttcttgaatggaagaatatgtggtatttgtgcatgctctcaca

SEQ ID NO: 1768 - DNA, 121 bp, Artificial Sequence
  Synthesized
  misc_feature (61): n=a or g
agctttgttctcagtacaatgtgctgacagattccataaggcactcaagacactttttagngttgattcctaggaaaataacaaagtgacaggattagaaaagtttttcaactattgatca

SEQ ID NO: 1769 - DNA, 121 bp, Artificial Sequence
  Synthesized
  misc_feature (61): n=a or g
agctagtttgattgtgtgatatcagtgcattttgtattatgatagtgtgcatgagctgtanggcataaccccttaactcatgctcctcaaatcggaatacagccttttttttttttgccat

SEQ ID NO: 1770 - DNA, 121 bp, Artificial Sequence
  Synthesized
  misc_feature (61): n=a or c
tctcaaagctgtgctggtgagcacacctgtcactctatgtctataaagatcagcagaagcncagtgctagtggtgtttcatccatacagaccaacactcaaaaaatgatttgagcttatta

SEQ ID NO: 1771 - DNA, 121 bp, Artificial Sequence
  Synthesized
  misc_feature (61): n=a or g
ctcagttctgagcattgctgccatgctgcctttgcctaactttgcagggagatttagagcntgtctccttctgcagttaccattaggcatggatacaaatggttactatttaaatattcca

SEQ ID NO: 1772 - DNA, 121 bp, Artificial Sequence
  Synthesized
  misc_feature (61): n=a or g
tttcttttcaagtccaaccagttctcaatgtttccttggtagcccatgcgagctggcagtnctgctcacaggaaggtcaagtgaggacagggctgtgtggggcaaaaacagcctccaaaaa

SEQ ID NO: 1773 - DNA, 121 bp, Artificial Sequence
  Synthesized
  misc_feature (61): n=t or c
ttaaaaaccgtgtcaaacctcctgcactcattagatggcaaaaacaaagctcttttccatngtaataattattatcattgatgtattactttattatcattgattacataagggaaacata

SEQ ID NO: 1774 - DNA, 121 bp, Artificial Sequence
  Synthesized
  misc_feature (61): n=t or c
tttgggaagcacttcagaaaaactccttaacttttcctctgttaagtcctgacagtctgantcccaaggctcccaagaaccataacgaatgatgtccatgcattcatttcatgatttgtaa

SEQ ID NO: 1775 - DNA, 121 bp, Artificial Sequence
  Synthesized
  misc_feature (61): n=a or g
agaagagacaaaaactcacgcatcctggagtcaacaaatgactttagttctaccagttaangccaaaacatgagtcatatcccctaacagtacagagggtgctaccaatcttgcagacttt

SEQ ID NO: 1776 - DNA, 121 bp, Artificial Sequence
  Synthesized
  misc_feature (61): n=a or g
actgggcgtttcctccagagtaatgctgtgaaacatcaaaagctttgctaaaatcaaaagntagctcacccactgctttccttttcgtccactaggtggctaaccttgtcctgaaaagcca

SEQ ID NO: 1777 - DNA, 121 bp, Artificial Sequence
  Synthesized
  misc_feature (61): n=a or g
tgtggaatattctggatttttgattaacggagttggaagtcttctggcagttggatttgancaggatgaataagaattactggtgaataccgaacaccatgtctgttagccaattatagat

SEQ ID NO: 1778 - DNA, 121 bp, Artificial Sequence
  Synthesized
  misc_feature (61): n=c or g
gaagaacagaagccacgcagcaggttgtacagcttttgatgaagctttgtgcacagaccantttctctttaactgggaatggtccccaataacagctgctaccagttctactattagtcac

SEQ ID NO: 1779 - DNA, 121 bp, Artificial Sequence
  Synthesized
  misc_feature (61): n=t or c
agcgctcagcttggggccacgtggtagcttttctgcctctcagtggtattgttgttgctgnagtgctagctgaaataacttaatctgtccatcagcagttgtgtggataacacgttcagat

SEQ ID NO: 1780 - DNA, 121 bp, Artificial Sequence
  Synthesized
  misc_feature (61): n=t or c
agcccaccagccatagaacttctcactacaaatgaaaagagaggttcagaccagtaatganaccacttgcatgctgctaaaataaccttcactcaagaaggtattacagaactttacaata

SEQ ID NO: 1781 - DNA, 121 bp, Artificial Sequence
  Synthesized
  misc_feature (61): n=t or c
caaagaggtggcaaacgtgtgcaaccagagtctgatgaagcttgtcatcccagaggacgangaaatggatgaggccaagcagtcaataaccctgtcagcagagcccaacccagaagagccc

SEQ ID NO: 1782 - DNA, 121 bp, Artificial Sequence
  Synthesized
  misc_feature (61): n=c or g
caaggtaaagaaagaaaagccaaatggaaaggccactccaagctgctcatacacctggcanacagacttatttacttttgttattcaattatagcagatataaagctcccagaggctcact

SEQ ID NO: 1783 - DNA, 121 bp, Artificial Sequence
  Synthesized
  misc_feature (61): n=a or g
taatgcagcactgttcctatgggatgtggtgcaaacatacagaactgtgctttttaagggncattctcagtttctaactttgtgttattacctctgtagcacttggaaccagtgttagtta

SEQ ID NO: 1784 - DNA, 121 bp, Artificial Sequence
  Synthesized
  misc_feature (61): n=a or t
agaaaactacctgtattcccgatcccttcaacatcctctcatgggacagaaggtctttttnaatattttgtaacttcctcattgcagcctcctgtaacccaatttgaatgagcagaagtag

SEQ ID NO: 1785 - DNA, 121 bp, Artificial Sequence
  Synthesized
  misc_feature (61): n=a or g
taatggtttgatttccctgaagatacaaatacagcaaatccagcacaggccctacaagccntgctacaaatttcgtattttttctgttcatgatacagaatatccatgtaaagatagagta

SEQ ID NO: 1786 - DNA, 121 bp, Artificial Sequence
  Synthesized
  misc_feature (61): n=t or g
gaaggtgtttgataccaaagagatccaaaaagtacaaaagccaggatcctgcaagaaccanacctgattattaatgcactgtggtgttgcatttgcatgaccccaaacctagcaggggaga

SEQ ID NO: 1787 - DNA, 121 bp, Artificial Sequence
  Synthesized
  misc_feature (61): n=a or g
cttggtagcacagaggtggaagtccttggggcagggtgttggttttttaggagtttatatnttggagattggaatgtggcttcaggcagttctggaagatttctgtcccctggaatccatg

SEQ ID NO: 1788 - DNA, 121 bp, Artificial Sequence
  Synthesized
  misc_feature (61): n=a or g
ctattttcgttcagttttgaattttaagctatctcatatggcagacctcaaaatattgtanccgattgactttgaaatacagatttgcaactctccttcacttagtttaacaagagcaaag

SEQ ID NO: 1789 - DNA, 121 bp, Artificial Sequence
  Synthesized
  misc_feature (61): n=a or g
gcagtttctgactgtctgactttgtcactagtttctgacaaaggctaaagttaaggactgnaatcagatttctgaatgtgtcaaacaacagttgtcaaaggtaagcttttttgttattgtg

SEQ ID NO: 1790 - DNA, 121 bp, Artificial Sequence
  Synthesized
  misc_feature (61): n=a or g
acaatattatgcaaatgtgctactcagaactcaattatgtaatagataccataaaaacaanagcagcagaaataatttacaaccaatagtagccatgatgttataaatgtcttataaataa

SEQ ID NO: 1791 - DNA, 121 bp, Artificial Sequence
  Synthesized
  misc_feature (61): n=t or c
aatatcagagtcaaaaactgaagaagccttcacttcttcttttaatcctcatacacacctnataggcatagcataatttcaagtttgttttaaaaaagattttagtggtgataatttaaag

SEQ ID NO: 1792 - DNA, 121 bp, Artificial Sequence
  Synthesized
  misc_feature (61): n=t or c
cttgaaatgaaattggtgtatggaacttctgctagagatgatgaactactatgtgatctcncttgagtgctgagcatagtgtgtaactgcgaacaatgtaggaaacagtacagcaccaatg

SEQ ID NO: 1793 - DNA, 121 bp, Artificial Sequence
  Synthesized
  misc_feature (61): n=t or c
tggcaatcactccttgagactgaggtgcagggccagatgagcctttgaacccattgcatgnaccaggtcgatgcctctgcttggagcccttgttgctttcctcctcggtttaaaggcagtc

SEQ ID NO: 1794 - DNA, 121 bp, Artificial Sequence
  Synthesized
  misc_feature (61): n=t or c
tcacacgttttctccacatccacagaaatggttttgaaaacaaagccagaaaaaacccacnatagtttcagtctaataccaataacaaatactatagtttgttaatacattgatactcttg

SEQ ID NO: 1795 - DNA, 121 bp, Artificial Sequence
  Synthesized
  misc_feature (61): n=a or g
agttctatgtatgcatctgtaaatatgatttcatcatctttactgaagtgatgactgtgangaatctataaagacacgattaagattttcattaacgatgacataaacacgttcccactga

SEQ ID NO: 1796 - DNA, 121 bp, Artificial Sequence
  Synthesized
  misc_feature (61): n=a or t
ggattaaaaacttattttgcattagtccttgagcgctctgaagtgagaccaagacttcatntgtacaaaaattcaccacaataatcttcagtggtcttcaaaatgcagtgtcaaatgatct

SEQ ID NO: 1797 - DNA, 121 bp, Artificial Sequence
  Synthesized
  misc_feature (61): n=t or c
taacacacaggaaactagtgctgcttcctgcataaagatatttaatggctgtcaagagaanactcaaaattcttagcacaactccaagttcctattcttcttcagagagtgcaccaactaa

SEQ ID NO: 1798 - DNA, 121 bp, Artificial Sequence
  Synthesized
  misc_feature (61): n=a or g
gccaaagccaattgttcctaagcctacttccagaacagtgggtgtgtcgagattgctcccntctcctgtggtgtctgaggagcacgaggatcacccaagcaagcccttcctgcagctgctc

SEQ ID NO: 1799 - DNA, 121 bp, Artificial Sequence
  Synthesized
  misc_feature (61): n=a or g
atctattatttatggcactgggctgaagtctgagaaacctatgggcttccaagcaggttgngctaattcttttgtcttttggtgcctcatctggagtgtgccttcttcatacacgaagagc

SEQ ID NO: 1800 - DNA, 121 bp, Artificial Sequence
  Synthesized
  misc_feature (61): n=a or g
gctacctcctcattagaaatcagtgcagagttgagtgaacaaggcatatctagtttcagtngggtgatgtaacgtgacttcagtgacagggcaccttttaaactagatatacaacactgct

SEQ ID NO: 1801 - DNA, 121 bp, Artificial Sequence
  Synthesized
  misc_feature (61): n=a or g
ttaccaccaagtttcctctgtgcattaaaaataaagctaaaaatccagcaaatccaacccntattatatttgaatactgaattgtaatgtttgcttggttgctatttcatagtagcaacca

SEQ ID NO: 1802 - DNA, 121 bp, Artificial Sequence
  Synthesized
  misc_feature (61): n=a or g
taaggatgtaatgcagattttagcaaaagcagaaagcatcacttttgcgtgcaactgagancagaaatccgtatccggacatatttctttatcccaaagtgcagggtgcaaataattggaa

SEQ ID NO: 1803 - DNA, 121 bp, Artificial Sequence
  Synthesized
  misc_feature (61): n=t or c
cacaatgtgtttggaatagaattctgctgcagtatgaatattttgtcttataaacacatanatagcaagcaagatcaaggcatacaggtttggtataaattacacataaggaaattttgat

SEQ ID NO: 1804 - DNA, 121 bp, Artificial Sequence
  Synthesized
  misc_feature (61): n=a or t
aactccacgtgctgcactttggggttgctttgtttatttctaagttaaccaggcagtgctntatcagtaagatttaatacatactatacattttttaacaataagtgaagtttaagaccaa

SEQ ID NO: 1805 - DNA, 121 bp, Artificial Sequence
  Synthesized
  misc_feature (61): n=t or c
ttcagttcacagaagtgtttgccagccaccttgagcagaagcagactgaagacttcaatcngctatctgggcacataaagctgcaaccaagtccctgcacagcaggaagtagcaaccagta

SEQ ID NO: 1806 - DNA, 121 bp, Artificial Sequence
  Synthesized
  misc_feature (61): n=a or g
ataagaagattgaaaacgtactttctcatattgaactatagcaatctgaaggcattcttgntgcatgcggaaattaaagtgacttactgattttggtttgcattcccataaaatgcacaga

SEQ ID NO: 1807 - DNA, 121 bp, Artificial Sequence
  Synthesized
  misc_feature (61): n=t or c
atccttgctgtccttcacccacctgagtgctgcagccactggctaagtattcattcactgnttcttgctctttggacttgatattgtgagtgcacagtgcagtgtaatagagctcaaaact

SEQ ID NO: 1808 - DNA, 121 bp, Artificial Sequence
  Synthesized
  misc_feature (61): n=t or c
tacacagcgccttctatgattttaatacttcagtgattagattagtttggtattgcctttncttatcatttccttccaacgtcttccgagtgcgtatgcacatctgtgagcaaagtacatg

SEQ ID NO: 1809 - DNA, 121 bp, Artificial Sequence
  Synthesized
  misc_feature (61): n=a or g
agcgtggcagcacaggatctaggacttcatgccaccttcctcctacctttgctctggctanaaggtatttgctcagatcctcagctcaaccagatttcatagaagtaggtatcagttccac

SEQ ID NO: 1810 - DNA, 121 bp, Artificial Sequence
  Synthesized
  misc_feature (61): n=t or c
cactctccgggatttcagcaagctgatctacagacaagataagaaatttcaaacatgaagncagctgatatattatgtggcagtttgattctgggacttctggtatcactgagatttctca

SEQ ID NO: 1811 - DNA, 121 bp, Artificial Sequence
  Synthesized
  misc_feature (61): n=a or g
aattacaaactcatatctccatgctctatccaccaaataacctactcttccaactaatccnctgtgattagcatgcattttaccttctggtacttaaaaataatttgcaggcaaacatttt

SEQ ID NO: 1812 - DNA, 121 bp, Artificial Sequence
  Synthesized
  misc_feature (61): n=c or g
aataatgacgttatctttactattaaaaaagcatttatgaatatattttgaatgtattaanaagtactatcctaggatctcagcatacacaaaaatactgaaagtatagaaaatgactgag

SEQ ID NO: 1813 - DNA, 121 bp, Artificial Sequence
  Synthesized
  misc_feature (61): n=t or c
attttcagtaccttcatatgctgctccatacatagaatgtagctccttctatttaagtctntttgtttttaaatacacacatttcagtccaagctcacatttgttgtatgttattcaatac

SEQ ID NO: 1814 - DNA, 121 bp, Artificial Sequence
  Synthesized
  misc_feature (61): n=t or c
tagagatgtatattcacaaaatgatttagtttcacatttgggaattgcatatttcatttgngacaaaccacagttttagtggcttcagaaagtaaaccactctacctagtttctgcataca

SEQ ID NO: 1815 - DNA, 121 bp, Artificial Sequence
  Synthesized
  misc_feature (61): n=t or c
gatttagagttcacatgtgagtctgaagaaatattcatttttgagtcaacaggttagtgangcgtagcaagggcagagattttcacaggatttcagtctgtgtgggttgctggaacttgcc

SEQ ID NO: 1816 - DNA, 121 bp, Artificial Sequence
  Synthesized
  misc_feature (61): n=a or g
agccaagcaaggtagaataagcttttaaagaggaaaggaaaaatatagctcaaacaacacngaagaaaagcttagaacagtgtgaataagaggatgatgattaaaggaacaaaagagaagg

SEQ ID NO: 1817 - DNA, 121 bp, Artificial Sequence
  Synthesized
  misc_feature (61): n=c or g
agcatgtcctgtctgcctgtcattaactaacagtggtgattaaacactgatagggtagcantcttctgatttgaatctcagtaggtgcagcaaaatgagtttctgctcttatttacatttg

SEQ ID NO: 1818 - DNA, 121 bp, Artificial Sequence
  Synthesized
  misc_feature (61): n=t or c
ctatttctcagtgtttaggtgccagcatcacaaagttggtggcagtgctgtcgttttttanatacatgctgaccgatgtatcaagtaacaaagatttaacaggcacagaaactgaatgcaa

SEQ ID NO: 1819 - DNA, 121 bp, Artificial Sequence
  Synthesized
  misc_feature (61): n=a or g
caagggcctgtgccctgttgctttccgtcacttgtcttctgcttgtgcaagagcacagaanttattttatacacagggaagtcgcagcctgaaaaacagaatgagagttactattagaata

SEQ ID NO: 1820 - DNA, 121 bp, Artificial Sequence
  Synthesized
  misc_feature (61): n=a or g
agctcctaaaatcaacactctccctaacaatccccaggacaactacaccactggggagttncatatttctctcgtgttgacttgtaatataccagagcaatgcaaaccagtgaaatgccac

SEQ ID NO: 1821 - DNA, 121 bp, Artificial Sequence
  Synthesized
  misc_feature (61): n=t or c
tgaaacccatgtgcagcctccccctccctattctgtgcagacagatgatttccacacgtangtacaccagggaaagatcaatccctcacttctgcagtgttgtaagttatggaggattctc

SEQ ID NO: 1822 - DNA, 121 bp, Artificial Sequence
  Synthesized
  misc_feature (61): n=a or c
ctttattcctcctctcctgtttgtccacagcccttacactgaatcccaaagagccttgccngtggggtgccacattttaaaagaaaaagggatgaagaaaagccatttttcaagcgtcaag

SEQ ID NO: 1823 - DNA, 121 bp, Artificial Sequence
  Synthesized
  misc_feature (61): n=t or c
gtgggatttggcttagtaaatattgtagcaaaataatacaaaagaggcaagagagacttcnctcgagttctgtggtctttgaattatattctaaacatgtaattcataactgagagagaaa

SEQ ID NO: 1824 - DNA, 121 bp, Artificial Sequence
  Synthesized
  misc_feature (61): n=t or c
attgtgtatcacaatgaaaggacaatcacatgatgttgagaggtacagataaaattaaatnaagcttttgctaaagcagcttcaaaagtggagtcttacagcttcagagaggatgtaatct

SEQ ID NO: 1825 - DNA, 121 bp, Artificial Sequence
  Synthesized
  misc_feature (61): n=a or g
ggggaaggaaaccaatggtttagaaacattcagtgacttctgttggaacataagcaagccntgtgtttgagagtcttaggaaagaacagcattcacacagccactgtctattagcacctcg

SEQ ID NO: 1826 - DNA, 121 bp, Artificial Sequence
  Synthesized
  misc_feature (61): n=t or c
aaaggggtttcgctcctggctacagagaaatgactttccaaatggtggtttgatctctacnccactacctctcattttctttttctccaggattcctcctgcattgattctgcaagatttt

SEQ ID NO: 1827 - DNA, 121 bp, Artificial Sequence
  Synthesized
  misc_feature (61): n=a or g
tcagtgctgtaagactggttccaaaggctctgggtatgaaaccaacctctcgcatcccggngtttgccctctgccaagattgcgtcccagcaaatgttttcagtgcagccctcagcttcac

SEQ ID NO: 1828 - DNA, 121 bp, Artificial Sequence
  Synthesized
  misc_feature (61): n=t or g
tggaggacagtaagggctgctaagagctgagaactctggaaaactttatttggatgccagnggagagttatttggcttcatctttcttgaaaatctgacccattgtttctgggaactctaa

SEQ ID NO: 1829 - DNA, 121 bp, Artificial Sequence
  Synthesized
  misc_feature (61): n=a or g
cttgcacaaatatctgtgaaccccacccagtaccttgggtattggggtcacaccatgaagnctgctcctcccccagccaaagcctttggcagggctggtccaaagcacacagcagtgtgtt

SEQ ID NO: 1830 - DNA, 121 bp, Artificial Sequence
  Synthesized
  misc_feature (61): n=t or g
ttgatagagtctggaatctcccttcctccatgtgagccctagtatttgcagccacattttncttggggaacccagcacgttgcctgcccgaagggctcagctcctgtgaacacagccctca

SEQ ID NO: 1831 - DNA, 121 bp, Artificial Sequence
  Synthesized
  misc_feature (61): n=t or c
aggaggggaattcaatcccgtttttcactgaattccctcaaagcctgtgttgcctggaggnaggattgttttcattgctgcccaacccaacgcctaccccagatcagtgaggatatcactg

SEQ ID NO: 1832 - DNA, 121 bp, Artificial Sequence
  Synthesized
  misc_feature (61): n=a or g
caccagagacgtgcatccagatggatgctgttccacaccattatccagactaccacctggncactgcttcaacagaggaactaccaaagaagtagaatggattcccatgtaaccacacgca

SEQ ID NO: 1833 - DNA, 121 bp, Artificial Sequence
  Synthesized
  misc_feature (61): n=t or c
ctgctgtgcccgactgtttcttcatctccagcaaaatgcagacatttgcatgatgcctttnttcagccctctgcaataccccatgctcaatttttgcgtgtgtgcatgttgtaaggtttgt

SEQ ID NO: 1834 - DNA, 121 bp, Artificial Sequence
  Synthesized
  misc_feature (61): n=a or g
aagaaaaaccatgctgtaagcaggctgatctcataccagagttgtgcattgctctctaacntgatgttacctgaatgaaaaccctgaccagaaggaccggaggcatatctgccctatgggg

SEQ ID NO: 1835 - DNA, 121 bp, Artificial Sequence
  Synthesized
  misc_feature (61): n=t or c
accagaagtcctagcctctaagggaagaccttgcggtgctggttttccccttacctgtggngtttgggtgctgctatgcagcctgtgtggcctgggcctgtcccagcagcactgtggcagc

SEQ ID NO: 1836 - DNA, 121 bp, Artificial Sequence
  Synthesized
  misc_feature (61): n=t or c
ctcatttgtgagtactgctgaaatcctggccgcagcaacattctgtgacactgatttccanggcctaattaccacgtctaattctatggggaaaatgtgtttgtttcacctgtgaggtcct

SEQ ID NO: 1837 - DNA, 121 bp, Artificial Sequence
  Synthesized
  misc_feature (61): n=t or c
aaaggcaaaagaagtgccagctctttgccccaggtgaccctgagctcagtcagcaagcttnggagcagcatagctgttcctgtgctcagctgcttgattggtgcacggaagcccagccctg

SEQ ID NO: 1838 - DNA, 121 bp, Artificial Sequence
  Synthesized
  misc_feature (61): n=a or g
tgacagtcctgaatggcctcgtgtgctcatgagccacaactcactgcaggtcagcgcaacncagcctttgttagtttcacctcactgactgcgagcctcgtctgcatggggtgcacgagta

SEQ ID NO: 1839 - DNA, 121 bp, Artificial Sequence
  Synthesized
  misc_feature (61): n=a or g
agaccttttctggaagctgggcatttatttttgttgcttttactgcagctgtgactacttnacacaattggctcaaactccatactggtgagtgtgtttaaacatagtccccagtgggctc

SEQ ID NO: 1840 - DNA, 121 bp, Artificial Sequence
  Synthesized
  misc_feature (61): n=t or c
gaaatgtttctggtgatgaatgtaaaaaggtattttgtgttttgtggggcacgtggagaangtgggtgattcagctggaacgttttttttttaaagagtttgtctatgcagcttattcttc

SEQ ID NO: 1841 - DNA, 121 bp, Artificial Sequence
  Synthesized
  misc_feature (61): n=t or c
tctttggcagcccatgaaggagacccagcagtcatgtgcacaggtccagagctgacaacgngctgtggctgactttggagctttttgtatttttagcgttgctgatgacagagatactgac

SEQ ID NO: 1842 - DNA, 121 bp, Artificial Sequence
  Synthesized
  misc_feature (61): n=a or g
aactatgggtgttcttagaaacgcagataacaagtgaagcagtctatttcagtatagcccntgatcacaggaaggaggacctggatttcagaactgtgagagcagaacagctccaggcaat

SEQ ID NO: 1843 - DNA, 121 bp, Artificial Sequence
  Synthesized
  misc_feature (61): n=a or g
tgtcctcctttagcccaggtgtgggaggccggtgtttgattcctgggtcagtataacgctncataacctgtgtttgctctccaatctctccttctgttgtgttttcaggccatttgtgtac

SEQ ID NO: 1844 - DNA, 121 bp, Artificial Sequence
  Synthesized
  misc_feature (61): n=t or c
cccttgagtcagccttcatttttaacaggtggtccctcaaaccagaaactgcccatgcagncagaatgctagagctcaagctatgcatcttctgtcctactctgagtacttgagtatttgc

SEQ ID NO: 1845 - DNA, 121 bp, Artificial Sequence
  Synthesized
  misc_feature (61): n=t or g
ctgtcattccatttagtttaaaaactaggatgacactagcaatttacccaacactttaacntcctgacattttccatggactttttgcatatagtgcataaatattcaattttgatgtttt

SEQ ID NO: 1846 - DNA, 121 bp, Artificial Sequence
  Synthesized
  misc_feature (61): n=t or c
atgtgaggagcactttaagttggatttggtctgaaaaagtgagaccttgagtattttggtnaagcacaaactgtttacacatctaagaggggggagtacagggtaagttctgtgtttgttc

SEQ ID NO: 1847 - DNA, 121 bp, Artificial Sequence
  Synthesized
  misc_feature (61): n=t or c
cagtactgcccaagcaccaggcctcaacaagactgcactgatttcctattaagagatactngttcatttaaaagcaagaacatgaccatgaactgccatcttcaagtggggggagatgctc

SEQ ID NO: 1848 - DNA, 121 bp, Artificial Sequence
  Synthesized
  misc_feature (61): n=t or c
tattgtgctcacacagaaatgtgtttctgttgcactcagagaaacaaactgctggcaacangcagagatgactgagctgagtctcctgagctgcagtgctgtgcttcaggcacgacctctc

SEQ ID NO: 1849 - DNA, 121 bp, Artificial Sequence
  Synthesized
  misc_feature (61): n=a or g
tctgcttttacctggtcagtctggagaaggagaaatgagagaggatgggaaagagcacaangggaaggagaaggacgccttccgatgcacagcaccaaaattctggctatgggaggtgaca

SEQ ID NO: 1850 - DNA, 121 bp, Artificial Sequence
  Synthesized
  misc_feature (61): n=a or c
tttctttttaattttagaatatgaccaaactgaatgataatggtcccaactctggcttatngtagctcatgagtgtgcagttataatgggacatgactaacttgcccgcttcaaattcaga

SEQ ID NO: 1851 - DNA, 121 bp, Artificial Sequence
  Synthesized
  misc_feature (61): n=t or c
acagtggctgcaacaattctgggtttgtcctgcatgatcaagtacttccattccagtacancattaagttgaagaacttaaagtctgccttcaaaaccaaacagctgaaaacctgaaaatg

SEQ ID NO: 1852 - DNA, 121 bp, Artificial Sequence
  Synthesized
  misc_feature (61): n=a or g
tcagcacagggaaagcaactgtgcaaagagcaagcgtaggtcctcctgaaaaagaactgcngtttcatggagaagatttttctgagctttaagtaggaagaatctacacagcagaataaag

SEQ ID NO: 1853 - DNA, 121 bp, Artificial Sequence
  Synthesized
  misc_feature (61): n=a or g
tgagatcacatcagtatcttttaaattctcctggtttaaatgccttcggtgatgaggaacntggatgctgctctggtaatattggggttttgttgctgaagcctcgtggccagctgacatg

SEQ ID NO: 1854 - DNA, 121 bp, Artificial Sequence
  Synthesized
  misc_feature (61): n=t or g
ctcctgtagggctggacacacagctctctgccaagcagctgttttgacaagagttgctttngagagaagggaatagagcttcctcctcccagttctttctccactccagctgctttgaagc

SEQ ID NO: 1855 - DNA, 121 bp, Artificial Sequence
  Synthesized
  misc_feature (61): n=a or g
cacctgactgacagacatctcctgcctgtgcccaccagtggaggtagcggctggtggcacntgtccatggcacgtgggtgctgtaggagttgggctttgttgcccagctctgaggagcacg

SEQ ID NO: 1856 - DNA, 121 bp, Artificial Sequence
  Synthesized
  misc_feature (61): n=a or c
tgttctagtataagtaaactatccaagtactttaccagcaaaggacgctcacaccttctantttaatgtcatttcatcaggatcactgtagcgaaagaagcttcattgcatctaatgtttt

SEQ ID NO: 1857 - DNA, 121 bp, Artificial Sequence
  Synthesized
  misc_feature (61): n=a or g
gctgtattgccatgcatcctgcacaacctgtctgtactgcagtaagaagtttccaagggantgggagtggtatgacctattctaatggctattaacttcattgctgcaaaccatgcatttg

SEQ ID NO: 1858 - DNA, 121 bp, Artificial Sequence
  Synthesized
  misc_feature (61): n=t or c
atgctgtaagtaacaggctttctgtttttgccttagtgcactgccttaggcatggaaaaangagaagcacatatctcagttcagataaacttctcgtttagtatttgtttaaatcatgttc

SEQ ID NO: 1859 - DNA, 121 bp, Artificial Sequence
  Synthesized
  misc_feature (61): n=t or c
tgccatgctgcagaaatcccaacagcaattcaacaagaagaatgcaaataaggtcacatcntccctacaggactgcaggatgccctgagagaaagccatgtccttgttcgtcaggagtatt

SEQ ID NO: 1860 - DNA, 121 bp, Artificial Sequence
  Synthesized
  misc_feature (61): n=a or g
gtggctgaagggattacctagatactcaccagctttacaatgatcacagttgtgctggtgncactcctccttggtcatgcaggttttcagagaaaagttctatattcagtgtacattcagc

SEQ ID NO: 1861 - DNA, 121 bp, Artificial Sequence
  Synthesized
  misc_feature (61): n=t or c
agtggaactaagtattttgtctgtgacctgcactggtattttctatataattacagttctnccttcagttagaatttttacatagctacagttctgattctgctctgggagagggcttcca

SEQ ID NO: 1862 - DNA, 121 bp, Artificial Sequence
  Synthesized
  misc_feature (61): n=t or c
ctctgacaaaacgtctcctatcatttctctgcacagctggcattagccattcttgcagcangcagtggtcacaactgtcaccatttttaatggaagaggcaactgtagaacagggaaagta

SEQ ID NO: 1863 - DNA, 121 bp, Artificial Sequence
  Synthesized
  misc_feature (61): n=t or c
ttgttaatagctgaaatagttaaggagagcctaagcgcacacatttgaacaccatcacatngctaggagtgaacagccaaaagcagcagtgaaaaactacattcttctactgtcacaatct

SEQ ID NO: 1864 - DNA, 121 bp, Artificial Sequence
  Synthesized
  misc_feature (61): n=t or c
tcgctgccaccctcagtctcacatacagcactaaggcagtcagatggccctgctgggatcnctaccactactattatacatgtgaagagcatagaagatattgaaatttctaaaacctgag

SEQ ID NO: 1865 - DNA, 121 bp, Artificial Sequence
  Synthesized
  misc_feature (61): n=t or c
gtctctaaggagcactgtgaagagcaattattgtaagtacagttaagacagccttattttnctggaactcgtatttgccagctaaatagccagatattaacttcttttaaattgttcaaag

SEQ ID NO: 1866 - DNA, 121 bp, Artificial Sequence
  Synthesized
  misc_feature (61): n=a or g
tcatacattcaacctgttattttactgcagtgacataatcagaagcagacctagcagcatngaaagcactaagctacaagaagaaattcactcttttaagcagatagaggattgcacccgc

SEQ ID NO: 1867 - DNA, 121 bp, Artificial Sequence
  Synthesized
  misc_feature (61): n=c or g
ctaagttgagcttcaacaaatgtttaattggggctgaggtttatcatcaataaaattcatnacgctcgcctggctttgcttctaattggggatccataaactcccatcacctcattgcaaa

SEQ ID NO: 1868 - DNA, 121 bp, Artificial Sequence
  Synthesized
  misc_feature (61): n=a or g
attatgtgctgtgaataatcgaagaaatatgtcatcatggacatgtctgatatgaatcatnacttttactactgaataaattaacacagacatgctgtgaccttccagtctcagccttcag

SEQ ID NO: 1869 - DNA, 121 bp, Artificial Sequence
  Synthesized
  misc_feature (61): n=t or c
actgcaactccagtgcttcacaggaaaggcaatgaggaacaacatgaattcatacactctncacccacctatacctgccttttctgttttcttgtctcatgcatcagaacagagacaagcc

SEQ ID NO: 1870 - DNA, 121 bp, Artificial Sequence
  Synthesized
  misc_feature (61): n=a or g
ctttgggcacaaggaggagctgccctcagtgcaggaagcatcatgtgagggaacaccaccngtgtgcttccagcggagcggcacgagagccctggtaccggtgctgtctgaacacagaaca

SEQ ID NO: 1871 - DNA, 121 bp, Artificial Sequence
  Synthesized
  misc_feature (61): n=a or g
ggctggagacttgaaaatgaatcagatgaagctgagagctgaaaagctggaaggaatatcncagctggaatatgatgtagagggcaaggagaatacaatagaaagaccacataagagatgc

SEQ ID NO: 1872 - DNA, 121 bp, Artificial Sequence
  Synthesized
  misc_feature (61): n=t or c
cagttagaaagcagtaatttaaaaaaattactgaagctaataaaacgtgctggaaaatatnggtctgctttattaaaatactctggcatcattgttagattatgttaactctcctgaattc

SEQ ID NO: 1873 - DNA, 121 bp, Artificial Sequence
  Synthesized
  misc_feature (61): n=t or c
cacagaatacagacagaaagaaagtttgcattttgtcagtatgtaaacaagttatcacacncagatacaaactcaaatagtggtctttaaacattgttttgcaccacagagtcaatactga

SEQ ID NO: 1874 - DNA, 121 bp, Artificial Sequence
  Synthesized
  misc_feature (61): n=t or c
tcaaatgaccgatggctgaggcaaaaggaatcatctgtgcatgcatttttggagtatattnataagttttgaggatttttaatcaagtcttccgaagtggattatctgttcacattttcag

SEQ ID NO: 1875 - DNA, 121 bp, Artificial Sequence
  Synthesized
  misc_feature (61): n=a or g
tacttctttcctgcccgtcagatgtatgtttgacccatgcttctaaattaagtgacacaangagaaatccattcctacagctttccctgccctctttttctgcccattgtcgccagctgtg

SEQ ID NO: 1876 - DNA, 121 bp, Artificial Sequence
  Synthesized
  misc_feature (61): n=a or g
ttgctgtgtcatgcaggtggagaaactcatgtttaggaaactgctctgtgggatcttggcntgatgtaccatttctcgtgcacataactgtggatgctgcacggtctgttaaaaggaagct

SEQ ID NO: 1877 - DNA, 121 bp, Artificial Sequence
  Synthesized
  misc_feature (61): n=a or g
tgaatgtgtgattgggagcaagacggaaaggatgcacattgcctgggaacatctgataacnccgtgcccttcagagtttgcacgtcggtgaaggggcaggaggagcagggcttagaaataa

SEQ ID NO: 1878 - DNA, 121 bp, Artificial Sequence
  Synthesized
  misc_feature (61): n=t or c
taactgtattttcacctgtttttttttggtcaaaatttatgacaaataattactgtcaccngaagccatgtagtaggacagttttctgcagcctacaaatatccagtctgtgatagccttg

SEQ ID NO: 1879 - DNA, 121 bp, Artificial Sequence
  Synthesized
  misc_feature (61): n=t or c
tactaactccccagcccatattattctacctttaggtcaaatccagcagaagtttaccttngagggcattggttaagtaagattttcaatactcaaatccacttttttttttttgtcactg

SEQ ID NO: 1880 - DNA, 121 bp, Artificial Sequence
  Synthesized
  misc_feature (61): n=a or g
gagcttcaattttagccgatccgtgcactcgcacgctataaagcagcagcttacagtcccnctgactaattaggtccccagcttagaatattgattttggttttaaatgctacttttctcg

SEQ ID NO: 1881 - DNA, 121 bp, Artificial Sequence
  Synthesized
  misc_feature (61): n=a or g
atgctggcctgtttgctctggaagaactttcagccaaggtaaagcatgaaaaaatccctgnaaaagcctgaccttctcatgggctgttcccttggtaaccatcactttgctgtgatggtat

SEQ ID NO: 1882 - DNA, 121 bp, Artificial Sequence
  Synthesized
  misc_feature (61): n=a or t
aatcagcaaagtaaccaaaataaatggtgtgtttagccctggttgtatgtggctgtatggngatgcaaatggtctgttaacaggatgtcttctcaattttggtattatctccctgctaggc

SEQ ID NO: 1883 - DNA, 121 bp, Artificial Sequence
  Synthesized
  misc_feature (61): n=a or g
tgcagccctcagtgtaccactgctgctcctaacatccaacccacagggctgttcatgagcnctcctcaaaccaagcaaaaatgagccaaatcaacctaagcaacaggtctttacaacctcc

SEQ ID NO: 1884 - DNA, 121 bp, Artificial Sequence
  Synthesized
  misc_feature (61): n=a or g
ctctggaactgagagtttgccagcaaacagccacctgctatcacttgaagaacttaccctntagtttcagtgtaagagcaatccaaatatcctctagcagacattagccttaagagcatgg

SEQ ID NO: 1885 - DNA, 121 bp, Artificial Sequence
  Synthesized
  misc_feature (61): n=a or g
atgctaaaataagagcagaaatctctctgcaccagtagaacagcttatagagcctggcacncagctacacctccacaaactgcatcagtaatttggacgttaaattgcacagtaaaataat

SEQ ID NO: 1886 - DNA, 121 bp, Artificial Sequence
  Synthesized
  misc_feature (61): n=t or c
ttgacaaaattgacattcatggatcccagttctcttccctgctggttttgacttttgctgngtctttagtttagggtagaacagtggccatggaaatgctttgttattcatttcagaaaag

SEQ ID NO: 1887 - DNA, 121 bp, Artificial Sequence
  Synthesized
  misc_feature (61): n=a or c
ttacttcagacctgccacattctttattgttctttatgacaaactgtttgttctatcagtnagtgcataatataaatctcttggtaccatggtatttatacccactgatctacataggata

SEQ ID NO: 1888 - DNA, 121 bp, Artificial Sequence
  Synthesized
  misc_feature (61): n=t or c
tgcatggggagtagttaatctcttggagaaggcaaaggcttgtcattttgcatttttgttnctggtctgaagatagcaggaaatagcctggagggttacctgggggaagatgtccattcat

SEQ ID NO: 1889 - DNA, 121 bp, Artificial Sequence
  Synthesized
  misc_feature (61): n=a or g
gttgtccttgtgctggtcctgttttgggattgctttggaagttctcttggatgggtatacntgatgcttgactacttgcaaagaatgaggcctaagccacaggcaggaagggtatgtccac

SEQ ID NO: 1890 - DNA, 121 bp, Artificial Sequence
  Synthesized
  misc_feature (61): n=t or c
ctgtatctctggtgcagagaagttccttatctccccactctttgctcataagactgcttgntccttttttccttctaaaatcaggcaccttagagagaagccagttcaactggagtccctc

SEQ ID NO: 1891 - DNA, 121 bp, Artificial Sequence
  Synthesized
  misc_feature (61): n=a or g
agctccattttacattcccatctctttgtgcctcttgcctgatagacaagcaaaactgatncagaacatttgaatatcacaagatttcccctctgctaggtactcaggcaatgcttacatc

SEQ ID NO: 1892 - DNA, 121 bp, Artificial Sequence
  Synthesized
  misc_feature (61): n=t or g
ctgttggtaggtgttttcttgaagccactggtcaactcagcatcgacttctttaagaccanttggccatttttttctaattcactattagtcatttctcttttagtcaaaaatgggagctg

SEQ ID NO: 1893 - DNA, 121 bp, Artificial Sequence
  Synthesized
  misc_feature (61): n=a or g
gttgaatgcctgaagatggtcactactgacataaggactgtgttcccttcctgtgtgaagnaacaagtgtttcctgcctccttcccaacccatctgtaacaaacctaccactagagcagag

SEQ ID NO: 1894 - DNA, 121 bp, Artificial Sequence
  Synthesized
  misc_feature (61): n=a or t
atttgataattatatgaatacagttgcctattgcattccggctgttctgaatgccagaggnctcagctgtcacagtctggattgcaggtagctgggtgagctggtgggaactcttagctca

SEQ ID NO: 1895 - DNA, 121 bp, Artificial Sequence
  Synthesized
  misc_feature (61): n=a or g
tgcactctcttgtgatcgcctgagctacagaggtgcatggaaatcatagctatagataacntctggggttagtgggtatttgtcctgcaccctgggcctctctctgctttaggacctgtat

SEQ ID NO: 1896 - DNA, 121 bp, Artificial Sequence
  Synthesized
  misc_feature (61): n=a or g
cgatcctgctttagaagaacacccacagtcttctgtttttaaagatgccaggtccactccngaaacctttcacttctgaataagtaatctctttaaggaactgaaagaaaagaatgcagaa

SEQ ID NO: 1897 - DNA, 121 bp, Artificial Sequence
  Synthesized
  misc_feature (61): n=t or g
ctagtgtgtcatcagctcttgagtggctcacgctgtctgcacattacttatagaaatagangtctgtttctggggtagagctaacactgattacatttctagaagcagctctctgtggtct

SEQ ID NO: 1898 - DNA, 121 bp, Artificial Sequence
  Synthesized
  misc_feature (61): n=t or c
acacactgggcagccttgagcaacaacctgcttcctgcagggccgtggcctttgaaagaanggtgcttaaagctgcacagcacccagaaatcccagccgcctgcccatgctcctgctggga

SEQ ID NO: 1899 - DNA, 121 bp, Artificial Sequence
  Synthesized
  misc_feature (61): n=a or t
agccagactgtgacatttatcttggcatcccacgccaagacgtggcaggtctacacgcacnttttggcacacctagagatggaggcataattaggctaatttccttaatactgaaacgtaa

SEQ ID NO: 1900 - DNA, 121 bp, Artificial Sequence
  Synthesized
  misc_feature (61): n=c or g
ctgccctcgggccctccctcactcctcaataggcctctttcaatctttttgttttctgcanaatcttctgggaggccttgagtttgtattgaatcagaacagaaaaaaaaaaagcctaatg

SEQ ID NO: 1901 - DNA, 121 bp, Artificial Sequence
  Synthesized
  misc_feature (61): n=t or c
agttttcaagggaatggatttgttttatgctatcactgcacaagatgctgctgctcgctgnagcatccatcccttctcacttgatcaaaagaatggcttgagaattcaggagttagaggaa

SEQ ID NO: 1902 - DNA, 121 bp, Artificial Sequence
  Synthesized
  misc_feature (61): n=t or c
gagcatcacagcaaggaatagggatgttctgagcagttctgatcccagagctggtggtacncactgctgtgaccgctcctggccatgtcagtgcccagccccagggcactggggatgagtc

SEQ ID NO: 1903 - DNA, 121 bp, Artificial Sequence
  Synthesized
  misc_feature (61): n=a or t
atattcgttcctgtgcaggaagactacagagcaatggctgtctcagggatttctcctctcngagctttctggtgactggagagttgactgaaagtctcacattccccaccctccctttttt

SEQ ID NO: 1904 - DNA, 121 bp, Artificial Sequence
  Synthesized
  misc_feature (61): n=t or c
ggtgcagacttttttggcgaagaccagttctaatacagcatcatttcaaagtgccagtaanataaacttcagtgaatagaaagcaagttggatcttaggacagaataaatactatgaaata

SEQ ID NO: 1905 - DNA, 121 bp, Artificial Sequence
  Synthesized
  misc_feature (61): n=t or c
tacttgatcctgaggtaacacactaccaagtccaaaggtttgggttggtttttcccatgtntgaggaaactcaacgcatgtgaatccatttcagtaaaggtttgagttaataaaatctttt

SEQ ID NO: 1906 - DNA, 121 bp, Artificial Sequence
  Synthesized
  misc_feature (61): n=a or g
ttaatcggtgtgcgctaacttgtatacttgtgcagaagacaatgacaaagcctcagccccnctgctgtaacacaagagcagcgatgcgccgagaatcactgcctgacatccgcccgctgct

SEQ ID NO: 1907 - DNA, 121 bp, Artificial Sequence
  Synthesized
  misc_feature (61): n=a or g
aattggagatcacacagcatctcttttgttgtgtgctgtagccagtcccatctccaacccnaccagggaggccttaggctcagccaacaagaggacacagcactaagctagctgataactg

SEQ ID NO: 1908 - DNA, 121 bp, Artificial Sequence
  Synthesized
  misc_feature (61): n=a or g
cttgcagcactaagttaacaagaaggaagtccttaaaaagttaatccatgtggtactccanaactagacagaatagaaagaagcatcaagcatgaatgtacagcttcagggatagataact

SEQ ID NO: 1909 - DNA, 121 bp, Artificial Sequence
  Synthesized
  misc_feature (61): n=t or c
gcacatttttgtaaaaagcagggctacctgtaatcactgcgcagcgaatgccacatcctangactgtaactcagagagcttgatggcccaaaagcatgcttcccattaaaaacaccgccac

SEQ ID NO: 1910 - DNA, 121 bp, Artificial Sequence
  Synthesized
  misc_feature (61): n=a or g
aatgacactattctgcctcttccgcactcactgctctcttacctactcagagaggcacacntactcaggttccagcagttctcaagcacgacccaagctatttttcctggagctgttgccc

SEQ ID NO: 1911 - DNA, 121 bp, Artificial Sequence
  Synthesized
  misc_feature (61): n=t or c
acgaatatgctgtgtttgtgcagattcaggccagatggaattatattaaagcctacacgtnggggctaagtggaaaaacctacagctttgccttagactgcttgtggaacgtagtctgatt

SEQ ID NO: 1912 - DNA, 121 bp, Artificial Sequence
  Synthesized
  misc_feature (61): n=a or g
ttttgccagtaggtatttttttcaacatcagtcagcagtatattgcaatgtatatgttatngtatgttatagttaggacttctttttctgggtactgagctcagtaatacagaagtaggaa

SEQ ID NO: 1913 - DNA, 121 bp, Artificial Sequence
  Synthesized
  misc_feature (61): n=a or g
gaagggcagtgggtagctctgagaactggttcttttctgctcagtttgtgaatccagcccngccttaggatttagggaattttgccttgtgagttaggacataatctggttcatgagaggc

SEQ ID NO: 1914 - DNA, 121 bp, Artificial Sequence
  Synthesized
  misc_feature (61): n=a or g
agattccactgtcagtgataagtctgcagagaccagaatttgcaaatttattagctctctncttatttgtgggtaaaatattctcctgtgattcatcccatcacaggagaatgcttttccg

SEQ ID NO: 1915 - DNA, 121 bp, Artificial Sequence
  Synthesized
  misc_feature (61): n=a or g
actcaaagcaagcaaagaaactgggtgatttgtcactggagaaggaattcgctggctaccngagaactatctccatggtttcatttttgtcatgctggtattacagggaaatcatataatt

SEQ ID NO: 1916 - DNA, 121 bp, Artificial Sequence
  Synthesized
  misc_feature (61): n=a or g
tcagagctatatcatactgtacatattgtactggctgtttttttaagtaccttttacctgngcatatagataaaaaaatatgaatttttaaatatctgattgaaatacaagcaagtaaata

SEQ ID NO: 1917 - DNA, 121 bp, Artificial Sequence
  Synthesized
  misc_feature (61): n=t or c
agcaaaaggcaattccttgttgttgggtgagggcagaaagagcttgtgtgcattcaagccnccacaattgtggtgtgggaagctcagcttcatttgtacagtcccttcctgtgaaagagct

SEQ ID NO: 1918 - DNA, 121 bp, Artificial Sequence
  Synthesized
  misc_feature (61): n=a or g
tctgttgcttctagcacagtaatgagaacaggtggaaatgcactcagagagggatgctgcntttataggaaagaaagaagggcagacgattcagtgtgtttttctgttacaaagcaggatc

SEQ ID NO: 1919 - DNA, 121 bp, Artificial Sequence
  Synthesized
  misc_feature (61): n=c or g
tcttgcttagatcatatgggtaagtcataagaaaaccacttatctaaaacttctgcagctnagtagaaagtggagccaaattattcatattattgagtattcaatcatctgagctgtgttt

SEQ ID NO: 1920 - DNA, 121 bp, Artificial Sequence
  Synthesized
  misc_feature (61): n=a or g
aaaaaaaacgtttatgaaaatagatcattttggtcttctttggcattcagtatttttcacngagtaacaaagatgcattaaggtaccatcatctgcctggatgcaagcgctgttattcatg

SEQ ID NO: 1921 - DNA, 121 bp, Artificial Sequence
  Synthesized
  misc_feature (61): n=a or g
aaaaaaccagaagcccgcttcccagacagcctttctgggtggacaacgaagtgtagcaccntggtgcttcccgcatacactgtatggcgtcaaactgacttgatgaattcaaggaatgata

SEQ ID NO: 1922 - DNA, 121 bp, Artificial Sequence
  Synthesized
  misc_feature (61): n=a or g
ttagcagtggtgaagcttcgttcctccgcccaccaccttgttcccatgctggcgcccagcncacaacgcatctggacaacacgcaaggttggaggaacaccacgtaaaacttgggcagggg

SEQ ID NO: 1923 - DNA, 121 bp, Artificial Sequence
  Synthesized
  misc_feature (61): n=a or g
ctttgagtgatttatcacctgctggcatctccagataagctaacctgcttgcagtccagtngggttcgatgctttgtgtcaagttgctcctctttgcatggccaagataatgagatcttgg

SEQ ID NO: 1924 - DNA, 121 bp, Artificial Sequence
  Synthesized
  misc_feature (61): n=a or g
tgaacagggtgtttggttttgttttttttttttttcaggattgttccttaacgttgtcccnttactgtgatgtgaacttaaccctgcattttgcttggatcaccctacagccaaacaatca

SEQ ID NO: 1925 - DNA, 121 bp, Artificial Sequence
  Synthesized
  misc_feature (61): n=a or t
atctgctatggattctagtgaatatacaatgactggcttgttgcatttgagaaatactgtnttcttccaaacaggaggaaaatgttactttggcaaaatatgcctaggaagattattgatt

SEQ ID NO: 1926 - DNA, 121 bp, Artificial Sequence
  Synthesized
  misc_feature (61): n=a or g
gttctgcacagaccacgtgtctcctgcaggtgagactttgcacagcggtgtgtcccaggcncgggctctgagtatgtctcgcagtggttccttttggtgtttcgtgaagaagtttcaaact

SEQ ID NO: 1927 - DNA, 121 bp, Artificial Sequence
  Synthesized
  misc_feature (61): n=a or c
attatatggtcatagagtttacagcattgggagggatgactgtgattttctcctgtggccnttagggtcggaggcagctacaggtcacatctgacagggccctgctgcctgtgagtgagcc

SEQ ID NO: 1928 - DNA, 121 bp, Artificial Sequence
  Synthesized
  misc_feature (61): n=t or c
gggtctgggccagctgtcccatgggctgttcaaggacagggcttcatctgcttcccagggntcttggcgcgggaggatggaatttctgctcctggtctccataagcactgggtactggcag

SEQ ID NO: 1929 - DNA, 121 bp, Artificial Sequence
  Synthesized
  misc_feature (61): n=t or c
gagctgccctggctgccctgagactgtggggctgcagggagtgaaggctgctgaaaggttnctttccatcttcagggattcttttggtgagacggtaagcttggagggcctgaagtccatg

SEQ ID NO: 1930 - DNA, 121 bp, Artificial Sequence
  Synthesized
  misc_feature (61): n=a or g
cctgccctgcagggaaacgaggcaagatgagattgtgtttggttgatgctctttgattttnctgtgaaatttcaatgaccttcctagcacaaaaaagaaaacacgttcttttcatcgttgc

SEQ ID NO: 1931 - DNA, 121 bp, Artificial Sequence
  Synthesized
  misc_feature (61): n=t or c
tgttcgggaaggttcagagctttccatagatccagggcacaaagcaaggccttaccaacangctcactgtctgggaatgtggcaggagctgcagcagggctgggagcaaatccatagagag

SEQ ID NO: 1932 - DNA, 121 bp, Artificial Sequence
  Synthesized
  misc_feature (61): n=a or g
acaagaactctcgttcctgttccataaaacatacaaagtgcactctcttttctgaaagccnaatgtcctccaaaactttcttgaacaccagaggaaatgctgtaacttgtcttctttcagc

SEQ ID NO: 1933 - DNA, 121 bp, Artificial Sequence
  Synthesized
  misc_feature (61): n=t or c
ttattattttgataaatatttatcttgtaagctcagggcaaaatactgaagcaattacaantgagtgttttggaacaccagatccaccatttgtttcctatacttacaaaaagatcaggct

SEQ ID NO: 1934 - DNA, 121 bp, Artificial Sequence
  Synthesized
  misc_feature (61): n=a or g
gcatggtatatttagagttgtgccttctagctttaacaagtactcttagtgctttcggggnctgcttacatatgtaagtgttgggcaggaaataagcaaagagaatatttgaatgtcatta

SEQ ID NO: 1935 - DNA, 121 bp, Artificial Sequence
  Synthesized
  misc_feature (61): n=a or g
gagacagataaatccatgtttcagtctaggaaaacatttgtattaataacagcttaagtanggatgacttagtttggtgtcactacagattagtatttattgacctcaatctatcaagttt

SEQ ID NO: 1936 - DNA, 121 bp, Artificial Sequence
  Synthesized
  misc_feature (61): n=a or g
actgagagtctccaagagccgccagggtatgctcacctggtgcatactgttccaaaaagcntgctggagacttctgaggaagcagcaaaatcactggatccattgagggcagccaaaaact

SEQ ID NO: 1937 - DNA, 121 bp, Artificial Sequence
  Synthesized
  misc_feature (61): n=t or c
gagaataacaataggagaattacaagagaaaaagaagagatgatgaggagacaattaaacntgcagggaattactatgtttagagatctgtctctgctggaagagatagggagtggtggtt

SEQ ID NO: 1938 - DNA, 121 bp, Artificial Sequence
  Synthesized
  misc_feature (61): n=t or g
cagtaacaaaattttcaaacatttatgtttacatttctgcacttcacctttccagaagccnttgaaaagcaggagcaccgtcacgctgtcacaccgagcacgacctcagccacaccaaaga

SEQ ID NO: 1939 - DNA, 121 bp, Artificial Sequence
  Synthesized
  misc_feature (61): n=t or c
cagccagactcccgcaactacagtcaaagaggttggagagttttgggtggtagtgaatttnttctcctttttaatttctaagacatgatgcttactgaggagaaagttatggctgaagctc

SEQ ID NO: 1940 - DNA, 121 bp, Artificial Sequence
  Synthesized
  misc_feature (61): n=a or g
cagctcagagctccaccagcaccaccagaacacgctaacacaacagctattccttccccancaagatgctacgtaacttcagtgcattttttcaggtcaggcaatagaagctttttaatat

SEQ ID NO: 1941 - DNA, 121 bp, Artificial Sequence
  Synthesized
  misc_feature (61): n=a or g
acacagtttttaaacagaagtaatactcgtgtgaataatatggggagattggagcataacnttctgcgctcaaatgtaatcaatcaggacttcagaaagctggttgcctttatcatcactg

SEQ ID NO: 1942 - DNA, 121 bp, Artificial Sequence
  Synthesized
  misc_feature (61): n=a or g
aacagtagcatctctgatgttacagcatgataaatccatctcttttcctaatgtagccccnatgttaaccagaaccatggagtcagtcataaaaacaagatcaaacccacatctacatagc

SEQ ID NO: 1943 - DNA, 121 bp, Artificial Sequence
  Synthesized
  misc_feature (61): n=a or g
gcattgtagacagttttcatgaaagaccaagctgaaattggaagaacacaaagaatcgttncatcctttcaacacactccaactctctctcaaggcagctattttcagattatgatcctta

SEQ ID NO: 1944 - DNA, 121 bp, Artificial Sequence
  Synthesized
  misc_feature (61): n=a or g
aatgggataaataggtgtttgctgtagggtatgataaacattgatacatacatatgtagtntaaaggtctgcattccactcagaatactccttagaggccattcagtcctaaacccgtgca

SEQ ID NO: 1945 - DNA, 121 bp, Artificial Sequence
  Synthesized
  misc_feature (61): n=a or g
cctatgaaatgccaagcagtttaactctcaagtttctgtagctttagacaggaaaattacnttttaaataacgcaaaggtggtgatgtccaccaggcaaggacaggaaattcatagttagg

SEQ ID NO: 1946 - DNA, 121 bp, Artificial Sequence
  Synthesized
  misc_feature (61): n=a or t
aacagataactcagtttcctttctaatgcatatttttctgtaaaatgcaactcctgagacngggcagaaccataacacatatcacttccgtgatcattcatggaagttttgcagggtcttg

SEQ ID NO: 1947 - DNA, 121 bp, Artificial Sequence
  Synthesized
  misc_feature (61): n=a or g
aataggtcacagctgaaagtctgcttataatggcaatttggctgtcagtgagacagactcntgcatttaaggaattaggtagcactggtcaatagacttattattgtttgtaagtattttt

SEQ ID NO: 1948 - DNA, 121 bp, Artificial Sequence
  Synthesized
  misc_feature (61): n=t or c
catttaattcttgactccagtagtaactggaaacactgacagcaatcaatctttctgtctngaccaggcattaagtaacattttgatttgtggaatacttggaagacatgatttggctact

SEQ ID NO: 1949 - DNA, 121 bp, Artificial Sequence
  Synthesized
  misc_feature (61): n=a or g
ccatcatttggggaccaggctgcgttccattagcaagccctcatcacttaaactagcacanatagaagactactatattttgaaaataaacgatacacagaaatttcacctccaaaccagg

SEQ ID NO: 1950 - DNA, 121 bp, Artificial Sequence
  Synthesized
  misc_feature (61): n=t or c
ggccgccctaaaacactgctgggctacaacttgaagcctttaggagcctggaagatgcagntcataaatgcttgaggtacaggactggcataggtcatggggcaagagggactgtgttaaa

SEQ ID NO: 1951 - DNA, 121 bp, Artificial Sequence
  Synthesized
  misc_feature (61): n=a or g
aacatttatctcacagggaagccaagaacagtacgttttcttgcaagtgatcttatcaacntttatttttagaagcttttgtcattgctagatgctccacttgtggcaataggcagttttg

SEQ ID NO: 1952 - DNA, 121 bp, Artificial Sequence
  Synthesized
  misc_feature (61): n=a or c
acaaaagactggattgagtgggtatcacagctgtgcacacacaaacgtcactacagtccanttgcaaataaccccccttcaagctgaacagaaataattatatgaactgctttgaaataaa

SEQ ID NO: 1953 - DNA, 121 bp, Artificial Sequence
  Synthesized
  misc_feature (61): n=t or c
gaacctcgcaggaatcctgcacatcacatgaaccaagctgcatgctcaattgccaagaagngttcgtattaacgtcaggctggaggtgcagagtactcatacatacttgagtcattaaata

SEQ ID NO: 1954 - DNA, 121 bp, Artificial Sequence
  Synthesized
  misc_feature (61): n=t or c
ccactggagaaagacaggatatctttcaaagtaaaatacgctctaatctctgtctaacacntgaattcctgacaagcctttgcactttttgtcctaacatggtgttcagatgttcccagat

SEQ ID NO: 1955 - DNA, 121 bp, Artificial Sequence
  Synthesized
  misc_feature (61): n=c or g
tgaaaacagaccaacgagttacttgaaattaccctctcagtatcactagtaggcaatcatnaaaaataaaatagctagtaaggctccattttgtcatcccagccatattagagaacaattg

SEQ ID NO: 1956 - DNA, 121 bp, Artificial Sequence
  Synthesized
  misc_feature (61): n=t or c
gttgggaatattttccaatgaatgtcccagatggagagctcttatcgatgactttgaggangctctggtgttcatttgtaaaatagctttattattttcagctagatgaattactagggga

SEQ ID NO: 1957 - DNA, 121 bp, Artificial Sequence
  Synthesized
  misc_feature (61): n=a or g
ttttccaatactcattcagtaaggtataagtggaacatgtatataggatttattctcattnctagagatggagtgttccttcgaggggttacgaagacttgcagcctttaaactttgacag

SEQ ID NO: 1958 - DNA, 121 bp, Artificial Sequence
  Synthesized
  misc_feature (61): n=a or g
aaggcctttaggtgtgtgtgcagcaggcagactttttgtagaagtcctgcaaccgaggtgnagagttcttcagtcttttagaagcagctgtgagggatttaaaaagagagttctcatttca

SEQ ID NO: 1959 - DNA, 121 bp, Artificial Sequence
  Synthesized
  misc_feature (61): n=c or g
gaacaagccctgctgctgttagtgagccacactgtgaatctaaaagttcagaagctcaatncaagctgcaacactcaataagtctctggccatatattagagagctcatagtaaaatatga

SEQ ID NO: 1960 - DNA, 121 bp, Artificial Sequence
  Synthesized
  misc_feature (61): n=t or c
agagacctgtgtgtggtgggacctgcagtgaggcagggcagcacaacagatctgctgctgngcaagcattccctcttcctgcctacaggtccaacaccctctcccaaggtaccctcccata

SEQ ID NO: 1961 - DNA, 121 bp, Artificial Sequence
  Synthesized
  misc_feature (61): n=t or c
tatttattttaaagcagataaataaatagatgaaaacactgatggaggacacactgctgcnacatctatgctgtcactggacagttcttggtggtgggggaactgtacttggccaccaagg

SEQ ID NO: 1962 - DNA, 121 bp, Artificial Sequence
  Synthesized
  misc_feature (61): n=t or g
gcttggcttcataatggtaagaagcacacctgcattcgtagcaagcttgctcagtttttantatcagcaccttgcttatagcctgagtttatctcgctgcacttcctaatccctccatctt

SEQ ID NO: 1963 - DNA, 121 bp, Artificial Sequence
  Synthesized
  misc_feature (61): n=a or g
ggggtgagtgttagtccaagtaaatagctggtcatctcagagtggtgtagctgtgacagancccatctgcagctccgtgccatcagcaggaagctctgtgttcgggaggagtgcgctgtgc

SEQ ID NO: 1964 - DNA, 121 bp, Artificial Sequence
  Synthesized
  misc_feature (61): n=t or c
cacttcagtttgctttgaactgtaacctgcccaggaccccagttttatatctcctttcccnagtttccatcgagaacaaccctaccgaagtcagcaaaaaatgaacaagaacagagaatca

SEQ ID NO: 1965 - DNA, 121 bp, Artificial Sequence
  Synthesized
  misc_feature (61): n=c or g
cacagcttgctgtttgacatgatgtctccctaagaagatgcaccaccctggggggcagagntgtggtgaagtgactgtacattcctcagcaatcatacttaaataaaacaacttaagagtg

SEQ ID NO: 1966 - DNA, 121 bp, Artificial Sequence
  Synthesized
  misc_feature (61): n=t or c
cccttttttgatgatgaagacactctgcatccttagttactttcttctcatgattcctttnaagttctcctccatacaagtttcacccaattgacagcaatggctcaggagcttcacagtg

SEQ ID NO: 1967 - DNA, 121 bp, Artificial Sequence
  Synthesized
  misc_feature (61): n=a or c
ccaaagctgggaaaagacttagtaagggtgtttatggttatggcaggccaaacggggatanaattttcctcttcaatctttaacacatgtaaatagagcagcgctgagaagagtttctctg

SEQ ID NO: 1968 - DNA, 121 bp, Artificial Sequence
  Synthesized
  misc_feature (61): n=a or g
gcttgggccaccacgccctgcggccaattccggcattatagtgcctttgccactattaaancataaataataattttgcagagataaaaacagcatgttcttgtccctccttgttcaggtt

SEQ ID NO: 1969 - DNA, 121 bp, Artificial Sequence
  Synthesized
  misc_feature (61): n=t or c
gaagcagcagcacaggtttcaggatccagggatggcagacctgggtgtgggctcataggantgaagaagggataggctgtgctcctgtagcctcactgcagaagcagcactgctatctccc

SEQ ID NO: 1970 - DNA, 121 bp, Artificial Sequence
  Synthesized
  misc_feature (61): n=a or g
aaatggggctgtgggctgggtgatggcagccctgtaacctgtggtctgctgagagacctcncttctgatccgccctgacttgttgggctgaattcatgttgtcatcatgttggtgtggctt

SEQ ID NO: 1971 - DNA, 121 bp, Artificial Sequence
  Synthesized
  misc_feature (61): n=c or g
ggcagatgagggataggatgggatgtccttcacttggaaggttcattacaggacgaatccnttagaaaggctgtgggacagtgcagctccagtgcatcaagtacaggctaggaaccagcat

SEQ ID NO: 1972 - DNA, 121 bp, Artificial Sequence
  Synthesized
  misc_feature (61): n=t or c
acattcctggtcttctctgctacctaatggggaatttcaggtgcctgtgcttccacccaancatctgacaatatgcataatattaacaagatgaaatgacatcgagcctttacttttcaga

SEQ ID NO: 1973 - DNA, 121 bp, Artificial Sequence
  Synthesized
  misc_feature (61): n=t or c
cccaatccttgtgtccaagaccaccacatatgttaggaaatatttaaacagctgaataggnccccagaacatgaaatatcctaattagtgtagttactcaatccacctcaatcccagagtt

SEQ ID NO: 1974 - DNA, 121 bp, Artificial Sequence
  Synthesized
  misc_feature (61): n=t or c
ctcagcagtccccatacagggagcatgtggctacgtcctgccttggactgttcttttgaanttccctccatgaagccgcagcggtttgtaagttaaaaccctccaggtctttcacgttagg

SEQ ID NO: 1975 - DNA, 121 bp, Artificial Sequence
  Synthesized
  misc_feature (61): n=t or c
tattttcagagggatctgccctttgtgctgcttgcacaaaactaatagacccaagtgaaanaatccagctcctagaggacagcctgctcgtcgtggtcccattaatgaggtggtttacttc

SEQ ID NO: 1976 - DNA, 121 bp, Artificial Sequence
  Synthesized
  misc_feature (61): n=t or c
gagcatgtggtgctcagacactggtgcatgcaatacctgggcaagaaccctgctgcatctnagaaaaaggatgtgattcagggtggtcctggtcctaccctcaagccctcaaagactaaat

SEQ ID NO: 1977 - DNA, 121 bp, Artificial Sequence
  Synthesized
  misc_feature (61): n=t or c
gaatgaggtgtatcctttgttctggattttaggtgttctcagaacatgagggcagttgttncagaaagtattcaggtgatgtttgggctcggtaaccttgttgtgtatctattggtcagtt

SEQ ID NO: 1978 - DNA, 121 bp, Artificial Sequence
  Synthesized
  misc_feature (61): n=t or c
ttcagcctgtccaccgagaactcagggtgctaaatactggatcactttttaatgaggcatntacagcaaagcatagatatttccccaaccattctcaggctatggagaaatgaatgactgg

SEQ ID NO: 1979 - DNA, 121 bp, Artificial Sequence
  Synthesized
  misc_feature (61): n=c or g
gaaatgcaggaaacagttgagagacttgcgcagaactagttgtgcattcaagtcctgcttntttcctatacctatccttttggggggttctttagccttctgtttcctttaggagatgagg

SEQ ID NO: 1980 - DNA, 121 bp, Artificial Sequence
  Synthesized
  misc_feature (61): n=a or g
tcctgttttccaggctggaagggagagataagggagataatacaggcaacgtttcactacntttctggagatgtccaatattcagactttctctgctcatcaagatttttgcctgagactt

SEQ ID NO: 1981 - DNA, 121 bp, Artificial Sequence
  Synthesized
  misc_feature (61): n=a or t
tcagcttctctttcagaaccttccagaccgtatatccagaacatgggcttgcctgagcagngagacgttttccatggaggcactgaaatccctctaggctttaaggacttgggtgccagct

SEQ ID NO: 1982 - DNA, 121 bp, Artificial Sequence
  Synthesized
  misc_feature (61): n=a or t
gactttcaggatgtggcttttagtgcattatgctctgtaagtcaatgacaacaacttcagnctccaggttgcccaagaccactgcaaagtcatcatggaggttgttaatgtccaagtgtgc

SEQ ID NO: 1983 - DNA, 121 bp, Artificial Sequence
  Synthesized
  misc_feature (61): n=a or c
caagacacaggaagtgatggacaagtgacctacagcttggaagcagagtctggcaaactcngaggactcttcaccattgatggagagaccggatggatcactacactgaaggagctggact

SEQ ID NO: 1984 - DNA, 121 bp, Artificial Sequence
  Synthesized
  misc_feature (61): n=a or g
ggtgtcagggaggtgtcccgtccctgggaggttggcacaaagcttctctgatgaaccccancaatggatgcacagagggcactgggacagctgaaggggtgaaacaccattcctgggaggt

SEQ ID NO: 1985 - DNA, 121 bp, Artificial Sequence
  Synthesized
  misc_feature (61): n=a or c
aaagcctgagcaccctacgcacactctgaacaccccaagatctatctccattatgctcacncctctgttggagtctaagccccaccgctccccctgcctgctgggaaccagagggttttca

SEQ ID NO: 1986 - DNA, 121 bp, Artificial Sequence
  Synthesized
  misc_feature (61): n=t or c
tcaattttcttctctttcctgaactgtgctttattagcacaatcatcatagctattgtcanagaaaggaaaatagcgctcaagatacatctgccctgagactactctagtaatttaattgt

SEQ ID NO: 1987 - DNA, 121 bp, Artificial Sequence
  Synthesized
  misc_feature (61): n=t or c
cagggtgcacaaggtggggtgctggctttattcctctgggagaggaacctgcactactccngttgtgcgtacatcagttggtgaactttgagtgggctctgaaatagaccaattcctcccc

SEQ ID NO: 1988 - DNA, 121 bp, Artificial Sequence
  Synthesized
  misc_feature (61): n=t or c
acaagatactgcatttcagtatttgaagtctgttactgaccactgttagcacaaacctccngcgctggtatcaagttattcagtgaagtatcaaagcccagccctagctctactgtatgat

SEQ ID NO: 1989 - DNA, 121 bp, Artificial Sequence
  Synthesized
  misc_feature (61): n=t or c
gcaatgcagagaagaagccgtgctgctgacaccccgataacagccagttatcacacctagnaaggctttctactgagtcttttcttcagccctgggcaaactgggtacagcagaaaagcac

SEQ ID NO: 1990 - DNA, 121 bp, Artificial Sequence
  Synthesized
  misc_feature (61): n=a or g
gcaggttgccttgtatggcttctaaaaattcccttcttcgtgcctccagttggtgtagagncgaccagttttgttagtgacaatttgcagaatgaaatgcccttattttttaatgttacgg

SEQ ID NO: 1991 - DNA, 121 bp, Artificial Sequence
  Synthesized
  misc_feature (61): n=a or g
ggttatgctacactggaggccacaatccactgaaaatcagtgtttcctctttaaaagtganggtattttgccagttcagcctttcattagtgctcaggaagggaattatttttgcaatgat

SEQ ID NO: 1992 - DNA, 121 bp, Artificial Sequence
  Synthesized
  misc_feature (61): n=t or c
actgtctgctctgatgcatttgatggattctcagtagtgttgctgtctcctgtgtgtcctngatatctttaattacacattgttctttgtttactttgtactcacgaggccacattatatt

SEQ ID NO: 1993 - DNA, 121 bp, Artificial Sequence
  Synthesized
  misc_feature (61): n=a or c
ccgctcactgccagttagatgtgaacttagcccagcttgtctgaaaaggttcatagactcngaaacttcagattcctgggccaactcaaacagggtcttagctgaaaagaaaaacaatgca

SEQ ID NO: 1994 - DNA, 121 bp, Artificial Sequence
  Synthesized
  misc_feature (61): n=t or c
acccccattccaggctttctttgccccttttcaatcaagtgatcagatgaaaagtggtacntaaaacctaactagagcttccttccctcctcccctcaacagctaaatttctgtgtgttat

SEQ ID NO: 1995 - DNA, 121 bp, Artificial Sequence
  Synthesized
  misc_feature (61): n=t or c
ggggatacagcaggcacagcaggcacagcaggtctgcctgtgagagcacagagcaacagcngaaccctgcccatatttgtccccatctgaccctgctcacatatttgcaatggcctgtctg

SEQ ID NO: 1996 - DNA, 121 bp, Artificial Sequence
  Synthesized
  misc_feature (61): n=a or c
tccaagccaagcccagtgtcccagaaggagtagcagaggtaagagctcactgttgcacacncttggttggatgctgacccaatgatgccttgctctgcacgcgctggctgagttaatgcag

SEQ ID NO: 1997 - DNA, 121 bp, Artificial Sequence
  Synthesized
  misc_feature (61): n=a or g
agctgctagtttgtcatagtaaagaagcacacacatttgagcctgttccattgagataacnctggtctagtgcttacacttgcctagaccaacacgagtagtgtagatacgtgtgcagtag

SEQ ID NO: 1998 - DNA, 121 bp, Artificial Sequence
  Synthesized
  misc_feature (61): n=a or g
gtagcactataatagaattataagcatcattcttgctttaaagtctttcaaaacagacatnaaaggatccaaggaacactagcacaagacctccagaaaagattactactaaccatacagt

SEQ ID NO: 1999 - DNA, 121 bp, Artificial Sequence
  Synthesized
  misc_feature (61): n=t or c
taggtcccaccatcagacgtggatatataggcgatattacatattctgtttaatgctgtangcttacattaattaccactcagaataataaaaactttccattttacagtgacatttattt

SEQ ID NO: 2000 - DNA, 121 bp, Artificial Sequence
  Synthesized
  misc_feature (61): n=a or g
attttttttccaaaagcactgaacaattttggttgtatccgcttcattaggggaaaagacncatcgaatatctgaccctagagcctttgctttctccagatgtttgctttgcacacgaata

SEQ ID NO: 2001 - DNA, 121 bp, Artificial Sequence
  Synthesized
  misc_feature (61): n=a or t
cagatgacaaaagagtgcttcctaatagagattctatctgtgcaaatccatctcttccagntcttcctcttccctcttcagaaatccttcctgtggaagaccttttacaaggaagagggta

SEQ ID NO: 2002 - DNA, 121 bp, Artificial Sequence
  Synthesized
  misc_feature (61): n=a or g
ctcctttggcacactgaaatcaaagcccctcaccatgaaccaggctggagccccaaatctncaaaatctttagggaagtactaatgcattgtgtttaattgggatggatttaagcatgtgc

SEQ ID NO: 2003 - DNA, 121 bp, Artificial Sequence
  Synthesized
  misc_feature (61): n=t or c
caattgctgtcactggttcatttgctgctttcatgttcagtccccttcccatgtggattantctgctgtgcctttttatacagtaatgaccaagtcttttcttgttcttaaataaggagat

SEQ ID NO: 2004 - DNA, 121 bp, Artificial Sequence
  Synthesized
  misc_feature (61): n=a or t
acagaagaaaggcctgcattataagaatattgcttaaaagcgtgatcagtctggtagttcngagtgtgaggtgtgtgtgtcggctgataaaatccaccaggatgtttgtgtactgcgttgg

SEQ ID NO: 2005 - DNA, 121 bp, Artificial Sequence
  Synthesized
  misc_feature (61): n=a or g
tgaaagctgtacccgtagtttctgtttttcttagagaaatagaggatctcctagcgatacntatatccacatcctggtgataagcagagaactttgtttgttagttttcattcccaccttc

SEQ ID NO: 2006 - DNA, 121 bp, Artificial Sequence
  Synthesized
  misc_feature (61): n=t or c
tctgtggttggtttctgggtttttttttttagaaaatccctggtctctctggatctggacnagtgacattaagaatgcagggacagatgccaccatctttttccagatttatggagacaaa

SEQ ID NO: 2007 - DNA, 121 bp, Artificial Sequence
  Synthesized
  misc_feature (61): n=t or c
cgtcagcatcttgaacgtggtggttttgcccgctccattgaagccaagaaggccaaagcantcccctttgctgactgccaaagagatcctgtccactgccagcagggattcccggctgtca

SEQ ID NO: 2008 - DNA, 121 bp, Artificial Sequence
  Synthesized
  misc_feature (61): n=a or g
acttttgggatcggggagggcatcagggagcttcttgcactcggcgcagaacttgaaggtntcctccatcttctggaacatgtcgaagtaagtccggatgccgaagtcactgcctttcttc

SEQ ID NO: 2009 - DNA, 121 bp, Artificial Sequence
  Synthesized
  misc_feature (61): n=t or c
ttgttttgtaattttatcatcttggtatgtggtttgcaagtatttctggtgatttctaacngtgattttcttgtgttaagtcagtctctgcattttcgttttccttagacactttggatct

SEQ ID NO: 2010 - DNA, 121 bp, Artificial Sequence
  Synthesized
  misc_feature (61): n=t or g
gggagacatgctggagtatttaaccacttctatgcacatcagcacgcttactgcttgcacnggtgcacgggagccctctgtgaatgtatgaactctcactttctcttgtagaacttcatga

SEQ ID NO: 2011 - DNA, 121 bp, Artificial Sequence
  Synthesized
  misc_feature (61): n=a or g
tcttctcattggcaagggagagagagagagagaagcaggttactttaaccagttaagcaangggatcgctatggaatcacccatgggtgaaacatgacatatgtttaataggtaatggaaa

SEQ ID NO: 2012 - DNA, 121 bp, Artificial Sequence
  Synthesized
  misc_feature (61): n=a or t
agacaaaatgtgttctgtcatctacgacaggacacgtgtacacgctttttggaaaggctgngaaaaggcactgcaggatgttccgggatcagtaatagaatgcagtgattttactgctggg

SEQ ID NO: 2013 - DNA, 121 bp, Artificial Sequence
  Synthesized
  misc_feature (61): n=a or t
aaaaacaagaggatgagcactggacatatcaataagaaattaaaattgttttcccgaaacngtagatttgtgcagctggccttttcagaaagggcttcagccagacactgccaactggtat

SEQ ID NO: 2014 - DNA, 121 bp, Artificial Sequence
  Synthesized
  misc_feature (61): n=t or c
aaaggcaagatgatgcacaacccctccttgcagccgctgaaacgtgggccagaagtactgntcagtgttctgatctcaggctgagctttggaaaccagggatgaagcctcttctgagctga

SEQ ID NO: 2015 - DNA, 121 bp, Artificial Sequence
  Synthesized
  misc_feature (61): n=t or c
atgcagctagcacagcaaactgccaaacaagttccagtcaaaccccaatgcattatgcaangcaaattgtattacttctatcgccaaagcaatgatgttgctttttcttctttaataaaca

SEQ ID NO: 2016 - DNA, 121 bp, Artificial Sequence
  Synthesized
  misc_feature (61): n=t or c
aaaagcaggcgtcagcaaaagcggcaatgaattggtactactggagcaagagcgaagcaanccagccttgcaggtttcctttaccaaagccatgactgatagcacgtccatctccttgctg

SEQ ID NO: 2017 - DNA, 121 bp, Artificial Sequence
  Synthesized
  misc_feature (61): n=a or g
gggtagtggagatgcagagatttggggcagttagcgcagaagacttctccttcaaaggaanagcttccccagagaataatttggacgatcccgacctggagggctgcacagcagagcaagg

SEQ ID NO: 2018 - DNA, 121 bp, Artificial Sequence
  Synthesized
  misc_feature (61): n=t or c
aaaaaaaacccagaagatgtaagcaggaaaaatacactactgtcttacactactgaggatncaggagtgacaaaaacacaactgaggttcctcccatctacagaggacaaaatagactttg

SEQ ID NO: 2019 - DNA, 121 bp, Artificial Sequence
  Synthesized
  misc_feature (61): n=c or g
cttacaaaagcaccacatcagataccataagcacaacccatacccttgcacactctgaaanagcacaaatagcagtttattgggcttcagaaaggatctgttctgggccaggtggaaatac

SEQ ID NO: 2020 - DNA, 121 bp, Artificial Sequence
  Synthesized
  misc_feature (61): n=a or g
cttcagttctgaaagtgtttggacctctgattttgagtacacaagccccaagcggtaagtnttatatccacctcaggtgcacgtctcgcttagatgtctgttatggaattgctggagaaca

SEQ ID NO: 2021 - DNA, 121 bp, Artificial Sequence
  Synthesized
  misc_feature (61): n=t or g
atctctgttataaattgacctgatatcttacactttaaatgaggaaaaggattagcataantaggagcggatctggaaaggataatattttctcaggtagaatcccgtatagattctcagg

SEQ ID NO: 2022 - DNA, 121 bp, Artificial Sequence
  Synthesized
  misc_feature (61): n=a or g
cttttctgattgttttacgtgttttgggaaggagtgcacaatagctaaatgcatgttttcnctgttagttttgtagggaaagaatatagggatgaaatgctcatgtgcctgagtatcccat

SEQ ID NO: 2023 - DNA, 121 bp, Artificial Sequence
  Synthesized
  misc_feature (61): n=c or g
tgcccgagctacaaactttctgatcccacttacctcaaaaatcagcatttttagcttcagngttgctgatttccagctgatgctgtcaaatatggacaaggcaatgttccccctggcaggc

SEQ ID NO: 2024 - DNA, 121 bp, Artificial Sequence
  Synthesized
  misc_feature (61): n=a or g
ccgagattaaaggtgtgggacaaagcccggggacaaaaccccatggggttttgtgtcaccntgtgccactggtgacaaactcagtgacggatggagcagtgtctgtgaatgaccagccatc

SEQ ID NO: 2025 - DNA, 121 bp, Artificial Sequence
  Synthesized
  misc_feature (61): n=t or c
gagcacccaccgcaacaaagcccagcaaagcatcaaggactaatcagggaaatggatgtgngagcagctgaccagttcctctttcagagccctcagctgtcattttcactcgctcctgtgc

SEQ ID NO: 2026 - DNA, 121 bp, Artificial Sequence
  Synthesized
  misc_feature (61): n=a or g
acccctgctcctgctgcaggtcctagccctgcaagcagctcctagaggcacacactatctntgtgtgcacacaagagcaattccttctcatcactgagaagccagagctccagttgaaaac

SEQ ID NO: 2027 - DNA, 121 bp, Artificial Sequence
  Synthesized
  misc_feature (61): n=c or g
tgcaaagcccctgcaccacacaggaggatcacagtgtctctgtgcatcagtcatgccccangaagtagagcccacactctgctgtaaggagggccctgacagccccgaagagctgccctgt

SEQ ID NO: 2028 - DNA, 121 bp, Artificial Sequence
  Synthesized
  misc_feature (61): n=a or g
agcacaaggctgtgcaggtttctgtgctgatgctgggtttgtctggcaccagaaacgcagnggtggagtgagggagtggtaggattgtgtcctggggaagcaatgcctattacttctgctt

SEQ ID NO: 2029 - DNA, 121 bp, Artificial Sequence
  Synthesized
  misc_feature (61): n=t or c
gttcattcataatatttgttctaatctctaagacactgtcggccctgatcccattgtccangctgtgattcaacacagaatcatatattcatactgaattgcatattgaatgccaagtgaa

SEQ ID NO: 2030 - DNA, 121 bp, Artificial Sequence
  Synthesized
  misc_feature (61): n=t or c
ccaagccagcttgggctcacagctttgtgttcctgtgctgccctctccaagaagaatgtanttaagctctggtttctcagtgctgttctgaccagtcatctgttttggctgaggatggagc

SEQ ID NO: 2031 - DNA, 121 bp, Artificial Sequence
  Synthesized
  misc_feature (61): n=a or g
gaacagctttatagatactgtcttgttcattattctgaaaggaaaacctgggggaacaacngatgaacctctgaccagaaaatcagtatgaggatctgctggccttgctgggggtattttc

SEQ ID NO: 2032 - DNA, 121 bp, Artificial Sequence
  Synthesized
  misc_feature (61): n=a or g
tgatgggatgcacgaggatgggtggcagccagaaaccaatcacagaactgagaggagttcncagcagcggtggttcccattccaatattttatctccaagacccttcatattttaggttgc

SEQ ID NO: 2033 - DNA, 121 bp, Artificial Sequence
  Synthesized
  misc_feature (61): n=a or g
gcacatttatggggagaaattcttctgaaataagagaaaaaacatctgccgagtgtccatncatgtgaagtcgggtcagctgctgaagatgcacctctgggaggactcatgtgtgcattct

SEQ ID NO: 2034 - DNA, 121 bp, Artificial Sequence
  Synthesized
  misc_feature (61): n=t or c
ctcaaacgtacaaatttgattaagtttcctcctaagacaaggatattacttttccattttncccctagtttatgaaaatttactcaatggctgatactggaaggatctcagaacagaacca

SEQ ID NO: 2035 - DNA, 121 bp, Artificial Sequence
  Synthesized
  misc_feature (61): n=t or g
gatcaggatccagtgctggttttatgtgtcagctgcctttgctctggcattacttttgccntaagagcttttcatgcgcctagtgtattttgggtggcttaaaataaaaaaataacaattt

SEQ ID NO: 2036 - DNA, 121 bp, Artificial Sequence
  Synthesized
  misc_feature (61): n=a or g
agcagcaagcccacagcatgccctgaaagctgatctcggtgtcgccacgtgagatccatcnctgctcccatctcactcaaggaaatgtctcagagattgcactctgctcccctgggcacgg

SEQ ID NO: 2037 - DNA, 121 bp, Artificial Sequence
  Synthesized
  misc_feature (61): n=a or c
ggagctgtagtcctacatatcagggctggcgcagcacagggcaagtgagaggattctaagnatatactgggaatggagtagggtgggtggtgagactccggggctccaaatttcttgttta

SEQ ID NO: 2038 - DNA, 121 bp, Artificial Sequence
  Synthesized
  misc_feature (61): n=a or t
tgatgtcttatttagaggcaagatctttacagatttaccattcagggcttatgctgatatntatctttaaatagggagcaagggcagaaaatggtccctaaaatagctgaggatcatcatt

SEQ ID NO: 2039 - DNA, 121 bp, Artificial Sequence
  Synthesized
  misc_feature (61): n=t or g
ccgccaattacagtacattcaggtcaaacaaaaataatctgctattcaatgtaaatatccntttctatgtaaaaagggctggatgcagagctattttgtaatgcagccagtagtgtgtacc

SEQ ID NO: 2040 - DNA, 121 bp, Artificial Sequence
  Synthesized
  misc_feature (61): n=c or g
tttgttccatacattttatttaaatacgtcgggctgtgtgaagcactgctagccctggctntgcatctgcatggcactgttatttgttgtcataatccaacattttttcataacatttttc

SEQ ID NO: 2041 - DNA, 121 bp, Artificial Sequence
  Synthesized
  misc_feature (61): n=a or g
tatggctagtgaagaatccttctgaactgttcatagcattggaggggttttgattccttgnaaggcctatgtggcatgcacatggcaccttttgctttccctcaggaaacatccagtatgc

SEQ ID NO: 2042 - DNA, 121 bp, Artificial Sequence
  Synthesized
  misc_feature (61): n=a or t
ttttcttgtgtttttttttcttctttccagctgaagcaattactacttgtcataaataaangctgccagctatgacaaacattcagttcactgttctaaaaatgtttcataattgtttctc

SEQ ID NO: 2043 - DNA, 121 bp, Artificial Sequence
  Synthesized
  misc_feature (61): n=a or t
ttcttttttctggttttgaaacatactaaagagtgtgagagctgtttgaaatcacactgangtccaatgaaggtaatttgttgagctgatgtgtgtcaattcattgtatgtttgctggtat

SEQ ID NO: 2044 - DNA, 121 bp, Artificial Sequence
  Synthesized
  misc_feature (61): n=a or g
ggagaagacgttataatccccgaacacttgaattcctgtatcttgtccgcataatcttaanccatacatggtggtggttgcattatcatggcatggagattttttttttcttccccaaatc

SEQ ID NO: 2045 - DNA, 121 bp, Artificial Sequence
  Synthesized
  misc_feature (61): n=t or g
aaattgggaagggtttgttctgtggtctgacctacctggaaggggagaatataatcccttntaaagtagaacctggatgcagaactgttgctgcagaggtggcatgttgtgcaggaaggct

SEQ ID NO: 2046 - DNA, 121 bp, Artificial Sequence
  Synthesized
  misc_feature (61): n=t or g
ttacatatggccacctgtgcttcaaatgtgaatgaagattggccctttcgcttaaaatatngcacttgagtgtctttgtgtgggggtgtttcttttatttttaaatagtagtttcttagac

SEQ ID NO: 2047 - DNA, 121 bp, Artificial Sequence
  Synthesized
  misc_feature (61): n=t or c
ccagcgagagaggacaattccttaacctgggagctcctaaagaggtcctaacgtgcagagngctgatacatacacagaaaataatcactgaatcaatgagctaaacttctctgagggacct

SEQ ID NO: 2048 - DNA, 121 bp, Artificial Sequence
  Synthesized
  misc_feature (61): n=t or c
tgcaaggaggcatttcaattcattcttttctgaaggatatcgaataaaactgtccattaanctaaaggagtgaatgtaatcatacgaacactgtgttttcttgatgacttttatgtattgt

SEQ ID NO: 2049 - DNA, 121 bp, Artificial Sequence
  Synthesized
  misc_feature (61): n=c or g
tgaaattcattgccagtcagacagcagatcttcacctggtataaactacctcagaattcantatctgttctttgacaactgagaatgccactcaatcaggaaggaaattattcccactagg

SEQ ID NO: 2050 - DNA, 121 bp, Artificial Sequence
  Synthesized
  misc_feature (61): n=a or g
ttgtgaaagccagctaggaagaacttaagactacatgtaaattcatttgaccaggaattcnagcttggggtaaaataccagctggatttactgaggtctttaactcatacaccaaggtaag

SEQ ID NO: 2051 - DNA, 121 bp, Artificial Sequence
  Synthesized
  misc_feature (61): n=a or g
aatgcttattgattgctttgtgccctgcatcactcttgcagattaatttcttcttaatacnttgtacctcagaaatgaaacttcagctgagatgctgcatcttgtcttcaaatgttaatga

SEQ ID NO: 2052 - DNA, 121 bp, Artificial Sequence
  Synthesized
  misc_feature (61): n=t or g
agcccttcgggtgctaagtctcagtttatacagatgagctatttaacagtaaggcctattnggctgcatttggtgctatgataagcacgctaacacacagaacttgtaccaaacatctggt

SEQ ID NO: 2053 - DNA, 121 bp, Artificial Sequence
  Synthesized
  misc_feature (61): n=t or c
aagaggaagaatttaacaaaccagagtttcaattgatataaatcatgacagttctactgangcttgtgtagctgcattgattcacagccactgaagacttggactctggtctcacaaataa

SEQ ID NO: 2054 - DNA, 121 bp, Artificial Sequence
  Synthesized
  misc_feature (61): n=a or g
gaaacatagtagatctgtatcgagtagatctcgagtagtctgatcaagtgctgggggtctnaggacagatgagactctgctgttcctgagtggaaccctcaggactcccagccacgcgctg

SEQ ID NO: 2055 - DNA, 121 bp, Artificial Sequence
  Synthesized
  misc_feature (61): n=t or c
ttcaaagacctactatatgccactactccctcttcaagactttcagctccctagtaattanagtaggtgatttactgaaattcaaaccttcataatcaagcagtcattttagaatagaact

SEQ ID NO: 2056 - DNA, 121 bp, Artificial Sequence
  Synthesized
  misc_feature (61): n=t or c
atcacattggagctgtgccacccctgcgcttggccagttgtggctgaaaggctgtgtgtgntgcagtcacggctgctctaaggccattggcagtgtcccagtccctctaagagccacctcc

SEQ ID NO: 2057 - DNA, 121 bp, Artificial Sequence
  Synthesized
  misc_feature (61): n=a or g
actacaaggggagaaggacagcagttactctgaagtcctctgagggtatgagagcaccacntggatgaagggagggagtggaaaaaggcagccgagtcggaaccctgtggagcatgtggca

SEQ ID NO: 2058 - DNA, 121 bp, Artificial Sequence
  Synthesized
  misc_feature (61): n=a or g
tctcagagcgaggcgttggagcgtgccagtttatgaccacagacgtgtgtgtacctttctntcttcagaaaacacgcggcactcaacttctcctcgggacatgatgttcacattgctgttt

SEQ ID NO: 2059 - DNA, 121 bp, Artificial Sequence
  Synthesized
  misc_feature (61): n=t or c
cttcaacatggctaagctccgccattcagagagaagaccaagagcatattttctccttccnttctgacactgttagctgctcccgtgtcaagattcctccagcaaaggaatcccaaagggc

SEQ ID NO: 2060 - DNA, 121 bp, Artificial Sequence
  Synthesized
  misc_feature (61): n=a or g
ggctgctctccattccccagcacgtggatattgaggtggtacccatgagatggcaccaatnggatggcaccaggcacccaccattgtgccatccacagggtgggggcaaggggatgagctg

SEQ ID NO: 2061 - DNA, 121 bp, Artificial Sequence
  Synthesized
  misc_feature (61): n=t or c
cagtgactctctctaacagctgatcgtttaacgtgtttgtgcaatcaaactgcatgagtanaaaatgaaaaggtctcaggtgcagaagaagcatttctaatcagcagttttccccacatta

SEQ ID NO: 2062 - DNA, 121 bp, Artificial Sequence
  Synthesized
  misc_feature (61): n=a or c
catccatagaggcttctgtgtcaaagtgagacctttctgtcttttcttgtgcttcccccancttcctgtctccaactcatagctctcctgtgagccttggactgcaaggtgtttcttgcct

SEQ ID NO: 2063 - DNA, 121 bp, Artificial Sequence
  Synthesized
  misc_feature (61): n=t or c
gattggagtagctggagtagatgatctccatgctctttgccaaccttatcagcagttgcantgttttgatctgtgtttctcccatcgttgacacaacagtgtcttcaccctcggtgaggaa

SEQ ID NO: 2064 - DNA, 121 bp, Artificial Sequence
  Synthesized
  misc_feature (61): n=a or g
actccctctctatatttacacgcacgcacacttatcaatataatcataattgcacagatancaaagcagaagtatacatgcaacagcagacaggcctatggaaagtttaaataaatgcatg

SEQ ID NO: 2065 - DNA, 121 bp, Artificial Sequence
  Synthesized
  misc_feature (61): n=a or t
aagccaattcaaatgaacagaattcatcttgaaattaggagtaattcaattctgataatancctttgcaatcaatggcataatattatgtgtccaatacacgagtgctgctctaaaactaa

SEQ ID NO: 2066 - DNA, 121 bp, Artificial Sequence
  Synthesized
  misc_feature (61): n=a or t
tacgagttacttgtgagcagctactgacttgaatcgcaggaaaatgaataccaggcaaccntcttctgctccccctgagataagacctgtcagcacactcttggcgcaaagcagcaattag

SEQ ID NO: 2067 - DNA, 121 bp, Artificial Sequence
  Synthesized
  misc_feature (61): n=a or g
tgccccatacttacagactactaggggagaagggacatggaaatcaggcagggtctgcaangggatctcagccatcagcaaaccctgacacaatggagttgcactgtgagggtctgggtta

SEQ ID NO: 2068 - DNA, 121 bp, Artificial Sequence
  Synthesized
  misc_feature (61): n=c or g
attcctttggaaccttaaatatgtgcctgaagatgtgacaggggccggggagtgatggcanaaccactaacagatgtggccacagaaaaatatttttgtgaccagaagctcgacaatgggt

SEQ ID NO: 2069 - DNA, 121 bp, Artificial Sequence
  Synthesized
  misc_feature (61): n=a or g
aatacaccagatcctatgctgtaaggacacgaatttctctgccgattgatactttttgcantgatttttattataatctctgccagagtacaagttctgttgtgcctttgataaaatgttg

SEQ ID NO: 2070 - DNA, 121 bp, Artificial Sequence
  Synthesized
  misc_feature (61): n=a or g
agtgcttagttatcaactttcctgtagtgttgaacaatggggaggcttgtgcagctaaacncagggttcctcatagcattcctggggtgtaatagaattatatgctctatgtgtatgtaat

SEQ ID NO: 2071 - DNA, 121 bp, Artificial Sequence
  Synthesized
  misc_feature (61): n=t or c
ataaataaataaataaataaataaaaatctctctgccttcaccagactataaattaagagnaaggagcagctttcactaaagctagtgaacatgatttcaccacttggatgaatcgagcct

SEQ ID NO: 2072 - DNA, 121 bp, Artificial Sequence
  Synthesized
  misc_feature (61): n=a or g
ctgtgttgataaaaaggcggacaaactaaatgccaataaaaacaggaacgaataaataccntaagagttatcctactgatagctgctataaacgttttattgcagcagactctgctgtgtg

SEQ ID NO: 2073 - DNA, 121 bp, Artificial Sequence
  Synthesized
  misc_feature (61): n=t or c
gctgatgatgtggttgctgctattttggtcggtgcactagggagtgaaagagggacttaangagctgaatagcataagctgggaacataagggcagagttatcctgtcagctgttcacagg

SEQ ID NO: 2074 - DNA, 121 bp, Artificial Sequence
  Synthesized
  misc_feature (61): n=t or c
ccatcagattggtgcttcctgtttacagaacttcaaatctccacagagtcctgggaatccntccagctagggaatgcctggcttaaacagtgagtgctgtttaaacagcaggtgatgaaca

SEQ ID NO: 2075 - DNA, 121 bp, Artificial Sequence
  Synthesized
  misc_feature (61): n=a or g
tgtgtatatatatgcatgtataatatagatataacatacatgtatacatgaagtgaatccnatcaaaacttgtctctgcatgtcccactagcctgcctctgctacctttttcaggcaaagc

SEQ ID NO: 2076 - DNA, 121 bp, Artificial Sequence
  Synthesized
  misc_feature (61): n=c or g
tgcaatgctgtgagcaatgctattttcaggaaaaggcaaactcttctgacaggtgtggganaccaaggatccaggcgctgcactgtattagagctgctcttctgcctgagctgaaaccagc

SEQ ID NO: 2077 - DNA, 121 bp, Artificial Sequence
  Synthesized
  misc_feature (61): n=t or c
tgtgtgagaaagttatagatgagttctaattgcttaaaacaagcagaagaaaatagaaccntctgggattttagaaggtagagtatccacctgtatacacgctggcatcacacagatgctt

SEQ ID NO: 2078 - DNA, 121 bp, Artificial Sequence
  Synthesized
  misc_feature (61): n=a or g
tggtacggcacagctgggagctagggaaaggcagcagtcagctcttcgggcagcccacccngtgtaagagaggtgatggcccggagcagacagtgctctgcttggatgcagcaaaacacag

SEQ ID NO: 2079 - DNA, 121 bp, Artificial Sequence
  Synthesized
  misc_feature (61): n=t or c
tgccacaccagcacaagtttctgctcaattatttttcttcccctaataaaggtgacacatngatgccacttttacaaccaggaataaaataactccattcctgttcctactgttccatggg

SEQ ID NO: 2080 - DNA, 121 bp, Artificial Sequence
  Synthesized
  misc_feature (61): n=t or c
aatagaaacccttcactaaaaactccttggattccactctgacaaccaaacatggaaaacngatgttcgtttgcagagacttttacagatgagtcagcattctcacaacatggagataacc

SEQ ID NO: 2081 - DNA, 121 bp, Artificial Sequence
  Synthesized
  misc_feature (61): n=t or c
agttagttttatgttatgaggataagactggatgccttttttttgatagagaaagctcccnttgagttctgaaacctcagcagtatacagtcaaaatgagtgattctttcaggaggctaaa

SEQ ID NO: 2082 - DNA, 121 bp, Artificial Sequence
  Synthesized
  misc_feature (61): n=a or g
attctgattgtgcttggtcagccgaagcttctgatctattctggctaaaaaggccttatgnaaattctttttttccccgaagatgaccaatagccctattattttacagccttttccatta

SEQ ID NO: 2083 - DNA, 121 bp, Artificial Sequence
  Synthesized
  misc_feature (61): n=t or c
agcttcccttggcgtaacgcaccttcctcacggagggaaagaggaacatcagcctctgctngagcaaacccgaacgcccgctgtgcctgccagcagcggtcccgcaggaagcgcggtgcag

SEQ ID NO: 2084 - DNA, 121 bp, Artificial Sequence
  Synthesized
  misc_feature (61): n=t or g
ttcagtttgagaactattattgagtgctgcacacataccggggctctccctggaaggtcgnctctcagcagaagtgggaaccagctatagcactgctcccacagctactccaaagtacagt

SEQ ID NO: 2085 - DNA, 121 bp, Artificial Sequence
  Synthesized
  misc_feature (61): n=a or g
catctgtacctcacaagctcgcttagctgaatttatccattatctttacgcagaaagcacntctccacaacacgacatgtgtacatacgatcagataaattactgctgcaactcacatgac

SEQ ID NO: 2086 - DNA, 121 bp, Artificial Sequence
  Synthesized
  misc_feature (61): n=c or g
ccacctctaggctgtctggcagcatgcagcccttctcaccctcgggctgggcacagaacanaagccaaaccctgggtgtcttgccctggttaacctgcatgaagcctatgtgtgtacaaac

SEQ ID NO: 2087 - DNA, 121 bp, Artificial Sequence
  Synthesized
  misc_feature (61): n=t or c
agataataatatcagcaaacatttcacaatttctttttggcagcatttccctttttcctangtgggcgtacatggccttgagcaatgtggctgtgagctgtggttgagagctgtgtacctg

SEQ ID NO: 2088 - DNA, 121 bp, Artificial Sequence
  Synthesized
  misc_feature (61): n=a or c
tgcagattagctggctctactctatacagccagccagcatgagtgaggctattgtgacaancagagcttgtgataggttatgcatctgctttccaagcagggggaatctcactgcttatgc

SEQ ID NO: 2089 - DNA, 121 bp, Artificial Sequence
  Synthesized
  misc_feature (61): n=a or c
aaagatgcatccctaacctgcctttgtcactgctctgtaaacagcagtgctgtaagataangagattggcaaagaaagaagagggaagttgttttttgtcggcatttcggtatttgttaga

SEQ ID NO: 2090 - DNA, 121 bp, Artificial Sequence
  Synthesized
  misc_feature (61): n=c or g
aattgtttaggagtctctatctctagaaagagactattctgcatatgtttacaggtggttntcaaccttcaagctgctaaaaggcagcattttagagacctcttctatagacacagataaa

SEQ ID NO: 2091 - DNA, 121 bp, Artificial Sequence
  Synthesized
  misc_feature (61): n=t or c
ctcatttcagaaggcagagaattcccaaggtagacgctatacacaccaacagtgcctttangtaactaatccactaatacctctagatatcaaaacatcctgttgtaaaaaatagcaccat

SEQ ID NO: 2092 - DNA, 121 bp, Artificial Sequence
  Synthesized
  misc_feature (61): n=a or g
acctagtgcaagcaaattttattgtgcatgcagctgttcaagattaagtaattatttgacnaacctttggaggcaatgaatctcagatgaagcatgtacacatttttattatgcatacatt

SEQ ID NO: 2093 - DNA, 121 bp, Artificial Sequence
  Synthesized
  misc_feature (61): n=t or c
acacttgttactctactgagaggagtcatgggaggacataaccatccaaacttcccattanctgacagctatacctggtcaaagctcctctttacaggaaagagacatgattttcatacca

SEQ ID NO: 2094 - DNA, 121 bp, Artificial Sequence
  Synthesized
  misc_feature (61): n=t or c
gagtgctctgggaagatctgcaagggaaaaaaaatgacagtcctgcacatacatgaattangtatcaggagcatttgtagggctggggctttgtggggagacaattttcaggataggaaga

SEQ ID NO: 2095 - DNA, 121 bp, Artificial Sequence
  Synthesized
  misc_feature (61): n=c or g
catatctgcatcacatgttctgttcgctgtgggttgcatgtagccgcacccgttctgttcnaataagggcaagaactgctatggcctgaatagccctccctgctgggcctgttcttcttgg

SEQ ID NO: 2096 - DNA, 121 bp, Artificial Sequence
  Synthesized
  misc_feature (61): n=t or c
atgagaatacatttatacatataagtctacactgttttagcaactatagaccttccacatnttgtgcaatcttgcatttagaacttgacagaaactgaaaggctgcaaggcaatggactgg

SEQ ID NO: 2097 - DNA, 121 bp, Artificial Sequence
  Synthesized
  misc_feature (61): n=t or g
actgtgcttttagaaaaagacaggctactgcttttctgagtaacttctaatcctttcattngaagtgtattttttgctgtgttttaaacagcaggtgcacatgtaattgaaagtggttgaa

SEQ ID NO: 2098 - DNA, 121 bp, Artificial Sequence
  Synthesized
  misc_feature (61): n=t or c
tctgcctcccctttttacccttctctaacctagtggtgctggttgatagtgactgctccangctgtgtcctccgtctgcagctgcagtacagtagagctccttgggcatacggtgtgtgca

SEQ ID NO: 2099 - DNA, 121 bp, Artificial Sequence
  Synthesized
  misc_feature (61): n=t or g
gtttggttccaggattgaagggaggaaattcttttctacctactttgtttggaatagttcntagaattgtttttagaaattaatgtaatgcttgattctaggtggtattaatgaagtaata

SEQ ID NO: 2100 - DNA, 121 bp, Artificial Sequence
  Synthesized
  misc_feature (61): n=a or t
taccttactggacagtgtattttcaagtgagtagtttcaaatggttgtgcactctttgtcntatgtaaaaaagcaatctcaagtgtaaaggccataactgcctttgaaagatcggggacta

SEQ ID NO: 2101 - DNA, 121 bp, Artificial Sequence
  Synthesized
  misc_feature (61): n=t or c
atactggccacaccatcaacttgttcctttctgctatttatatcccaattcctaaatccangaaaagcttttggaaaagcaaagtaaagtgaaaaacctgaagaaaaatacacgtagccat

SEQ ID NO: 2102 - DNA, 121 bp, Artificial Sequence
  Synthesized
  misc_feature (61): n=t or c
ctgtgagcccatgctggctcaaggaccctttaccacacctacaaagttcacttccatctgngcttcctcctcttgctcagagcattaggcaagaaagcacttatgaaagagatagagaaat

SEQ ID NO: 2103 - DNA, 121 bp, Artificial Sequence
  Synthesized
  misc_feature (61): n=t or c
tttatattatggcacagacatgtgctacgtttggataaacacatcccagataaagttgctngcttttgtaggtttgtttcctctcccttttaaactgcaatttgaaatccacaccctgggg

SEQ ID NO: 2104 - DNA, 121 bp, Artificial Sequence
  Synthesized
  misc_feature (61): n=a or g
agaatagtacttaagtttgcactgtgcatctttccaggatattaagtttaatctaggagcntttctgacattttaatgagttcagttctgaaaagcatgtgtaattgtcttattaaatacc

SEQ ID NO: 2105 - DNA, 121 bp, Artificial Sequence
  Synthesized
  misc_feature (61): n=a or c
tctatattcaaaaaggtaactgcattttcaaaagacaaaacagtaagcttttcagctgttnctagcaggttaataaaagacaatcagtctcttgttcataccttattgaaacagcctcctg

SEQ ID NO: 2106 - DNA, 121 bp, Artificial Sequence
  Synthesized
  misc_feature (61): n=a or g
ttaacttgaaacacagacttcagcattaatccaggtttgatttgacatcatttgggaaaantatactggagaaggaaccctaatgatgcacaccatgttttttttttttttgttttgtttt

SEQ ID NO: 2107 - DNA, 121 bp, Artificial Sequence
  Synthesized
  misc_feature (61): n=a or g
aaggatgtaacggttcatacagcatcctgtctgtgaggacagcaatgaagctatctgttcnctgtgcagaaattctcagctgccaaatgtgataaactctcactattattattctgcagca

SEQ ID NO: 2108 - DNA, 121 bp, Artificial Sequence
  Synthesized
  misc_feature (61): n=a or g
atcaaattgaagacatgaagttttgtttacctggctaacttaaaaagtttgagaactcgtncttactggtctcattttcttgtacttaattatatctgtggggcagttttgtatccaaaac

SEQ ID NO: 2109 - DNA, 121 bp, Artificial Sequence
  Synthesized
  misc_feature (61): n=a or g
gggcaagagggggtggggcaggctctgcaagggaaggaatgggaatattcccagctcctgnaatgatgctcatctgccttaagccagacccctgttatgtaagtatcagagttattgcagc

SEQ ID NO: 2110 - DNA, 121 bp, Artificial Sequence
  Synthesized
  misc_feature (61): n=t or c
gttcaaagacagcagtccaggctcagccaacaaacaccttgagcacctcatccactgtaanttatgaagaccgtgtttattaaactaatcccactctgagttatcttaaatgtccataaac

SEQ ID NO: 2111 - DNA, 121 bp, Artificial Sequence
  Synthesized
  misc_feature (61): n=a or g
cctcttcctcttcctctcctctggtctcagcttgtcccatggcctggagaccgctgctccnaagcaatggaaggagatctattttccattacagcgtctaagagtgtttagagggtttttt

SEQ ID NO: 2112 - DNA, 121 bp, Artificial Sequence
  Synthesized
  misc_feature (61): n=a or g
tcagttccctttgctgaagcactgcattactaagacgatgtgggtaatggcagcagaatcnttaaggagatcctcgtcctgactcccagggtggggtctccttctcgtgtctggggttaac

SEQ ID NO: 2113 - DNA, 121 bp, Artificial Sequence
  Synthesized
  misc_feature (61): n=a or t
agaaaagaaagtggtgggtaatatgctcagaaacgattcccagcctatgaattatctgacnagcatatgtctactaaaatacatttttatcttcatgacacatacttaaggaaggaagtat

SEQ ID NO: 2114 - DNA, 121 bp, Artificial Sequence
  Synthesized
  misc_feature (61): n=t or g
aagctacattgctactcaaggttgcctgcagaatacagtgaatgatttttggaggatggtnttccaggagaattctcgagttattgttatgacaacaaaagaagttgaaagaggaaaggta

SEQ ID NO: 2115 - DNA, 121 bp, Artificial Sequence
  Synthesized
  misc_feature (61): n=t or c
gtgcaagggatgcaaggagggaaagggaaactttcagaactatctgtttaaatgagtctcntatcagttgaatgtgctacttcgccaggcagattagaacccgtgctctcacttaatgaac

SEQ ID NO: 2116 - DNA, 121 bp, Artificial Sequence
  Synthesized
  misc_feature (61): n=a or g
acatgccctggccaccccaaggaggtgccgtggggatgaaaaggcatccacagagcatctncagagcctccatttccagttacagaatcaagggaccacattataaccaggctgaagaaag

SEQ ID NO: 2117 - DNA, 121 bp, Artificial Sequence
  Synthesized
  misc_feature (61): n=t or c
ctttcagatcaagcagtcttattagaaagccttctgaagaaacaacgtctgctaaggtgtngggcggaaatgttcctccattagtagatcacaaagccattggaaatgaaagcaaggctgg

SEQ ID NO: 2118 - DNA, 121 bp, Artificial Sequence
  Synthesized
  misc_feature (61): n=t or c
atatttttagccacctctttatctttgaaacaatgtgaagttgtatttttaggttattagngaagtgttgcctaaaaagatgttaaatgctttgtcatgcacttttagaaaaatcctatta

SEQ ID NO: 2119 - DNA, 121 bp, Artificial Sequence
  Synthesized
  misc_feature (61): n=t or c
atttatccaagaagcaagtgccagccagccttttccaggtgaggttcagtctgttgacgtntccttcacttatttgacagtgggtgatgttgtgcatggagacaaatgtgttcttacagag

SEQ ID NO: 2120 - DNA, 121 bp, Artificial Sequence
  Synthesized
  misc_feature (61): n=a or g
acgttgtgcactggtggcctttgggaccaatgccagcacactgacagggtgaccgtgtggntgccgtcccttccgctggcaaaaggagactgttagaataggaaatgtggttgtttcacgt

SEQ ID NO: 2121 - DNA, 121 bp, Artificial Sequence
  Synthesized
  misc_feature (61): n=a or g
atgtgcagcagagctgctcagcactgccagtgcgccgaggaagggaagagagcagaacccnagcatggcttgaagtaaaaagctgaggtggcctgtatggtaaaaagcaacactggcctcg

SEQ ID NO: 2122 - DNA, 121 bp, Artificial Sequence
  Synthesized
  misc_feature (61): n=t or g
tcttttttttaaacaaaaaataggaagatgtttttgcaacgttaccacctctgcaatacanacatccaacatttctctcttcgtagtttaggtagcaatggtcacaccccaaacttgtaat

SEQ ID NO: 2123 - DNA, 121 bp, Artificial Sequence
  Synthesized
  misc_feature (61): n=a or g
caaagtgttttacctgggttgttcatgctcttgtgcttttgtcttgaccctgtgagctctngtctagttatgtcaatacttactttgtaggaggttggctgttattctgggcttctgaaca

SEQ ID NO: 2124 - DNA, 121 bp, Artificial Sequence
  Synthesized
  misc_feature (61): n=t or c
catggtaaagaagttctgtcagggaaggattattgcagagcttgtagtagagaccttggtnctgtcagcatccatacttattggcacaaatgagaactgtgtttttattgttcaattgttt

SEQ ID NO: 2125 - DNA, 121 bp, Artificial Sequence
  Synthesized
  misc_feature (61): n=t or c
tcccaggcagctttctgcccatgatctcacttccttaggagagcagccaagctgacttcangcattacagtacgcccaggggcagcttcagtctgcattacaatccttgtcacattttatg

SEQ ID NO: 2126 - DNA, 121 bp, Artificial Sequence
  Synthesized
  misc_feature (61): n=t or c
gaaacacgatccatcttgtagttgtcggcccttttcaagtcccatcttccactgctgtatntgtagttgtagcacactacttatcttacttgagcttgaagagcattattttatatatata

SEQ ID NO: 2127 - DNA, 121 bp, Artificial Sequence
  Synthesized
  misc_feature (61): n=a or g
ccagcgagagcagcacagggaaaaggcagcaggagcaggcaggttacaaagcagactgacnacaaagaatcagtgagtgtgatgctccagcacagagagcagcctgtgacaaatggggtca

SEQ ID NO: 2128 - DNA, 121 bp, Artificial Sequence
  Synthesized
  misc_feature (61): n=c or g
gagcctgcctgagaggccatcatgcagctatggtagctgcagaaagtggactcatctctancgccacgtgggccactctaaaactgctcgtattacacagggatgacaagcttctttatac

SEQ ID NO: 2129 - DNA, 121 bp, Artificial Sequence
  Synthesized
  misc_feature (61): n=a or t
caaacatatttctggttttgtcagtattgcaaagctacatattacaggaaagggaacttgnaaggattatggattatcattaaaaaaaatagaacaaattactgcactactcccaaaggag

SEQ ID NO: 2130 - DNA, 121 bp, Artificial Sequence
  Synthesized
  misc_feature (61): n=a or c
tgctggcttaggaaagaaaatgagtactaataacaattgccaatttcctcacagcaaatgntgaatgcaaagagcacagaagtacagaagtattaatttcaagaatttcaagaagaaagag

SEQ ID NO: 2131 - DNA, 121 bp, Artificial Sequence
  Synthesized
  misc_feature (61): n=a or t
attttataataaaattaatagtattccaaaggtatcatacaaaccaattttgcaaccatgncaaaaaaaagagacagctgttacctagttgagtcatattaggtatgtacatggaaacaga

SEQ ID NO: 2132 - DNA, 121 bp, Artificial Sequence
  Synthesized
  misc_feature (61): n=a or g
ttggtaagactttgaattgtcccataacattatcttgacatggtaattgtacatacttccngccttttctcttcataaaaagaaatgatctatggatttcttattaaaattttccataccc

SEQ ID NO: 2133 - DNA, 121 bp, Artificial Sequence
  Synthesized
  misc_feature (61): n=c or g
gagtagaaacagatgagcaagatcactcagcccaactgaaagaagcccaaattgagcacantgcatcagaaaaataactggggactttgaatcacaggcaaaccgccctgaaacataaata

SEQ ID NO: 2134 - DNA, 121 bp, Artificial Sequence
  Synthesized
  misc_feature (61): n=a or g
aaagtacaagtcccctgcaaagtaaacatacccaaacatcaaacaatagcaattacttcanctacaggctgtatttaacactgggattctaggagttgttttttagtaggatcagagcaga

SEQ ID NO: 2135 - DNA, 121 bp, Artificial Sequence
  Synthesized
  misc_feature (61): n=t or g
ccagaaggcaccagtctgttatctgttggtttccagagagtctgatttctcaccctgcttnactctgttaaaatattttatgtgatactattatttttcttttggataaccattttgtttg

SEQ ID NO: 2136 - DNA, 121 bp, Artificial Sequence
  Synthesized
  misc_feature (61): n=a or g
ctgcctctgtatttgcagaagatattggtaacttcagaactcactgccagcaattgtattngttgttttcacagtctaactccagatctcatatactgtatctaattaaattacttttaca

SEQ ID NO: 2137 - DNA, 121 bp, Artificial Sequence
  Synthesized
  misc_feature (61): n=a or g
gatacggtttcagtcctgtcttacctgaatagtggtagataatttgcatactcattccccntcttcagttactaacttatctgtaactttttctttaatatcaaaatttggaaatggctaa

SEQ ID NO: 2138 - DNA, 121 bp, Artificial Sequence
  Synthesized
  misc_feature (61): n=t or c
cgtagaggcatcagtttcaattggcacagggaactacaattgcttctgaagtttcattgcngttcaattttgtgagttaaaccacatattcaaaacctgtacagactgttaatagtctaat

SEQ ID NO: 2139 - DNA, 121 bp, Artificial Sequence
  Synthesized
  misc_feature (61): n=a or g
tgcaagctcctgcacagaagaggcctgttgctgtgaactcttgcatagtaattagaggaancaactttgggctcccaccagtggttatgcaacagggctggatctggcccatttgttgctg

SEQ ID NO: 2140 - DNA, 121 bp, Artificial Sequence
  Synthesized
  misc_feature (61): n=a or g
cactgcaaataattctgaacgtgactaacagcgttgcattaaaaactgggtttgtaggatnattttctttgctttctggtggattttgatctctcctgttcttctggagaaggcaagagat

SEQ ID NO: 2141 - DNA, 121 bp, Artificial Sequence
  Synthesized
  misc_feature (61): n=a or t
ccaccctctgctgtggctggttccactgagtgctggctgcttttgtccccacttaactccntactgatttgttcaatgtgctcttccccactgtaggaggggggctgctcatcattggcac

SEQ ID NO: 2142 - DNA, 121 bp, Artificial Sequence
  Synthesized
  misc_feature (61): n=t or c
tttcctggccttgatgtagaggaagggaaaggcttaagattgtcttgctatatgctgaaangcattgcaaagtactgtcaggtctatcaagtgcaggcaatcactaatggataagtaggaa

SEQ ID NO: 2143 - DNA, 121 bp, Artificial Sequence
  Synthesized
  misc_feature (61): n=a or c
gtgcactgaaaggtgacagtcagcataagctacctacaaaattttattgaacaaatgcagngtgcttcagtttatacagtctgtctctgcagaaacattaaaacctaacggcagggcagca

SEQ ID NO: 2144 - DNA, 121 bp, Artificial Sequence
  Synthesized
  misc_feature (61): n=a or g
ggtttctttatacaaactgggtttggggaagattggaacaactattatgccaagggaatcngtgtcctaagtggtttgtgttagatgaggcctgcatttagatttcaactcttcctattat

SEQ ID NO: 2145 - DNA, 121 bp, Artificial Sequence
  Synthesized
  misc_feature (61): n=t or g
gcactctgtgctctcccttgcatcccttccctttgctcagagctgcgctggtctgaggaanttgcaagctattgtagcagagagctcaccgaggatttctgttaagtgctgtgttaatgga

SEQ ID NO: 2146 - DNA, 121 bp, Artificial Sequence
  Synthesized
  misc_feature (61): n=c or g
cgtgtgaagtggacacacactcaccacccatgcagatcccttccctccacaagagtgccantgagggctgtgatcttacctgagacatcttccttgccctttaaggcagctgaaccaccac

SEQ ID NO: 2147 - DNA, 121 bp, Artificial Sequence
  Synthesized
  misc_feature (61): n=a or t
gctagagcgtgttgaccaactatgcaaacctgaagacaatctgttgcaaaaaggtggacangctcaaggcttgcacagcagtcttccatcacactggtgagttgcagtgtcagtgacacgc

SEQ ID NO: 2148 - DNA, 121 bp, Artificial Sequence
  Synthesized
  misc_feature (61): n=a or g
agtcacagccaaacttaagaccaccgtgtcttcctccaatgaagcagccttgctacaggtngagctattccaggggcagcagtttctaaagctgtgcgtgtgaaatgagtgggtgacaaag

SEQ ID NO: 2149 - DNA, 121 bp, Artificial Sequence
  Synthesized
  misc_feature (61): n=t or c
ttctgggttctcgcccaccagtaacctggcttttcactccatgacagcttcgtttgcctanttctgagcctgtcaaattagtggggtggcctgctggccatctgggagcaaaatgctcctt

SEQ ID NO: 2150 - DNA, 121 bp, Artificial Sequence
  Synthesized
  misc_feature (61): n=a or c
ggtcagcaacctgcccttagggggagggaaagggcagctcccttctctcgctggctgcagnggggtgaaatgagatcaaggttgctcaggtctgacctttaattggccaatttggagtcaa

SEQ ID NO: 2151 - DNA, 121 bp, Artificial Sequence
  Synthesized
  misc_feature (61): n=t or c
agtgatgtctgtgtgcagtaattcgtcagcagaagagtaacaacagtaataggatatgtangtatattattaatcatataaacaattacagttaacctactgcttggtcatgtctacagca

SEQ ID NO: 2152 - DNA, 121 bp, Artificial Sequence
  Synthesized
  misc_feature (61): n=a or c
gtaaggattttgaggaagccagaaatggacagtgaatgccttgggatgtatttccatcagnagccagttgcacactcgaggtcaccacttttgctgtctttgggtatatggtgacataaac

SEQ ID NO: 2153 - DNA, 121 bp, Artificial Sequence
  Synthesized
  misc_feature (61): n=t or c
gtctgagcttaaataatgtttattgtgttgctgtaataaatcactggttagccatcaaatngttgtgcatgaaaacaaggaagtatacccacctggtttttgggtttctttgttttgtttt

SEQ ID NO: 2154 - DNA, 121 bp, Artificial Sequence
  Synthesized
  misc_feature (61): n=a or g
agaacattaacagaaactaacacttcatatccataggtactgtttgatatgaacaagtagnaaaggcctcaagagcacattaaaaagaattgcctgatcttaatcaattatttgcccaaac

SEQ ID NO: 2155 - DNA, 121 bp, Artificial Sequence
  Synthesized
  misc_feature (61): n=a or g
agctctggcaacgccatctccagtggttgtagaaaccttcttcaatctgttcttcagagcngaaacctggaatcacaccaccagtgcaggtgactctcgcatcacaaacagagctaaagaa

SEQ ID NO: 2156 - DNA, 121 bp, Artificial Sequence
  Synthesized
  misc_feature (61): n=t or c
tgtctgattttccattttctggaggctgtgggaggggacgtgtttggctctgctctgcacngaggggctctttgctgtgactgcgctccccaaaggcctgcggaggcggtgactttcccca

SEQ ID NO: 2157 - DNA, 121 bp, Artificial Sequence
  Synthesized
  misc_feature (61): n=t or c
agcaaattattcctctaaaacacttaattcctatggcaagtgggcaccagtgcttgacagnaaaattgagtatggcttgagatttccttctgcaaattgttttgcaaactgtcctgcctgg

SEQ ID NO: 2158 - DNA, 121 bp, Artificial Sequence
  Synthesized
  misc_feature (61): n=a or g
cccaaagcagctacaactgaacaaaagcaggctgctcactcagccaacgcttcccacgccntacagatctgcacttcatttaggggcccctttttgtaccatgggattctttctctgcgat

SEQ ID NO: 2159 - DNA, 121 bp, Artificial Sequence
  Synthesized
  misc_feature (61): n=a or g
tgttgcctcgctatgtactgctcacaggaatggtcactcttgtttcaggagcaaaccagcngtggaaccctgaagcacagtttcatggcctgggtggaaaaagcatcccatgctgcactac

SEQ ID NO: 2160 - DNA, 121 bp, Artificial Sequence
  Synthesized
  misc_feature (61): n=t or c
ttgagagaaaaggttgaaatagaggagccatttctgccaaactgtgcatcatacagttgtnatttctaaagaatgaggggagttgcagtgaacgtgtagctacgtcagatactttattttt

SEQ ID NO: 2161 - DNA, 121 bp, Artificial Sequence
  Synthesized
  misc_feature (61): n=a or g
gcctatcatggttgtggtggttgtggcaatttgtttatgaagatttattcttgaagttggnaagcctcttaccttacgtgtcaatctctttcctaggaggatagctatggacagtatgacc

SEQ ID NO: 2162 - DNA, 121 bp, Artificial Sequence
  Synthesized
  misc_feature (61): n=a or g
gcaatgccccgtgctggctgctggccacctctcctctcggcctggcacttcactgactccngccataaagccccattgtgccgtccccgcaaatccaattagaaagcggagtgaaatgaat

SEQ ID NO: 2163 - DNA, 121 bp, Artificial Sequence
  Synthesized
  misc_feature (61): n=t or c
tgtgcaggcaaccttctaggatctggggaccacgaggctgggcagcatcccttggtgactngctaagcagcaggattgcctccctgaaagtaggtgtcttcaacacgtcaaatcttgggta

SEQ ID NO: 2164 - DNA, 121 bp, Artificial Sequence
  Synthesized
  misc_feature (61): n=a or g
cacacactcagacattggggcgggcgctccggaactccatgagacccaaagcaaagacatnctcagggcttctgctttgtctctgaagggcgaccatcagacaacaccctcagcttcctcc

SEQ ID NO: 2165 - DNA, 121 bp, Artificial Sequence
  Synthesized
  misc_feature (61): n=a or c
gacaccacactgctgtgcagtgggaggccagatcctctccagtgtcaacatttgacccagnaaagcccatttctttgaaataaaagaagttgcaaccacatcagcctattgcagctgggat

SEQ ID NO: 2166 - DNA, 121 bp, Artificial Sequence
  Synthesized
  misc_feature (61): n=a or c
ccacccctgtgtgcctgttgagctctgtgagcccctcatctactgccaacaggggtctttnacccctgtgatgaggactagttagccatctcatgctacgtctgtaaagcagagataataa

SEQ ID NO: 2167 - DNA, 121 bp, Artificial Sequence
  Synthesized
  misc_feature (61): n=t or c
caggacacacacgtggtcccacttagaggaacccaactctgtgaggaatatcctgaactcnaagacaggagaggtcaggcacggctcagtgccatggatgctctgagctccttaccagtag

SEQ ID NO: 2168 - DNA, 121 bp, Artificial Sequence
  Synthesized
  misc_feature (61): n=t or c
accagagtagctgtgtgaattacttccagattgagcagttatagtaggaacatcactttcnctgtgcctttgggttatgagcttagaaccagcagctagaagaaagcccatctgctggggg

SEQ ID NO: 2169 - DNA, 121 bp, Artificial Sequence
  Synthesized
  misc_feature (61): n=a or g
gagtactgaagaaactaggtagaaaatgagggatgctctgaaaaaatggagcctaaaagcntattgatgagaacactttccagcagaaacgcagcttatatggagatactgaacagtactg

SEQ ID NO: 2170 - DNA, 121 bp, Artificial Sequence
  Synthesized
  misc_feature (61): n=t or c
tcactaagattgtataaatcctgcccctagcttcaacagctcggtgcactgaagtgtcagnatacctctgttcagtgttgaagagggcaaagatgtgcttgctggacatgaaccccttctc

SEQ ID NO: 2171 - DNA, 121 bp, Artificial Sequence
  Synthesized
  misc_feature (61): n=t or c
gtatgttgtcttctgaaggcaagaagtgctacctaccaagccaacccatggttccattccnctccagctgtatttccatagtgagcatgccttctcaagcatgtgtagtgtttcagcttag

SEQ ID NO: 2172 - DNA, 121 bp, Artificial Sequence
  Synthesized
  misc_feature (61): n=a or g
atgaaagacctgtgagagtgatttgaagcctgcaacacctgccagcaagcaagctgcattnaggagctttaatttggaaggcagcaagttaagaggcagcttgctcaccattttaggtagc

SEQ ID NO: 2173 - DNA, 121 bp, Artificial Sequence
  Synthesized
  misc_feature (61): n=t or c
ttttccttccgcctgaaaattgaaagcacaaacaaaaaaagtgccacagcctggggggaangagcacggctgcagcatgacaagataactccagaggacaggaatgaaagggaattctatt

SEQ ID NO: 2174 - DNA, 121 bp, Artificial Sequence
  Synthesized
  misc_feature (61): n=a or g
tatgcatggagctggaggtccaccttgaggaacaacttcctgataaccactgaactggtantgtaagaactaccttctgtgattttactctgagtttcacttagctcttctaagtaccaga

SEQ ID NO: 2175 - DNA, 121 bp, Artificial Sequence
  Synthesized
  misc_feature (61): n=t or c
aggtatggcaaggcttctattttatttccctgtggaaacctcaggatttacttgggaaaantggaggttaataaagatgcatttgatttggaaatgtgaagcccaggtggaagtgctggtg

SEQ ID NO: 2176 - DNA, 121 bp, Artificial Sequence
  Synthesized
  misc_feature (61): n=t or g
taaaacaagcttttgggtatttttggttctcatgccaatttttgcctttggttatattcancctacgccccaaatattatgtatttttttttttaagttgctctcaattcttactgcagta

SEQ ID NO: 2177 - DNA, 121 bp, Artificial Sequence
  Synthesized
  misc_feature (61): n=a or g
accaccataagtggaaaaaaattatgctacagaagcctagtctgaacatagtggctcctcncttttcattagctcatacttctgatcaactcagtgtatttgggtcatttcatcgtctaca

SEQ ID NO: 2178 - DNA, 121 bp, Artificial Sequence
  Synthesized
  misc_feature (61): n=t or g
aatcttgtgtatttaaatattcctcttacgaagcagtgtcaagaaataattttgaaagctnatctttttgaattgtttcccgctttccctcaagttcattttttagtactaaaaaattgcc

SEQ ID NO: 2179 - DNA, 121 bp, Artificial Sequence
  Synthesized
  misc_feature (61): n=t or c
gacagaaggtaggtggaggggagtgcatggtcggcaatgcagaaagaggatgttgagactnctttccatccttcccttatccgtagcctacacacaaggtaaggtatggcccagtcctttt

SEQ ID NO: 2180 - DNA, 121 bp, Artificial Sequence
  Synthesized
  misc_feature (61): n=a or g
ggatagctggttgaggtgagatgccagttgtgaatcagaggtagatgaagctctaatgtgngtgctggatgccccacaatgatgccccaccatgcccacagcccatgctaatgtgaaggaa

SEQ ID NO: 2181 - DNA, 121 bp, Artificial Sequence
  Synthesized
  misc_feature (61): n=t or g
caaattagagcatttttcaaacctcgggttgctttatatttagcaattatgtttctaccanccacaatgaagtaagagagatatttccatgtaatccctcataggcaaggagcccttcgcc

SEQ ID NO: 2182 - DNA, 121 bp, Artificial Sequence
  Synthesized
  misc_feature (61): n=t or c
ttaggattaatttaagatgaacagtgagctgaggaaatactttcattggaccttcagttgnctgtcagaaacacaaagcaatttgcaagtgatgttcacagaggaagagcccaagacagca

SEQ ID NO: 2183 - DNA, 121 bp, Artificial Sequence
  Synthesized
  misc_feature (61): n=a or g
cagcctctgtaatggaggtgtcacagtaatgttcattaagaagctcatgagcattactagngtacatcaagtccttgggtagcaagacaatgatagcaagaaaaatggggagcaataccct

SEQ ID NO: 2184 - DNA, 121 bp, Artificial Sequence
  Synthesized
  misc_feature (61): n=c or g
atggtccattggttcgagttaagtagagtggttcgtacaaatggagagggcagaaatgtantccttctttgtagacaaagataatagtcatgtatccaatggaaagagtgaccgtgagcag

SEQ ID NO: 2185 - DNA, 121 bp, Artificial Sequence
  Synthesized
  misc_feature (61): n=t or c
tggtctgcagccaggggtggtgtttcagagcagcagatttcctatgggcacttggctcagnatccacatgccttgcatgccatggcagcatttgggagaagaccagaatgggcagaagagg

SEQ ID NO: 2186 - DNA, 121 bp, Artificial Sequence
  Synthesized
  misc_feature (61): n=a or g
ctggtgccttccaacccatacatgtctaaaagggtggtgatttgggtggtcctcatcacgnaatagtccaattctagactatgtcatactggaagtgatctgtaagtgacgtggaacagag

SEQ ID NO: 2187 - DNA, 121 bp, Artificial Sequence
  Synthesized
  misc_feature (61): n=a or c
ctttaccacaccaaccctaacagcttccagcaggacagcagcagagaggctgatagcatgnagagggagatgaaaaagattgactatcttctaccaggatgaatttgtcacttgttgtcca

SEQ ID NO: 2188 - DNA, 121 bp, Artificial Sequence
  Synthesized
  misc_feature (61): n=t or c
tttctatataaattacatattcaaatatttctagacccagatcttcaggtcttacattatnatacaggagcaaactttgaagtttttcatttatagagctaaggggtcaggaacactagca

SEQ ID NO: 2189 - DNA, 121 bp, Artificial Sequence
  Synthesized
  misc_feature (61): n=t or c
agtgagacacatcttaagaagctagtgtcctacagctgggtatgaaactagtctgctgcantgtttgttaggtgtgacatgtatttgacttttacctcttctctcagggacttatcgatga

SEQ ID NO: 2190 - DNA, 121 bp, Artificial Sequence
  Synthesized
  misc_feature (61): n=t or c
aaccaggtttactttctgttcacagggcaagttcaccacggccagcgatgtctgggcgttnggggtcaccctctgggagatgttcatactgtgcaaggagcagccttacagcctcctctca

SEQ ID NO: 2191 - DNA, 121 bp, Artificial Sequence
  Synthesized
  misc_feature (61): n=t or c
tgctcttcctcatccacagttgcagaaggactttcccaccaagaacaggatccacctccgngactcctgcgcagccagctcctacgtcctcaccctcctgctgcaaggctacaaatttgat

SEQ ID NO: 2192 - DNA, 121 bp, Artificial Sequence
  Synthesized
  misc_feature (61): n=t or c
acccaggctgctgtcagaaagacactgcagatagcagtacacgctccccattgaactgcanagtaggtagatatcacgctgaggtttgtgttctctaccgtgcaaaaggggtggtgcaaag

SEQ ID NO: 2193 - DNA, 121 bp, Artificial Sequence
  Synthesized
  misc_feature (61): n=a or g
ttacttctattcatcgattctctgctttgagcaactgatcattaaagtgagaagcgggtgnggagtctctgaagaaataggaaaaacacgggtctgaacccacatttaggatttagtagct

SEQ ID NO: 2194 - DNA, 121 bp, Artificial Sequence
  Synthesized
  misc_feature (61): n=t or c
ctatttggacaagagtacttttctagtacgtatttgcaaaccttggagaagactttattcnggatcagccgcttctggattggtctaacaattaaaatgatgggattaacattggagggga

SEQ ID NO: 2195 - DNA, 121 bp, Artificial Sequence
  Synthesized
  misc_feature (61): n=a or g
atggtgatgtaagctcaggaccagaaaagcaggtaagatggtgtaagccaaagtggtacangtttgacaagtcttgaattgctgataagactgagagttaagaagtctgtttctctattag

SEQ ID NO: 2196 - DNA, 121 bp, Artificial Sequence
  Synthesized
  misc_feature (61): n=a or t
gaacctacatgaggatttgtaaaacataagacatttgaaagtcatctttcataatgttggnttattctatctttaattagctcctccagctctaacgacacaggtctgattgtgtctcccc

SEQ ID NO: 2197 - DNA, 121 bp, Artificial Sequence
  Synthesized
  misc_feature (61): n=a or g
gaatctcctcaaaggatgactttctcttgcatcaaattcactatagttccttccccctcangtataaatgctgccccctcctgtacttcatgtgtttgggaaaagaacattaaaccactct

SEQ ID NO: 2198 - DNA, 121 bp, Artificial Sequence
  Synthesized
  misc_feature (61): n=t or c
ttgacattatctcacagggttttctcatattcaaaccagagaaatttgatctggataagangcataagaaaggagcataactgtgggtcaccaaaggaattaggaatggttcaccgtgaaa

SEQ ID NO: 2199 - DNA, 121 bp, Artificial Sequence
  Synthesized
  misc_feature (61): n=a or c
ataattctagcaacaactgaagcaaagaaagcactgaactcttttcatctgacacaatttnatctgttgtcatctctcccttttcgctgagcagaagactcactttctttgactttcctat

SEQ ID NO: 2200 - DNA, 121 bp, Artificial Sequence
  Synthesized
  misc_feature (61): n=a or g
acagaccacagcatggagatggtcacagagataagcatggccatgggatccccacagagantcaaatcttgctccatttcactggggcttcaagaactctgaagaatgggtggaaacgggc

SEQ ID NO: 2201 - DNA, 121 bp, Artificial Sequence
  Synthesized
  misc_feature (61): n=a or c
acttccaggctcgtgtgaaggagtgcaaagagagcctgcctgctgtacctggtaaagatcngcaacttatcttatctctgtgtaatggcaagcagaaggtcctggtgagccagtgctttaa

SEQ ID NO: 2202 - DNA, 121 bp, Artificial Sequence
  Synthesized
  misc_feature (61): n=a or g
ccagcagagagctgttgctgagcagtctttgggtggaatgacttcttggcggggccatagnttgctgcagacagcaccactgcaaagggagaagccactggggaaatcagcaaccaggaga

SEQ ID NO: 2203 - DNA, 121 bp, Artificial Sequence
  Synthesized
  misc_feature (61): n=t or c
catggaggtttggatgagctgaaataagcccggttatatgcatggagctgtgttcagtgcngaagcaggagcattaactgactacttgcatggagagtgtgaaataaagtgccacacattt

SEQ ID NO: 2204 - DNA, 121 bp, Artificial Sequence
  Synthesized
  misc_feature (61): n=a or g
gccagagcacactgtgctctgtgatcctgctgatctgtacatgataaaccgagccagaccnggtcatggctgtgagaccatcgggaagctgatgctgctgcaatccgtgatcttaacttgc

SEQ ID NO: 2205 - DNA, 121 bp, Artificial Sequence
  Synthesized
  misc_feature (61): n=a or g
gttgtcagagcccaatacaagtcaatgttggtgtctcttgattttggtatgttacttgaangagaggaaagacaaggagatgggtgatacagaacttcacgtgtgagtgctgctgagctgt

SEQ ID NO: 2206 - DNA, 121 bp, Artificial Sequence
  Synthesized
  misc_feature (61): n=a or g
gcacagttcctcagacagatgcagatcctgtctgctggagatgcacttcataatatttaanccatcgtgtgatgttgatcaagttcaggtaacagagctctgaaaggtataatcttttacc

SEQ ID NO: 2207 - DNA, 121 bp, Artificial Sequence
  Synthesized
  misc_feature (61): n=a or g
gattttgatatgctatcccagactgcagagctcagcctgcttgcagaggcctatttgaaanccatggtatattcctagcagtaagcaacctgagaaataaacatacatatctgtcaggcac

SEQ ID NO: 2208 - DNA, 121 bp, Artificial Sequence
  Synthesized
  misc_feature (61): n=a or g
aaatatgctggtgcgtgagcggctccccgactcgcgggctattagcacgatttcacactcnctgcaatgggttattgttggtgtaatccaccatcctatacaacagcaggagaaatggagt

SEQ ID NO: 2209 - DNA, 121 bp, Artificial Sequence
  Synthesized
  misc_feature (61): n=c or g
agcccatccccaggagctgagcgataagtgtgatttcatcaccaggcaatgacccaggtanagtaatgaaggccattttgctcgtccgtcctgcaaaaggctgctgtagtgaacggcagcc

SEQ ID NO: 2210 - DNA, 121 bp, Artificial Sequence
  Synthesized
  misc_feature (61): n=t or c
gactgtgttctgtgggtggcagtgtgtgccagtgccaccacacggctgggaacttctattncccattgacctggaggaggtgatttcattctaaccagtggaagctgaacaggtgaagtga

SEQ ID NO: 2211 - DNA, 121 bp, Artificial Sequence
  Synthesized
  misc_feature (61): n=t or c
agctctgtgtcttgccttctcagatcagttcacagccagcgagaggtcctggatggagganagagcctgacagtgctgctctgcaggacagggaccacctggaccatggggagggtatgga

SEQ ID NO: 2212 - DNA, 121 bp, Artificial Sequence
  Synthesized
  misc_feature (61): n=a or g
agctcctgttctctgggatttcactttggggtgggtaggaacatcacaccctgcagctccnctccctacagggacagcacaggcattgtatggatatgtgcacccgtggctgggagcatac

SEQ ID NO: 2213 - DNA, 121 bp, Artificial Sequence
  Synthesized
  misc_feature (61): n=a or g
gatctgttcgccaaccttaacaaaaccaacagaaattcccccgtgttttaccactgcgctntttcctatgttagcagcagagcaagacaacaactggcacttctgcttccccagcaaaaca

SEQ ID NO: 2214 - DNA, 121 bp, Artificial Sequence
  Synthesized
  misc_feature (61): n=t or c
aacatatatgtcaacaaattgcagatgtgattaggaagatcttccctttggtcgcagctgnggagcacctggatgcagccatctcatccaaccctgcgtttttagaggacccagggctgtt

SEQ ID NO: 2215 - DNA, 121 bp, Artificial Sequence
  Synthesized
  misc_feature (61): n=t or c
gcatcagttttccggggtcacctgatgggagatgcatgcttcaggctactcaaaaatgggntctgtgtgtaacacagacaaaagtcacagctctatagaagcgagatttgcttttgatttt

SEQ ID NO: 2216 - DNA, 121 bp, Artificial Sequence
  Synthesized
  misc_feature (61): n=t or c
aagaaagaagtggagatgcccagacttgtgatgtggccaaagcagtaggcgtacctccagntacacctattggctctcagtgcacccgagaatgtgcaagcagtgatgctacccctgcagg

SEQ ID NO: 2217 - DNA, 121 bp, Artificial Sequence
  Synthesized
  misc_feature (61): n=a or g
tggaagctttgattctcaagggttatcacttgtggtgagcaggaacttgtcaagattaggnaaatgggatttcaaagctaacttgtgcctattttcatcatctaaatcttgctacctcttg

SEQ ID NO: 2218 - DNA, 121 bp, Artificial Sequence
  Synthesized
  misc_feature (61): n=t or c
agtaactgatttttgctttgctgctgttgttgttctcctattcacaattttgaagtgatanggaatacaaatcaagtagtcctgggacactggaatgcattcagtactttgatactcccca

SEQ ID NO: 2219 - DNA, 121 bp, Artificial Sequence
  Synthesized
  misc_feature (61): n=t or c
tttcaaaataggaatggagcagatgtttcttgactcctgtattcagtcagtaggtcagcanacactttaacagagctccattgttatattactagggtggatgggatggtaataattgctg

SEQ ID NO: 2220 - DNA, 121 bp, Artificial Sequence
  Synthesized
  misc_feature (61): n=a or g
tcagcgcaatggatatgttgcaggcaggcggtcacagctcagaaatggcaaggtgaaaacngagtattttttctgtaatatttgtatgaagtgcactgctttgttttggggagcagctcca

SEQ ID NO: 2221 - DNA, 121 bp, Artificial Sequence
  Synthesized
  misc_feature (61): n=a or g
tgaacaccctttccaaatcagctcctcgctgtaccctcgcaggtgagcacggccggttccnggagcactgtctgcaggctgagcatgccatcaaaaagcgtttctaattctctcctgctac

SEQ ID NO: 2222 - DNA, 121 bp, Artificial Sequence
  Synthesized
  misc_feature (61): n=a or g
ccacagcactgctgccagagagctggggagacattgctgtctgcgggccgctctcctcggntcctgctgagggttctttgtgggcactgagtgcccacctgagccatggtttgttcccttg

SEQ ID NO: 2223 - DNA, 121 bp, Artificial Sequence
  Synthesized
  misc_feature (61): n=t or c
atggtgctttcaggaagcaggagggctcagggtccctctcacttgcacactgcaacctcangtgtctgtgcctctgcagctggcagcccatcatgaagttcatcaacgatcagtatgagaa

SEQ ID NO: 2224 - DNA, 121 bp, Artificial Sequence
  Synthesized
  misc_feature (61): n=t or g
atgaagctgcatggaataagacagcttcttcaaggtgctctgcctctgtggccaggttcgncccaaagcagcagataaatctccagcacagcgctgcagcgatgctcacagagccatcccc

SEQ ID NO: 2225 - DNA, 121 bp, Artificial Sequence
  Synthesized
  misc_feature (61): n=a or g
ctgctgctctcgtccaaagctcccgccaccattcacaggggaaaataatgcattaatctcnctaatgaagataaattagagtagcagctttggaaaaataccatcggtcaacagcgagctg

SEQ ID NO: 2226 - DNA, 121 bp, Artificial Sequence
  Synthesized
  misc_feature (61): n=t or c
ggagggaagttttggcccctggatagaacataatgaaaggacaagagaagggagaggaggngaaggggaaggttcataaacagaacgagatggagaggtcatgaactactcttgcttgtgt

SEQ ID NO: 2227 - DNA, 121 bp, Artificial Sequence
  Synthesized
  misc_feature (61): n=c or g
gtgatcaaattagaattcttaagcttattgtctttccatcttaggtgaatctgctgaccanagaactggaggccctcagagagactggaatgaaagcatcagaatcaccacaagcagcaga

SEQ ID NO: 2228 - DNA, 121 bp, Artificial Sequence
  Synthesized
  misc_feature (61): n=a or g
tcctgctctgtgggtaaccacgaggtggcaagctgaacgtttcataacgatggcacaagancccactgcgcttttgccacctgtaataacaaatggcagcaggccaacccagcacagatgt

SEQ ID NO: 2229 - DNA, 121 bp, Artificial Sequence
  Synthesized
  misc_feature (61): n=a or c
tcagaatgatactcattgctgaactatttgattaatactgttgcacactcggagcgcctcngtaaaccaatgtctcataaggactggaactgctgggagggccggaccccctcctggctgc

SEQ ID NO: 2230 - DNA, 121 bp, Artificial Sequence
  Synthesized
  misc_feature (61): n=t or c
gtgtcttaaccattaaaaagatagatctcatcagtactattctgtgtagaagataggaatntttttagcaaacattagtgtatgtatatataaaaatgcatgtcatggccatagaccaaaa

SEQ ID NO: 2231 - DNA, 121 bp, Artificial Sequence
  Synthesized
  misc_feature (61): n=a or g
gttgtctgcaggtccagtcatagctgcaagtgagggaattctaagtgctaacatttccacnaagtagctgccttctcatcgtttttccttcttcatatctttacatttttcaaagagactg

SEQ ID NO: 2232 - DNA, 121 bp, Artificial Sequence
  Synthesized
  misc_feature (61): n=a or g
tggtatcagtttatttaaataattcccacgtatgcatttttaagatgctaccctttgtcgnggcctctgtgttcatttatattcagcaaacttaatatgaaagtcccttttcactgttctc

SEQ ID NO: 2233 - DNA, 121 bp, Artificial Sequence
  Synthesized
  misc_feature (61): n=a or g
ttccaggtaacattcctggttagctggtggctaaatgcctgtatccttatttcctgcaganctctgtggcacctggaaccaactctgagcctgtgcacaaagggagaagtggtgtcgggaa

SEQ ID NO: 2234 - DNA, 121 bp, Artificial Sequence
  Synthesized
  misc_feature (61): n=t or c
aaaccttgtgggcttgttgcgtatccaaaatttgctgaaggctatggctatctgaattcantacttttgcacaacaactggcaaaaacttcaccctttgtgaagaaaaacaagctttactg

SEQ ID NO: 2235 - DNA, 121 bp, Artificial Sequence
  Synthesized
  misc_feature (61): n=t or c
gtgtgtgatcatatggtttgagatggttcttctataaatgctgttgtaggatctctcctancataatctgtggtacttctgagcattactgtgtaagtcttaatgaagtcttaacttgctc

SEQ ID NO: 2236 - DNA, 121 bp, Artificial Sequence
  Synthesized
  misc_feature (61): n=t or g
cccaaataatgtgcaatgaaagaatgtacgtctccagaatccataaaaggttgtgcttctnactacaaactcaggaaatctgaagggtagaattttacattaataaaatattttatattaa

SEQ ID NO: 2237 - DNA, 121 bp, Artificial Sequence
  Synthesized
  misc_feature (61): n=a or g
aaaaggagacctgtgatacagccaatgaatcaggtgtaccaaaatgaaagtggcaaatatnttgattagatggttttccaacagagaatagcaaaataataaactcatggatacatttttt

SEQ ID NO: 2238 - DNA, 121 bp, Artificial Sequence
  Synthesized
  misc_feature (61): n=a or g
taccctgcttcgtgactgaagcattatgatttatgaagctgcagtgggagagggaattgcntagagtttcctgattattacagatttataagtgaacaccatcggatttatctcatctccg

SEQ ID NO: 2239 - DNA, 121 bp, Artificial Sequence
  Synthesized
  misc_feature (61): n=a or g
caggtcgtgccaccttgatattgagtatcttgaaactttcgctcctatgtatcccttaatngtgtgcaattgtaacaatcatattaaaagttgctcttaaaggtgattcctctcagtcttc

SEQ ID NO: 2240 - DNA, 121 bp, Artificial Sequence
  Synthesized
  misc_feature (61): n=a or g
gaaatgtagtgtgttggtgtgtgtttaataagtatgcgggtgcaatagctacaaatcagtngttcataagcttttaatgtaattcaagtagattggagtttagtttccagtatttgtgttt

SEQ ID NO: 2241 - DNA, 121 bp, Artificial Sequence
  Synthesized
  misc_feature (61): n=t or g
atttaactttgcatttttatagtaaaatacaaagttgcacagcctgtttacaacagtcagngtaaccataaagagattactggaaaagttggttggctgaggttggagaggtatgaatgca

SEQ ID NO: 2242 - DNA, 121 bp, Artificial Sequence
  Synthesized
  misc_feature (61): n=t or c
tcacctgggaagtgaatcacacaggtgaatgtaaatgggttggtaggacaggtgaaggaanactgtatgttaaagatttctagctctttctaccacattttgcttttgctctttcttatca

SEQ ID NO: 2243 - DNA, 121 bp, Artificial Sequence
  Synthesized
  misc_feature (61): n=a or c
caagtcacaatgacttacatttgccaacaaagcccaaggtagattggcagtccaggtatanccagaagagagcaaatggaaagaatgatcgctttccatagattacaggagcaggaaagca

SEQ ID NO: 2244 - DNA, 121 bp, Artificial Sequence
  Synthesized
  misc_feature (61): n=a or g
taacgttgaaatgtaaatgtcttaatgcacagttctgtgcacaacagctgcaatgaggtgntttttggaagtattgtactttggtatttgcctactgtctattctgtaaaggttttctgta

SEQ ID NO: 2245 - DNA, 121 bp, Artificial Sequence
  Synthesized
  misc_feature (61): n=a or g
caatagctaatgcacagacactaccctgacaagaacttgttctatcagtatcagaagcatnaagcctgtgccagctgcatggctctttccatcctcctggcaagaagcaatacagcttccc

SEQ ID NO: 2246 - DNA, 121 bp, Artificial Sequence
  Synthesized
  misc_feature (61): n=a or g
acacggcttgccaaaggcaaaaatatccacgctgcaggaacagatatcccaaagaaacacngtgctgagaggcattatcacaggctagatgccaagatgtgtcagaagaaaagagaaaagg

SEQ ID NO: 2247 - DNA, 121 bp, Artificial Sequence
  Synthesized
  misc_feature (61): n=a or g
cagagctgattaaaacaagcttgtttctcatctggaaaggctgctttttcaaaataccccnttgcaggcaggtatttcagtggagtgctgcagcgttttgctcttcacttttgaactctgc

SEQ ID NO: 2248 - DNA, 121 bp, Artificial Sequence
  Synthesized
  misc_feature (61): n=t or c
cattcacttgtctccatgcttttcccttgtgagatatctgtctgcctacacggccattggngtcgtcagaccaatcttcacttttcagcagctggaggcacgtagctagccagacacctcc

SEQ ID NO: 2249 - DNA, 121 bp, Artificial Sequence
  Synthesized
  misc_feature (61): n=a or g
gtgcttctgaggtgctggggctgctgttccccagcgcctgagctgctgagggatgcttgcncattcagagggtgggaactgctttcttgcagctgggacttggcagaggtgcaatctcatg

SEQ ID NO: 2250 - DNA, 121 bp, Artificial Sequence
  Synthesized
  misc_feature (61): n=c or g
aaccagccatctctgtgccagactacttccaatctttatggtacatctctggtacccttgnagtttatctaaacaacttccctacattattttttcttttagtacactgcacaggtgtagt

SEQ ID NO: 2251 - DNA, 121 bp, Artificial Sequence
  Synthesized
  misc_feature (61): n=a or t
atgcacttagttctccttgcctgcatctcccattgctgagcgaaaagcactgatttttgangagctttctgttggagccctgcaaaatgacaggggactttgttttcctggctgagatttc

SEQ ID NO: 2252 - DNA, 121 bp, Artificial Sequence
  Synthesized
  misc_feature (61): n=t or c
acaaacaatcaacaagacactgctatgggaaatggcgattagttgggctaaaagaggatgntgccttctgcaaagaagccaacacaaacctctcaccaacctcttcaagctccattaagga

SEQ ID NO: 2253 - DNA, 121 bp, Artificial Sequence
  Synthesized
  misc_feature (61): n=a or c
gactccttccacacagcactgaaaccttgggctctgccttccagaggtgaatattaacatngaacaactcttccccactcagctggcagagttaagagcatattgcccaatgcagcagtca

SEQ ID NO: 2254 - DNA, 121 bp, Artificial Sequence
  Synthesized
  misc_feature (61): n=a or g
gagttttccagcactgcaaagcaggtggacatcaacaggaataaagtaattatgagtttcnagtacagccatttcatgagacatagatgtcactgccattcctttccacaagcaattgtga

SEQ ID NO: 2255 - DNA, 121 bp, Artificial Sequence
  Synthesized
  misc_feature (61): n=t or c
actgtggagctccagagaatgatgaattagcagcagaggagcattattaggcttgggtcgnttatatggcaattagtccacgtccctcgtgcttcttgttctggtctcaccccaaagaaat

SEQ ID NO: 2256 - DNA, 121 bp, Artificial Sequence
  Synthesized
  misc_feature (61): n=a or t
atttaaacagaagccttaaagtacatagagcagcagttactgtaagtaggtatagatcctnactcagcaaaacctcagtgttggctcatcctcatgcactagaccattgatattaattcca

SEQ ID NO: 2257 - DNA, 121 bp, Artificial Sequence
  Synthesized
  misc_feature (61): n=a or c
tacacttggattggagtctgtgaaccatttcagctattccagcttctgaaaatgacaattnattcatttagccattgcataaaagaaatattttttctacttgattcaaagttataatata

SEQ ID NO: 2258 - DNA, 121 bp, Artificial Sequence
  Synthesized
  misc_feature (61): n=a or g
gatgccagtccccttggaaatgcccttctcctttgtgtttaatttttaaaaggacactgtnaaagtgtaaccagcttagattttagatttctgtcaaagtttgaggttgccaggattgcag

SEQ ID NO: 2259 - DNA, 121 bp, Artificial Sequence
  Synthesized
  misc_feature (61): n=t or c
acttctcatttacagtgagctatgtatcagcagcaattaatctaagacctgaattacttcnacatcacttgttgtgtttggatgaaaggcagtagaactccatcagacatgaatattttat

SEQ ID NO: 2260 - DNA, 121 bp, Artificial Sequence
  Synthesized
  misc_feature (61): n=a or g
tcacgtgagctcctgaaagttaaaagacatcatttgaatttcctgtaatacattcaccctngatacaaattgaaaagccaattcaaattttgtatactgaacccatgcacatgtacatgca

SEQ ID NO: 2261 - DNA, 121 bp, Artificial Sequence
  Synthesized
  misc_feature (61): n=t or c
tgtggattaaagaaaaagaggaacaaaatgaaggtcaaaaaataggagaaaagatagcgangctaaaaagggtttgtaaaaatgagttcacccactgcaaagatatgtggcatttctgctg

SEQ ID NO: 2262 - DNA, 121 bp, Artificial Sequence
  Synthesized
  misc_feature (61): n=a or c
ctcttggtaagtagtgccttctgagtacacgagcattcctggtgatttagtaaagcattancttgtaaatcttggtaattgtattttctgtaagaggtaagctaaagacttgggttacttt

SEQ ID NO: 2263 - DNA, 121 bp, Artificial Sequence
  Synthesized
  misc_feature (61): n=c or g
ggggttcaaaccaccaattctcagccaaaccaatactctgatcacacccatcacatggctnagcatttaccacaactgccacaaataagacagcagggctgttgactggtttaaactgaga

SEQ ID NO: 2264 - DNA, 121 bp, Artificial Sequence
  Synthesized
  misc_feature (61): n=t or c
tacatccaggggatttcctgttatccaagtatatatggaggccctttatttctctgtgtgngtgttttttaattcaaatcaaatgtaaatgtcactggtagactgcacttaacctccttag

SEQ ID NO: 2265 - DNA, 121 bp, Artificial Sequence
  Synthesized
  misc_feature (61): n=a or g
agcgtgtttggagtgaaacgtgcagcttcccaagctctgtgctgagtgcttggcaatgtgngggtctacctgaggtgctggcaaagagggtgcttatgtctgatgccagaatgagcaggat

SEQ ID NO: 2266 - DNA, 121 bp, Artificial Sequence
  Synthesized
  misc_feature (61): n=t or c
agaacactctaagtttccttagggcaatttacatttatgtcatgtctgtaaatcaggccangggccccaaacattgggggtactaccaatttctttcaaatcttttttaatatgcagaatt

SEQ ID NO: 2267 - DNA, 121 bp, Artificial Sequence
  Synthesized
  misc_feature (61): n=a or g
gttctggctactggacctgaagctagcaaggtgtgtaactgtttattcagtttcaaaagcnacactgaccttctggccaggcctgggacagcttcagcagacctccagcagaaggacttgt

SEQ ID NO: 2268 - DNA, 121 bp, Artificial Sequence
  Synthesized
  misc_feature (61): n=c or g
atttatctacgtagcaccagggcaccatttgtccgtcttgctttaattcaaaattcagcantggaaagagtgaatctttctgctatgtttggtgcaggggaagactgtaaaacggatagct

SEQ ID NO: 2269 - DNA, 121 bp, Artificial Sequence
  Synthesized
  misc_feature (61): n=a or g
tgtctcttccaagaccactcatgtctccgttctggaggtttgaatggggcacagagtagcnttgaggcatcattctggtttatgtagagctgtttatttcagtgattggaaccatggaacg

SEQ ID NO: 2270 - DNA, 121 bp, Artificial Sequence
  Synthesized
  misc_feature (61): n=a or t
aggaagacccctcaggggcaggctgttcccttcccactgctgaatgagcagtgtgggtttngcctttctcaccttctctggttggaacactctgatggaaaaacacagcggtgctgggccc

SEQ ID NO: 2271 - DNA, 121 bp, Artificial Sequence
  Synthesized
  misc_feature (61): n=t or c
tataaagctatggattgaacatgctggtacaattcctattcggcttgctgaatgctgtgtngctcccccagcaatgaatgatacacctgcagctcctcctgcctggcgtagcctgatgatc

SEQ ID NO: 2272 - DNA, 121 bp, Artificial Sequence
  Synthesized
  misc_feature (61): n=t or c
aaccagtctagtgtctccagccctggaggagatgtgcccatctcacctgtcacgtctgtgnttctttcctgtcttctttttcttctccttgcggattggggaagagctgtcacagctgcag

SEQ ID NO: 2273 - DNA, 121 bp, Artificial Sequence
  Synthesized
  misc_feature (61): n=a or g
gaaattggggatctgcagcctggggttgtggaaggcttgctgggatgtcacccaaatgtcncagagaaaaactcaggcagtgcagggcaggacgtgggtatgggcagtggtgtgttacgtg

SEQ ID NO: 2274 - DNA, 121 bp, Artificial Sequence
  Synthesized
  misc_feature (61): n=t or c
gttgtaagaaccagtggcacaaaggaaaactgattctctctgtgagtgcaacgtgaaccantggaaacactccctaaactgcaggccaatcgatgtctctgaaattaacaggacttttgct

SEQ ID NO: 2275 - DNA, 121 bp, Artificial Sequence
  Synthesized
  misc_feature (61): n=a or g
tgtagcattgctgagctaagtgttttctgtagtgtccgtgctgttagaaattgtaccagcncttcctttgctgcccagatttagagtgttcagtggggggaaagaaatgaattgcctgttc

SEQ ID NO: 2276 - DNA, 121 bp, Artificial Sequence
  Synthesized
  misc_feature (61): n=t or g
ggatccctcatgtcctccttgtccatgtgtgtgacttgctcagagcgtcagagtagatgtntggggcattatgtgcacttacagaaagccatactcttcagtgcagtatttatgatccatt

SEQ ID NO: 2277 - DNA, 121 bp, Artificial Sequence
  Synthesized
  misc_feature (61): n=c or g
tctactatctgtgtgcagtgatacactgcgtatcctgaggggaactacaaatcacacaaantgaagttaaataaggctgtactgagcaacactccttggtagacattttaaaataaattct

SEQ ID NO: 2278 - DNA, 121 bp, Artificial Sequence
  Synthesized
  misc_feature (61): n=a or g
ttcgggtccacgcaatcattttccacctccttccctttgctgcttcctcctccatcccacncagccagcctctggcacagccttctcatcccatccactatcacacaccttcggatgcagc

SEQ ID NO: 2279 - DNA, 121 bp, Artificial Sequence
  Synthesized
  misc_feature (61): n=t or c
ggaaacctggctcacagctgcaatacccattgagaggattgcaggagccgtgcacgcagtngcagtgccactggcacgccgacccccaaaaaccagccttgcatttgcaattgcccgtctc

SEQ ID NO: 2280 - DNA, 121 bp, Artificial Sequence
  Synthesized
  misc_feature (61): n=a or g
ctccaggctgcacagaccccccccttgcaccccaatgcaagcagcaacagcaggaggttgnaatagcataaaagagctcagccctcttgagatctttatcaaagcccacgcgaggcagcga

SEQ ID NO: 2281 - DNA, 121 bp, Artificial Sequence
  Synthesized
  misc_feature (61): n=t or c
tacctctatgttacactgcctaaacatatgtgaaaacttatgacctccactgtgatacggntttctccaaggcagaactacctccagaagaaaagggttttggcaagaaagagcagcagtg

SEQ ID NO: 2282 - DNA, 121 bp, Artificial Sequence
  Synthesized
  misc_feature (61): n=t or c
cactctcctgaattgacagttgcatacttgcagcatctgtgtcaaaaaagagaaacaagcngtattggtagatggcacaatgactccaacacacgtctggatcacctacctggatttcacc

SEQ ID NO: 2283 - DNA, 121 bp, Artificial Sequence
  Synthesized
  misc_feature (61): n=t or c
gggcacggaaacttcacggatgtaagccaggtttgttgtgagggcgctgggcatgctgctnccccagggttagaggatggatcgtgctttatccgccacgtgaggcagctcatcccagctc

SEQ ID NO: 2284 - DNA, 121 bp, Artificial Sequence
  Synthesized
  misc_feature (61): n=a or c
gtgtcagagctgggtttgagtcggtctggagtgatctctggttagtcagtgtgggaagtangggggatcacagagacttgacaatgctggagcagagagaaaaggagaggagggggttcgg

SEQ ID NO: 2285 - DNA, 121 bp, Artificial Sequence
  Synthesized
  misc_feature (61): n=t or c
aattcatctgttaaaataagcattgggaatgcctgagtaaattgggaatgcctgacaaacntacactgagagtacagttatctggttctctgtctttagaagtcttcaagatgttggtaaa

SEQ ID NO: 2286 - DNA, 121 bp, Artificial Sequence
  Synthesized
  misc_feature (61): n=a or g
aactggagatagaagtactatattgggtttgtaacacaacaaacaaattggttgctgaatncatccaaattttgagtggctttgtgcatatgcatttcagagccattctagctatacagtg

SEQ ID NO: 2287 - DNA, 121 bp, Artificial Sequence
  Synthesized
  misc_feature (61): n=a or g
tccatggtcaccacggcagattcttctctaatgaaatgcaaagaagtcccttcccattgcnctgaagtgctgtgaagcagcaacaggcttctgttggcacatgttttagagctaggaaaac

SEQ ID NO: 2288 - DNA, 121 bp, Artificial Sequence
  Synthesized
  misc_feature (61): n=a or g
tcagtatcccaaatgcatgttgctttttgtattaaaaaaagctgaaatgtagacctactcnttctacaggtattaaaatcaaagcttttacagcgtaagtcagggcactaacactcacagc

SEQ ID NO: 2289 - DNA, 121 bp, Artificial Sequence
  Synthesized
  misc_feature (61): n=t or c
tgcttcaggttcctcatctgctctattgttacaccggggacttgtctgcttcgatggattnggttttacagcccaagctgtaaatgatttctggcatccagtggagctctgtggatgggca

SEQ ID NO: 2290 - DNA, 121 bp, Artificial Sequence
  Synthesized
  misc_feature (61): n=a or g
taactgctttcaaaatttcactttcagcactatggatcgtgataaagttggagttcccacngatggagattcacacgctatcacctatccacctgccattgtagtttacataatcgatcct

SEQ ID NO: 2291 - DNA, 121 bp, Artificial Sequence
  Synthesized
  misc_feature (61): n=a or g
tggcacccgatggcggggtgagttccacctacaagcagcctatttgtacaggaacaactcnagaaaggcaaaccaggtgctactgtagccaagcagctacttgtgtgaaatcctggcaaaa

SEQ ID NO: 2292 - DNA, 121 bp, Artificial Sequence
  Synthesized
  misc_feature (61): n=t or c
ctaggtaactggtgttcatagactgttaagcatattgctctgtgcaagcttcaattaagcnaatgctattttttcatctttgtaacttctttttgagaatgtgtgtatttagaatatgtgt

SEQ ID NO: 2293 - DNA, 121 bp, Artificial Sequence
  Synthesized
  misc_feature (61): n=c or g
cagggcacagtgctatggaagccagcgtgaacgtctgcattacagtgctcaacacagaagntgaaaggagctgatgaatcctacctaataatgagcaacaaatgagagagcctttcaggac

SEQ ID NO: 2294 - DNA, 121 bp, Artificial Sequence
  Synthesized
  misc_feature (61): n=a or g
gccgcagaagcagcgcagccagaagttccacattcgttctcagctaaatgacacggccgancgcttcctgaagaagcaccgggaaaagaaagcacacgcacaacacacagctctgaaccaa

SEQ ID NO: 2295 - DNA, 121 bp, Artificial Sequence
  Synthesized
  misc_feature (61): n=a or g
cgggcacttagcttggtttgtactagagcctgaatcctcttcagggctgactgcagcaccnctgcgacacttagtgctctttgagatcagagagagagaaacacaagcagggacgctgctt

SEQ ID NO: 2296 - DNA, 121 bp, Artificial Sequence
  Synthesized
  misc_feature (61): n=t or c
aatgtagtgacgcccatcgttgccaataatgcctttgcactccactgaggagcacaactcnacctcctcattcttgtcattcaggactttgtgcttctggatcttaagcggtctgctggtc

SEQ ID NO: 2297 - DNA, 121 bp, Artificial Sequence
  Synthesized
  misc_feature (61): n=t or c
aaacccacacgaaacagccctcagaaaagggaaaacaaagcttggagagagtcactttccngtactgcaaactacaaattgttgtaatttggccatagttgcactttatccagtgcaaaac

SEQ ID NO: 2298 - DNA, 121 bp, Artificial Sequence
  Synthesized
  misc_feature (61): n=a or g
ggcaggtgctgtctaagcattcaccacctcgcatggcaggaggacactcaccgcacagaanaagagctctttcactgctatcacttcattcagctctcactacctggaatgctgtcatttt

SEQ ID NO: 2299 - DNA, 121 bp, Artificial Sequence
  Synthesized
  misc_feature (61): n=a or g
tagcacaaagcctgaggaagaaataggaatatttacgctgtctttgaattgtacttctagnctagaatacatgaggaaaacttcagggatgtgggaataagagagtaccatggtaaagatt

SEQ ID NO: 2300 - DNA, 121 bp, Artificial Sequence
  Synthesized
  misc_feature (61): n=a or g
ctctttcggagaagaaacttttcctagtatccaatatctatcccttctcatttgtgcccangctgatgatagactgagacatttggaaaatctaacagggatgcaacatttcgatgttaaa

SEQ ID NO: 2301 - DNA, 121 bp, Artificial Sequence
  Synthesized
  misc_feature (61): n=t or c
gctatccaaagaattttggcctccccagttaggaagtaccatactccattaccaactctcntctcctccataaaaaaaactacaattttctcctgcatgaaatttctttgcttctttcccc

SEQ ID NO: 2302 - DNA, 121 bp, Artificial Sequence
  Synthesized
  misc_feature (61): n=a or g
acctctgcgctgcagaaacacctccaggttctcactcaagctctcctcatggtccagcacnaacttgaggatggtggccagctcgacctgtgggacaggagccacgagagtggggctccag

SEQ ID NO: 2303 - DNA, 121 bp, Artificial Sequence
  Synthesized
  misc_feature (61): n=a or c
caagaatctcatgaagttcaataaagagaagtgtgaaatcctacacttgaggagaaaaaancccaggtatcaaacatgctggaatacagaaaaggacctggaggtcccaatggtcaccaac

SEQ ID NO: 2304 - DNA, 121 bp, Artificial Sequence
  Synthesized
  misc_feature (61): n=t or c
gccacagcccaccagtcaccaatgagacgtggagagatggcatgtttctgctcacattccncattccttttgagtcaaaatataatcaagttaccctcaaaaatgactctaaagctgtagg

SEQ ID NO: 2305 - DNA, 121 bp, Artificial Sequence
  Synthesized
  misc_feature (61): n=a or c
acaatgagttagaccagtcatagagtgggaggaatcctgggaggactgaccaagttgctgntgaaatcatggccgatctcccagctagatccaactttgacatcagatccaagttacctat

SEQ ID NO: 2306 - DNA, 121 bp, Artificial Sequence
  Synthesized
  misc_feature (61): n=t or c
ctcttcaatgtttgcacacagttctttgccccagctacggtgtgtagttagcaagagggcnatgctgctcagggactagaaagcccagtactgctgttagtctgggctgtggcttgcttgc

SEQ ID NO: 2307 - DNA, 121 bp, Artificial Sequence
  Synthesized
  misc_feature (61): n=a or g
ttatccatagctgcagtgacagtccagcttcctctaagacagaaacacaatctctttactnattgctgttagaaaaaaaacatctttcaagagaggtactatccacattttccaccatccc

SEQ ID NO: 2308 - DNA, 121 bp, Artificial Sequence
  Synthesized
  misc_feature (61): n=a or g
cctgttccaaagcattctgtggtggagctcagcttggacaggatctgctcctcctggcaangatgtggagcatcacgtggtagcagacaagtcagtacagggatttttttgtagctatcca

SEQ ID NO: 2309 - DNA, 121 bp, Artificial Sequence
  Synthesized
  misc_feature (61): n=a or g
aaactatagcagcagccacaactacatctcagccatcagtgttcaagcagctgttgctctntctttcctgatggacttctcctctaccaccactgctacagcagatgttctcctgaagggc

SEQ ID NO: 2310 - DNA, 121 bp, Artificial Sequence
  Synthesized
  misc_feature (61): n=a or g
ttgtgcatgccggtggactctaccctcacgaaggcaatgaaatgcagatttttagcaaccngcacagattttcagcagcgagcacttgggcaactggcttagtgaattgctagacactgat

SEQ ID NO: 2311 - DNA, 121 bp, Artificial Sequence
  Synthesized
  misc_feature (61): n=a or g
tggtgatggtgactccatcacataactgggcagtctgttccaataaacagctctgtctgcngatagcaggaaggtgagagctgcctgcagcctgccttgccaagaagcacttccagcaagc

SEQ ID NO: 2312 - DNA, 121 bp, Artificial Sequence
  Synthesized
  misc_feature (61): n=a or t
gtacaagcacacaggctgtcaagccaaatctaaggctctggaaaccaaaagttttgagctntggattaatgtatttactgactgcatgtttagctttgaagcacagagcatcctaccagaa

SEQ ID NO: 2313 - DNA, 121 bp, Artificial Sequence
  Synthesized
  misc_feature (61): n=a or g
gaaacatacctttttcttggtccagatcaacaattctctccagaacaacgtgaaagactcntactgcccacgtgtaggtgttggccattgggtgaccctacattggtgctgcccattcggt

SEQ ID NO: 2314 - DNA, 121 bp, Artificial Sequence
  Synthesized
  misc_feature (61): n=a or g
atataacgagatgctttaaaacctgcttctcattcctttcagcttatcagtaaaagactgnctagttctgtggtcatctgttacccaatgggaaaaataatggtctgaatttctcaacagg

SEQ ID NO: 2315 - DNA, 121 bp, Artificial Sequence
  Synthesized
  misc_feature (61): n=a or c
ggggaaggaggggtacctacgtgccttctgaatttggacctctctcagcttcccaggtccnacctttcctccacaaccaaacaaactcaagaaatattttcaacatagaaactgagatcaa

SEQ ID NO: 2316 - DNA, 121 bp, Artificial Sequence
  Synthesized
  misc_feature (61): n=a or g
caataccattactgtaagacaggagtctaggagagcctgacctccaacccaggagccatgntaatggggcatgaaaaccctttacccatagtttgcctgttctggggatgatcaatattaa

SEQ ID NO: 2317 - DNA, 121 bp, Artificial Sequence
  Synthesized
  misc_feature (61): n=t or c
aagcctctgttcctagaaaccaagctgaactctaaatgatttgcctagtagttgcaattcngtcttgctaaaccttgctgtgaatataaattcttgcagaagtatcatatccagcatgaaa

SEQ ID NO: 2318 - DNA, 121 bp, Artificial Sequence
  Synthesized
  misc_feature (61): n=t or g
gatttatcctagaccaccacgtagctctcgatccatgggaggccttgtgcccgggtcatancacaggggaaggctgtgaccacgcattacatctgggctgtgtgtgatattgctcagggcc

SEQ ID NO: 2319 - DNA, 121 bp, Artificial Sequence
  Synthesized
  misc_feature (61): n=a or t
caaacattcttcgacgtgggagagaatcaagtggaggaaaacagaaacaattcatgacttngaagtgaaatttcttattgctcttttcaaaatcaactctattgtccatacagtctttcat

SEQ ID NO: 2320 - DNA, 121 bp, Artificial Sequence
  Synthesized
  misc_feature (61): n=c or g
gtttttgttccttctccccaaacacagcagacatttgttttgtgaatagtttgggagtggnagtcagagtgcacttcagcttttgagttgttcagtgcttctctgacagggaagagtgtat

SEQ ID NO: 2321 - DNA, 121 bp, Artificial Sequence
  Synthesized
  misc_feature (61): n=a or g
tttttttaacagaagtgctgcaaaagtaaagatgggaaatagcacaatgtcacctgcaaanctaacttgtaacaggagcactggccatgaagatttcagttatattctggccattagaaaa

SEQ ID NO: 2322 - DNA, 121 bp, Artificial Sequence
  Synthesized
  misc_feature (61): n=t or c
atgcccaatggtttccctatgacagccctttgcagaggtttggcattcagctgcagcatcngctgtgctatatgttgtacaaaagacgacatagtctggaagcagaagtactcatcttccc

SEQ ID NO: 2323 - DNA, 121 bp, Artificial Sequence
  Synthesized
  misc_feature (61): n=t or c
gccctcttcttgaggaacttcagtacaattcttgccatcctcatttacacatctgactaangtaccacctatcacttttaaataccaaagtagcatgaaaattacagaggtaaagagatga

SEQ ID NO: 2324 - DNA, 121 bp, Artificial Sequence
  Synthesized
  misc_feature (61): n=a or g
tctattctatgacattcaggaatttagagactggcctcatgcttttcagttcaatccaaanatgcccagagacaagcagacgagctcatagggcttcctaggcaggcttttccttcctatt

SEQ ID NO: 2325 - DNA, 121 bp, Artificial Sequence
  Synthesized
  misc_feature (61): n=t or c
ctctaacctccaggtgaggtctcgagccttaggcaacagcaggtcaggatggtcttcccangaaggacagcaccttcagcctacaggagtgcagctgtccctgtgcgctgcatagttccac

SEQ ID NO: 2326 - DNA, 121 bp, Artificial Sequence
  Synthesized
  misc_feature (61): n=a or t
aagagtgcgtagtgtttgcaaaagcacaatagcaatagtttttctttatccaaactgctanaatcagctcttagaggaaatataaactgcgagctagccatttaaagcctatgcagatgag

SEQ ID NO: 2327 - DNA, 121 bp, Artificial Sequence
  Synthesized
  misc_feature (61): n=a or g
tcagtccaaccaccagtatatctgagcactttcttccttcttaaagaagaactcagaacantcttgaagcctgatactcagtttctgaaataatcaaaaaaattgttaaggagcagaggtg

SEQ ID NO: 2328 - DNA, 121 bp, Artificial Sequence
  Synthesized
  misc_feature (61): n=a or t
cgcaaaaggaataaaaaaatggtgggagtgtcaagtatcttgcagttcctttctttcaccngccaagttccgtgtgttataggaaaatacctatatttatatttcacttaactatctatgc

SEQ ID NO: 2329 - DNA, 121 bp, Artificial Sequence
  Synthesized
  misc_feature (61): n=c or g
aagagaaaatttaaggcttggaactgcccgatttactggtgaactaaattccaaattcaantgttaaagagcaaggatttgaggaaaaactcgagagctttctcttggatttctgtgccag

SEQ ID NO: 2330 - DNA, 121 bp, Artificial Sequence
  Synthesized
  misc_feature (61): n=a or g
agaactatctgctagtgagatgaatgcatatcctgcttttggatatccagtacctgaggangaaggactgcaaataacaaaaatgtagctcatttcttccagtgatggtttaactttacct

SEQ ID NO: 2331 - DNA, 121 bp, Artificial Sequence
  Synthesized
  misc_feature (61): n=t or c
gcacctgatccctttcagagcagagcattgcctgtctgcctgctgcattccagccagcagngctcgtggaaccctttcgatgttttgttactgtcagacacgaccttgccatctttgcagg

SEQ ID NO: 2332 - DNA, 121 bp, Artificial Sequence
  Synthesized
  misc_feature (61): n=a or t
gaagaaatctgactgctaatgatgtatctgcgggcaaagatgcagcagtgttcggagtgcnatggaacagggttcctgaatgtgcgtcattcattgtagctccatgtattgtctgtcttgg

SEQ ID NO: 2333 - DNA, 121 bp, Artificial Sequence
  Synthesized
  misc_feature (61): n=t or c
gtatttgaattctgaaagtctctagtttttaatctcttgcattagacttattaataaaganggatggaaaacaggtgtggtagttgttgagggtgttattgaaagacataattgcttcaac

SEQ ID NO: 2334 - DNA, 121 bp, Artificial Sequence
  Synthesized
  misc_feature (61): n=t or c
aagcagtctaactctggtttccccaagccatcccacaaaggactgacttattctatatctnactggcttctacatgcccagaggctagttcagagctctgcgcacttctggcaagcaaaca

SEQ ID NO: 2335 - DNA, 121 bp, Artificial Sequence
  Synthesized
  misc_feature (61): n=t or c
ttctgtttaagctagaactcaccggatgttgtcactatttaacagatacttcttaatccgnggaagtttgcgtagtattggtttaatatcaggcatttctgctattctcttcatcaacttc

SEQ ID NO: 2336 - DNA, 121 bp, Artificial Sequence
  Synthesized
  misc_feature (61): n=t or c
aaacatgaaacatgctgaattcattgctgaacatgagaaatgcattctggtgaaaagtcangctctctcacaaaacctattgcgtacaggctggtagctgtggcaatacaatagaaggcac

SEQ ID NO: 2337 - DNA, 121 bp, Artificial Sequence
  Synthesized
  misc_feature (61): n=t or c
ctttatattgccattttaagactcatgcttctggtatcttctactgctttcacccattttnctttaacaaataacaaagtgcttaccttttagttcacaatcatctcagatatcaagaagt

SEQ ID NO: 2338 - DNA, 121 bp, Artificial Sequence
  Synthesized
  misc_feature (61): n=t or c
ctgtgacttgctgatcagttttaaaggtactcaggagtacagaatgtgctctgcagcatangttaaaatgtgtacagtcatcccctacttagtcttctagtgctgctaattttaatgtggc

SEQ ID NO: 2339 - DNA, 121 bp, Artificial Sequence
  Synthesized
  misc_feature (61): n=a or c
gtaaaaaatagttattatgaagaacactggattaaatgttgcataggtaaaactacagaanagaggatctatgcaaatcttaactagatgaagctcctttaatagaatcagaggggttgaa

SEQ ID NO: 2340 - DNA, 121 bp, Artificial Sequence
  Synthesized
  misc_feature (61): n=a or t
aggtttcaaggaaaatgtatatgcattttgccaatttattatagtagttctgctaaaaagnatttccaacacaggtcaaaatccagtgatatatgaaccataatgtcttctgaggtttgga

SEQ ID NO: 2341 - DNA, 121 bp, Artificial Sequence
  Synthesized
  misc_feature (61): n=a or g
aaatcataaatattagacaagagagagcacacacatataaacaccggggaaatttcagaanatattgcactactgcttagaatgatgtggagccttgatagccacagaacacataccattt

SEQ ID NO: 2342 - DNA, 121 bp, Artificial Sequence
  Synthesized
  misc_feature (61): n=t or c
agtggagatttgtttttatttttttcttgataatctgcagcaaagttcttgagcaaatttncatgggcaaaatccccgctgttgtgttagtgccctcgtttaatcagagcttgcaaaatac

SEQ ID NO: 2343 - DNA, 121 bp, Artificial Sequence
  Synthesized
  misc_feature (61): n=a or g
ctgggctctgctgtggtttgacaggcttctggtgaaactgacacgtttctaaatgccacantgagtgattttattgaaagtgtgcgctgtacttccagtctgaatgcagagctgcagttct

SEQ ID NO: 2344 - DNA, 121 bp, Artificial Sequence
  Synthesized
  misc_feature (61): n=t or c
tctttcccttttagagacacatcttcagtaacttcacactgtgggctctactcacattgtngacccagagaaattcaacagtttacatgtgtcagtgtagcaaattggttttctaaacatc

SEQ ID NO: 2345 - DNA, 121 bp, Artificial Sequence
  Synthesized
  misc_feature (61): n=a or g
taaatctcagcacaccagtaaggctttcctctcagggctgctggtctgatgggcgtgctcntgttccttatggctgcttcccctgctgacctccattcaggctcattctccatcttctgcc

SEQ ID NO: 2346 - DNA, 121 bp, Artificial Sequence
  Synthesized
  misc_feature (61): n=a or g
ccatctccctttctgtcccaggctggcttgctttcagccattttttacacttcatttttcncccgtccttttcagttataactaatctccccgggtggtgattccagcactgctgcagaac

SEQ ID NO: 2347 - DNA, 121 bp, Artificial Sequence
  Synthesized
  misc_feature (61): n=a or g
ttgctgaacctgctccaaaccccctgttcctgaacaggactgtcgagaaacttgtggtaangcagccctcgtgtcctgacaccatcaaggctcctgcggccccaccgtgcctggtgcccag

SEQ ID NO: 2348 - DNA, 121 bp, Artificial Sequence
  Synthesized
  misc_feature (61): n=t or c
ctaaggagccagcctctgcaagtctcatggtagaatcatgcatgactgcttccctcaacancctgaagtgaaaccatccacctgaaaggtatcatctggcaccctggagagctacacaaag

SEQ ID NO: 2349 - DNA, 121 bp, Artificial Sequence
  Synthesized
  misc_feature (61): n=t or c
caggaattgaatttctcaaacattcttatgaataaacaaaacagcaaagggtttgtatctntgccatcgtcagctaggatgtgtcaagaatttgcttccataatgaagacagcttggctga

SEQ ID NO: 2350 - DNA, 121 bp, Artificial Sequence
  Synthesized
  misc_feature (61): n=a or t
tactgtctgccactagaaaggacaacttaaatagattggtcattaattgctttcattaggncatgtgccctctgctttcaggaatccccatagccttgctgcttaaatgctcatttgtagc

SEQ ID NO: 2351 - DNA, 121 bp, Artificial Sequence
  Synthesized
  misc_feature (61): n=a or c
gactgtggcattaaacagatctcctgttttggaaggagaaaacccctgctgttcttctacntctcctgctcacagaactcgggtggctttgggcagttcttaacagaacagccacactcaa

SEQ ID NO: 2352 - DNA, 121 bp, Artificial Sequence
  Synthesized
  misc_feature (61): n=a or g
aaatgaagattttccatcttccaaatggaatcacaatatttacaaatcagctgctgttctntcaagtagtgacctataaattaaatttaaacagcgtgctaccagaaaataacagttcaca

SEQ ID NO: 2353 - DNA, 121 bp, Artificial Sequence
  Synthesized
  misc_feature (61): n=a or c
cagagatgagatatgtacctcaggtggacacactctcacaggtttgctcatcaaacaagangatcaccttgcacttccacaatgacacctcaagccagaaaatgcactgagccttgagatc

SEQ ID NO: 2354 - DNA, 121 bp, Artificial Sequence
  Synthesized
  misc_feature (61): n=a or g
aatgttcagtgcctgatttgtttgtgtgctttcagcaactgaaagagctaacgtaagtaantgagaaaagaaaaatcacctgcatagctggaaacataaagttcagttgtccaagttttaa

SEQ ID NO: 2355 - DNA, 121 bp, Artificial Sequence
  Synthesized
  misc_feature (61): n=t or c
tggatctgacatagttaaaattaaaaaggaaattgttttctattattaattatggaagtgnatgtcttcttcccagagccctcagaaatggtgaaacagcatctggtagcagttcattgta

SEQ ID NO: 2356 - DNA, 121 bp, Artificial Sequence
  Synthesized
  misc_feature (61): n=a or g
aaacatttgtatccgcaacacatactgcatttaattggtctggtaatatgtcttgccttcngttttatgagctttcagtattgctctacaactgccacaatgagaacatcaaatctccacg

SEQ ID NO: 2357 - DNA, 121 bp, Artificial Sequence
  Synthesized
  misc_feature (61): n=t or c
gtgggagtctctgaccattttttgcaaccagcactaacagaaacacaccttttagctctgntgaaatgtcttgtcttcatagagttcttattcttcatcacatattggccctgttgacttt

SEQ ID NO: 2358 - DNA, 121 bp, Artificial Sequence
  Synthesized
  misc_feature (61): n=t or g
cctccaactcacagtgaaacccaccccttcactcactgaagacacatggagccattccctngctttgtgctgttcactcatccccaccttagtgctggggctgagtgcccatcaccactgc

SEQ ID NO: 2359 - DNA, 121 bp, Artificial Sequence
  Synthesized
  misc_feature (61): n=a or g
aggagagtatgttgttctgacttgtgcttccacccggtaccgcacgtactgctgcgacacncacgagacatatcagtgcctaaccaaagtgcatcattcctgcctcatctctccaaagcca

SEQ ID NO: 2360 - DNA, 121 bp, Artificial Sequence
  Synthesized
  misc_feature (61): n=a or g
actaaaacctatgcaatcattcataagttccaggtgccatcaagttcaatatgttatattncagcatcacatactgaaacaaagtgcaaaattctgagataataaagtgattactaatttt

SEQ ID NO: 2361 - DNA, 121 bp, Artificial Sequence
  Synthesized
  misc_feature (61): n=a or g
tgtttcaggcttgcatactaaaaatgaatgagtgaacttaaattgtaggacgctcgcctcnaaagttcaaatctccctgttcaaagcagtcataatgaattctgagaaaaaacatgtattt

SEQ ID NO: 2362 - DNA, 121 bp, Artificial Sequence
  Synthesized
  misc_feature (61): n=a or g
agaattaaaatattttaaagtagaatttcttcacaagctgagggagctgagggtacttccnttctgaatgattctgatgatgagatagaaagtaaaaataaaacgctggaggtgttggttc

SEQ ID NO: 2363 - DNA, 121 bp, Artificial Sequence
  Synthesized
  misc_feature (61): n=t or c
atctataatagcagaactgtctcctcactggaggaagtgtagtagcctgcactgccataanaagcaacagaatgcacaagagagatacttcaaaatgagtctcaaaagagcaattaccaca

SEQ ID NO: 2364 - DNA, 121 bp, Artificial Sequence
  Synthesized
  misc_feature (61): n=t or c
aacaaaacataacctgaaatcctataattctcagatcctctctgtttgctatctattattnatattcattgtcaatagttcatcagttctggtctgtttttccacttcaaagatcttgttt

SEQ ID NO: 2365 - DNA, 121 bp, Artificial Sequence
  Synthesized
  misc_feature (61): n=t or c
atggagtagaatagactttctgtataggaagaaaggaaataatttcagggagaaaatcttnagactatggattttctagatgggtatcactggagatgtttgagttcactaatggaggtag

SEQ ID NO: 2366 - DNA, 121 bp, Artificial Sequence
  Synthesized
  misc_feature (61): n=t or c
ttctgggaaccaaggtgaattaaggtttgaccttctttttagtattgtctttcttgacacnttctcttacatatacacttgttttcaggcttcaggaatgagctgcattgatcctgttttt

SEQ ID NO: 2367 - DNA, 121 bp, Artificial Sequence
  Synthesized
  misc_feature (61): n=t or c
agttggaccaaacgcatgtgtaaagctcagcaggatcagtctgcctgcttcagactcttcngtgatcctgactggccctctaggttctcagtaattagtgagagatcactgcagtgagttt

SEQ ID NO: 2368 - DNA, 121 bp, Artificial Sequence
  Synthesized
  misc_feature (61): n=t or c
tctagacacattttgaatcaaaatggttgaaagcatatttgaacaccaagcacttggtaantgggcatactctcacagatacttctgataggtaaaaatgattttcatcaatgttcactgt

SEQ ID NO: 2369 - DNA, 121 bp, Artificial Sequence
  Synthesized
  misc_feature (61): n=t or c
ggcaagaacatagactgcattaatcaacacgcccaaagaacaatcaaacataattttattnttaaaaatgcgaagatttcgtttttcatcattctgaactctagaggctccaggcctgtaa

SEQ ID NO: 2370 - DNA, 121 bp, Artificial Sequence
  Synthesized
  misc_feature (61): n=a or g
tacatacagagacttcctggtcttgggcaatcaagataaagaccatgacactcacagtccntttctcttatgttcttgctttctccaaaaggacaatgacccaacgcaaatctgtggcagc

SEQ ID NO: 2371 - DNA, 121 bp, Artificial Sequence
  Synthesized
  misc_feature (61): n=c or g
catgccattttggcttggcaaagaattctcaatttgctgcaggagtcagcctgtaatccanaataccacacactattgggcacaggtagcgacccactcacattctagcaatgtgtcctct

SEQ ID NO: 2372 - DNA, 121 bp, Artificial Sequence
  Synthesized
  misc_feature (61): n=a or g
ctaacatttatccagaaataaaatagaagcttgaatggattgtagcttggaaacaaaccanggctttggatatctgaaagaggcctagaaattatacattcatatgagctactgcatgact

SEQ ID NO: 2373 - DNA, 121 bp, Artificial Sequence
  Synthesized
  misc_feature (61): n=a or g
tctgctgtacacacacagctctgtgcagagggcagccctgcttcaagtagtcctgaggctnccacacgtctacagggacgtttagtgccttcttgccttactaagaaaagctgagaaaata

SEQ ID NO: 2374 - DNA, 121 bp, Artificial Sequence
  Synthesized
  misc_feature (61): n=t or c
atccctcacgctgctcttatgcctgctgtttgcattcaatgttttcctcactccacacttnatccttctttttttcattagagaaaaatacttgtgaagataacaaatcatttgggggcca

SEQ ID NO: 2375 - DNA, 121 bp, Artificial Sequence
  Synthesized
  misc_feature (61): n=a or g
atcagctctaaagaatatgcataatcattttgatgcacaggagagattatcctaagtgcanccaaacatttgatgttgctgagcgcttggtcatgtactctccctaaactactgggaactg

SEQ ID NO: 2376 - DNA, 121 bp, Artificial Sequence
  Synthesized
  misc_feature (61): n=t or c
cttattaagagtaaattcctattgagacttacatatttagctgctacttagggtagccacngagtcttaatttgtgagcactgaattggagacagtttcctttattttctttgatatctct

SEQ ID NO: 2377 - DNA, 121 bp, Artificial Sequence
  Synthesized
  misc_feature (61): n=t or c
agcatttttccattgcttgttgaaaatgaggtcagttgttggggttcggtattggtgaaantttaaatattatttgttagtaacgtgcttggttcctggcactggagtaaactcaatactg

SEQ ID NO: 2378 - DNA, 121 bp, Artificial Sequence
  Synthesized
  misc_feature (61): n=a or c
catggcaaaaatgggactgaagcttgtgcattcacacagcaccagcaaatgtgttccaatnaaaaaccaaaacacagttgtatggcagtggaccgatcagagtaataatcactgtttgact

SEQ ID NO: 2379 - DNA, 121 bp, Artificial Sequence
  Synthesized
  misc_feature (61): n=a or t
gggatttttgccctgctatgcagctcagttttccctgaataggaattaaactgagtttaanttagtacagaacaaaacacacctgaataatctgtacttagagagtacagtcaggggagaa

SEQ ID NO: 2380 - DNA, 121 bp, Artificial Sequence
  Synthesized
  misc_feature (61): n=t or c
ttgtagaatggagtttaatgaaaagggtattgtctccttttctaccatgtatggacattcngaagtgttataaggccttcaaactatgtgtgtaccctgcttttgactgtaaaaccatgtg

SEQ ID NO: 2381 - DNA, 121 bp, Artificial Sequence
  Synthesized
  misc_feature (61): n=t or c
ctcaagcatgagggccttagccctttagcactttctagaggaacaagaaaaatgtgaaatngtttatcagagagaggtacagatactggagttgcacactgctgtatttttacttttgtta

SEQ ID NO: 2382 - DNA, 121 bp, Artificial Sequence
  Synthesized
  misc_feature (61): n=a or t
aatcagctcttgcttagcttttgtcttcaacatattaaacattttaagctgtctactcttnaaaggatttaacaaaactacagggaaagtagtcaaatagcagggtagtttacatgagcat

SEQ ID NO: 2383 - DNA, 121 bp, Artificial Sequence
  Synthesized
  misc_feature (61): n=t or c
taacagaaaaagtggtggataaatgaactgaaattacattgggtattccttaaacaaacangaggatacagataaagcttacttactttttaataacatggttcactaaaacttcttaaaa

SEQ ID NO: 2384 - DNA, 121 bp, Artificial Sequence
  Synthesized
  misc_feature (61): n=t or c
agtgagattcgtaaacccacagcaaaagatcacacagatttaatcacgcattttcagaaanagatctgagcaagaaggacgttctgttactgagaaaggaaagcaatagataaatacagta

SEQ ID NO: 2385 - DNA, 121 bp, Artificial Sequence
  Synthesized
  misc_feature (61): n=t or g
taccatgactcttaacgatacagctagagagtcctcaagttagctaacttactgcaagttngactggaacagcacaaaatgtcagcgtagattgaccacatgcacttcctcacttttctca

SEQ ID NO: 2386 - DNA, 121 bp, Artificial Sequence
  Synthesized
  misc_feature (61): n=a or t
tgtataaatagctcagaatatgagcctttaatctctcagccatttgcactatgtttagttngtatttggttcttttctgtacccattttttctatatcacttagctttacattttctgagc

SEQ ID NO: 2387 - DNA, 121 bp, Artificial Sequence
  Synthesized
  misc_feature (61): n=t or g
tttaaatactacacatgtaattgagcttgaattaaaaaggttgggaaaggcctttgtaagntactctgcagtttgtcagatgtatttattcatatgctgaggattagaattcataaacatt

SEQ ID NO: 2388 - DNA, 121 bp, Artificial Sequence
  Synthesized
  misc_feature (61): n=t or c
taaaagagcatggagcagtttcaagagcatcatgtacacataagtaagagtagttaaagcngcggttttactgaggagtgtaacttcaaacctgacatcaatctcactacaggtagaatct

SEQ ID NO: 2389 - DNA, 121 bp, Artificial Sequence
  Synthesized
  misc_feature (61): n=a or g
tgaagaaacagacctgtgcaaaaacctccccacgttcctgcacactgagcactgagacaantgattattttagcttctctgctgttgtcacatcagcgttgctccatgcgtgctaaccccg

SEQ ID NO: 2390 - DNA, 121 bp, Artificial Sequence
  Synthesized
  misc_feature (61): n=a or g
gaggtgtgatgatgagagaaaggagttgaatgtggtcccaaaagtgacttccctggactgntgcataggaaactttcagtaagaaaagaaaatatgctgtattgtcttaggggttgctagc

SEQ ID NO: 2391 - DNA, 121 bp, Artificial Sequence
  Synthesized
  misc_feature (61): n=a or t
aaccttaattaagatctctcttggttttggaagagaatgatgatttgcttcggttctgccntatctagctttttaataagcacctgaattaaatcactaggagacattaaaagtcatgaaa

SEQ ID NO: 2392 - DNA, 121 bp, Artificial Sequence
  Synthesized
  misc_feature (61): n=a or g
cccccagcactggccaccccccccccgacatttccccccagctttgtggccttctgtgtgntcacagaatatggaataaccccttgcttaattatgaccagctgtgctgggaatggctagg

SEQ ID NO: 2393 - DNA, 121 bp, Artificial Sequence
  Synthesized
  misc_feature (61): n=a or g
acaggcctgagccttgtatggtgctggcctgggccttgaatggtgtgagcctgcatcccgnggctaaggagatgctgtggaggcattaactgcaagggctctgtactgtgcctgtctctgt

SEQ ID NO: 2394 - DNA, 121 bp, Artificial Sequence
  Synthesized
  misc_feature (61): n=t or g
gacacattcgcccatacagcactcatcttgggtctaactctttcactgcatcctgaacagngaagctggagggcataaggccgtgttgccactagcattcattcttgtctttcaacagctg

SEQ ID NO: 2395 - DNA, 121 bp, Artificial Sequence
  Synthesized
  misc_feature (61): n=t or c
ccatgctcccctcagtactcactgagtactctgtaggagctgtgggatctggcttcacacngatatattctgaaccccttgaggaagaagctgtgtgtctatctcaaagagaaacagaatt

SEQ ID NO: 2396 - DNA, 121 bp, Artificial Sequence
  Synthesized
  misc_feature (61): n=a or t
aagagaagtaactggaagattgaatttggcaagtttcttggataatctgggtgatgcttcntacatcaagttccccctaagaactgcttctgtcttacactgttctttacaactcccagtg

SEQ ID NO: 2397 - DNA, 121 bp, Artificial Sequence
  Synthesized
  misc_feature (61): n=t or g
cggaggcatggaaacatggactttgaccagctaaaggtgaacttcaaagatttgattaagngtctaccagtcttttaggaatagaactcagtttatgcaaacccgccttcccctagtcatg

SEQ ID NO: 2398 - DNA, 121 bp, Artificial Sequence
  Synthesized
  misc_feature (61): n=t or c
gcagccctttgaggctgctgggtcctcctcactgatgcctaaggagtagagaacaaccttntccttaagacaggtccctagaatgcatgagctgaggggatggatacatccctgcattcct

SEQ ID NO: 2399 - DNA, 121 bp, Artificial Sequence
  Synthesized
  misc_feature (61): n=a or g
gttgccttcaagcatctgagggatgctgctgtgatggcttctttctgctaaatgccctccnaggcttcattctacctgcctgagattctatcatcgctgggatctgctctccaactcggtg

SEQ ID NO: 2400 - DNA, 121 bp, Artificial Sequence
  Synthesized
  misc_feature (61): n=a or g
gcagcaagtaagtattgcatagtaatttgtactgttcttcaattatgtttcccatccatancactgttcacagtaaagacagacaacaaattggaaacgggcatttctcagccatatattt

SEQ ID NO: 2401 - DNA, 121 bp, Artificial Sequence
  Synthesized
  misc_feature (61): n=t or c
gttgttgctctaagatagaaatttgtctggacatgtcccctgcaaaaggtttccacagagnctgcagacattcctgtgacccttctttacgtaaacctcaactcaactcaataacaatgct

SEQ ID NO: 2402 - DNA, 121 bp, Artificial Sequence
  Synthesized
  misc_feature (61): n=a or g
agacgtaattttttataaaatcactgaaattttaaattagcaatagaatcacttaaagcanagaggctccaggttcaagcaagaatttgttcatgaaaaccttctaattcctaatggagtc

SEQ ID NO: 2403 - DNA, 121 bp, Artificial Sequence
  Synthesized
  misc_feature (61): n=t or c
tatgattacatgattctatgagtctacgattgtcatccaccctggggaacctaagggcagngcagaaacaaagcattaaaggacctggagatgctcattgctgaaagtgaggcagttattg

SEQ ID NO: 2404 - DNA, 121 bp, Artificial Sequence
  Synthesized
  misc_feature (61): n=a or g
ttacttaggttacatgaaaacctgctacagcccaaatatagatgcaagacctgatgaaagntacagaagtatacaactgcaaacactatagaattattttttttcagaacaagtgacatgt

SEQ ID NO: 2405 - DNA, 121 bp, Artificial Sequence
  Synthesized
  misc_feature (61): n=a or c
ctttctgacggagggataaaggatcggagtttctagaagattacgcttctgggtccagagnattttttgtccaaaatacaagcatgttcatggttgacaaactcttctggtggaaatcctt

SEQ ID NO: 2406 - DNA, 121 bp, Artificial Sequence
  Synthesized
  misc_feature (61): n=a or g
aaaaaaccataacagacaaaaactccaacatccttgcttccagctagtgacccacaggaangtaatgatagaaaatgaggacctaccttaggttcaataggggtttggggtatatcagaga

SEQ ID NO: 2407 - DNA, 121 bp, Artificial Sequence
  Synthesized
  misc_feature (61): n=t or c
gaaaaaaaaaaatcttctggctgccctccagccttcacatttgtactgttccacactgtanggacatgaatgtacaacataaaagaaatatgactagctaaaaggtaggaaagcagttctg

SEQ ID NO: 2408 - DNA, 121 bp, Artificial Sequence
  Synthesized
  misc_feature (61): n=t or c
actcgttgtcatcgaatgaaatcaccgaaggttcggcaagtatgggttctccagctgtgcngcagtgattcacggcctcatgtcctcattctgtgcctgacagagatttcacatcaacagg

SEQ ID NO: 2409 - DNA, 121 bp, Artificial Sequence
  Synthesized
  misc_feature (61): n=a or g
tgaaaatgtatgtgtaggtaatccattatctggaacaatgacagtgatcggatgaagctcntattagagaagggcctccttacagagaaatacatggccctgccatgtctgcgagaggctg

SEQ ID NO: 2410 - DNA, 121 bp, Artificial Sequence
  Synthesized
  misc_feature (61): n=a or c
cccagaaaaacacagaacttctttaaaaccaactttctctgttactttgaccaactaatcnatcatttttaccattactgcaagttctgatcttcagctgcatcaccaccatagtttaaaa

SEQ ID NO: 2411 - DNA, 121 bp, Artificial Sequence
  Synthesized
  misc_feature (61): n=a or g
aataaaagttgaaggggaaaaaaataaatgtgcttataaaagtgctgccttttaaatagtntagactgtatttaatttccgcagttgcagtcaaagtctatgcaacaccactcaaatccag

SEQ ID NO: 2412 - DNA, 121 bp, Artificial Sequence
  Synthesized
  misc_feature (61): n=a or g
aagaaaaaactccttttcctgaaagagaaagacacaacattactaacttctgcatcaaacnctggacgataaaccaactcctgagtgtaaatgctctttaaaacagaagagatccatcata

SEQ ID NO: 2413 - DNA, 121 bp, Artificial Sequence
  Synthesized
  misc_feature (61): n=a or g
ttatatcaaaagaagcctcttcctctttataatatggaaattccaagctaaaggaagaacncaacaaaaagcctcatacttggatgcagcgagccgctccccagtcccaccaactgcagag

SEQ ID NO: 2414 - DNA, 121 bp, Artificial Sequence
  Synthesized
  misc_feature (61): n=t or c
gatcctcgcttgccactgcctatgtaagtaggctacattgaagaagagacaaattgtgagntctgagtaaagaaacggattagctgtctaccatgatgtcgtgcagaaaaaaagctgatgt

SEQ ID NO: 2415 - DNA, 121 bp, Artificial Sequence
  Synthesized
  misc_feature (61): n=t or c
aggacttcaaagtctgagatgatatatgctcagagatttgcccgggcgtttctaaatctgntacaacgtaagtcgcatacaatgctgttcacttaagttatggaaagaaggataaatgctc

SEQ ID NO: 2416 - DNA, 121 bp, Artificial Sequence
  Synthesized
  misc_feature (61): n=a or g
ttctgccttcctgggcagctctgcaggtacactttttatgcattgatacaagcaagaagcntttattttcatcagcaggatctttttgtgtttgaaagtgctagggagaatgttagctgat

SEQ ID NO: 2417 - DNA, 121 bp, Artificial Sequence
  Synthesized
  misc_feature (61): n=a or c
tatccctggcacactttatataactaggcagcctgtttgaactttaggactatccccagtnctttaacttaatctacccatacagaaagattttggaaacagtgaatctctacatcacctt

SEQ ID NO: 2418 - DNA, 121 bp, Artificial Sequence
  Synthesized
  misc_feature (61): n=t or c
tcagagtgcaccgtgaactgagcagctgcctctgagggcgaaagctttcttctttcagcanagattcttgagcgtggtttgaaatatcacaattctaatagggtgtttgtttaaatcaaag

SEQ ID NO: 2419 - DNA, 121 bp, Artificial Sequence
  Synthesized
  misc_feature (61): n=c or g
cttaggtttgcttttctgcttaagccaatatgtattagtgcaacatgcagtatttttatgnagaaaggtaggatgccaatagtattatacttgacattatataaattaatgcatttctgag

SEQ ID NO: 2420 - DNA, 121 bp, Artificial Sequence
  Synthesized
  misc_feature (61): n=t or c
aaatgttggttcaaatatagtgattttttgctgcagaaaaaggcctaaaaaattaacactngtgtaagctgggacataaatcctttcatgtcacatcagtattttttgtctgtacccttat

SEQ ID NO: 2421 - DNA, 121 bp, Artificial Sequence
  Synthesized
  misc_feature (61): n=a or g
tagcattgcagtagcgatcagctttgaaagcaccagtattatgaatagttgagaagtcagnaggaagggatatgttgtggctttgttcaggaaatgtttgcaggctgagaaatactggaca

SEQ ID NO: 2422 - DNA, 121 bp, Artificial Sequence
  Synthesized
  misc_feature (61): n=a or g
ctttgaaagtaattttaggtataactcagtgattgttctatgaaactgtaagctaagctcntgtaaatttggcttctagtggtctattttactccaaagtaatggaggatcattcacccaa

SEQ ID NO: 2423 - DNA, 121 bp, Artificial Sequence
  Synthesized
  misc_feature (61): n=t or c
catttcgtattcgctctcagcttgtgggctcagtcacatctcagggccagctgctctgagnggagatttatggaggtgctcactgcagatgctcagcctcaccaggcacagagcaggatcc

SEQ ID NO: 2424 - DNA, 121 bp, Artificial Sequence
  Synthesized
  misc_feature (61): n=c or g
acttcaaaccctttctggagcagagaaagacgtggtgtggggacacagcaaggctgagctnagccttatgaacaaacaccacaacaagcagtgctctgcctcagcacacagaatctgctca

SEQ ID NO: 2425 - DNA, 121 bp, Artificial Sequence
  Synthesized
  misc_feature (61): n=a or c
ctctctaacttacttaagtctattcagactatactgactggttttgcattgaagcagtganagaaccacagctgtgctgggacagaagtatcatcgagctgaagagcagcacttccttgag

SEQ ID NO: 2426 - DNA, 121 bp, Artificial Sequence
  Synthesized
  misc_feature (61): n=t or c
gctccttgctcactcatgaaggtcttttcccaccttctcctgaatctactacagtcttgtnccgtttcaaattcctgtataaacagtcggtaactagctgggagacctccaaggagcagca

SEQ ID NO: 2427 - DNA, 121 bp, Artificial Sequence
  Synthesized
  misc_feature (61): n=t or c
aagactgaatacactggcagtaaatggcaacaagtgaaaggtggcaatctcttttacacanctgtttgtccaaagaagcctatctcacaaataagcactcagccttacagaccctcataag

SEQ ID NO: 2428 - DNA, 121 bp, Artificial Sequence
  Synthesized
  misc_feature (61): n=a or t
ctcagagctccaaataatgtcactcctcctaacgtcctgttaagcattcacatttgtcagnctcactgagtagatataccagacttagcacttggaagccatacagtgccaacagctgtag

SEQ ID NO: 2429 - DNA, 121 bp, Artificial Sequence
  Synthesized
  misc_feature (61): n=a or g
aaagctttgctgaactgtgtcaaagagaaaaatcagtatagtatgttttaaaatggaaagnaattacctggacattgtagtatgtccatgatatggtgtctgcacgaaatttcctaatata

SEQ ID NO: 2430 - DNA, 121 bp, Artificial Sequence
  Synthesized
  misc_feature (61): n=a or g
atctctagactcctgtgtacaacgcccttgcatctccttctttcacacagtgtaacatgantgtgagctacagctgtgagccttcattgagatattgctgctttgtacatctgtgcccttc

SEQ ID NO: 2431 - DNA, 121 bp, Artificial Sequence
  Synthesized
  misc_feature (61): n=a or g
ccgcgtctttattttggaaatattgcctcttcatgccaattcatgaggctgtgtcacaacnctgtgcctgcttcatctcttgtctctgggggctgtgatccatgtgcagccagtggcagta

SEQ ID NO: 2432 - DNA, 121 bp, Artificial Sequence
  Synthesized
  misc_feature (61): n=a or g
tcactggacatacggaggatgctgaaagtttgatttgttccttcctatctcacataacaanactaagaaaggacagaaattatttctcatcagaaaaatggttccattttctctggcacaa

SEQ ID NO: 2433 - DNA, 121 bp, Artificial Sequence
  Synthesized
  misc_feature (61): n=c or g
atggtgactgtgtaaggctgagatgtcagcagcttactggaagacagcttttaccctccantatctgatgaagcaaatgtatggtttgtgggaactggttcaggaacacaggatattttaa

SEQ ID NO: 2434 - DNA, 121 bp, Artificial Sequence
  Synthesized
  misc_feature (61): n=t or c
gtttggcacctcctgcttctggctggcgagcacagaggctccaaaagccaatctgttgctntctgagttcagatgaagactgcactggctatgtaatcccagactgatttattccagcgtt

SEQ ID NO: 2435 - DNA, 121 bp, Artificial Sequence
  Synthesized
  misc_feature (61): n=t or c
gtatggatgtacagatttcagtccacagtgtagcaggtgtggacagtgtgttttctgattncagtctctggttccagctgcttggaaacaacattgggtaagtactgttcaaccagctgtt

SEQ ID NO: 2436 - DNA, 121 bp, Artificial Sequence
  Synthesized
  misc_feature (61): n=t or c
gtgatcaggctctgatctctgtctttcctggctcaaactctcttgtgttcagacacctgangttttaaatgataaaaagtctaacacaaaaggaagaacagttgtgacctggaatgagttt

SEQ ID NO: 2437 - DNA, 121 bp, Artificial Sequence
  Synthesized
  misc_feature (61): n=a or g
tcacaactggttttggccaatttgaaactaacttaacagagagatgctcaagttcaagtangtagtatgctgagtaaaggtaagaatcagtttctgaaacaacaggttgccaaaaagtacc

SEQ ID NO: 2438 - DNA, 121 bp, Artificial Sequence
  Synthesized
  misc_feature (61): n=a or g
tccctacatccaatccaaacctctagtgtttcaagttatgtgtgttgatagcactgctacnaagagcctggccctgtcagaaaacttcccagacatgctgaggaactgccaccaggccctt

SEQ ID NO: 2439 - DNA, 121 bp, Artificial Sequence
  Synthesized
  misc_feature (61): n=t or c
acagggatctaagggagctgcttatgcttttgttgtgcagcccagagtgaaatcaggaatngcttcaagtgagagtcaaatagactccaagcctctagatgaaaacagatgaagggacaga

SEQ ID NO: 2440 - DNA, 121 bp, Artificial Sequence
  Synthesized
  misc_feature (61): n=t or c
cattgaacagatattgtagtcaccaccattacacaaaaaagggaatacacttggtctgtanagacttacatgttcgggaaggatgaggaaaaacagcatttgcttgaaaactcatgaagca

SEQ ID NO: 2441 - DNA, 121 bp, Artificial Sequence
  Synthesized
  misc_feature (61): n=a or g
gggctgaaggttggggggaatgatgttgcagaagccgtggggcagaatgtattctgtctcntagtagatgtttttccagcggtgtgcacaggcctaaacagatcataccacatgtgttact

SEQ ID NO: 2442 - DNA, 121 bp, Artificial Sequence
  Synthesized
  misc_feature (61): n=a or g
tttattactgtgcaatcaatatggctaaaataatctgatttcgacagaaagtcaatatgcngtgattaagcaaattccacaaatgacatgcaatcccattagcactaccaagccaaattct

SEQ ID NO: 2443 - DNA, 121 bp, Artificial Sequence
  Synthesized
  misc_feature (61): n=t or c
cctcactaactactcccaccaagtgcttttaatttcccactgtgcaatgatgtagcaagcngttataagaaaacacctatcaggccctaacaaactcctttcaggtactggtctgcacaaa

SEQ ID NO: 2444 - DNA, 121 bp, Artificial Sequence
  Synthesized
  misc_feature (61): n=t or c
tcctgtagctttcctgcttcctcacatgcagaagacatcactcagccccacactgtgtcangaagagctgcaactcggcaaataattactgcaactaattactgcaactaatgcctaacac

SEQ ID NO: 2445 - DNA, 121 bp, Artificial Sequence
  Synthesized
  misc_feature (61): n=t or c
gagtctttgagcaaacactggagagtgaaaaatacattatagacctggtgagccgtgctgngggaaatgtaaactataaagcagtgatatatctttaggagttgtttcttttttactactt

SEQ ID NO: 2446 - DNA, 121 bp, Artificial Sequence
  Synthesized
  misc_feature (61): n=c or g
ctcattcctagtctgctcctgtgcatcagtttatgtgccactgctggccaatctttgtagnaagtgggcctttctctcaaggtcctactccttgcccaattttctgtgatttgtctgcagt

SEQ ID NO: 2447 - DNA, 121 bp, Artificial Sequence
  Synthesized
  misc_feature (61): n=a or g
tatatatatatatatatatatataggctatctggagcccattttggttttttaagcagtcntcttggggcagcagtggatagcattaatacttcagttaaggttaaaaagcttggagtctt

SEQ ID NO: 2448 - DNA, 121 bp, Artificial Sequence
  Synthesized
  misc_feature (61): n=a or g
aaagctctcttacatgaagtacagaaagaagaaatttgctaagctgcccaagatgtaccanctgcttcactgaaagttcatgttctggcagcaatgtaacacatttgctgaaagccctgga

SEQ ID NO: 2449 - DNA, 121 bp, Artificial Sequence
  Synthesized
  misc_feature (61): n=t or c
acatttagataacagctttgcaggaatgcagctggggcagcactggagtctgctcaggaanattgttacaagctgtgatttgacttcaatatctccttgttatttcttagtattaaatcca

SEQ ID NO: 2450 - DNA, 121 bp, Artificial Sequence
  Synthesized
  misc_feature (61): n=a or g
tggtgctccaggtagcctaacaccggtgttgacaggcaagaagaccaaaaactactgtgantggtgctgcacagaagtctccaccttagctggaacattttcaggtggtccacaagctgta

SEQ ID NO: 2451 - DNA, 121 bp, Artificial Sequence
  Synthesized
  misc_feature (61): n=a or t
atctgctggttttggatcttcttgaaaatttccctcatgtgctcttccttatccaaaaaanaaagattcagagggaggagttttaattgatgatcaaactgaatctatgatcagtgctgtg

SEQ ID NO: 2452 - DNA, 121 bp, Artificial Sequence
  Synthesized
  misc_feature (61): n=a or g
gtgtaggaatggtgcaaagctgcaataagactggtcattaggaaaaattaatttactgtgngggtgatcatatactgcaacatgctttctagagaggttgttgatgtcccatgcttgtcag

SEQ ID NO: 2453 - DNA, 121 bp, Artificial Sequence
  Synthesized
  misc_feature (61): n=a or g
ctttgaaggatgtcaatctgttcaatatgttctcaactgaactctttaagacttgcaaatnttttgaatgaacaagaccaatgcattctttaaaaaaaaaaaaaaaaaaaaaaaaaaggcc

SEQ ID NO: 2454 - DNA, 121 bp, Artificial Sequence
  Synthesized
  misc_feature (61): n=a or t
atctttaattgatttgtgatggctctcaagattgtccattctgtaaccttctttagtgctnatgtgagactgatagttctgtgtaagaagctggaacaatttttgtctcaaagtctcttca

SEQ ID NO: 2455 - DNA, 121 bp, Artificial Sequence
  Synthesized
  misc_feature (61): n=t or c
tcaactatgtctattactccatataagctattcttgttaagtctatccgcactgttattgntatgaatatgcctccactgtcctgttaaatcaaatataaacattgcagttagttcatgct

SEQ ID NO: 2456 - DNA, 121 bp, Artificial Sequence
  Synthesized
  misc_feature (61): n=t or c
aaagcttggaagcgtagataagctcagcaacacacagccaaagttatacaacacagttcantgctagactgacagcggaaggtaaactcatccctgtttcaaaaagcccacctgaagcttc

SEQ ID NO: 2457 - DNA, 121 bp, Artificial Sequence
  Synthesized
  misc_feature (61): n=a or c
tcttaaaaaaagtgcatggttatactttaagaaaaagttacttcctggtcttgagactagntctgaattgggaagaaggtgattttaaaggattctagtgagaagaaagaaaaccataatt

SEQ ID NO: 2458 - DNA, 121 bp, Artificial Sequence
  Synthesized
  misc_feature (61): n=t or c
tggttgttcctgagtgatttgtgcatggctaggcctcctagctgacaagaacctctgctgnggtaatgcagggcaggacataggcttcattatgagctgtcccagactgcattatgagtgg

SEQ ID NO: 2459 - DNA, 121 bp, Artificial Sequence
  Synthesized
  misc_feature (61): n=t or c
tgatttttaattgttgctgtttcttgccagctgtgggtgctgttaatttcatttctcccantcctctgaacaaggaatgaaaacaaagtttaagaccgtttgaaaaaaaaaaaatcagtta

SEQ ID NO: 2460 - DNA, 121 bp, Artificial Sequence
  Synthesized
  misc_feature (61): n=t or c
gttaactcaaatgctactgctcctctgctactggctgactaaagggcaagcacatctccangtgccctttaaacactctggatttgtgcaagataaaatcctggcagctgcggcaacgttg

SEQ ID NO: 2461 - DNA, 121 bp, Artificial Sequence
  Synthesized
  misc_feature (61): n=t or c
ttttattaggactacttattcacttccctgcatctgctacaccaggtgcctttgtccaacnctacaaaacccagagagagacataaaagccctctttaaaaaaatctgaaaccaccacgaa

SEQ ID NO: 2462 - DNA, 121 bp, Artificial Sequence
  Synthesized
  misc_feature (61): n=t or c
tttcatcatttcaatttctccttcccttctctactcccatgttttctgaatgtgctgtttncaccagaattctcagacatatgtaaatggccatttttaaggcatttttactgctcagatg

SEQ ID NO: 2463 - DNA, 121 bp, Artificial Sequence
  Synthesized
  misc_feature (61): n=a or g
aaatcctatgtgactggatgcatgggtgaaatacactggtatgctgaaaggtgactttatnattaaagaccatccaagcaccactatttgaatgcagaagtaggacaagtgtaacttgaag

SEQ ID NO: 2464 - DNA, 121 bp, Artificial Sequence
  Synthesized
  misc_feature (61): n=a or g
ggaagaggctaaagcaccaaagctcagatatgtattcaaaattattttcaagcttcaattntgttccaaagcaaagttgcttaaacacagccctgcaattcattcagccagctacagacac

SEQ ID NO: 2465 - DNA, 121 bp, Artificial Sequence
  Synthesized
  misc_feature (61): n=t or c
ctaaaataaacagttaatcagaaaggatctacagagaggcctgtgcaatcaagaatgtcanagagaaggtgcacagggattgtgcattcactgctagtcactatatgagatagagaggaca

SEQ ID NO: 2466 - DNA, 121 bp, Artificial Sequence
  Synthesized
  misc_feature (61): n=a or g
actcaggaacaggttttgtgaaagacatgtatcttataccatacacaggattgtgaatacntaggataacttagattcctagatttgcaagccagccaggataatgctagctgtataacat

SEQ ID NO: 2467 - DNA, 121 bp, Artificial Sequence
  Synthesized
  misc_feature (61): n=a or g
taatctgatttttcccttgctgtcagaaaagcattctgaaacgtacagagtgcttcagagntgcaattatagagcatctacagcacagaactggcaaacacctttgaatggaggcctctgg

SEQ ID NO: 2468 - DNA, 121 bp, Artificial Sequence
  Synthesized
  misc_feature (61): n=t or g
cacttactaagtttttaagctttaagaataaaatagatgcatagctctgttgatgtaggancctagcggcaagcaatcttgaagtagtgctctctggttatccaactttccatcaccgctt

SEQ ID NO: 2469 - DNA, 121 bp, Artificial Sequence
  Synthesized
  misc_feature (61): n=a or t
gacactcctctccattctgcctgaaaagcttaatacaaataatgaactgtgggcaacccancaatatcacctctgagtttggagcaggatgaatgagctgtagatgtatttgcgactgggc

SEQ ID NO: 2470 - DNA, 121 bp, Artificial Sequence
  Synthesized
  misc_feature (61): n=t or c
acagaaaacagaaactttcatctgcactttctcaaaactttatacaaacgttgctactcanatcatgtctgggtgtgttcccttattcaaatgccttctaaagctttgtcacgataactaa

SEQ ID NO: 2471 - DNA, 121 bp, Artificial Sequence
  Synthesized
  misc_feature (61): n=a or t
tttctgttctgaagaacttacagacgtgagactgaacatgtgaagacactttgaaataacngatgctgaggtgtttttcttaagccattcagagctgatttcactgctcaatttgcactcc

SEQ ID NO: 2472 - DNA, 121 bp, Artificial Sequence
  Synthesized
  misc_feature (61): n=t or c
aagatcagcataaaatgtattaggagaagttcaaaggagagatttgaaacagaagtgtgantggcatgcagaaggtggacagaccttccagacacagaaagaagcatgagagttccagcac

SEQ ID NO: 2473 - DNA, 121 bp, Artificial Sequence
  Synthesized
  misc_feature (61): n=a or g
agtctttctgttttacagagcaatcattaacagtgtgttggtgacagtaagtttgccccantctctgagtattgatcacagctgtaaaagtaaacctagctcctactgaggacaatgagag

SEQ ID NO: 2474 - DNA, 121 bp, Artificial Sequence
  Synthesized
  misc_feature (61): n=t or g
ccagcacagctttcggttgtgatgttctttaagctactttccacagaatttgatttaaaanacgcataactaataaaagagttcttggaacagagtgtgtatttaaaaccccggaataagt

SEQ ID NO: 2475 - DNA, 121 bp, Artificial Sequence
  Synthesized
  misc_feature (61): n=a or g
agatttgtcagcacctgtgctatctgtccatggtgagtatagtcctgaaccactgctgggntatcgtggcccctgttctgtttacaacacgctgcgatagactgtaagcattggagagaaa

SEQ ID NO: 2476 - DNA, 121 bp, Artificial Sequence
  Synthesized
  misc_feature (61): n=a or t
tgaccatgtctatcaagtgtacttgtatacacggggttctgtcccagattccctgtggaanaactcatactggcttatttctgtgtcttgatttcctgctatttgtgaatcgtttatataa

SEQ ID NO: 2477 - DNA, 121 bp, Artificial Sequence
  Synthesized
  misc_feature (61): n=t or g
actatatttctctcagattttctaattaattacataatggacagattgaatgagtaaactntttgaagtggttctatgtgtttttccgatacttcttttaggaactgcagaagaaacatta

SEQ ID NO: 2478 - DNA, 121 bp, Artificial Sequence
  Synthesized
  misc_feature (61): n=t or c
tgcccagactctctgccctctccagcaagggagagtgaagaaaagcctctcttactgctgngttactgtgctcagcaggtaaacaaacaaacagaatgaaataaggacttctaatcaaaca

SEQ ID NO: 2479 - DNA, 121 bp, Artificial Sequence
  Synthesized
  misc_feature (61): n=t or c
ccaactggcaatatcccagaagtgctgtggagtcttgctgcattgctaagccacatgcgcnttttggtggttgatgatctgcccccttctaaccttgccaacaagagtctttctgttgact

SEQ ID NO: 2480 - DNA, 121 bp, Artificial Sequence
  Synthesized
  misc_feature (61): n=t or c
agccaccattataataactgattattttaacatattttaagatacaagaatcaaaaaacanctttaactaaacttctcttctactacatgctgactattaatggagtggcaaatctatatt

SEQ ID NO: 2481 - DNA, 121 bp, Artificial Sequence
  Synthesized
  misc_feature (61): n=t or g
tctgttgctctactgcaagttcggtcacagaacagttacacccttaagcgtgaagagcatntggggagcttaaagatacaaagactgcatcttgcagtttatttctcccatctgtgctcag

SEQ ID NO: 2482 - DNA, 121 bp, Artificial Sequence
  Synthesized
  misc_feature (61): n=t or c
cttaaaaaaaaaacaccacaatgcagattccaaaagattcccatccttcattttcagttgnaatgtgttttgtcaaactttgctctcttgtgtctgcttttagactaggcagggtctgctc

SEQ ID NO: 2483 - DNA, 121 bp, Artificial Sequence
  Synthesized
  misc_feature (61): n=a or t
agaatgtgttgacagacactgtggctgttgtgagcccaaagggtgaaacactgctcagctnctgtcagtcaagtggcctacaaataatgggcaaagatctcaggcagtgtggtttcacgag

SEQ ID NO: 2484 - DNA, 121 bp, Artificial Sequence
  Synthesized
  misc_feature (61): n=t or c
gagattatccaatgcacatggcaaagttttttagatggtgatggaacatcaggaaaatatnagaatttttggccaattatatgattagatgaaggaatttcatagcaaaaatactaatccg

SEQ ID NO: 2485 - DNA, 121 bp, Artificial Sequence
  Synthesized
  misc_feature (61): n=a or c
catctgcgagagggatcagaaacatgcatgatgttgtatcaaaaagtttgcttctgccttntaggatgctataggtacttttgtagctctactgaaccagcctacttaaccttcttccatt

SEQ ID NO: 2486 - DNA, 121 bp, Artificial Sequence
  Synthesized
  misc_feature (61): n=a or g
caaaagaattacaatgtggcttctaacaatatataacaataaagcccaaagcaactgtctngaacactggactgtgataaagtcacatgagaatggcgagagatttggagtgcccaagtcc

SEQ ID NO: 2487 - DNA, 121 bp, Artificial Sequence
  Synthesized
  misc_feature (61): n=t or g
gcatgccagttgacaccagcagatttggtccacgatctacacaaaaagagaatggacttgngtattgaacaagttttatgcagaacaaattatactggaaatataaccccattcatttcat

SEQ ID NO: 2488 - DNA, 121 bp, Artificial Sequence
  Synthesized
  misc_feature (61): n=t or c
catccatagttagttagctgagaattcactgggaaaactgttaagtctcttttatagattncaggaaaaccaacttgttttaaagtataaactttgaaatttcagtggtgaaatatctcag

SEQ ID NO: 2489 - DNA, 121 bp, Artificial Sequence
  Synthesized
  misc_feature (61): n=t or c
tgacccagagcagatctctgaaagcaaggagctagcaacgtgtataacttagactgatagngagctttgggaaagtgatttaagaaagatgtatagagtagtgttgtgttttaaatgtggg

SEQ ID NO: 2490 - DNA, 121 bp, Artificial Sequence
  Synthesized
  misc_feature (61): n=t or c
taatcctgccatttttcttttaaaaataatgaagagagtggccataaaaggaatattagtngcaagtacagtgaacttaatcagcaaggtgtgaattaagttggttcaaatggacattgtg

SEQ ID NO: 2491 - DNA, 121 bp, Artificial Sequence
  Synthesized
  misc_feature (61): n=a or c
cacgctcttctctaatattcacttagcagaaggcagtttcaccccaaagggaggatttaanctcccgtggagctgaggttcaatataaaacttggtagcagaaaaaacagtgcagttcaga

SEQ ID NO: 2492 - DNA, 121 bp, Artificial Sequence
  Synthesized
  misc_feature (61): n=a or g
tttaacaaaagcaagaaagaatcagtctgtgcagactctttcaaagcccctcatgttcacnattactatgtcacagagaggccgagctctgctacaaggtcagcagccagataaccttggc

SEQ ID NO: 2493 - DNA, 121 bp, Artificial Sequence
  Synthesized
  misc_feature (61): n=t or c
tggatctccagactcatgatcctgacctcaaatatctctgtgcttggttatctattattanccatcagctgcgccagatgcagaggttcctggaatgagaggtttggggatgtgctgcacc

SEQ ID NO: 2494 - DNA, 121 bp, Artificial Sequence
  Synthesized
  misc_feature (61): n=a or c
gcctcccacttctatagtgcctttctctcaggtaaatattctaaggcactttactatcagncattaaactgagtaatactcactggaaaacaggaaatcatttaatagatattttgcagag

SEQ ID NO: 2495 - DNA, 121 bp, Artificial Sequence
  Synthesized
  misc_feature (61): n=a or c
acccatactttgaactttaattccactggagagactaaacataatatttattaattgtagnattttcaatgaaataaagcgtaaagtgagctcaactcctaagagaaatgctgtcctattc

SEQ ID NO: 2496 - DNA, 121 bp, Artificial Sequence
  Synthesized
  misc_feature (61): n=a or c
ggctaagaattagactgctccctgtgtgcatatgtatgtgtgtacatagatgtacacacanatactgcagaatgaatatggatgcatttcatcatacttgtattctttctcttaaactcat

SEQ ID NO: 2497 - DNA, 121 bp, Artificial Sequence
  Synthesized
  misc_feature (61): n=a or g
gagaagtctactggagctggtaaatatggagaaaacaaacaaagcccaggaaatcccccanactaaatgtagtcagaggttgggacagtattcaggggaagtgcttgcttttcctggtata

SEQ ID NO: 2498 - DNA, 121 bp, Artificial Sequence
  Synthesized
  misc_feature (61): n=a or g
ataacagaatatttgctattaaatgctaacagtggaccctgcttttcaaacatattcacanttttaaagaatgctaaaattttagaaaaagaagatatccagatcaagtctagcactttca

SEQ ID NO: 2499 - DNA, 121 bp, Artificial Sequence
  Synthesized
  misc_feature (61): n=t or c
gaatgggcaagtagaaaagagtcagagggtttttcttgaagtgacacttctaaaactaagnggctatcagctcagctgcttgacaagaagccaccagtgtcagaatacagatttcatcttc

SEQ ID NO: 2500 - DNA, 121 bp, Artificial Sequence
  Synthesized
  misc_feature (61): n=a or g
gaaggctattctaaagaattttaggaagttcttcccactgcttcttctagacacttttgcntggttttcagtgatgggatcaacattcagagtttgagattcagagaaagatatgatattt

SEQ ID NO: 2501 - DNA, 121 bp, Artificial Sequence
  Synthesized
  misc_feature (61): n=c or g
cgaacagaaggaagtagagaatatctataccttatagagccacagtactgttagggaatanaagtgaataaaacagatcaacacaaccctaactaaacaaaaaagccaaatcaatacgaaa

SEQ ID NO: 2502 - DNA, 121 bp, Artificial Sequence
  Synthesized
  misc_feature (61): n=t or c
tccgctctagtagagctgaagtcacgttcccataattagagaataactgcacaggttcaangtagaactaactataggctgtaatatgtggattggatggtatgctgcaggagatgtagga

SEQ ID NO: 2503 - DNA, 121 bp, Artificial Sequence
  Synthesized
  misc_feature (61): n=t or c
ttcagtagacaactttctcctttcttgtccaagtgagcttccttctctacctgagaactanccagtagtgaaaatactatatctggtaaagaacaaagtctgttccattacattaattgct

SEQ ID NO: 2504 - DNA, 121 bp, Artificial Sequence
  Synthesized
  misc_feature (61): n=a or c
aatgctattatcttcagggaaaaaaagcaatattcatctgacttgaccgttgtacaggtanaagcacgccgtgtaccgggactgttgagtatatttgcatgagattagttaaaccatctaa

SEQ ID NO: 2505 - DNA, 121 bp, Artificial Sequence
  Synthesized
  misc_feature (61): n=a or g
agccagctacaaaacatcaagttttactgagggtgttttttcaacaggcaaaccaaaacanaaggagaactacttcaagccacatttagttttgtactcctcaccactgaaatggacaaaa

SEQ ID NO: 2506 - DNA, 121 bp, Artificial Sequence
  Synthesized
  misc_feature (61): n=t or c
cactcaatgtccctggtatgtgaccctctgtgtatacgttctctcttcaattttagttgcnttccttaggctaagatgctcagggcaaggctggcacagtttcagacgcttgtgagatacg

SEQ ID NO: 2507 - DNA, 121 bp, Artificial Sequence
  Synthesized
  misc_feature (61): n=a or g
tcaagactctctgccttaaaccagcacagagtacacatttgacaactgttcctcagtgccngtgagactaccagtgactctcagctttgccaagtccttatctctcctcagagctagcaag

SEQ ID NO: 2508 - DNA, 121 bp, Artificial Sequence
  Synthesized
  misc_feature (61): n=c or g
ctgggtactgcatccatgcttcaggtaatgagccagcttcctgactactgtatccatttanagtgacaacggatggggtgaataaaaaatagaagccaaaaagatagagacatataagtaa

SEQ ID NO: 2509 - DNA, 121 bp, Artificial Sequence
  Synthesized
  misc_feature (61): n=t or c
cattaactctatcaaatgaagtcctcaaagtatttcttatcattttagagacagaaattangtggaacagtacagtttctatacaagtgttagtggccttttcaatctcattctaacctag

SEQ ID NO: 2510 - DNA, 121 bp, Artificial Sequence
  Synthesized
  misc_feature (61): n=a or g
agcccgtacgatgatgtgttttggatctgtcacttcaacggtagtataacacaccagtgtnttttcatactactgctgaacagtgttgcatagcagcaaggcttcctcctctcccccgtgt

SEQ ID NO: 2511 - DNA, 121 bp, Artificial Sequence
  Synthesized
  misc_feature (61): n=a or t
attaagtacagagctgcaagagcatactctgttgtggcaggacacaagcacatgacaacangtacaatttctggtgtacagtggtacctcacaaccaacaggctgcaagtataaataaaca

SEQ ID NO: 2512 - DNA, 121 bp, Artificial Sequence
  Synthesized
  misc_feature (61): n=a or g
ccatgtacttgttggcctaatgagtacttaaatttgtcttggaaaatagaataactttaantgatagtactgatccatcaaaaaaactttgctatctgaccaggcattcaccttggaagaa

SEQ ID NO: 2513 - DNA, 121 bp, Artificial Sequence
  Synthesized
  misc_feature (61): n=a or g
ggtatatttctattttattcagtaaaactatattttcatggttgtaatacacaagtatgtntgcttgtcctcgatcttcttatgcttcttccactgttcagcgggaggatatggttcttca

SEQ ID NO: 2514 - DNA, 121 bp, Artificial Sequence
  Synthesized
  misc_feature (61): n=t or g
aaaagctagacttcaacccacaacctagtggatttccaaacatcagtgattctggacctgntaaataaaatgaacaacctgtcttttgattactgtcttttcaaatgttgagtctactgct

SEQ ID NO: 2515 - DNA, 121 bp, Artificial Sequence
  Synthesized
  misc_feature (61): n=t or c
tctagtgaaatcctgaagaacacgtggttcttaaactcacaaaagccagggattaatcaantattagctcttattcctatcttttcaaatacagacagaatagtaatgtagaggatttata

SEQ ID NO: 2516 - DNA, 121 bp, Artificial Sequence
  Synthesized
  misc_feature (61): n=a or g
agatttggtaaagaaggactctgtctcaaataaagagaagtgtgaagatgcatataggcantaactagtaacacattagatgcacattagattgtatgcagatagtggataagacaggttc

SEQ ID NO: 2517 - DNA, 121 bp, Artificial Sequence
  Synthesized
  misc_feature (61): n=a or g
gttgttatttatgacagccagcttgaaaggaatactccacacttgagtatctgtatatcantaattcaagcaacagtttaaaatcctgcctcacatgactgtttttcctgaaaaacttgaa

SEQ ID NO: 2518 - DNA, 121 bp, Artificial Sequence
  Synthesized
  misc_feature (61): n=a or g
ctcctttatggtgctacttacccctaccagctttcttctacactttaagtccttcttagtncacatttgctctgtgactccactgccatgacctaatatgccaaatgcactaaccataaat

SEQ ID NO: 2519 - DNA, 121 bp, Artificial Sequence
  Synthesized
  misc_feature (61): n=t or g
caccaaggttttcttcagtgttcagagatgatgtcttaattcaggcctatttctggagacnccatctttcctaagttcatctttctcactacttaattcagttcacctttgaattatggaa

SEQ ID NO: 2520 - DNA, 121 bp, Artificial Sequence
  Synthesized
  misc_feature (61): n=c or g
agaaatgaaagctctgaaggtgaactagacataaagatgacttccatgcttacccagatancagttgcaaatgtttatctgcctaagcagacagctttgggctttttctgattacttttgt

SEQ ID NO: 2521 - DNA, 121 bp, Artificial Sequence
  Synthesized
  misc_feature (61): n=c or g
cattcacatcactgttcacactgaattgagttctataaatatacttatatatcatgaaatnactgttttttcctcccccaaaatcattacatagaactgagtgcttgagaagaggtcttct

SEQ ID NO: 2522 - DNA, 121 bp, Artificial Sequence
  Synthesized
  misc_feature (61): n=c or g
aaaattattcaaattcttattatccctttatccccatacttgcccagtaaatactgaaaanttgtgtaatggcctagtgagagggatcactgttgattttagttcgctttgtggattttaa

SEQ ID NO: 2523 - DNA, 121 bp, Artificial Sequence
  Synthesized
  misc_feature (61): n=t or c
agaaacatgtaatatctgatttattcctctaacataaagatgtcttcaccttcagccttgnagcacttacaatatattaaacatctaaactaatgttgtctttcaagataatataatttac

SEQ ID NO: 2524 - DNA, 121 bp, Artificial Sequence
  Synthesized
  misc_feature (61): n=t or g
acttaaacaaaagttctaaagcaaaactggaaaaagaagcaactggaaactgcaagttganttccatgagtttttatcacaatttgcattctgaaattgttccttgaaaattgacttccta

SEQ ID NO: 2525 - DNA, 121 bp, Artificial Sequence
  Synthesized
  misc_feature (61): n=t or g
gaaaaaaagaaaaaaaacaaacaagaaaatgtttagacatcaaaacttcaattgccaatanttccagacaaactaaatgctggccacaatgacatctccaatatcagtattttaagcctct

SEQ ID NO: 2526 - DNA, 121 bp, Artificial Sequence
  Synthesized
  misc_feature (61): n=a or g
cctaaaatgaatatttcaagcagaaaatcctgtataactgacttatttttccaaattcccnaagaattcatcttccactgcccccgagtctctttgcccatttttacctgcacagtcattt

SEQ ID NO: 2527 - DNA, 121 bp, Artificial Sequence
  Synthesized
  misc_feature (61): n=t or c
tagccatttcaatgactaattcatggtatattccttagaagccatctccgtcaagaggggngagaagaatgactttgaagagatccatcgtggtgctgagcctagcgaaacggctgtgcct

SEQ ID NO: 2528 - DNA, 121 bp, Artificial Sequence
  Synthesized
  misc_feature (61): n=a or t
gcaggtagggagactatggagaagaatattatcatctggggttataatattccttccattngcagctcagatttcttggaagatctcagtgtctatacatttctttaaatgtaacatacaa

SEQ ID NO: 2529 - DNA, 121 bp, Artificial Sequence
  Synthesized
  misc_feature (61): n=t or c
gataccaccagcctttgtggaggatacttacatttccttgactgtcattcagctggtcagnagataaccttcttatcctagtattctccaaagttttccaaatagaacttatccttatcta

SEQ ID NO: 2530 - DNA, 121 bp, Artificial Sequence
  Synthesized
  misc_feature (61): n=a or g
agacagttaacattactgatgcaacaactgtgtctgttaatcagttacaaaagatactgcntgtggaatttttccaaattcttctgaacctaagagctcccaggacctaatcattagcatt

SEQ ID NO: 2531 - DNA, 121 bp, Artificial Sequence
  Synthesized
  misc_feature (61): n=a or g
gctctacaagcggtcactgagttgaagtggctgaagatgtgttatcacaaacagatcaacngtgtcagtagctcataccagactggaaatactatgaaactgctgctctgccctcctgact

SEQ ID NO: 2532 - DNA, 121 bp, Artificial Sequence
  Synthesized
  misc_feature (61): n=t or c
ccaggttgcataaagttactttggactcatgctgcacaaacacagagctcttgcctggaanattttccaagcagatttgaaaacagacattaaaaaggtgcataatttgtagaaatgagag

SEQ ID NO: 2533 - DNA, 121 bp, Artificial Sequence
  Synthesized
  misc_feature (61): n=a or g
agctttcccctcatggcgatttgcataaagttggattaaatagggcttcaagcctctaaangctgattactgacaccgggccttattagttatttccttctttatttgaaacaattaacga

SEQ ID NO: 2534 - DNA, 121 bp, Artificial Sequence
  Synthesized
  misc_feature (61): n=t or g
catatttcctgctcattataataaattgaatcaatataataaaatctgtaacatgttacanattttaagtgtttctcctcaagccattcagtgtctgaattcagattgtaacatcttagta

SEQ ID NO: 2535 - DNA, 121 bp, Artificial Sequence
  Synthesized
  misc_feature (61): n=t or g
actataaaagcaaaatataaagaactttgttgcaatttctacctagaacaaatacacaaanaagcagcttctcagtgcgttcgaggatagaaaaaaaatccagcaacacatccactcccat

SEQ ID NO: 2536 - DNA, 121 bp, Artificial Sequence
  Synthesized
  misc_feature (61): n=a or g
ggtgcctgaggaagcaagatgttcatgtgcacatcttgcaagatcttcatcctcaaatacnaaattcttgaactaatgcttaaaggatagggagcaccagcttgttggagtagaaagtaaa

SEQ ID NO: 2537 - DNA, 121 bp, Artificial Sequence
  Synthesized
  misc_feature (61): n=a or g
acattttatgaagaactgcaggaacaccttctatctgcgaaaatacatgaggaactgacangaatattggaaagcctctcttttgtggtgcacctgcataccaaactgcaaagaaaactgg

SEQ ID NO: 2538 - DNA, 121 bp, Artificial Sequence
  Synthesized
  misc_feature (61): n=a or g
gagaagaaaacttttgtccaacattagtgatttagaacaaccctgacacagttcatatacntatccactgtccattaatctttttgtttcactttttctgtcatgtatactatccagagct

SEQ ID NO: 2539 - DNA, 121 bp, Artificial Sequence
  Synthesized
  misc_feature (61): n=t or c
ggacaggtagctaagcaccatgcagttgtgagcaattgcttgtgcaaaccacccacctacngatgcccagccagtcctcaagcagtggctcctccgccggtcaactctctgctgtttttca

SEQ ID NO: 2540 - DNA, 121 bp, Artificial Sequence
  Synthesized
  misc_feature (61): n=t or c
tgagcaccagggatgttgaaaaaggatctgtttttctgactgtagatgatagcttatcctntctggtaagtccctacagatgctatggaacaaaagtggtgatagaggacatgttgtgttt

SEQ ID NO: 2541 - DNA, 121 bp, Artificial Sequence
  Synthesized
  misc_feature (61): n=a or g
aattcttttaccccgaactatctaatgcacctatctctgagtccttttaataaaagtctanagtctaaatttaaaataaagatgttacatttatgttttcaaatcaattttgaaaacatta

SEQ ID NO: 2542 - DNA, 121 bp, Artificial Sequence
  Synthesized
  misc_feature (61): n=t or c
tgggtaagagagaaagaagagaggctttgtagaagacttaataagaaattcttttgtgcantgataatataaaggctgcattaacaacctgttgccagttatgagttgctcctacacagaa

SEQ ID NO: 2543 - DNA, 121 bp, Artificial Sequence
  Synthesized
  misc_feature (61): n=t or c
cctctgcactccgctagcccacagattgccttgagcctagtgcgtgtcttgattccaggcnggatcctgctcttctgattcttgggaatcatcagcatgaaacaccataaatctggctaca

SEQ ID NO: 2544 - DNA, 121 bp, Artificial Sequence
  Synthesized
  misc_feature (61): n=a or g
tatactcactgtacagccatttcagcctaccttcctactctacctttttgcaagcacaaancagtattatcactggaatgttaaatgacttgtatccacacacagatacccacaagttcat

SEQ ID NO: 2545 - DNA, 121 bp, Artificial Sequence
  Synthesized
  misc_feature (61): n=a or c
ttccagggaacgccctctggtgaagaatcttttcctcacgtccagtttgaacctgctctgnaacagtacaggtatgttgtccattttggttatgctacctaccaggaagtcaaagggaaga

SEQ ID NO: 2546 - DNA, 121 bp, Artificial Sequence
  Synthesized
  misc_feature (61): n=t or c
ccagtcgtaactaaaaacagaatgtttgctacacatgcttgggaaggaattacagatattnacagtgatgtataaataccttagtatatgccaaatcatatttctcaagctcgcctacaac

SEQ ID NO: 2547 - DNA, 121 bp, Artificial Sequence
  Synthesized
  misc_feature (61): n=a or g
acaattcctggagtagaaattcacattttaaaggcagatatgaactttaaatatcattcanaagctgagctaaaagttcatgattcaaaagtcacctttgactcacctgttatacagtcat

SEQ ID NO: 2548 - DNA, 121 bp, Artificial Sequence
  Synthesized
  misc_feature (61): n=t or c
aacattttcagatttcctagtgaaccatgcagccttctgtacttgccactgctctcactgngctacataccagtgtaaccatgagcccgtttcatatgaagtttcatattgcttttctgtg

SEQ ID NO: 2549 - DNA, 121 bp, Artificial Sequence
  Synthesized
  misc_feature (61): n=a or g
aagtatttttaaggaagaactgccaaaatacgctgaaggatacatacaaaaattgtaaacntacctatgagtcttcatatgttttttacagtttaatgaggttttgaatgttttttgacaa

SEQ ID NO: 2550 - DNA, 121 bp, Artificial Sequence
  Synthesized
  misc_feature (61): n=a or g
gagcatcttttttactgcttaagtcagaggcacgagcaaagcacattcttatgcacacacntatgtattagagggggcaggagagctccttatgaaagtgtttcctggaagttttgatctt

SEQ ID NO: 2551 - DNA, 121 bp, Artificial Sequence
  Synthesized
  misc_feature (61): n=c or g
tcccacagggctcattgtggtcacccaagcaccgcagaagatgtccattcccacttcccgntgttaaagagttaatccagctgggtttgggagatctaggaaacaaggcagatgagacagc

SEQ ID NO: 2552 - DNA, 121 bp, Artificial Sequence
  Synthesized
  misc_feature (61): n=t or c
ctgagaggtaatcctctttttcagctgcatgtttccagaaaggtgagaggctctcttttcntcacctttttctgttaggtttatgaaacactaaagtggaagtctgcctgcactcactgct

SEQ ID NO: 2553 - DNA, 121 bp, Artificial Sequence
  Synthesized
  misc_feature (61): n=a or g
ctccaagcaagctaggcttatgcacacaaacccaccacaacgtttctatttagcatggagnacctgaagcttgagtcagatgtgttggactctttagttgcttatgccctgattatattct

SEQ ID NO: 2554 - DNA, 121 bp, Artificial Sequence
  Synthesized
  misc_feature (61): n=a or c
catacttgtgtaagccatggctatgagacaaacattttcatgtaaaatattttgatagagntctaactttgatactattggcaaaattacatgaaaatttgtatgcaacttagatgggact

SEQ ID NO: 2555 - DNA, 121 bp, Artificial Sequence
  Synthesized
  misc_feature (61): n=t or c
ctgtccctgttttacatgtgtgggttgggttaactgctatgtctcggaacatgtggtatanttaacactgtttcatagctttgaactcatttttggtgatgcgtgcacattttatcctcat

SEQ ID NO: 2556 - DNA, 121 bp, Artificial Sequence
  Synthesized
  misc_feature (61): n=a or g
taccaacttcactgatccaccaaagatgtgaaggagtgtagttttgcttagatctcatccnctgtgaatgaatgagtcagataggaatgctgctgttcaactgacacagcatgactagtta

SEQ ID NO: 2557 - DNA, 121 bp, Artificial Sequence
  Synthesized
  misc_feature (61): n=t or c
cttgatactgacaagaagaaaattaactgcttaggagaaccagatattaaggatgctatcntcatttctttgcctgtgctaaaatagagcttctactagtttatttgttccattgtaagta

SEQ ID NO: 2558 - DNA, 121 bp, Artificial Sequence
  Synthesized
  misc_feature (61): n=t or c
atcaattgaaaatttaatgaaaactcccagttaaagaatatatgtgtattaaatttaagcncagatgcagagcaaaataattagtataaaaaggctctggataaactcctgggaaactctt

SEQ ID NO: 2559 - DNA, 121 bp, Artificial Sequence
  Synthesized
  misc_feature (61): n=t or g
tgtccggatgttggcatattttcagatggaatatgcaatttcattttaaatggcttcaagnactgtattccttttttaggaaagcttgtggctattgcagtcattgatgacaaaaactctt

SEQ ID NO: 2560 - DNA, 121 bp, Artificial Sequence
  Synthesized
  misc_feature (61): n=t or c
agtttttgtatcaagtttctaagtctaaaacgtaatcaggatttgaatctcatggactgtnggtgctgttttatactgcttaaggtttctcattgactctgttgaattctccttggacttt

SEQ ID NO: 2561 - DNA, 121 bp, Artificial Sequence
  Synthesized
  misc_feature (61): n=t or c
catggctcataataagacttagagaaaaacatacaaagctgagagaaattctggggagatncctttccaagctttcctcagttgttcatttaagaacttcatcagtaacatgtttaatctc

SEQ ID NO: 2562 - DNA, 121 bp, Artificial Sequence
  Synthesized
  misc_feature (61): n=a or g
tttttgtccaagcatctcaagccactctctatgaatggtcatttaaagtatatctgtgaanttattatctacattgtgcctctcgcaaatggtgaaggtgagagctgggtaccttgccaaa

SEQ ID NO: 2563 - DNA, 121 bp, Artificial Sequence
  Synthesized
  misc_feature (61): n=a or g
aaaaaagtgccccttcacaataaccaccagagaaattcttgcagggatgcccctggctccntactactaacttctactgtgcctccatccttttgagcccctcagctagctcgaggcatgc

SEQ ID NO: 2564 - DNA, 121 bp, Artificial Sequence
  Synthesized
  misc_feature (61): n=a or g
tacatgttggataccatcagaaagacaaagcatggcgttcagacggctccatctgaacacngctcagacgatcatctcaacaacaggaatgaatactttatttcttgtctaggcaaaatat

SEQ ID NO: 2565 - DNA, 121 bp, Artificial Sequence
  Synthesized
  misc_feature (61): n=a or g
aagctcgtttcccatggctatagttgaattccatcaacagacgtaaactgccatattgttntgatgtgagtaactcctaccttgtataagccccacaaaaaaaaaaaaggaagaagaaatt

SEQ ID NO: 2566 - DNA, 121 bp, Artificial Sequence
  Synthesized
  misc_feature (61): n=t or c
ctttttcttgattgcagtcccctgatcttctgtttgctaaaattaaatggattgaatcccntgatctgttgctgcatagcagcatttctggttttcattcatattagttccactgatctca

SEQ ID NO: 2567 - DNA, 121 bp, Artificial Sequence
  Synthesized
  misc_feature (61): n=c or g
aatgctacaattaaaaatgcagataaatgacaagaataacatttttggggggttttggagntaatatatctagaagtactgtcttatgtcaccaataagatatgcggacctgttagaataa

SEQ ID NO: 2568 - DNA, 121 bp, Artificial Sequence
  Synthesized
  misc_feature (61): n=a or g
tcatctcctgataatttcttatgccagcaggggaaaaaatccagattaaatcgatgttttncagaggacaaatccagttggaaacacagtttcagcatagcagtgatcactgtcacaaggg

SEQ ID NO: 2569 - DNA, 121 bp, Artificial Sequence
  Synthesized
  misc_feature (61): n=t or c
tagtgctctggaatactccttaatgagtaagtaatgtgtacacagagaatataagaagtcntcatgtggtttgctagctaatacatggggaattctgtagtctccttccagcaattttcta

SEQ ID NO: 2570 - DNA, 121 bp, Artificial Sequence
  Synthesized
  misc_feature (61): n=t or c
caccccctaaggaagcttcttcacatccatatggtagatctcatttaagtctagcaaagangtatgaatacccatacatttctgttttttttttttttccctgcttcactcttgaactttt

SEQ ID NO: 2571 - DNA, 121 bp, Artificial Sequence
  Synthesized
  misc_feature (61): n=a or g
ctgtaacgtgtagctaaggagttgcaggttgcctgacccacagcctgtggtggtgtggctngcattgattctgcacaagcagaccactggcagtgctgatgaatgtgccttatctctaact

SEQ ID NO: 2572 - DNA, 121 bp, Artificial Sequence
  Synthesized
  misc_feature (61): n=t or c
gctaaaaaaacattattgccatataggagtatgcctacaaacattagtattaattattggntgtgttctagcggctttgcagatttccagcagcagtgtgcagaggaaaatcttggaaacc

SEQ ID NO: 2573 - DNA, 121 bp, Artificial Sequence
  Synthesized
  misc_feature (61): n=a or g
taaagcaaacctattcatatgcaacttattagtagctggagatgcacaggcaaaaaagatnctgtgaattagataaaagcggaagtagaggtagaaaaaaaacacacattaaggtatatca

SEQ ID NO: 2574 - DNA, 121 bp, Artificial Sequence
  Synthesized
  misc_feature (61): n=t or c
agcgtgaaattacatctacaaatagtttttcacaaatctgcaactgtaatttctacccagngactaggcaggaatatggtaaagcatttgttatcccatttaccatagaatcatagaatcc

SEQ ID NO: 2575 - DNA, 121 bp, Artificial Sequence
  Synthesized
  misc_feature (61): n=a or c
attttagcatctgaggaaaattgagtgtttccttactgtctttttgttctttgagctttcntatactcattttccccaaacctttgtattgtattcaggtctttttcttggatgaagggtt

SEQ ID NO: 2576 - DNA, 121 bp, Artificial Sequence
  Synthesized
  misc_feature (61): n=a or g
gggctgggagctctggtttgtagggattaagcacatgtatctttgtaggtaaattaccaantaacttgagacttgccaataaaaatgagacttgacagcgctacctttgtgtccaaatact

SEQ ID NO: 2577 - DNA, 121 bp, Artificial Sequence
  Synthesized
  misc_feature (61): n=a or g
ctattagacaacccagaggtaatggtataacctatttttaaaccctgtaaaaaaaataatnaagtaagtgtggtgcagaatcagcatagcactgtccaaacaatgaaacaaagcttgtggg

SEQ ID NO: 2578 - DNA, 121 bp, Artificial Sequence
  Synthesized
  misc_feature (61): n=a or c
taggatgaaacagtatttcaaagaggtctttagtaattctattaatgtgttcagagacagngacaacaaagaagaacttgggttacatccacagctgcagagctgtctctgttcttttctg

SEQ ID NO: 2579 - DNA, 121 bp, Artificial Sequence
  Synthesized
  misc_feature (61): n=a or g
tgtgtttactatgccttgtacacttttgcctcctttctgcaggcaagcctgcagcaccggnacatcaataaactgcctgtttctttgcgtttctgaaagggaggatattggtcaatatgtt

SEQ ID NO: 2580 - DNA, 121 bp, Artificial Sequence
  Synthesized
  misc_feature (61): n=a or t
tttcttattctgatatagtcatttcacaataccaataggcactgtttacttttctaacacntatctgaagttattagtgacatttgcttttcctagaatcacaattggatttgccagtaga

SEQ ID NO: 2581 - DNA, 121 bp, Artificial Sequence
  Synthesized
  misc_feature (61): n=t or g
ccttgatattattataagcataattatctcatttgttgaggagcaatggcataattaaaantgtataatattcaaagacaggaagcatcagcatttaatgcatgtattttgtcacccttct

SEQ ID NO: 2582 - DNA, 121 bp, Artificial Sequence
  Synthesized
  misc_feature (61): n=a or g
gtgacatgcatttaacttgctgctttcatgaaaggcactttctaccagatcgacaaattancagctccgcaaataccagcttttaactgcccctatgtcaaggtgattttttccccactca

SEQ ID NO: 2583 - DNA, 121 bp, Artificial Sequence
  Synthesized
  misc_feature (61): n=a or t
ggctttggccctgtgttacctgccatggccccagtactgcctgactgcccacactattacnttgccatggtttatgttaccccacagtcactaaaagggggaacctggaaacggtgttgat

SEQ ID NO: 2584 - DNA, 121 bp, Artificial Sequence
  Synthesized
  misc_feature (61): n=a or g
ttctctccttacacaaacttgctttatccctctctaagtcacatgctgaaccactctgttntggtatcagttgatgttattgcaatatcaattatttctcccttgttttttcattgcctat

SEQ ID NO: 2585 - DNA, 121 bp, Artificial Sequence
  Synthesized
  misc_feature (61): n=t or c
aaacaaaaacaagaacaacaacaaaattttaccatgcaagagttataagaccgtttcttcnagttcagtctgtgtttgagtcaggtgcttcttggtgcttcttgaagaagtgcatagcctc

SEQ ID NO: 2586 - DNA, 121 bp, Artificial Sequence
  Synthesized
  misc_feature (61): n=t or c
gtgaagacatgaaggaaggagaagaaacatttcagtgctttttctccagcactggcaaggngtaacagattcctagcttgcagcagcagaggatggagtttaattaccaggaaggttgcag

SEQ ID NO: 2587 - DNA, 121 bp, Artificial Sequence
  Synthesized
  misc_feature (61): n=t or c
tgaagaaagtgaaaatacccaattgtcatatttcttcagacatcctttcaaaaatcaagtnacaaaccaaaaccattttcaacactatgacatttaattatgtttaaacacatttaactgc

SEQ ID NO: 2588 - DNA, 121 bp, Artificial Sequence
  Synthesized
  misc_feature (61): n=a or g
gttatgaagctctcccatatggcagtaccatgacctctgtgggcagcctacttccattgtnctgaaggatttttttcttaatcattcatattcatttcctgatcttgctggtctatattct

SEQ ID NO: 2589 - DNA, 121 bp, Artificial Sequence
  Synthesized
  misc_feature (61): n=t or g
tattttcttaccattatcagtatggaaatagaaatttggaaggaaaacatcattcttagtngcatttgatttagaacacaatcaaagcagcatgaatatgtattatatgaattctgggaga

SEQ ID NO: 2590 - DNA, 121 bp, Artificial Sequence
  Synthesized
  misc_feature (61): n=a or g
tttatacatgtgctgttgtataaaacaaattaaatcctcgggggctgctagaaatagtctngatgttattcaccagacagaagtctcacgggaacctatttttaatgctaatcaatagaaa

SEQ ID NO: 2591 - DNA, 121 bp, Artificial Sequence
  Synthesized
  misc_feature (61): n=t or c
ttgcacaatgctcgtcttaaaaaaaaaaatgctttctgatttgatatgtcctactgctttncctttgtaccttttctaataatagagaaattatgtggtcatgttagactgcttgaattct

SEQ ID NO: 2592 - DNA, 121 bp, Artificial Sequence
  Synthesized
  misc_feature (61): n=c or g
gacacaggctgcatctcaaccattttgtaattcactacagctcataacttagccctgcctntcatttcagtttaaattttgactaactgtataatcctttcattaaacaaacaagaaacgg

SEQ ID NO: 2593 - DNA, 121 bp, Artificial Sequence
  Synthesized
  misc_feature (61): n=t or c
acaattgtagcttcacatgctgctgttgttgcttactttttcttctcactccagttctgangaggaaagaacagtttctagtgggtatttcctggcatgacctagaaaaccccctggaaac

SEQ ID NO: 2594 - DNA, 121 bp, Artificial Sequence
  Synthesized
  misc_feature (61): n=t or c
gatgtactctgctccttggggaacgtacgcataggtgcattaatgggactgcagaacaaangaaattacatcacatacatctaacttatgttctccataagattaatagccatgaaatgaa

SEQ ID NO: 2595 - DNA, 121 bp, Artificial Sequence
  Synthesized
  misc_feature (61): n=t or g
agtgtttaatgtttatgacaagataaagatgatacagaaagggtgggatattaaaagatgntatcactgatacataatggctatgtaaggatttaagtagtgatgtagcctgccattctgt

SEQ ID NO: 2596 - DNA, 121 bp, Artificial Sequence
  Synthesized
  misc_feature (61): n=t or c
acgctacaaaggccagagggcagctttccaatgccatgcattgaatccagcagctgtcagngtccaacgctcaccaaaatattaacatttgtctttgggaattgtcttaacgagaagcagc

SEQ ID NO: 2597 - DNA, 121 bp, Artificial Sequence
  Synthesized
  misc_feature (61): n=t or c
ccatcagttttgtgttttgctacggttgagatgtgacagtctgaccttctcaagatttccnactcccttaatcccctagcacatatttcttaaaaaaaataaagtagattgatgctactaa

SEQ ID NO: 2598 - DNA, 121 bp, Artificial Sequence
  Synthesized
  misc_feature (61): n=t or c
acagatcccaagaaagaaatggactatggcagtgttttatattagctaactttgcttctanagttatcatgactgggctaaaagccaaagaagaggaaaaaaattgttagttcaaatgcat

SEQ ID NO: 2599 - DNA, 121 bp, Artificial Sequence
  Synthesized
  misc_feature (61): n=t or c
tagaagagctttacactcttgtttctcttccttccttttaggatgttgcaggtttaggctnttggatatggaaacttgggtatgtgggttttcttttcagtttcagactgaggagctagcc

SEQ ID NO: 2600 - DNA, 121 bp, Artificial Sequence
  Synthesized
  misc_feature (61): n=t or c
taggctattatgcatttcagccgaactgcgtgtgagtaaagattgctccatctgattctcntgagaaaggaaatcatatgcggctaactttcagtagcatttagtgtgaaggtgctcatct

SEQ ID NO: 2601 - DNA, 121 bp, Artificial Sequence
  Synthesized
  misc_feature (61): n=a or g
taactttaggcttctctttgattttcttacttgatgagagtacacgatggccgtaaatccnacctggcaatgattttcaaggtcacctgtggatattgttttgcatggtgttaaatagact

SEQ ID NO: 2602 - DNA, 121 bp, Artificial Sequence
  Synthesized
  misc_feature (61): n=a or g
aacatttattaattcttgagcaaaagccatttgggtggtagtgttaaatttgcagacctcnacagccctaccaaaagctttcttgaaaatatttaggagacttccatggcaattcaggaga

SEQ ID NO: 2603 - DNA, 121 bp, Artificial Sequence
  Synthesized
  misc_feature (61): n=a or g
cttgcttcaaatactagcaacaggtagagaccattttactttaacaaacttgtaatataanctacaccattccctaatcacttccacattcaatgcagctggtttacttagtgtctcattc

SEQ ID NO: 2604 - DNA, 121 bp, Artificial Sequence
  Synthesized
  misc_feature (61): n=t or c
caggaatacatcacttcttgccctgttctctatggaagtgggcactggctgcatcctgccnagcagcagtttcatgttcgaaggctgtgacatttccctttccctttatatgagtacagtt

SEQ ID NO: 2605 - DNA, 121 bp, Artificial Sequence
  Synthesized
  misc_feature (61): n=a or t
aattaagaaaaaataaagtgattttgtcatcctatgacattaggaaagacattgtacagtncacattgccttcagcattcaggttttagaagttggatcatgcacaagacaggtatgagca

SEQ ID NO: 2606 - DNA, 121 bp, Artificial Sequence
  Synthesized
  misc_feature (61): n=a or c
gaacaaaaaataaatgatgtttctgcctgctttattgtatctgaatttagcatctcagcangtgaaagcaatgctaaacagccactgatctacctgcattgctgtaaaagtctacagaatc

SEQ ID NO: 2607 - DNA, 121 bp, Artificial Sequence
  Synthesized
  misc_feature (61): n=t or g
gtttgagcactttgttcttcctttgcaaaagaagagaggaagaagtggttggcatagaagncctcaacaaaatacagctctacttacaaatatggagtgatttattgtgagtgataaattg

SEQ ID NO: 2608 - DNA, 121 bp, Artificial Sequence
  Synthesized
  misc_feature (61): n=a or g
agcacaatcactgctggtaacttacctttttgtcaaggtaggaagaaattgcaaggcagcnagcattcactagggatcatgcagtccaagcagtaattagggtcagtgaagaaagctatgc

SEQ ID NO: 2609 - DNA, 121 bp, Artificial Sequence
  Synthesized
  misc_feature (61): n=a or t
acactcccacttagcatttcaatttcaggatatctacatttccagcagaaagaaaaagcantgatctagaaagcactaaactagctctagtggcagggatggtgccattctgcagacctca

SEQ ID NO: 2610 - DNA, 121 bp, Artificial Sequence
  Synthesized
  misc_feature (61): n=a or g
accctacggacactactgcaactgcaccacgcaagttggttggtacatcagtttaaacaantcacgttacttactgctgccatttgcatgggcatcggggtaaaaactgagttctcggact

SEQ ID NO: 2611 - DNA, 121 bp, Artificial Sequence
  Synthesized
  misc_feature (61): n=t or c
actctgaataacgtactgcacttacatggtcaccaaaaataagtttaactaatctagctgnggaacaatgactaaaataccacagtcacttaaaaataccaattttaccaaagatgaattt

SEQ ID NO: 2612 - DNA, 121 bp, Artificial Sequence
  Synthesized
  misc_feature (61): n=t or g
aggggtataatagattttgttataaacagaagtgactcatacttcacaaccaatgaagaanaaagacggtgataagggattttcagatctgtgttgctgtttggtcatgcaagtgtaggac

SEQ ID NO: 2613 - DNA, 121 bp, Artificial Sequence
  Synthesized
  misc_feature (61): n=a or g
agtgatttccatttctccgatggaatcaaattccactggagtaagtgtactgtgaagtgtntagcgttcttccaacaacgtgtatcttcaggcattagagaagtaatgattctgaaacaaa

SEQ ID NO: 2614 - DNA, 121 bp, Artificial Sequence
  Synthesized
  misc_feature (61): n=a or g
agaacagaattccttgagtagtgaggagccttgaagaagcaaatgaggctcccgagaacanctgaagctggcttttctcagactggcctctcagaacatcagtaaggatgttctttgaaca

SEQ ID NO: 2615 - DNA, 121 bp, Artificial Sequence
  Synthesized
  misc_feature (61): n=a or g
tgccaagtcttcctctgctaggtattcgataaccagataaaaatagagggctgaatgacangagaaacaaaagagcatagagctagtggagaaggaactgaaaggtggtgttgtcctgggg

SEQ ID NO: 2616 - DNA, 121 bp, Artificial Sequence
  Synthesized
  misc_feature (61): n=a or c
atgagttgatttagtgcttgctatagtggaggtgatagtcctactctggtatggctataantgggacgaagaatagttttgtgaaatgctctgagccccgctctcttatccagtaagaatt

SEQ ID NO: 2617 - DNA, 121 bp, Artificial Sequence
  Synthesized
  misc_feature (61): n=a or t
tctacaccacgttctcattcagtaaactaacttcctagttatagccatccagtaaacaaantgcaataaactacccttctccagctgtccaggaacctaagaaggattagtactatgacca

SEQ ID NO: 2618 - DNA, 121 bp, Artificial Sequence
  Synthesized
  misc_feature (61): n=c or g
ttttttgctcaacttctatattttaaaagcagagcaacaaatcagtgtatgttactgtcanatcatcctgatacctctaccatccagtaccagcacagagacaagtggttttttttgtgag

SEQ ID NO: 2619 - DNA, 121 bp, Artificial Sequence
  Synthesized
  misc_feature (61): n=t or c
atgctcaacacacaaaatggctgtataacagctgtttctgtgcctggagttcgttcattcngacattaagagaaatatataattatttctgactgagattcaaggtagaattgcaatgtat

SEQ ID NO: 2620 - DNA, 121 bp, Artificial Sequence
  Synthesized
  misc_feature (61): n=c or g
gtacagaaaatggcaatatttcatttctcatagtgggaaaacatttgtaaacaggaatggnttagagaggcaaagaactttcttaaagcacttatagattattagaaaaaaaaattagatt

SEQ ID NO: 2621 - DNA, 121 bp, Artificial Sequence
  Synthesized
  misc_feature (61): n=a or g
cttatactggcaaggtgttttagagaacacagcttttttaagccaattacctttcattgcnaaatatacgaaataacatttttctccattttaaacaaaattacaaagaaacctaaggaaa

SEQ ID NO: 2622 - DNA, 121 bp, Artificial Sequence
  Synthesized
  misc_feature (61): n=t or c
cctcttcactaggaattatacaaagaaaaatgctaatttcagtgatacctcagaaagctgnttggtaggataaatttttgagtacaattaatttatgtggatttggaaacaagagctctgt

SEQ ID NO: 2623 - DNA, 121 bp, Artificial Sequence
  Synthesized
  misc_feature (61): n=a or g
ttatgctactatgtaaaataaaaagtgttctgaaagccaaaataatcaaataaagaaggcnaactgtccccagacatctctatagaatggaaaacagtgcagtgaaagtacaagaatgttc

SEQ ID NO: 2624 - DNA, 121 bp, Artificial Sequence
  Synthesized
  misc_feature (61): n=t or c
cccgttaactcttatctgttctcctcagtttctgctcagcgtgcttaaataaaaatgccgngggctctcagcccttactttgaacagcgattgttagggtttatttttaaatataaacagc

SEQ ID NO: 2625 - DNA, 121 bp, Artificial Sequence
  Synthesized
  misc_feature (61): n=t or c
cttgttataaaactgtctgagaggaaaagattcactggcattgatacacaatcactaaagnacttgatctgagaaattattatttttaagcaaaaagttgcaacactccaagtgagttaat

SEQ ID NO: 2626 - DNA, 121 bp, Artificial Sequence
  Synthesized
  misc_feature (61): n=a or g
tatgattataatctttgccttcttctgtttgcagtcactcattattttttcataatgaagncgggcaagtatctgagttctctctcgttgatgttacttaactaaagttcatcaaaacatt

SEQ ID NO: 2627 - DNA, 121 bp, Artificial Sequence
  Synthesized
  misc_feature (61): n=a or c
tcacctcccagtgaattgtattatactttctctgtacggagaggagatgtttaaaagtccncaagggatatcgcatttttttcatttttcccatagtaaatgctaactgtgtcacacttgg

SEQ ID NO: 2628 - DNA, 121 bp, Artificial Sequence
  Synthesized
  misc_feature (61): n=t or g
agttcagctttgcatgcaggctcacgctaaggaagaaggtgaaaatggagtgaaaagatantgagcttcgttttgtttgactggctcgtgggagtggggaggtggaagaggaatcttgctc

SEQ ID NO: 2629 - DNA, 121 bp, Artificial Sequence
  Synthesized
  misc_feature (61): n=a or g
tcttattgtacagtaaaataagcttcctaaataggttaaatggaccatgtcctaaatgccnctacttcccttcactgaaaagggggagagctggagtgaccaggcctggtgcagacgtcct

SEQ ID NO: 2630 - DNA, 121 bp, Artificial Sequence
  Synthesized
  misc_feature (61): n=a or g
gcccctatcataaatgagtatatcttgctttgactctaacacacacaaataacagtcatcnctgattgctaattactatgtataattactaagaagtaatctgaagaaatgatgatataaa

SEQ ID NO: 2631 - DNA, 121 bp, Artificial Sequence
  Synthesized
  misc_feature (61): n=a or g
taaatggattgaaagtgatttttttgcatgatgtaagcaaagatttttgtttgaatctaancagaacttgcagcagggattaatatgactcacaaagaactaacattacagaaaataatgc

SEQ ID NO: 2632 - DNA, 121 bp, Artificial Sequence
  Synthesized
  misc_feature (61): n=a or g
agcagatgtaaattaggcaatatatactcttttgggtgtatatatcctgccagtgtttgtnaaagctctgattccccgtgccggggaagattatggagcagattgtcttgagggagatcat

SEQ ID NO: 2633 - DNA, 121 bp, Artificial Sequence
  Synthesized
  misc_feature (61): n=t or c
tgaaaaacccgtggaagaaaaattgtgggttgacaggcagataatttttcagttatggcantgctgtggtccaaacagactaaatctatcaaaaattaacataaattattcccaattaaaa

SEQ ID NO: 2634 - DNA, 121 bp, Artificial Sequence
  Synthesized
  misc_feature (61): n=t or g
atcacttctgaaagacatctctgtcactgagccttcatttttccagaactgtgatgagagnaactgctgcctactccagcaaggtctgcttgaatcctgaatataagaacagtgtctttgg

SEQ ID NO: 2635 - DNA, 121 bp, Artificial Sequence
  Synthesized
  misc_feature (61): n=a or g
gggctctaatttaggcttcaattctgcaaacacgtttggaaattaaatatcactaagcaanccctcaaccattggacagtgctactttatgctgtacctaatgctgatcaaaacagtgcac

SEQ ID NO: 2636 - DNA, 121 bp, Artificial Sequence
  Synthesized
  misc_feature (61): n=a or g
caagaccagagcaatggtgttaaagactcctattatgtcagtagacaggagagatgcaaanattcacaaagcaagcaattcacatgtaaactcgaagataattgagccaagactgtacttt

SEQ ID NO: 2637 - DNA, 121 bp, Artificial Sequence
  Synthesized
  misc_feature (61): n=a or c
caattcagagggaaagatataactgtgagtcacaagattacaccctttttctgctcttctntgtggtacatgctccccagccatctcacccttagcattagagtaaggccatcagttttta

SEQ ID NO: 2638 - DNA, 121 bp, Artificial Sequence
  Synthesized
  misc_feature (61): n=a or g
ttcgtctggctattttttctagttctgaaagtgtctctactgttttaccatgaattcacanaagtcagccttttaacttggaatttatctttgcaaaagtcacttacatcattttggtctg

SEQ ID NO: 2639 - DNA, 121 bp, Artificial Sequence
  Synthesized
  misc_feature (61): n=a or g
ttgtacttcatttgattagatttatttccgcatccaaatttattctgtgggcatttcactngagtcatctaaatgataaagggcagagttgaagaccccctctttcatgttaaataagacg

SEQ ID NO: 2640 - DNA, 121 bp, Artificial Sequence
  Synthesized
  misc_feature (61): n=a or c
gatttgcactcagaaggttcacactggtgaacatgtattaacatttaatactatactctgnaagaaattctagtatctacattgggaatattcatgatctgagatataaaacaccatggtt

SEQ ID NO: 2641 - DNA, 121 bp, Artificial Sequence
  Synthesized
  misc_feature (61): n=t or c
ctggcaatgtttttttagtattgcttaggatttaatctttcccttatttcttctctccttntccttccctactaccccaacttcatttctagtggacaaggtgaaagaacagttgaaatta

SEQ ID NO: 2642 - DNA, 121 bp, Artificial Sequence
  Synthesized
  misc_feature (61): n=a or g
aagaaaatgaaaatgactcattgctacaatagttaacctgaaaaaggccaaaccaaaattntgagtggaaacatctgggtaacaaaatttgctgggaggacacagaaagggcttctgcatt

SEQ ID NO: 2643 - DNA, 121 bp, Artificial Sequence
  Synthesized
  misc_feature (61): n=a or c
gctttatctctatttctgagggtttctctcaagggccaaccagaaactgatgttaaagatncttacttaccactctggccccactcaggatgcttcccgagttgttcatgccaccttggag

SEQ ID NO: 2644 - DNA, 121 bp, Artificial Sequence
  Synthesized
  misc_feature (61): n=a or g
ctccttggagaccttcagaagctgcctggccatgatgtgtctgctccgagtgctctgggtnaccatgctggagtaggagttgggccaaagggacccagatctttctgccaacctcagtcat

SEQ ID NO: 2645 - DNA, 121 bp, Artificial Sequence
  Synthesized
  misc_feature (61): n=t or c
tggtaattgaaaggatatgcacacattgatttgcacatcagtgatgtactgcaccagttantgctgagggaattactatctggcagtaagtcttgttatacatttcttgttactttcttac

SEQ ID NO: 2646 - DNA, 121 bp, Artificial Sequence
  Synthesized
  misc_feature (61): n=a or c
ttgcgtatacatgtatttcatacatgttatttcaatcagaatagtatgaacaatatgtttntagggctggaaaatcatacagcgaggtttctacattggagtattgcatcactattttggc

SEQ ID NO: 2647 - DNA, 121 bp, Artificial Sequence
  Synthesized
  misc_feature (61): n=t or g
agtaagcacttggaaacgttcgcaaagggaagaaaagcagccctaaaggaaaagccctgtnctggaagagcacagaccacaatgagaagctgagaaaatgtccgaaagttgacactataag

SEQ ID NO: 2648 - DNA, 121 bp, Artificial Sequence
  Synthesized
  misc_feature (61): n=t or c
tctcttgagattattttgtttatgagcaccatggatgccaaactagtacaacctgcacagnattcttggctgacgagctgcttggtttgtggcaaactggtcatgcagcgtagaccagggc

SEQ ID NO: 2649 - DNA, 121 bp, Artificial Sequence
  Synthesized
  misc_feature (61): n=t or c
gagaaagtgggggttttttattatttgttttaaagatatcttctcacaaaaagtaacttanttattctttaggagcttctctaatgtgctcactcataacaataaaggcaataacttcagt

SEQ ID NO: 2650 - DNA, 121 bp, Artificial Sequence
  Synthesized
  misc_feature (61): n=t or c
tacatggaaaaagcccccgtaggattaggagaggcaggagaatgagcagatggcatcaccncaggggactaagggacaatgtcttaagaaacactaacgaagagactgggtaggagctgtg

SEQ ID NO: 2651 - DNA, 121 bp, Artificial Sequence
  Synthesized
  misc_feature (61): n=a or g
tcatcctgaaaaatgaaattaaaaaagggaagacaatgccaggatgctttggtggtgctcntactgttgtggaacagccccacctgctgttggggtgaagaagccttcatgggccgtgggt

SEQ ID NO: 2652 - DNA, 121 bp, Artificial Sequence
  Synthesized
  misc_feature (61): n=t or c
aatccactgcccaaactaggcttctcttactggaggtgcagggagtcatgcagtatgttcntttgtgtcaacgatcatttgactcgtttcttgcataatgttgttgttggcttagaatctg

SEQ ID NO: 2653 - DNA, 121 bp, Artificial Sequence
  Synthesized
  misc_feature (61): n=c or g
atcctttcctagaaaacaatgcctaaactagcattccaaggttttgttgaatccggctttnaatcactgccaaggtatttggcatctggttctgcatcttttcagttattttacagaatat

SEQ ID NO: 2654 - DNA, 121 bp, Artificial Sequence
  Synthesized
  misc_feature (61): n=a or g
aagtttgtaaaaccacagcacatggaatagggataattgagtaacacaaatttagtatatntagtgtaatgaataaagtgagtttgtttttctgcttctttttgatttgttattcgcaggt

SEQ ID NO: 2655 - DNA, 121 bp, Artificial Sequence
  Synthesized
  misc_feature (61): n=t or c
actcagcatgctttcgaccctctcacagctcatgtctgggaacatgggcccctggtgcttnaggcacaccaccacctcgccttttcagcacaagagaaatttcaacattctcctgtttgtt

SEQ ID NO: 2656 - DNA, 121 bp, Artificial Sequence
  Synthesized
  misc_feature (61): n=a or g
gcaaaactgtttcccagattgggaatgctctgtcaggagcttaacagaatacgcttcccantgtttgcagtttgacgtatattccagttctctggatccaggtgtgcaacttgactttgag

SEQ ID NO: 2657 - DNA, 121 bp, Artificial Sequence
  Synthesized
  misc_feature (61): n=a or g
aatattaactgtgtataatttaactttaaaacactcaggacttgtgtaagctaagaaatgnaaaatggcaattatatctggggatttaaatattgtcataatagaatatgtagttccaaga

SEQ ID NO: 2658 - DNA, 121 bp, Artificial Sequence
  Synthesized
  misc_feature (61): n=t or c
tcgtcaagtttctgccaggccacacacatcatatgttagaaacctatgcagggaaaagccngtctaacattaccttgtcagcattgattccttttagcaagagtacaaaactattttcaac

SEQ ID NO: 2659 - DNA, 121 bp, Artificial Sequence
  Synthesized
  misc_feature (61): n=t or c
tcaattaaaatgttgcagaacatttttttccaaataagctacacaatcaaggcaaaactcngcttatcattacgtttttaagtaagcaatcttaccaagcaaggaagcattatcttcactt

SEQ ID NO: 2660 - DNA, 121 bp, Artificial Sequence
  Synthesized
  misc_feature (61): n=a or g
ccatcaccactgaaattcactccttttatacaccatcaacattgcttaatgctataaatanctgttctgtttatcagggtcctgcttgagactggctatcgcactgctctttctaacactg

SEQ ID NO: 2661 - DNA, 121 bp, Artificial Sequence
  Synthesized
  misc_feature (61): n=t or c
gacgcaaaacgttgctgatgttattctgtagagccattccatacaggattctcttccacgnggtttgacttctgctgtctacaggcacagcaggcaaggcagtggagaatcagactgtgtc

SEQ ID NO: 2662 - DNA, 121 bp, Artificial Sequence
  Synthesized
  misc_feature (61): n=t or c
caaggtgcaacaggcagaggtttcaaagactttcagttatgcccatccagaaaagcaagcngatggagctttccagtcacgttcgggcgcaaggaaatagacaattcccagcacatcaaca

SEQ ID NO: 2663 - DNA, 121 bp, Artificial Sequence
  Synthesized
  misc_feature (61): n=t or c
gggtacaacagctcttgttcttgcattcacaaacacactcaaactcctttccgggtgccanggttcatgttcaagtctgaatgtctttactcccccagtacataactctacacactatagt

SEQ ID NO: 2664 - DNA, 121 bp, Artificial Sequence
  Synthesized
  misc_feature (61): n=t or c
actacccagagcctcacaaggactcatcctgaccactacacacaataccttaagattcagncctggtttcagaggtgatttggacactgttaatcgtgtggggccttttgcaacactagca

SEQ ID NO: 2665 - DNA, 121 bp, Artificial Sequence
  Synthesized
  misc_feature (61): n=a or g
gcaggggtacaggcacttcacactgctggcgtgggttgagtacagctataagaacaggagnatacctggaacagcatccacatagtccatgtgaactccccagtgcatctcattgggatga

SEQ ID NO: 2666 - DNA, 121 bp, Artificial Sequence
  Synthesized
  misc_feature (61): n=c or g
ccgttttcccccatggatgggagcatacagggagataatggtgcccaggtgaagtccttcntgattgtctccgatggaaaccctccagcctgactggaaaccctttcaccaagctgactgt

SEQ ID NO: 2667 - DNA, 121 bp, Artificial Sequence
  Synthesized
  misc_feature (61): n=c or g
aagcaatcagacctcatgctgcatcatctttgagcaaaaatgggtgattcttctcttttcnccctgcaggaagctggattgaaggagggcgactacatcatcttggtgaacggcaaggatt

SEQ ID NO: 2668 - DNA, 121 bp, Artificial Sequence
  Synthesized
  misc_feature (61): n=a or g
ggactagatgaccttcagaccccttccaactcaaacaattcaatgatcatttgttagcacngattaatttttctgaatatctgtgtatggacaggaggatgaaacctctactataaatggg

SEQ ID NO: 2669 - DNA, 121 bp, Artificial Sequence
  Synthesized
  misc_feature (61): n=a or g
gctttgttcacttactttacattcagtgtggccagaatttttttgaagaatcctcagaatntgtaaggagttatttatgtagcactttagacaactaaataactgtcatgtacaatttatc

SEQ ID NO: 2670 - DNA, 121 bp, Artificial Sequence
  Synthesized
  misc_feature (61): n=t or c
cttggaggtcatccagagccacctggacacgtcctgggcaccttgttccatgcatctctgnttgagcagaggttggaccaagggatccagaggtcacttcttacctcaaccattctgtgca

SEQ ID NO: 2671 - DNA, 121 bp, Artificial Sequence
  Synthesized
  misc_feature (61): n=c or g
gcttactcagaaaaggaccaagaataagatttaggctaatacacacatggtgatgcagtanaaaagcatgacaagcttccctgaaaggagttttcccactcagacatacaggaagtaacag

SEQ ID NO: 2672 - DNA, 121 bp, Artificial Sequence
  Synthesized
  misc_feature (61): n=a or g
taactcagaagttgctcttggctgcttaaatgtacttacactaaaataatagaattggacnccccaaaacaggacccaaaccagctgcgatgagcaaaatgcaactgtttagaaccagcaa

SEQ ID NO: 2673 - DNA, 121 bp, Artificial Sequence
  Synthesized
  misc_feature (61): n=c or g
aattctgcttagtgtcaaagcttttgtgctatttacttttaggggttgctcttggctgtantgaagaacagaaggcttggctgttgtaattttacaagatttagataagttggaatcactt

SEQ ID NO: 2674 - DNA, 121 bp, Artificial Sequence
  Synthesized
  misc_feature (61): n=c or g
tctctatctcctttcacatactatttacatgttctcaaaggactgttttcagacaaatcanacagatatcatcctctctgaagactgctgcatttccatttcaataccactgccatttcat

SEQ ID NO: 2675 - DNA, 121 bp, Artificial Sequence
  Synthesized
  misc_feature (61): n=t or c
gcatctctggaaatcttcctcagttgctccgtgaaggtcctaaaggatttaaacacacagngagatgtaaaaggtagcattttcactgtcttcttaccagtttttagggaaacattcccaa

SEQ ID NO: 2676 - DNA, 121 bp, Artificial Sequence
  Synthesized
  misc_feature (61): n=t or c
tcccctgcccacttgcaccttccgtaaaaatgagaagggaaattcaaccagacagaaatangtagtgcaaaattgtcactctgctctctggttcagactctgcagcagaagaatagggcaa

SEQ ID NO: 2677 - DNA, 121 bp, Artificial Sequence
  Synthesized
  misc_feature (61): n=t or c
caaggtaatgaacaaatatgacttatgtggttcttcagaagagctgagctgaaacatctgngctttatactttcaaaacttacaagaatcaatactacatgtgcgagtatcgattgtagaa

SEQ ID NO: 2678 - DNA, 121 bp, Artificial Sequence
  Synthesized
  misc_feature (61): n=t or c
ctaacctgcataaatgatagaatggacctacattgtccagtgatttccccagaccagccantgtgtgcttcagtgtgttgattcacatccagggtgcgcaacctggctatctcacggactc

SEQ ID NO: 2679 - DNA, 121 bp, Artificial Sequence
  Synthesized
  misc_feature (61): n=a or t
gggaaatactttattagttgattttaaggtgaatgtattcagtagattacaaatagaaagntgtaatgctggagagagaaaaaagcagatcaaaatcaaaaagggtgcagtgaataggtac

SEQ ID NO: 2680 - DNA, 121 bp, Artificial Sequence
  Synthesized
  misc_feature (61): n=t or c
ttaatatcatgattgtaatcgaaagattttgcatccaaacattacacttttgcttatgctncctttcatagctctgaaatgcatggtaccggattttattctcctttatgattgtatccat

SEQ ID NO: 2681 - DNA, 121 bp, Artificial Sequence
  Synthesized
  misc_feature (61): n=a or g
ttgattattgtagccaaaatatgtaggataacagccaaactgtatttcctatttaaaatangaaacacattcttcgtgatttcagtttaaattcttgcttatgactctggaaacccattca

SEQ ID NO: 2682 - DNA, 121 bp, Artificial Sequence
  Synthesized
  misc_feature (61): n=t or c
ggagcacggttaccttggtaggaattacatgataatgtgaaagtcagccacctatgtctcncttatatacatatcaaagggaaaataaagtttgaaaaagttactgcaataacccccggaa

SEQ ID NO: 2683 - DNA, 121 bp, Artificial Sequence
  Synthesized
  misc_feature (61): n=a or g
taaggaagaaaaagagcatgaaggaagcaatactgataattttctgaacacctgagacatngtagaattaagcaattcatcttttttttcctacatccacccactcctcatggcagcaggg

SEQ ID NO: 2684 - DNA, 121 bp, Artificial Sequence
  Synthesized
  misc_feature (61): n=a or g
gaaagagtaaatgtagacaccaggtacaggggcagcatgctaataaactgtttcatgaganaaaacagttttacagagaaagcatagacagaacccagtgtttcaacatatttcaggacag

SEQ ID NO: 2685 - DNA, 121 bp, Artificial Sequence
  Synthesized
  misc_feature (61): n=a or g
tacagcctttgtgtaaacagcttgtttctttgctttgaagggggttagatttcactggtgnaacaagccaggctgtaaactgagacaaagctcttcctttgccaaaacctaagttacaaaa

SEQ ID NO: 2686 - DNA, 121 bp, Artificial Sequence
  Synthesized
  misc_feature (61): n=a or g
cataattctgcttattctcatcgtcttcctggtgctcttcatctacacattgccaggtgcnatcagtcgtaagctagttgtaggaatgtaggattacagctctcatggtaaccaattgtat

SEQ ID NO: 2687 - DNA, 121 bp, Artificial Sequence
  Synthesized
  misc_feature (61): n=t or c
tgttttgatggatggtaggaaaatgtgggtaatattagagctgacattctatacattgatnctgattccatctcaaatgcagttctgggacagctcttgagaaattagtaatttgttcagg

SEQ ID NO: 2688 - DNA, 121 bp, Artificial Sequence
  Synthesized
  misc_feature (61): n=t or c
ggagcatttgtcttttctgaacacacaaagtctagcatgcctcctggcagttcccgttgtngaacattaattactcggtttttataaactgagcaaagaagagtggttttatgctatcatt

SEQ ID NO: 2689 - DNA, 121 bp, Artificial Sequence
  Synthesized
  misc_feature (61): n=a or c
gccagtaataatgtgaatatagttaatcctgtcgtgggataaaaggacatgttaaaggttntttccactttgctttctgtgattctgacctactaagaataatgatcattttgaccagaac

SEQ ID NO: 2690 - DNA, 121 bp, Artificial Sequence
  Synthesized
  misc_feature (61): n=t or c
agccccactgaacccggcacagctgctctttctgctggaaaaactcttgccgaagtgttgntgcccttgcgtgtaggataagatttactagaatggaatacagctctggccgtactgacac

SEQ ID NO: 2691 - DNA, 121 bp, Artificial Sequence
  Synthesized
  misc_feature (61): n=t or c
agtttggacatctgaatcctttgtgagcaatccaccaaaccttacggtgctgaaccagtanatgctttagcacagacttgcaaacagggtcaacgttggtacacacacaatgagtgaatgt

SEQ ID NO: 2692 - DNA, 121 bp, Artificial Sequence
  Synthesized
  misc_feature (61): n=a or g
atgcaggacttggattgctttgacaaatagcttgacactcactaccaccagctcatagganaacccttaggtctgtataacagatctatataagagttacagaagtccctagaattgaaga

SEQ ID NO: 2693 - DNA, 121 bp, Artificial Sequence
  Synthesized
  misc_feature (61): n=a or t
catattttgatatgtattgattcctatcaacttgcaccctttcatattctgacaatatgtnaaaaacactaagggaagcacttctcagttaagtgcctccgcatataactaacacataggg

SEQ ID NO: 2694 - DNA, 121 bp, Artificial Sequence
  Synthesized
  misc_feature (61): n=t or c
ctgactgtgcccatgtatacagagttaccagaggactagtcacctccaaagatgccgaagngtggggtgggacacctcacatggctaaagcagaaaacatgaatgatgggagcacaggctt

SEQ ID NO: 2695 - DNA, 121 bp, Artificial Sequence
  Synthesized
  misc_feature (61): n=t or c
tggcatcctctggcaccttgaactcagctggtacagcacatatgggggagtttcacagganctgcagtgagctggaaggagaatgtctgaacctggggatttcaggagtgtcatgccatgt

SEQ ID NO: 2696 - DNA, 121 bp, Artificial Sequence
  Synthesized
  misc_feature (61): n=t or c
agggttttgaaagatatccaaaaatatcggttcaaacttcctgaagatgacggtggacacntcgaagttcctctccagcctctccacccgctcccggaactcctgcggcacgttcgacatg

SEQ ID NO: 2697 - DNA, 121 bp, Artificial Sequence
  Synthesized
  misc_feature (61): n=t or c
accccaagattgattcaaggcccaagagcacccgagtgatatcagcaaccatctgcagcanaactcccccagccactttacaacacatggctggcaagcctatgacttctttaggaacaag

SEQ ID NO: 2698 - DNA, 121 bp, Artificial Sequence
  Synthesized
  misc_feature (61): n=a or g
gcgatctggaccttccaccccaactttatgtgccattgcaatgttgttatatactgatacntattactgcattgtaaaaataatcactgtgtttagctaaaatgatctggtgcttgaagtg

SEQ ID NO: 2699 - DNA, 121 bp, Artificial Sequence
  Synthesized
  misc_feature (61): n=a or c
tacagaacattaacattactggcagcaactgtgattatctgtcttgcagcagcttactagntcttatcagtagcactaataacgatcttatgacagcagacaaaactctggaggcgtaaga

SEQ ID NO: 2700 - DNA, 121 bp, Artificial Sequence
  Synthesized
  misc_feature (61): n=t or c
ccttcagggatgctttagctaactccccatttctcttcactattgttaatttctcccttangggcacctttcatatctcctttactatttttctttccttgttcctggaattataagccct

SEQ ID NO: 2701 - DNA, 121 bp, Artificial Sequence
  Synthesized
  misc_feature (61): n=t or c
acgcagagcactggatgctgtatgcagctcggagctgcatcgtggctgtggtgctgatgcngtagagccagcaaggcagcagccttcgtgggaccattagtctgggcatagcacatgcctt

SEQ ID NO: 2702 - DNA, 121 bp, Artificial Sequence
  Synthesized
  misc_feature (61): n=c or g
ccacacagagaaatgtactcgagtaaatctatggaggtccaaaccaatgctcacggcctgncttaacttcaaaagcctacattatgcaggctggagacagcaagtgagttagctacagata

SEQ ID NO: 2703 - DNA, 121 bp, Artificial Sequence
  Synthesized
  misc_feature (61): n=a or g
cacatttttcttggtttttccttaaaataagtcctaaggacatggtaagttaacgcctaancaagatgacatacagaaagaaaatgctgagtagtcaactaggaggaaaaacacagagatt

SEQ ID NO: 2704 - DNA, 121 bp, Artificial Sequence
  Synthesized
  misc_feature (61): n=t or c
atttgtttcatttcttcttaccaattaaaacaacctccggaaacctatgtgggagaggaantcactgcaacacctgaatttcatgtgcactagcaactgatataaggatggggaaaagata

SEQ ID NO: 2705 - DNA, 121 bp, Artificial Sequence
  Synthesized
  misc_feature (61): n=t or c
catcattaggttggacaagtgacaaggaatgacacccctctgacaacaccttaatgaaggngagacaaaaactgacttgagaagagacccctgaagccctggcaggagttcaccctgcaca

SEQ ID NO: 2706 - DNA, 121 bp, Artificial Sequence
  Synthesized
  misc_feature (61): n=a or g
aagggaagtccactcctcgtggtctttgttggctctcagagatgtgtattgaagtttcagnctgccttggactttgactgggtcacaccccagcagttcatatctcctggaacgctcttcc

SEQ ID NO: 2707 - DNA, 121 bp, Artificial Sequence
  Synthesized
  misc_feature (61): n=a or c
gccctccagaggtgcacgttttaattcactctcattctatattatctagaacaggggagcntcattactgtggtctgctgatgacccgtgaacaattgataaagaaactgggaaacgccag

SEQ ID NO: 2708 - DNA, 121 bp, Artificial Sequence
  Synthesized
  misc_feature (61): n=t or c
gccttctcttcctgtgtaacagaggtaacaaatgcctcctctgcaaaaggttgaaaacatngtaaggacaaagccatgatgaggcccatcaatctggactacatttccaccttacgtgcca

SEQ ID NO: 2709 - DNA, 121 bp, Artificial Sequence
  Synthesized
  misc_feature (61): n=t or c
cacagccctcaattagtgccctgcatcatttatgatgcagtataacccattcccatctccnggtatactctgcaacaactggagatgcagacacaccaccaaacgctgtgtgctgacccca

SEQ ID NO: 2710 - DNA, 121 bp, Artificial Sequence
  Synthesized
  misc_feature (61): n=a or g
cagcaagagaaaccccagctttactttatgccacatggaaatatcatgtcaaaattaatgngaatatgttaaacacccacagacacagcagtggggtccttgctgtgctctcagccacaaa

SEQ ID NO: 2711 - DNA, 121 bp, Artificial Sequence
  Synthesized
  misc_feature (61): n=a or t
cctggtgcttcccactgacagctgggcaagttgagttcctgcacccaaatatctcccagcnaactcctctacctcacaacatcgtgagcgctgccgaacggccctccatcaagtaaaatgg

SEQ ID NO: 2712 - DNA, 121 bp, Artificial Sequence
  Synthesized
  misc_feature (61): n=t or c
gtcctgagactcattccccactctgctgagcctcttcctctgctttccgcagcaaagcagntgattcctatggacctcttctcctggatttgctctggtctcagttggagctgcacagggc

SEQ ID NO: 2713 - DNA, 121 bp, Artificial Sequence
  Synthesized
  misc_feature (61): n=a or g
gcatgcacctgttacagtcaggtattgacagcagagcaccctaaaactgaggtattgttgnagcttaggctagtggctcctcgttgccaccataaggctgttccctttcttttccagcagt

SEQ ID NO: 2714 - DNA, 121 bp, Artificial Sequence
  Synthesized
  misc_feature (61): n=t or c
attgctagagggaaatttggccagagaagatgtttttagatgcctttgaagatgtaaaaanggcaaatggaacgtgctgtggcataaacatcaaagacctgcccaggaagaatcaaaggac

SEQ ID NO: 2715 - DNA, 121 bp, Artificial Sequence
  Synthesized
  misc_feature (61): n=t or g
tagtctgggtgccagtgtgtcatccgcagcccaaggaaactgcagaaggtaatgcaagatngtgaggttttccagactgctctgctgtgctgcattagatcagcctcaggacttctgtaac

SEQ ID NO: 2716 - DNA, 121 bp, Artificial Sequence
  Synthesized
  misc_feature (61): n=a or g
taaacataagtggggcctcgtgtaaataaacaagggcaaagtgagctttaacttgcgatgnattgtatatcaatcttgtgcacatgcatggaacccattgcatgcatgcacatgtgtaccc

SEQ ID NO: 2717 - DNA, 121 bp, Artificial Sequence
  Synthesized
  misc_feature (61): n=a or g
aaatagagaaaataaaataaaataaaataaaccacacctaacaaacaaagtagcagctgcnaagccagcattaacgtgtttaggtttgattttgatttttaaagggctaatgacaaaggaa

SEQ ID NO: 2718 - DNA, 121 bp, Artificial Sequence
  Synthesized
  misc_feature (61): n=t or c
gaattctgactgcaaaatcattttcacccaaacaaagacattattttctatcagctcatangggcaaaaaataagtgagtgtaaatacatataaatagctttgtaggagagcaatgctgat

SEQ ID NO: 2719 - DNA, 121 bp, Artificial Sequence
  Synthesized
  misc_feature (61): n=t or c
ttgaatttaatctcacacctgattggccttcctcaagaaaatgtgccagcttctatgatantcaccattcccctgaccaacattaacgtttcagtatcatcctgtgtgttgtgctggtata

SEQ ID NO: 2720 - DNA, 121 bp, Artificial Sequence
  Synthesized
  misc_feature (61): n=t or c
caaaacaggtatatgtaaaacacatgcttgtagaagcagtaggcaggctctttcagaaaanagcacagtaaaaatcttcgtgtgttccctttttatccctgttgcagcctgcccaccactg

SEQ ID NO: 2721 - DNA, 121 bp, Artificial Sequence
  Synthesized
  misc_feature (61): n=t or c
aagtccatctctagatgacctctgatgagattccaggattttagaagttaggaaggtatangtaaatattcctgctctcacagtaaatcatcaagctgagaaaaagtagaattaatttttt

SEQ ID NO: 2722 - DNA, 121 bp, Artificial Sequence
  Synthesized
  misc_feature (61): n=t or c
atattgtatgtcctccagcctcacgcatattgttatcaaacaaaatgagagcagaggttanagctttttgtttttctgtcatacatagtatcctgaagtcttgataaaaatacagctcctt

SEQ ID NO: 2723 - DNA, 121 bp, Artificial Sequence
  Synthesized
  misc_feature (61): n=t or c
actcttataatagcagctattatcaggctgaaaactctgctaagcttctgaagtttacagntatatggtatagaagggtaaagtcaaagctagacttatttacttcattttgttgaacatt

SEQ ID NO: 2724 - DNA, 121 bp, Artificial Sequence
  Synthesized
  misc_feature (61): n=a or g
cagtcctggactccccatctcctggtgaggaaattatcagttacataattacagatgttancccaggaatttggaacctgcagttacactgtattaaagtgtaattatggtcagaaaaatg

SEQ ID NO: 2725 - DNA, 121 bp, Artificial Sequence
  Synthesized
  misc_feature (61): n=a or g
atttgatcatggaggagctgtgctgtgagggcagatctcagggttgctggagcagagtgantgcttgaactcaaagtctccttaatttcttgcttcagcctaagctggtgtttctgtaagt

SEQ ID NO: 2726 - DNA, 121 bp, Artificial Sequence
  Synthesized
  misc_feature (61): n=a or t
gaaatacttgttctggctttagaaatattaaaagtgttattatgtttaaaggttgagagangagaagcttaaattgagagaatttctgcttttttcatggtgatggtatctgtcatgattt

SEQ ID NO: 2727 - DNA, 121 bp, Artificial Sequence
  Synthesized
  misc_feature (61): n=a or g
ggtccacccaacagagtgagcagaagtcatggagccctcctgtacttggcttgctggaagntggacagtcgggatgcccatggtacagatcaggaagcacaatagccaaaggaaccttcca

SEQ ID NO: 2728 - DNA, 121 bp, Artificial Sequence
  Synthesized
  misc_feature (61): n=t or c
tgataggatttggaaaaacctcagaattaaggggtttggctatagcagcagtgccacgagngtggaattttgagcctgtctgcacaaaaaaaaaaatgagaccaagtataaattatgagca

SEQ ID NO: 2729 - DNA, 121 bp, Artificial Sequence
  Synthesized
  misc_feature (61): n=t or c
actacgcacacttcagatgcagaaggaaccatttatttagtctctgctgttcagagttagnagtgacctctcagagagctcatctatcacggcagctttaccgcaccttgtgctgagccca

SEQ ID NO: 2730 - DNA, 121 bp, Artificial Sequence
  Synthesized
  misc_feature (61): n=t or c
ctccaggtacagggagtgctattgaagacacaacacgcatctgaggccacatattcaagancaaactcccagtcattcagacagtcagtggtggtatctccaaccaaatactgtgatcagc

SEQ ID NO: 2731 - DNA, 121 bp, Artificial Sequence
  Synthesized
  misc_feature (61): n=a or g
agtgactttgggggtgagatttgtgtgtttgatttgaggaggtttggaaaggtggagaacngggggaaaacatattaattgctgcccctttagcatacattgaaagtatgttactcggatc

SEQ ID NO: 2732 - DNA, 121 bp, Artificial Sequence
  Synthesized
  misc_feature (61): n=t or c
actgcaacaagtgaagcactgcactctaaatcacaaagatagccaaacaggaacaaactcnattaaatgggaatggcctcggccattagagaactctaagagaatccgtggcacctgacat

SEQ ID NO: 2733 - DNA, 121 bp, Artificial Sequence
  Synthesized
  misc_feature (61): n=t or c
aactcagatagcagcagcagaggtgtgttggagctttataactgcctaactttcagtaggntgctattgcaggcttctcatattttctttgcccccacaccccatgatatggctgctttac

SEQ ID NO: 2734 - DNA, 121 bp, Artificial Sequence
  Synthesized
  misc_feature (61): n=t or c
attgataataaatgcatttattttggttaggttaggaacttctgaagtaagcaatcctcanttggaaaatacttaagcctttaaggctacctgtaaacaaagacaagttatgaatttattt

SEQ ID NO: 2735 - DNA, 121 bp, Artificial Sequence
  Synthesized
  misc_feature (61): n=t or c
cagtgtttgccatggacaaaaggttgaggttttacgttatgttgtggtttgtaaagtttcngaactgcagcagcctgcactcagtgcagcacccagaaaccaacatgctgtgcaacgcggg

SEQ ID NO: 2736 - DNA, 121 bp, Artificial Sequence
  Synthesized
  misc_feature (61): n=t or c
tcaccaatttaaatagcattggtttaccccatttgcattttgggaaactgatgtggggagntggggccactgattggtccagcagtaaatcagagcagattgccagcagtggagtggggct

SEQ ID NO: 2737 - DNA, 121 bp, Artificial Sequence
  Synthesized
  misc_feature (61): n=a or g
agaatcgcagaatgagtgcggaaataggaaataacagccaaatatgaggacaagtcagatnagcaacatatctcatctcacccatgtgaaacccatattcttcacataccctcagatatcc

SEQ ID NO: 2738 - DNA, 121 bp, Artificial Sequence
  Synthesized
  misc_feature (61): n=t or c
ccctataactcctgtcctaagcatggtaaaaatgctcagctaaaatagctaggtagcaccntgttcttgcatcttgctgctgggagaaaagagcaaacgcatcaggggtcggatcaggatt

SEQ ID NO: 2739 - DNA, 121 bp, Artificial Sequence
  Synthesized
  misc_feature (61): n=t or c
gttgcgtctcttctcaaagtgcttttgccgatgctgctcctgaaccttcagagcaaatccngaacctaaaatgccctggggaaaagaatgaaattgtgcagttagcaggtgttaggcaagc

SEQ ID NO: 2740 - DNA, 121 bp, Artificial Sequence
  Synthesized
  misc_feature (61): n=t or c
tacactgcactgagtgcagctccagaaatgcagaggctgaagttaatcatgaacctccctnccatgcccacctcctcccaacccacccaccccccagagaagctcagtgggggcagaaggg

SEQ ID NO: 2741 - DNA, 121 bp, Artificial Sequence
  Synthesized
  misc_feature (61): n=a or g
caataatcctagtgaaacccacagccctggtgtctcgtgtgttcctcgtggctcactccantgaccaaagtagcgtggtgatcctgcagacaggtctgcttgcatcccactgacacctggc

SEQ ID NO: 2742 - DNA, 121 bp, Artificial Sequence
  Synthesized
  misc_feature (61): n=t or c
cccacaagggaaacagcttagatcagttcaaggtggtgcagtttccttcctctgtggcaanccagaggtttgtggctacctccctccctcccaaatcagggggcagttcttaggttcccca

SEQ ID NO: 2743 - DNA, 121 bp, Artificial Sequence
  Synthesized
  misc_feature (61): n=a or g
gaaccttaaatcccaagcaatgttttcccagtgctgataaagcctgggatgcaggcaatcngagcacaggctcactgcagggagaaaaacaaaaggcttccatccaaaacagcctcacaca

SEQ ID NO: 2744 - DNA, 121 bp, Artificial Sequence
  Synthesized
  misc_feature (61): n=c or g
cttagtggggactcctggtttttgtttcatgtgtagaagtacgtgtagttaagcagctgcnacagtgggttgttgtgttaccagcagaggtgatgacagtccttgctggggcggagcagga

SEQ ID NO: 2745 - DNA, 121 bp, Artificial Sequence
  Synthesized
  misc_feature (61): n=a or g
acaccaaaactgcgacccaattttcccttcaatatgtatgcaaatttctgattaattatgnagcttttctcatataggaacaattgccctggttttgctttattccaccttggggggagct

SEQ ID NO: 2746 - DNA, 121 bp, Artificial Sequence
  Synthesized
  misc_feature (61): n=t or g
tacagcctaatagcagcaagactagaaaagagccctaggaggattatgtatccaagttttncttgcaatttgctacaaacagtgctaatcgaaaggctactgacatccgaacagtcttctt

SEQ ID NO: 2747 - DNA, 121 bp, Artificial Sequence
  Synthesized
  misc_feature (61): n=a or g
aggcagacattattggagaaaggtatggtcactaacttcctctgaaaggactgatgtctcntgaatgttgtcttttttctgccagtgcagttactcgtaagttgacttgcttgactggtaa

SEQ ID NO: 2748 - DNA, 121 bp, Artificial Sequence
  Synthesized
  misc_feature (61): n=c or g
agatacatgtctcaccagtgcttcttaactccagctatgctcataaagtgctggtgagctnataatctgcatagattttgtgggtatatccttacaaaacatactctagtgctattgctga

SEQ ID NO: 2749 - DNA, 121 bp, Artificial Sequence
  Synthesized
  misc_feature (61): n=a or t
atgtgtaatcagaagcaatcaaatccccaggcatctcaccaaaactactccctctgttacnccataaaacaacattagcaaaaactcatgatcagttttgagctattgaaaatgtttccgt

SEQ ID NO: 2750 - DNA, 121 bp, Artificial Sequence
  Synthesized
  misc_feature (61): n=a or g
ttcctctggtgctatggagagaggtaaaatttatgatgggggaattagaaagaaactggancaagaattgagctaggaaataggaaatgatgctgctaaaaatgtctcatgaacaattaag

SEQ ID NO: 2751 - DNA, 121 bp, Artificial Sequence
  Synthesized
  misc_feature (61): n=a or t
cggaagccaaattagtgccagtgcttgctgtctgttcatgattgtacaggcagacctgaangttggctttccagggtctaaaggcaagattgtttaactcagtatgagaagcatggctaag

SEQ ID NO: 2752 - DNA, 121 bp, Artificial Sequence
  Synthesized
  misc_feature (61): n=a or g
taactgttttttgctggcttgctgacttcgtcagtgatctgaacaaatgaggtttttgcanctggaaatataggaaggagcaaagagcgcccatttttcctgtaatcattaaaatggcaat

SEQ ID NO: 2753 - DNA, 121 bp, Artificial Sequence
  Synthesized
  misc_feature (61): n=a or c
ggatataagctgaagaagaggttgcagctcaggaaaggcagattgaaggtcctacgcctcngcacaaataaccagcagggcaaaaacaagatgggggacatcagcttagtagcaggtttgt

SEQ ID NO: 2754 - DNA, 121 bp, Artificial Sequence
  Synthesized
  misc_feature (61): n=a or g
ttgtcagagggtgcctttcagattatttaggtggaagatttttatttactatacaaacacntttaccaatacagctagctaatgactcttctgcaatcaatgcttttcactgagttattgc

SEQ ID NO: 2755 - DNA, 121 bp, Artificial Sequence
  Synthesized
  misc_feature (61): n=t or c
gcagggaaggtggttgtctgacttgattgcattatgggcagaattgagactacattgaaancaacagcaaaacaggattctgatggaatcagagccagaatttctctgttatttctgatac

SEQ ID NO: 2756 - DNA, 121 bp, Artificial Sequence
  Synthesized
  misc_feature (61): n=a or g
gtgagaatggcagtaaatcgcagtgtaggtttgcgtgtggcagaacatcagcaacggcatngaacaaagccagaaatgccccctaactttttacaccagagagaaatgcccaaagccaacg

SEQ ID NO: 2757 - DNA, 121 bp, Artificial Sequence
  Synthesized
  misc_feature (61): n=a or c
gcaggtgaagactgtaggaagtttcagtaaaggcttcaattttgcaaagctcatcaccaanaccagccactgctgtaaaagctgtaagaagctgattatttgcaacaccatccaaaacgta

SEQ ID NO: 2758 - DNA, 121 bp, Artificial Sequence
  Synthesized
  misc_feature (61): n=a or g
tttgaaatcaaaagtcagcacagccaaagactgactctcaatatcactgcgcggacctccntgtaagacgaaggcatgcaaagcagccctcgatgtagctgagatgcagctcctgcattct

SEQ ID NO: 2759 - DNA, 121 bp, Artificial Sequence
  Synthesized
  misc_feature (61): n=t or c
gcctcggccctgtatttatactgtgcagccttcctgagagtctgtgggtctgtagcttggnggagtttcccacactctatggccaatcagagagataggcagcacaatagcagaagcatct

SEQ ID NO: 2760 - DNA, 121 bp, Artificial Sequence
  Synthesized
  misc_feature (61): n=t or c
gctgctgaatgttcctgggtgactcaacatgcatgcacaccacatgctagactgtggcacncactgagctacctgcacttgctgcatgcagttactgttcctacagagagacaaggatgat

SEQ ID NO: 2761 - DNA, 121 bp, Artificial Sequence
  Synthesized
  misc_feature (61): n=t or c
acactcctagagcaaggttttataagttgaggactatgtttgaaaatgatttatctctgcntggcctctgtgacagcttctgtagttccttattcactgtgggctctggagcccacgcaag

SEQ ID NO: 2762 - DNA, 121 bp, Artificial Sequence
  Synthesized
  misc_feature (61): n=t or c
ggtcagacaagtattgctggaaatacaggcaggtaacaacttctgatatttagaggtcttnctctaactggtttaatatcagcttgattgttggctgtagaactcttctgtatgctaaacc

SEQ ID NO: 2763 - DNA, 121 bp, Artificial Sequence
  Synthesized
  misc_feature (61): n=a or g
accagggctttgtgacccagaaggggtcaatgggatctatttattaggcagagacctgcancatgctgcattttagcagccatagtgaggagcccatctgaaagagccctggaagctgaaa

SEQ ID NO: 2764 - DNA, 121 bp, Artificial Sequence
  Synthesized
  misc_feature (61): n=t or c
ctgtgctaccccagagcaactctaggttgtctgttgtggcttcttgctggatttgctctcngctgtaaacaagagcagcactctgataagcaggcagcagcacgggaatgtgcagtggcca

SEQ ID NO: 2765 - DNA, 121 bp, Artificial Sequence
  Synthesized
  misc_feature (61): n=a or g
ctggatgggattaaaatctgtttttaccttgcccttaagggagttctgaccaagagacagnagtcacgactgagaagtgtctgattgtagggatctagaatagtttaatcactgggaaagc

SEQ ID NO: 2766 - DNA, 121 bp, Artificial Sequence
  Synthesized
  misc_feature (61): n=t or c
gctcaacatattaaacacccgaacaagggcacaaacatcacgcaggcaaatactgaagcanatgtgtatagacctagagctccaaatcagttgcacatagatccagaaagacacagcaaaa

SEQ ID NO: 2767 - DNA, 121 bp, Artificial Sequence
  Synthesized
  misc_feature (61): n=t or c
gtgctactttcaagaaaaaatactgtatgttaaagtctcttacagtacttttaaggaaaancaggttaagcatgtttattttgaggagggtgttttgtttatgaccacacgtagttgttgt

SEQ ID NO: 2768 - DNA, 121 bp, Artificial Sequence
  Synthesized
  misc_feature (61): n=a or g
tctactacatacttctttaggtgagaggtagactgcggtgtctgagctatgtggaacaaantaggcatcaaaggtagctggtacataaatattgcatcctttgctttcacagagcacagct

SEQ ID NO: 2769 - DNA, 121 bp, Artificial Sequence
  Synthesized
  misc_feature (61): n=t or c
actccccgctttcctttctacgaggctgacgattgcccctccagattttttgctgggatcncaaagttgcgttaagtcccagtccccctctcccactcctagcaacactgctcctgtgttc

SEQ ID NO: 2770 - DNA, 121 bp, Artificial Sequence
  Synthesized
  misc_feature (61): n=t or c
gcactcctcctgaaaggcatctttatcctcaaaagcaaaagcaccacgaccagggtaggtntgcctatgaacaggatgagagaaacgtggcacaggacccgtggcatgtgccagagaacca

SEQ ID NO: 2771 - DNA, 121 bp, Artificial Sequence
  Synthesized
  misc_feature (61): n=a or g
attgagataacttgcacaaggctgtatgtgagctctgtatcacaactggaattcaagcgtntgctccaggtgcactccgcaacatctttccttgtaggctgtgccatgtatctgaaggggc

SEQ ID NO: 2772 - DNA, 121 bp, Artificial Sequence
  Synthesized
  misc_feature (61): n=t or c
ccaattttagacataaattatgctaacatacaatagaaaatgttgttgccctttattttangatcaaattccagcataactcaattcgtaacatagagaagtttcagtgaagaactagaaa

SEQ ID NO: 2773 - DNA, 121 bp, Artificial Sequence
  Synthesized
  misc_feature (61): n=a or g
cgtgcaagcctacaaaatgataattatattggttaataattcctgatctttctgtatacanatatgatgataatctgcgttattactgcctttgtgctacagtctgttttactttgctctt

SEQ ID NO: 2774 - DNA, 121 bp, Artificial Sequence
  Synthesized
  misc_feature (61): n=t or c
ttttctgtactttctgtgtagtttgaggaaatttgcttcttctaactcaattaaatcacangggaatggaatttcactgcattatattttgcatttaatgcaggttactctgaatgtgtat

SEQ ID NO: 2775 - DNA, 121 bp, Artificial Sequence
  Synthesized
  misc_feature (61): n=a or g
gtagattctacatgaaaattgaaaagaagatgaatttcttattagatacatgtatgttatnctggtttctttttcacataataagatttcactgacagtttcttcagtgctgcttatttcc

SEQ ID NO: 2776 - DNA, 121 bp, Artificial Sequence
  Synthesized
  misc_feature (61): n=a or g
taaatttttgatctatcagagaatgtgaaacattactgaagtttatgttcaaatacaaacnacttacctcaaaacagtccccaaagtcgatatgcaggatttttccactcagtctgtctaa

SEQ ID NO: 2777 - DNA, 121 bp, Artificial Sequence
  Synthesized
  misc_feature (61): n=t or c
cctggaatatcattcctgagaacattatctcggcagcaaggcagaaacctttcctccctgnagactgccctgcaatagaccaaacggtggcactgagggtcatggttagcgggtatggtgg

SEQ ID NO: 2778 - DNA, 121 bp, Artificial Sequence
  Synthesized
  misc_feature (61): n=a or g
gtagaattcctaatttccccctggcaatatagtctgggtcactgctgtgatatgcatgttntgatgccatttccagcagagtttatggacccacaacgatcagtgctggtttcacagtgaa

SEQ ID NO: 2779 - DNA, 121 bp, Artificial Sequence
  Synthesized
  misc_feature (61): n=a or c
ctctggaactggagagcccagaactgaagtatggttgcaaagctgagacttcattctctcntgtctatgcccacaccttttctgctttattcagttttcttcaagcttgtctcaaactcag

SEQ ID NO: 2780 - DNA, 121 bp, Artificial Sequence
  Synthesized
  misc_feature (61): n=a or g
ttctcttccactgctgaaacatcccgaaatcacttacttcctttactgggaggtgcaaacnagaatatttcatcattaaaacaacaagttgtggtatattgttgaagccatcactgaaaga

SEQ ID NO: 2781 - DNA, 121 bp, Artificial Sequence
  Synthesized
  misc_feature (61): n=t or c
cattcatgcatcccctgccaaacaagacaaaaaacccaacccaagttcacaaggagcctgnagcagtgtttgcatttatccctgctcccatactaccacttggacttaggatctccttgca

SEQ ID NO: 2782 - DNA, 121 bp, Artificial Sequence
  Synthesized
  misc_feature (61): n=a or c
gagacatagtaacttcagagtaacagcacaatccttagtagacatcacagtagcagaacgnaatgaactaattcaaggaagagaaatagccttaacccagggtaatgaaaagatttgggac

SEQ ID NO: 2783 - DNA, 121 bp, Artificial Sequence
  Synthesized
  misc_feature (61): n=t or c
gatggttgggaagtgtccatcaaagagtggttttcaagaaatactgaacatttcacccagntgtgttcttttcattaaaacatcctattccagtgttccatatgggaaacatgaaagactg

SEQ ID NO: 2784 - DNA, 121 bp, Artificial Sequence
  Synthesized
  misc_feature (61): n=t or c
catgacccaagctggcagcgtgctggctttcaaatcacacaagggtgtctggagacacttntaggaaacatttcactagcttctgggctttgttagtcagtcactctggtgagatcagcct

SEQ ID NO: 2785 - DNA, 121 bp, Artificial Sequence
  Synthesized
  misc_feature (61): n=t or c
acaagtgtgcaatcccaaggcacttaacaccaaagctctggttgtgccttaaactttttgnggctctactcggaggcactacgttacaggcgttagaagttcctagaagcaacgcttccat

SEQ ID NO: 2786 - DNA, 121 bp, Artificial Sequence
  Synthesized
  misc_feature (61): n=a or g
aggaaaatggatttccccttatcagctataagctaaatatttagaataaagatccaataangatccaaaataaagtctgtcctggaaagaacgagttggtaggccactacaaataactgaa

SEQ ID NO: 2787 - DNA, 121 bp, Artificial Sequence
  Synthesized
  misc_feature (61): n=a or g
gcctggtagcaggaacacttgaaatcgtatgcaagtgttatgcagaatgtcaccgtaaganactattgtccaacagttacagacaggaggattaagcatcaacattatttgttctatcaaa

SEQ ID NO: 2788 - DNA, 121 bp, Artificial Sequence
  Synthesized
  misc_feature (61): n=a or t
tgagcaaagataggacaaagccaccttcaaccaccttgggactatgatggaagagcaacancacaggcaccaccacagagctggcactgacagtggaaggaagaaggtgaattatcagatc

SEQ ID NO: 2789 - DNA, 121 bp, Artificial Sequence
  Synthesized
  misc_feature (61): n=a or g
cttcaaatagccctgcactgcctgaatgccaatgcattatgcagagtggcccctttcagcngtctgcataccaggtccttcagacacccaacactgctgaaagattggcgttgtaggaaat

SEQ ID NO: 2790 - DNA, 121 bp, Artificial Sequence
  Synthesized
  misc_feature (61): n=a or g
cagccttattggatccatcgactaccattaaacatacctgcatagcccagcattaagcccnaagccgacatggttcccaaatttctcctgtaatatatgagattaacctgagcagctcagt

SEQ ID NO: 2791 - DNA, 121 bp, Artificial Sequence
  Synthesized
  misc_feature (61): n=a or g
ggctacagccagagccatcattgtccaaagtgctcagagatgcttcagcagcactgactcnatgtgatacgggatgggatgagcatattccacaccatccatcttttctcctaagaacatg

SEQ ID NO: 2792 - DNA, 121 bp, Artificial Sequence
  Synthesized
  misc_feature (61): n=t or c
cttgtctgaaagactgaaccagtgcagaaatcagggtttgctccctcctcacaggaacatnagaaggccttggtgccagatgtgacctcttcatgctccagttgaggctattcctttcttt

SEQ ID NO: 2793 - DNA, 121 bp, Artificial Sequence
  Synthesized
  misc_feature (61): n=a or g
tcctattgcagcttaacatgcaaaaccgtctccagcttttctcaccttccacaaaggagantttcagagctcactctccgagctgagcttcagctctccaaagagctggaaaataggactt

SEQ ID NO: 2794 - DNA, 121 bp, Artificial Sequence
  Synthesized
  misc_feature (61): n=t or c
actgtggtgaggcttctgtgactgtttcattgaaacatctatggctggtgtgtgtcacccnggagcagcctctgtgtcccccccctttgctttgaggccaggtgagaccctagaagtggga

SEQ ID NO: 2795 - DNA, 121 bp, Artificial Sequence
  Synthesized
  misc_feature (61): n=t or g
agcccaggcttggtgtgtgcactgggaagtccttagggaccaagagtcacatggctgatangacacagatggatgtagcccttgtatgaagattgggtttgattgctgcctgctttggagc

SEQ ID NO: 2796 - DNA, 121 bp, Artificial Sequence
  Synthesized
  misc_feature (61): n=t or c
tggcagccccccaagaagccagggatgttccagcagagctccctggaggtttgtgtttgcncagaagggtccttgtccagatggagagggggtggttgatcccgccatgactcactgcccc

SEQ ID NO: 2797 - DNA, 121 bp, Artificial Sequence
  Synthesized
  misc_feature (61): n=a or g
cccatcaccccgcagccccctcccaggacccctcctgggcggctccgcagagggaaaggcnctgagcagatggatcgactactttggctcctttcccctcctttgacatcatcgctggccc

SEQ ID NO: 2798 - DNA, 121 bp, Artificial Sequence
  Synthesized
  misc_feature (61): n=t or c
tctttctccatggattatagagggacagaggataactatcctggatgcaccaccagatgcnttcacagctggagtcaggtgagctgcatttccccagcgtgtgctctgcagcacaggttgg

SEQ ID NO: 2799 - DNA, 121 bp, Artificial Sequence
  Synthesized
  misc_feature (61): n=a or c
tatggaggcacatgagagcacccacaagcaggagagtagcaagatgtcccctcggagcaangatttctcccaatcctctgctggagatgagagcccatctccaggatacctgcatgcctca

SEQ ID NO: 2800 - DNA, 121 bp, Artificial Sequence
  Synthesized
  misc_feature (61): n=a or g
gcagcaaagctgaaaacagtgttgatggataatgaatggaagttggctactgtagttcacngtgttgttttccctctaccagaagttgccatttctgctccttgaagctgttattaagcat

SEQ ID NO: 2801 - DNA, 121 bp, Artificial Sequence
  Synthesized
  misc_feature (61): n=t or c
ttttaccctaaaatggaacaccttccttctgcgacagcattctgccacaatatctttgctnccattaaataatggggtgtgatcattttgcctaatggatccggtgagtggcattcatcag

SEQ ID NO: 2802 - DNA, 121 bp, Artificial Sequence
  Synthesized
  misc_feature (61): n=t or g
ggaaacattatctctcagggcaagttcagaaggacgaatgaagccaaactggcacgggttnagagtctcaatacattattctctctgctctacaaatctgtgagaacaaagtgctcagtgt

SEQ ID NO: 2803 - DNA, 121 bp, Artificial Sequence
  Synthesized
  misc_feature (61): n=a or c
agagtcaccttgctgaatcctgacaccactgtcagtgaatggaaacaaacgttccctgccnaagtgcagtgctgagtgtttggaaggtgctcttgacaaggcagtttcagagggggaaatg

SEQ ID NO: 2804 - DNA, 121 bp, Artificial Sequence
  Synthesized
  misc_feature (61): n=t or c
gtggtgggatttgggggtggcagcagaaggcccttccgcagtctgctcctgcacaaagccnggaatcctgttgtagaagtgctgcaaagcttggcagtctccgctcctgctttctgcccat

SEQ ID NO: 2805 - DNA, 121 bp, Artificial Sequence
  Synthesized
  misc_feature (61): n=a or c
gagcaccattttgttcagcacatcagcttgctgcacctccagagccagctttggagataanggcttgcttccctgctcagcaccgctcagcacagcagcagatgcagtcggtggctgcagc

SEQ ID NO: 2806 - DNA, 121 bp, Artificial Sequence
  Synthesized
  misc_feature (61): n=a or c
ctggaacaagcccttgctgggctcaataaatattctgacaaacaacccacagtgcttttcnaggggaagagaataaaacctgttttgaccaatctccctttgccatgatagatcactgggc

SEQ ID NO: 2807 - DNA, 121 bp, Artificial Sequence
  Synthesized
  misc_feature (61): n=t or c
gagaatctgagccttgaacacacagattatgtcagtctctggcccctctgagtttgatganggttttcactgacttcagtgaattcagggcccacatagtgatgctgactgagactggctt

SEQ ID NO: 2808 - DNA, 121 bp, Artificial Sequence
  Synthesized
  misc_feature (61): n=t or c
aagctgggcataacgctatagaaatgttattacttctgtagagagaggatactggctagcnacagcgtgtgattaaatcacctgcactgtagctagcctagcagcataaagaggggttggc

SEQ ID NO: 2809 - DNA, 121 bp, Artificial Sequence
  Synthesized
  misc_feature (61): n=a or t
catattacaggaaaataggagtgactttctggcactgatgccttctgtaaaacccatcctntaactgcagctttgacagcagcctcctttgtgatggacacagcccttccctggtacacca

SEQ ID NO: 2810 - DNA, 121 bp, Artificial Sequence
  Synthesized
  misc_feature (61): n=a or g
aaagctttcaaatgccttcagcaagaagaagccagggtagcggatctcttggcaataaganataaagaaatacatgtatttgaagtctgcttcagttgaataaaagcagagagcacgactc

SEQ ID NO: 2811 - DNA, 121 bp, Artificial Sequence
  Synthesized
  misc_feature (61): n=t or g
tgtgcagaccgcagcagtgagcacacaggcatttgaaatgtatgaaatgaaaccagccagnagctgtatgcattcagtgtccaaaaataaatacacacggttgtgggaaagtgaaaggata

SEQ ID NO: 2812 - DNA, 121 bp, Artificial Sequence
  Synthesized
  misc_feature (61): n=t or c
accaggactgtttcagatgtcagtgcctacagctgctgtgttgatttttgagggaacaaangtgcctagtgaggcagagaggttaacataactctgtcactgttcagtgctacaaaaagca

SEQ ID NO: 2813 - DNA, 121 bp, Artificial Sequence
  Synthesized
  misc_feature (61): n=a or g
tttcctggtagagcatcattgtggaacgcagaagagagcagggaaggctgtaggtccaacntcctcaggctgctcggccttggaaaccaaatgctcaggtcagggtcacccttgctttgtt

SEQ ID NO: 2814 - DNA, 121 bp, Artificial Sequence
  Synthesized
  misc_feature (61): n=t or c
ctgcctggagctcctcggccacagcagtgatacgggcacgggctgtccgtttgcatgcctncccacagggatgcttgcaggtttgcttctcctgttgcaggaggggcaaaagagtgcctcc

SEQ ID NO: 2815 - DNA, 121 bp, Artificial Sequence
  Synthesized
  misc_feature (61): n=t or g
ggactctccgagtgataaaccacttacttgaaggggctctcatgcaaaatcccacagggangccttaaattggacatttatggcatgatcatagaattcttaaggttggaaaagacctgta

SEQ ID NO: 2816 - DNA, 121 bp, Artificial Sequence
  Synthesized
  misc_feature (61): n=a or c
aaatatataaaaatagtcgggtttctaaaggttgtgtgataccttcctaattaaacggagngtgttttaattacaaatcaaagtcactgccatttgaaaaaacaacccacaggcattttcc

SEQ ID NO: 2817 - DNA, 121 bp, Artificial Sequence
  Synthesized
  misc_feature (61): n=t or c
accagggaaaaaaaaacacccaaccttaactactgcttttacaggtcatgttccaagtccngacatgtaaaactcaggcaaattgagagctgcgtttcccccatagcacctggctcagctc

SEQ ID NO: 2818 - DNA, 121 bp, Artificial Sequence
  Synthesized
  misc_feature (61): n=a or t
ttctctatgtcatgctgtttctagcatttggtcatttaattatgaggcaggctgggagacngaaggttacttctaatggcagtaccttgccctggttgggctgcataagctggagcttgtg

SEQ ID NO: 2819 - DNA, 121 bp, Artificial Sequence
  Synthesized
  misc_feature (61): n=a or g
cttgtgggtattatggcaatgtgaactggaaaacgcacagtattcagcagaaataaaatgngaaaatagttacttcacttgaattttagctaagttacaagacaaagcccttcaatctgga

SEQ ID NO: 2820 - DNA, 121 bp, Artificial Sequence
  Synthesized
  misc_feature (61): n=t or g
gaagccagatagaaattcatagtagctgatcacccatcccaatgtttcagcatagcagtanaggtgaagacagagcctctgttgtttgataactggctgatacagatgaaatcctgcacac

SEQ ID NO: 2821 - DNA, 121 bp, Artificial Sequence
  Synthesized
  misc_feature (61): n=a or g
tgtattgtctttgtgtggttggtatcttcgtcttgacatctttccaagacagctaaagcantgcagagctgacaccttgcctagcatgggattcatggtgtattgttgcactgcaggatag

SEQ ID NO: 2822 - DNA, 121 bp, Artificial Sequence
  Synthesized
  misc_feature (61): n=a or g
cttcgggacgtggatcagtggtggacctgtagtgtcacgtcgtggttggatatggagtgantgctgggtcatggttggatacggagtgctgggtcatggttggacttgcagtgctacatca

SEQ ID NO: 2823 - DNA, 121 bp, Artificial Sequence
  Synthesized
  misc_feature (61): n=t or c
tgggctgggaatctggaggcaatatggtcccaccagactcactcaaccacaacacgtgccngcagatcggatgtgcagcgtgctgcagctaatccacctgcagaaagagaatggtgctgat

SEQ ID NO: 2824 - DNA, 121 bp, Artificial Sequence
  Synthesized
  misc_feature (61): n=a or g
tgcagcagcagctgtatttatttcagccccatcacacacgtggcagggaacgtccccattncaaaggccacaggcacaaacagggaggtgcatggcaacccctctatttctgcccctcctc

SEQ ID NO: 2825 - DNA, 121 bp, Artificial Sequence
  Synthesized
  misc_feature (61): n=a or c
ggaggaaagctgctgtattgtgctggtgggaaactgagggacagctgaagagccttccatngaatgaggtaactgctgcactgtgcagacagagaaagtgcagcttaagaggaatgcaagc

SEQ ID NO: 2826 - DNA, 121 bp, Artificial Sequence
  Synthesized
  misc_feature (61): n=a or g
actcgagctgcccccgaacctcctgcaaaggtctgcctcgagtttcccttggtgtctgtcnctggaagcttgggcaaagccctggtttcgtttgctctctgcagctctgccaaactgctcc

SEQ ID NO: 2827 - DNA, 121 bp, Artificial Sequence
  Synthesized
  misc_feature (61): n=a or g
ctccaaatccactccatctgaactggaggcattggagggttggattcaaactcggccaccncagtcatgctctcagcccactgaaatcagcggtgatttcagcagaagggtatcccactag

SEQ ID NO: 2828 - DNA, 121 bp, Artificial Sequence
  Synthesized
  misc_feature (61): n=a or g
ccactgatcccaacaccaaaccctgcaaggttaactttgcagcctagcagatgctcaaatntcagtttgattttagaggctaaagagcccattagcaagggcagccacaacaggcagccga

SEQ ID NO: 2829 - DNA, 121 bp, Artificial Sequence
  Synthesized
  misc_feature (61): n=t or c
cagggcacgatggatggtgtccacgcacagcgagaatgaaacactgctttattgcctgctnggggtgggtgagaccctgcaggcagctcttttccccctgtgctgccctgctgtcccctcc

SEQ ID NO: 2830 - DNA, 121 bp, Artificial Sequence
  Synthesized
  misc_feature (61): n=t or c
tctgcttttgtatagggagatggggcagcgtgcctcggaaatcacaggatcagaggatggnttgagctggatgggactcttaaagggcatccggtgccgctccctgcagtgcacagagaca

SEQ ID NO: 2831 - DNA, 121 bp, Artificial Sequence
  Synthesized
  misc_feature (61): n=t or c
gcagactggctggaagaaggatctattaaggacagaagctctcactgcacacatttaccancagtgataaatgcaaggccacagtcactgcatttagaagtgaatgacagagcaaccacag

SEQ ID NO: 2832 - DNA, 121 bp, Artificial Sequence
  Synthesized
  misc_feature (61): n=c or g
ttgctttgcttccgtttgtttttaactctattccctgttggtgaggaaaatggatgtccanatatccatcctcagaatggggtgttccttcagcaacctctgacctccctggagaaattca

SEQ ID NO: 2833 - DNA, 121 bp, Artificial Sequence
  Synthesized
  misc_feature (61): n=a or c
caatttcagcacagagctatgaagtttggtataggcttcattctctgggcaagtttctaanactgggcctaaaactggtcccatgccagcggcggtgttaggctccccagtaattactggc

SEQ ID NO: 2834 - DNA, 121 bp, Artificial Sequence
  Synthesized
  misc_feature (61): n=a or g
gagatcgctccagagcacagagcagctcgaggagggctgagtgcatctggcagcttcccangctcaggaggaaatccccgtccgagtccaatgggatccttagtcatcgttggaggaatag

SEQ ID NO: 2835 - DNA, 121 bp, Artificial Sequence
  Synthesized
  misc_feature (61): n=t or c
cttgaagcctgacatgccaggccatctctataaagggaatgaattgacatatcccacctcnaccccatctctcacacgtgtagctgtgtgcctcagcagtgtgccctgcatcgtcagcctc

SEQ ID NO: 2836 - DNA, 121 bp, Artificial Sequence
  Synthesized
  misc_feature (61): n=t or c
atctgctacagcagagacacaaaaaatctaaagtgtacagagagagatgctttaggggaangtcagtgatatgttttgtatccacactttaaacaaagatattcttttacctgctacaaaa

SEQ ID NO: 2837 - DNA, 121 bp, Artificial Sequence
  Synthesized
  misc_feature (61): n=a or t
tcataagaaatataaaacttagtattttcaagcctcaaatttaagagcagtgctttctacngaaagaagtcctttgcgtactaggtctgaattggtttgcaaagtctagactgtaatcagc

SEQ ID NO: 2838 - DNA, 121 bp, Artificial Sequence
  Synthesized
  misc_feature (61): n=a or g
gctcctttagtacgcagcatgcaagaacagagaggcactgcaaccttatttccttacctcncacctgacccactgctgttagccaagaaaacaagctgagttatcacatgtgtgacagata

SEQ ID NO: 2839 - DNA, 121 bp, Artificial Sequence
  Synthesized
  misc_feature (61): n=t or c
acagaagctgggaacctgcgagtccatcctctcttaactgctcgaaagagaggagaaatgntgtggttaaagagcagcactccagcagtctgcctctgccattggacccatccctgcatcc

SEQ ID NO: 2840 - DNA, 121 bp, Artificial Sequence
  Synthesized
  misc_feature (61): n=a or g
ttttaaatgaaaggaaaatgaatccttaaatgacagcaaccagtgtgcacagtgaaactcnatgctgcatccagaggaaaagcagatatccatccctccagagctcgtctgtcacacacca

SEQ ID NO: 2841 - DNA, 121 bp, Artificial Sequence
  Synthesized
  misc_feature (61): n=t or c
atcttccagagctctttgggtgtatccatttggccaatattagcctgcaagaagacatcanggcatcattagaaccttaaaagatggatggcatttcacacttgctaacagtcagattcct

SEQ ID NO: 2842 - DNA, 121 bp, Artificial Sequence
  Synthesized
  misc_feature (61): n=c or g
gagggcaggaccatgtcactccaagactgggatgtgggtggtgggtgttgtgccaggtcanagctgagtcccaccaggacacacctggctgctccctgccctgctgatctcaaaccacctt

SEQ ID NO: 2843 - DNA, 121 bp, Artificial Sequence
  Synthesized
  misc_feature (61): n=c or g
caccgtggtgcagtggctgaggttaccccctgatgttggacagctttgaagaacattatancaaaggatgccaatggcacacagggctgggcagggcgactgcaggctgtgcttaggcgga

SEQ ID NO: 2844 - DNA, 121 bp, Artificial Sequence
  Synthesized
  misc_feature (61): n=t or c
aagtgactgctttgagaactgaagttgccatgccattatcccagcaagccacagctatagntggggaatacagacttgggctcatttcctcctaatattgcccgtgtaggcaattccttcc

SEQ ID NO: 2845 - DNA, 121 bp, Artificial Sequence
  Synthesized
  misc_feature (61): n=t or c
tacgcatagttatttgaatagcttgttgatcacatccatcaatcctaaaacacagactcgngccagaggaatttataacccttttaacatggtctgacacaggaatgcactcaggctgaag

SEQ ID NO: 2846 - DNA, 121 bp, Artificial Sequence
  Synthesized
  misc_feature (61): n=t or c
ttatttatgtgcttggatgtacaccgaatgaaaaagggattgctggccctcagctctgcantgctctcagcagcatgaactgctccgctgcccattgcctcccggaacttctgcacacact

SEQ ID NO: 2847 - DNA, 121 bp, Artificial Sequence
  Synthesized
  misc_feature (61): n=a or g
cgacaaccaagcgtgctgtgcaaccccactgcaggaacgctggcgttcagctgctgttccncttgctctggaattctggtcaacggaaggaagaacaagaagagaacacacaggccctgaa

SEQ ID NO: 2848 - DNA, 121 bp, Artificial Sequence
  Synthesized
  misc_feature (61): n=a or g
ctgctcctcacctccttcagcacccaccgtgttaggctccatacagcacagataaataatncagggcccttgcctgggacagcttgctatttaattcatgcatgctgcagcgaagggtcag

SEQ ID NO: 2849 - DNA, 121 bp, Artificial Sequence
  Synthesized
  misc_feature (61): n=a or g
ctagatttcatcgtcccgtcttaacgttaactctccaagtataggagggtgagatgtctgnaagttaccctgtgctgaagatgcaataagagcaggaaattggttcttctgtttttctgag

SEQ ID NO: 2850 - DNA, 121 bp, Artificial Sequence
  Synthesized
  misc_feature (61): n=t or c
tgcctgaagatttattggcacgggagacatagagatgtcatctacggtatgttaaagctcngggcagatgctctgagggatgtgacttttgacccttcccgtgaccttggacagcctgagt

SEQ ID NO: 2851 - DNA, 121 bp, Artificial Sequence
  Synthesized
  misc_feature (61): n=a or g
tccacacctctactgaacaaacattgctgctgctaattgtgttatcactgccaataaaccnccacaatagcagatgcgtgacttctcatctgctggaaatgagcttggccctggggctggg

SEQ ID NO: 2852 - DNA, 121 bp, Artificial Sequence
  Synthesized
  misc_feature (61): n=a or g
agaattttctgtgaagagaggtggaaatggacaaaccatcatgcaaaccatccgaagtttncctgttttgttagcagcagcttcaggcaagctggagagtttggaagtgaaattcgtattt

SEQ ID NO: 2853 - DNA, 121 bp, Artificial Sequence
  Synthesized
  misc_feature (61): n=t or c
cagagagagacatttctgcaccggttcccctacacgtgaaattgctttgctgatttgttgngtcctttgtggttttaagcacgcaggatttgggctttccatcggttcctttaatgggagg

SEQ ID NO: 2854 - DNA, 121 bp, Artificial Sequence
  Synthesized
  misc_feature (61): n=t or c
ttctgagctttgttacagatatactgatttcactgggcccattcacatacaaaacaactangcaggcagttctttttaaatgctgttcacagataagctgagtaaagagtaacatcagacc

SEQ ID NO: 2855 - DNA, 121 bp, Artificial Sequence
  Synthesized
  misc_feature (61): n=a or g
aggaagcttgaactattaatcattgcatttgagtactgcttctacatttcaaactctaacnccccataggtcttctccctatgactgctgtgaaaaaatctgtgtctcctgcacgtaatgg

SEQ ID NO: 2856 - DNA, 121 bp, Artificial Sequence
  Synthesized
  misc_feature (61): n=c or g
aaggtttttaaattaaaaaaaatggagtttgaggttccacagctaagcacactacaagcangtaaggtaaatcccatcctgtcacagaggcaagaacccaaaacagctttcgcagactaac

SEQ ID NO: 2857 - DNA, 121 bp, Artificial Sequence
  Synthesized
  misc_feature (61): n=a or t
ccaatggtactgccagcagacttgcagtactacaaacagaaactaccacttgtgcaagtcnaccacacaaatcaaagtgcaggtttatggcacgtagcattatcatgatttgaaaatgctg

SEQ ID NO: 2858 - DNA, 121 bp, Artificial Sequence
  Synthesized
  misc_feature (61): n=t or c
aagctgttaaatcagcctattacactgctcataattgagagcgtatcagggttttgttcanggagtattccccaggagggaaaatctcctgccctggtttattcagcactggaaattgcag

SEQ ID NO: 2859 - DNA, 121 bp, Artificial Sequence
  Synthesized
  misc_feature (61): n=t or g
tacgtccatccaaaccctttggcactaatgcagaatgtgccagctagagcatcctgccttnctccagcccatgtaatgctgtgcgtggccctggagtgagcacttttccagcaaagctgct

SEQ ID NO: 2860 - DNA, 121 bp, Artificial Sequence
  Synthesized
  misc_feature (61): n=a or t
tgtgcacaggcacaagggaggggtaaacatttgtaggtgcagagagtgcaaggcagttatncacttttcaaactgctttggatgaactcaagtgctgcttttctgcatgtgcttttttttt

SEQ ID NO: 2861 - DNA, 121 bp, Artificial Sequence
  Synthesized
  misc_feature (61): n=a or g
ttttttctgttctgtctcctgtgtgattcatttattttccaatttaaaagcacatccggtntatttcctcgtgtaatttaaacacgcttcttgacagcgctgttcactccaaaggtccctt

SEQ ID NO: 2862 - DNA, 121 bp, Artificial Sequence
  Synthesized
  misc_feature (61): n=a or g
tgccagctgagcagtggggctggggacatgccatagtgctgcggtgctcaccctctcaccntacttgttcctcttcaccagcatctgctgcagcgtccgtaacactttgatgcacagcttc

SEQ ID NO: 2863 - DNA, 121 bp, Artificial Sequence
  Synthesized
  misc_feature (61): n=a or c
ggtgggggctttttgaaagcagggagaaaacactgaggacatgtaaaaacacctggatggntgtgggaagagggaaagtccaagcacagactagtattgctctctcttaggacctgtcctt

SEQ ID NO: 2864 - DNA, 121 bp, Artificial Sequence
  Synthesized
  misc_feature (61): n=a or g
gcccagcaaacctgcatgtaaggcttaaagcaagatctgccatacccacctttgcaaagtnctgtacaggtacaacgtacttcataaaggtgattttcaaccgaaagaaactagtgaggag

SEQ ID NO: 2865 - DNA, 121 bp, Artificial Sequence
  Synthesized
  misc_feature (61): n=t or c
tattcaaaatgttattggatacaaggcaccaaatctaaggaattatacaaaattagctcantaaattgtattggcaggtaaaactaatctctatctattttctcttccataagtattcctc

SEQ ID NO: 2866 - DNA, 121 bp, Artificial Sequence
  Synthesized
  misc_feature (61): n=a or g
tgaaagcaaaactgagagggctctgtgaatgcattctgagacaatgcaggaaacactgagntaccagcatgtgctgctacaaagtcctgcccctctggatcactgggcccagtgttctgca

SEQ ID NO: 2867 - DNA, 121 bp, Artificial Sequence
  Synthesized
  misc_feature (61): n=t or c
cacaggagccagaagtccagccacaatatgcataagccccatcatcaacaggtgcttttcnccccactaccttaattcagcccctttccttcttaactctcaaagggcccctggcactgct

SEQ ID NO: 2868 - DNA, 121 bp, Artificial Sequence
  Synthesized
  misc_feature (61): n=t or c
gagctccaggatggctttggttgtggtaagcagtgccccatttggagccaaatcctgttcnaggatcccaggcaagaacccagcctgcagggaatgcttgcctttctgctgcagtggggtg

SEQ ID NO: 2869 - DNA, 121 bp, Artificial Sequence
  Synthesized
  misc_feature (61): n=a or g
atcaattggctgatacttccagttttaaatcatttgttctgtgaagctaatttagtgccgncgttcccatgaagaagggctggcagggatgctctcctctgagcaaagccaggactcccag

SEQ ID NO: 2870 - DNA, 121 bp, Artificial Sequence
  Synthesized
  misc_feature (61): n=a or g
atattttgcccaaatgtatatgccctcagtgttgacatctctatctgaacaagcaatctgnaatcccttaatagttaatggagaaaaaccagcactcacaagacacaattcatcacagtga

SEQ ID NO: 2871 - DNA, 121 bp, Artificial Sequence
  Synthesized
  misc_feature (61): n=a or c
gtctatgctgtagagcatgcaaccccccatagtgctgctctgtggctctgagcctttacangaatgcagatgtaggaacccaggcatgctccagctccaggcactcccaatgccacccttg

SEQ ID NO: 2872 - DNA, 121 bp, Artificial Sequence
  Synthesized
  misc_feature (61): n=t or c
agagagatgctgcaggacatccttagtttgagggttggctctcacaagagcacccattggnatcttatggccaggaatggcctcctgttccatccacctcaatacatctcaatggccacct

SEQ ID NO: 2873 - DNA, 121 bp, Artificial Sequence
  Synthesized
  misc_feature (61): n=t or c
tttgtagaaggtaaattcaaaggaaacttatgagactgtagtcttatttcccccataacanagtagttaagtcctgtctgatctttacatttccctgccagacagagaccatgagtttcct

SEQ ID NO: 2874 - DNA, 121 bp, Artificial Sequence
  Synthesized
  misc_feature (61): n=a or g
cagcccagtagacagagggctccatctccttttgaaactgagtgtgatattgatgctgtgnagaacttctgttgacttttgtactaggtgctatacagagcataattgctgcaacaaagat

SEQ ID NO: 2875 - DNA, 121 bp, Artificial Sequence
  Synthesized
  misc_feature (61): n=a or g
ttggagctttgggaagcttgcttcttgcctcaaattggacattcctctgtgcccatcttgnaatcaaccagccagggtgcggcgttgcaccgagggaagcctccagagcgatgttcagcca

SEQ ID NO: 2876 - DNA, 121 bp, Artificial Sequence
  Synthesized
  misc_feature (61): n=a or g
gaggaaacattggctctcagcacaccattgatatatgctatagaattggcacatcattcanttgtctgtctccgttgaggaaagacccagaactaaatgaatgagtgatgggtcctaacga

SEQ ID NO: 2877 - DNA, 121 bp, Artificial Sequence
  Synthesized
  misc_feature (61): n=a or g
ttgaagagccttggagtgccctggtccttgcaggtagtgctggagttattgcaaccatgcncgatgccacattttcaaaggcaagatctctttgtttgctttgtgcttactgcaggcatcc

SEQ ID NO: 2878 - DNA, 121 bp, Artificial Sequence
  Synthesized
  misc_feature (61): n=t or c
tgccccaaggatgctgctgggatccatctgcttccaagcagtgggaactgaagcacagagnagcccatcccttggactacagccatgttttatggcatccattaagcatcacgaagggaat

SEQ ID NO: 2879 - DNA, 121 bp, Artificial Sequence
  Synthesized
  misc_feature (61): n=t or c
gcctctctcacactgtacagcacgaatgggtgctgaacagggagtcagacttaaagactanggtctcattggctcagctttgtatgcaatggagctgaagtcgatttccagaccatcgcaa

SEQ ID NO: 2880 - DNA, 121 bp, Artificial Sequence
  Synthesized
  misc_feature (61): n=t or c
ggtgatgccattattgctgttgtgtatgctgtaggtcattcccagtaagaattccaaatanggctcttcaaaggctgtgtcaggcaactcctgacagagttcatctacttgctgtcttttt

SEQ ID NO: 2881 - DNA, 121 bp, Artificial Sequence
  Synthesized
  misc_feature (61): n=a or g
ggaaaacacattcgggcagccatcagagagctttccccctgagtaatgcagatatccacantacccctttaatgactcccgatcccactgcggcgcttccccaccgcgctcctcctgcacg

SEQ ID NO: 2882 - DNA, 121 bp, Artificial Sequence
  Synthesized
  misc_feature (61): n=c or g
tttttgcagaacgtggtctgtacgcactaataaaatgtgctaaatgagctactccttcacntgttttgccagaataatttcttaggcaagattgggatccagtttgtagatctgaagggct

SEQ ID NO: 2883 - DNA, 121 bp, Artificial Sequence
  Synthesized
  misc_feature (61): n=t or c
tataactgcacaaccaaaggagaaaatgtggcataatttgtatacaaaacagctgttcttnaccctaatttgctgtgtgtgcttgtaatgtgtgtctgaggataccagtataagtgctgtg

SEQ ID NO: 2884 - DNA, 121 bp, Artificial Sequence
  Synthesized
  misc_feature (61): n=a or c
taacaactgatggtgctaaatattagcaagtaattctccagaaatgttagtactaaaaagnatttgttgtggatagaggcaaacaaacccactccagcctgtcactacagaggaagatgca

SEQ ID NO: 2885 - DNA, 121 bp, Artificial Sequence
  Synthesized
  misc_feature (61): n=a or g
gaactgaattatcagtaagcctcacgtcaacatttcattatgttctaggtcagtttccacnatctgtacaggtgagcaaaggctgtgcatgggggcaggacttgtgcaatggggtcttgct

SEQ ID NO: 2886 - DNA, 121 bp, Artificial Sequence
  Synthesized
  misc_feature (61): n=t or g
acgttttgtgtggcagagagcacttaagttgcaggaatactctatcagctggatgactcantcacagcataaaatcttttgactctaaacaagaattcatgagtagtttgaatgtgtagga

SEQ ID NO: 2887 - DNA, 121 bp, Artificial Sequence
  Synthesized
  misc_feature (61): n=a or g
aatccgtccctgaagggcaagtctatggatgtttgcacgagggtcatgacatgacttccanatctcatttgaaagccgtgtctggttgtgcagagcttggcaggctgtcctggaatttccc

SEQ ID NO: 2888 - DNA, 121 bp, Artificial Sequence
  Synthesized
  misc_feature (61): n=a or g
ccttctgcatcatttttactgcccagtccatgcagtacaggtccttctcacagacctgacntacacatgaaatgttagaaatgtgggggtttttttgtgacaaatatgacactaaaaaagc

SEQ ID NO: 2889 - DNA, 121 bp, Artificial Sequence
  Synthesized
  misc_feature (61): n=t or c
ggagataatcatccgttcgagccatgggaagcttcgtggctgagaggaagttattgcagcnaacacagctctgctttatcgtctcaccagcttccttgggcagagcatattggtgagttcc

SEQ ID NO: 2890 - DNA, 121 bp, Artificial Sequence
  Synthesized
  misc_feature (61): n=t or g
gctcaatgaggtatgcatgtctgatttgatagagtaattaaaagacagcttcccaatagcngttgatcatctccccaagatgatgtgcctttgtgacacttgtagcagaaactactatttt

SEQ ID NO: 2891 - DNA, 121 bp, Artificial Sequence
  Synthesized
  misc_feature (61): n=a or g
ccaactcagctaagtccctaaagaggtgcatctcactgcatagagatgcaaaccactgaangcagtcggtgtgtggaaggtgattgttttgtctcatcttccttcagttttttgtttgtag

SEQ ID NO: 2892 - DNA, 121 bp, Artificial Sequence
  Synthesized
  misc_feature (61): n=a or t
ttacttatattctatttattaatctcttcctgcccacatatagcaggctacagaagcagtncgtcttaagcataagattcaaatacctacagactcagtaatatgcataacccaggaatat

SEQ ID NO: 2893 - DNA, 121 bp, Artificial Sequence
  Synthesized
  misc_feature (61): n=a or c
gtctcttttccagaagcacaaggagtaattctttctcaaatattctgtgtcttccaccaantcctgtctctgtgacccttctgctcttatctggggtctgtatatagaccgcactctgctg

SEQ ID NO: 2894 - DNA, 121 bp, Artificial Sequence
  Synthesized
  misc_feature (61): n=t or c
taccctccacgtgaaggagctgcacagccccaccttggctgcagaggagccagctgataangacacaaagacagaacagtcagaagtttctatcgcacagagtgaggaagcagctgggcac

SEQ ID NO: 2895 - DNA, 121 bp, Artificial Sequence
  Synthesized
  misc_feature (61): n=t or c
aagttgttctgggatccccctaaaatcagaaagacacagtgttagctattttcttactggntcttggtattttaacactagactctggttatccccgttgctaacagcaccttcctcctag

SEQ ID NO: 2896 - DNA, 121 bp, Artificial Sequence
  Synthesized
  misc_feature (61): n=t or g
agataagaacgtggtgcaggactgcatcaaaggcctaatggaagtccagggagaagacatntgttgtcttcccttatcaactgatgtcatcactccttcacagaaggccatcaagttggtc

SEQ ID NO: 2897 - DNA, 121 bp, Artificial Sequence
  Synthesized
  misc_feature (61): n=a or g
tgcagtgtgctgctctcagtgtgcaggctgggggtccttccagctgctgcccttagatgtntccatgtagttaccaaataatctatcagaagtcctttcaaggctctcccctttccatcgc

SEQ ID NO: 2898 - DNA, 121 bp, Artificial Sequence
  Synthesized
  misc_feature (61): n=t or c
cagagagaaaagcaagagcacaacctgagcaaatcccctccttgggtataaggatcgctancggagggctgagcagcagacggctcccactgaggtggcaggagagatgtcagcttgtccg

SEQ ID NO: 2899 - DNA, 121 bp, Artificial Sequence
  Synthesized
  misc_feature (61): n=a or t
gtttaaagcagtgatgagattcctttgcgcctgtatcagtctgccaggtttagctgcaganccggggatgaaactcaagggggaaagcctgagagcccgtgtctgtgctgaaatgataaac

SEQ ID NO: 2900 - DNA, 121 bp, Artificial Sequence
  Synthesized
  misc_feature (61): n=a or g
ggggggttcggctccgggtgctcctcgtggcattgagctctcagtgctgctgtgttcatgnaacggctgagaaatctctgcccattgcaccaggcagagagctcggggttttgggagcctc

SEQ ID NO: 2901 - DNA, 121 bp, Artificial Sequence
  Synthesized
  misc_feature (61): n=a or g
catttgatggcttgagatgcagagatgctgtccttccctccatctgaagccatgcagcttnggagatgtacgtaagatctacactagggggtgtcgtagtttcgcttgcaaccaggcaacc

SEQ ID NO: 2902 - DNA, 121 bp, Artificial Sequence
  Synthesized
  misc_feature (61): n=t or c
gcttcatgcatccaggtttaggaaggggtgtgtgtgcgtgcagtggttgtccctgtggcangaggtcctctcctcccctgggttcccagcagtgaaaccaagcacctgaagaggcagcctg

SEQ ID NO: 2903 - DNA, 121 bp, Artificial Sequence
  Synthesized
  misc_feature (61): n=a or g
gtgttcctcacatctcgcctctgaggtccactgtcagccttacctctttctgaaggattcnctaaaagccagtatgacatttgcgtgtcactgcacagcctggcttgtcttggggttctgt

SEQ ID NO: 2904 - DNA, 121 bp, Artificial Sequence
  Synthesized
  misc_feature (61): n=t or c
gtgcagagtgcatggaatcatggtgagatctgtcccatctgaatcataagccctgtcatantgtgggaaataaacatttggagaaacctccgttgcctgggaaaccctctgctcattgtgg

SEQ ID NO: 2905 - DNA, 121 bp, Artificial Sequence
  Synthesized
  misc_feature (61): n=t or c
cttgctctgactgctcggtgttcagcaaggctgctgagctggggtttgaatctccatgctnctacttaagcatctaaatgacaggcattgactttaggaagcagaagtttagggggtggcc

SEQ ID NO: 2906 - DNA, 121 bp, Artificial Sequence
  Synthesized
  misc_feature (61): n=t or g
gtggttgctgtggggttggggctgtggcttcagggctcgcaggacataaggagcaggttgntctccaacaggaataatgctgatgtggctctgccctcgtcccctgcttccatccccttct

SEQ ID NO: 2907 - DNA, 121 bp, Artificial Sequence
  Synthesized
  misc_feature (61): n=t or c
gaatccctgcaacagaagaggcagcagctcacacctcatgcagcccagtgcttcctgaagngctcactgcttcctctctcctgccagcactgcacggtgacacgcagcaaggagcctgctt

SEQ ID NO: 2908 - DNA, 121 bp, Artificial Sequence
  Synthesized
  misc_feature (61): n=a or c
ggaagggacccttaaaggataactgagtccaactcctggggctgctccaggaaaggaatgnaccacttcttcctggggaggtcagtttgcagactgtaactgttctgctgaatttttcaaa

SEQ ID NO: 2909 - DNA, 121 bp, Artificial Sequence
  Synthesized
  misc_feature (61): n=t or c
gtccaatgcctggccacaaaactgaacagaactgaaggaattggaccgttaaaaagcagcngaaggtagaagatttgccaggctctgtaggagggtgttgggatttcagatgtctgatagt

SEQ ID NO: 2910 - DNA, 121 bp, Artificial Sequence
  Synthesized
  misc_feature (61): n=t or c
tttttaactgatactggagaataagtctgaaagaagttactgctactcagttccatctacntcaagccaggttaaatatggaactgacacaaaatttcagcatccaggtaaacctctagga

SEQ ID NO: 2911 - DNA, 121 bp, Artificial Sequence
  Synthesized
  misc_feature (61): n=t or c
tttaacatatttttcctggtgtgacgtccaaccaaatgacagccaccaaacagaggcaccngctcctaagatggcatcaaaatcaagatggctgcagctgtgtgtgtggggaaacgccttc

SEQ ID NO: 2912 - DNA, 121 bp, Artificial Sequence
  Synthesized
  misc_feature (61): n=a or t
ctggtccatattcacttagtatctctggcaatagtgggagagtgtacatcttagtttattnctttcttctcttgcacttgtataatttttttgtatttcaatcaaagtgtctaattttcct

SEQ ID NO: 2913 - DNA, 121 bp, Artificial Sequence
  Synthesized
  misc_feature (61): n=a or g
cctgtatttttaaaatcagtgttataaattcttgtttgagactgcatatgctgtttagccnctaatgtttggaatttcagctgctctgattgctcccaaaaagacttccttatcattgata

SEQ ID NO: 2914 - DNA, 121 bp, Artificial Sequence
  Synthesized
  misc_feature (61): n=a or g
tcatttactgatgcagacctagcaaaaatatgaagtaaactgtgttctcattaacttgctngaggaaaagaaagaaaattactccatagtttgtccacaattaatcttcttattcacatat

SEQ ID NO: 2915 - DNA, 121 bp, Artificial Sequence
  Synthesized
  misc_feature (61): n=c or g
tcacagtagaaatctcttttatccaagatagctgagaagtttaaatggattttgaaatttntccctatatgtcagttcagtcacagctatgacttctgctatgctttagaataaaacgtgc

SEQ ID NO: 2916 - DNA, 121 bp, Artificial Sequence
  Synthesized
  misc_feature (61): n=a or g
atacaactgaatcatactacagcaaggagttatgctcatgttactctgggatgtaaactgnagcaagcagagctcagaatgtcacgggattgagcagaggtactgccctaaaatcacagga

SEQ ID NO: 2917 - DNA, 121 bp, Artificial Sequence
  Synthesized
  misc_feature (61): n=a or g
attcctttcttgatgtagaggacaacactttatcttctccgtccttgcctgttcttactgnacagcttatagacatcaatagccacatttcaatcatgggaatcatcccagaaggttttgg

SEQ ID NO: 2918 - DNA, 121 bp, Artificial Sequence
  Synthesized
  misc_feature (61): n=t or c
cttcagctcaaaagtctcccagcactgaacaagaaagcagcagtgattttttacagtgatncaatccgactgcaaacatttccatcgcgtctaccagatctaacagctacatctgcttttc

SEQ ID NO: 2919 - DNA, 121 bp, Artificial Sequence
  Synthesized
  misc_feature (61): n=a or g
ctccccaccctgactgggctatccattgcagtcaggtgccccatcactgcacaatttggancattcagttgctaataaaaaagctttttgaggcaaaacattcaagcacggtgacaaaaag

SEQ ID NO: 2920 - DNA, 121 bp, Artificial Sequence
  Synthesized
  misc_feature (61): n=t or c
atccaagcgaatcccagagtgatccaagtgaatcccagacacgctgagcacctgttgctgnctgtccctgaggatgcatgggatgcacagctccactggctccggacatgggacaggccca

SEQ ID NO: 2921 - DNA, 121 bp, Artificial Sequence
  Synthesized
  misc_feature (61): n=t or g
agggtcccacaaggatcatcattcacctcttcagaaatctttcagtatagtaacaacagtnatcatcttgtcacaattgcctcaattttgctactcaggctgctgcaatttcaaaattgtt

SEQ ID NO: 2922 - DNA, 121 bp, Artificial Sequence
  Synthesized
  misc_feature (61): n=c or g
ggtaacttgaagttagatttgtcactgtttttctgtctcagctgttgttgtaatagaaaangggatttcttgccctttcttttatagacttcaatctctgcatattgtggctctgattcct

SEQ ID NO: 2923 - DNA, 121 bp, Artificial Sequence
  Synthesized
  misc_feature (61): n=t or c
agctcaactaattctcctcccatcgaaccaagatgcactcactgtgcttctgtgctgcagnctggtgaaacttgaagaccttcattctctattcctcaaagagtcatcaaaagcaaaaatc

SEQ ID NO: 2924 - DNA, 121 bp, Artificial Sequence
  Synthesized
  misc_feature (61): n=t or c
aggtaattgtaatgacactgcagaaaacataacacgaatttttggccgtaaactaaacacnagcacagaagcttggctcttaatagatcctgctgcaagcataactttccccaccttctca

SEQ ID NO: 2925 - DNA, 121 bp, Artificial Sequence
  Synthesized
  misc_feature (61): n=a or g
ttgaagaaacactgaatctttatgaggttgccaaagcattctttcagcttttaaaaaaggnagttggctttagtaacttctgctgcaaaatgatgaacttccaaggagtgcacgctgctct

SEQ ID NO: 2926 - DNA, 121 bp, Artificial Sequence
  Synthesized
  misc_feature (61): n=a or g
gctgttttggattgattcagaagcttctgaatcaaacaccaccacagtaatctaaactagntattgactgatttatttcaacattcttttaccttgaaacatattatggcaggttttatcc

SEQ ID NO: 2927 - DNA, 121 bp, Artificial Sequence
  Synthesized
  misc_feature (61): n=t or c
accttctttctgccttttgtgcattttatggccggaaaagagtcagagccactcacacctngccactgggaacctttgctagacaaaaaccatttgctctgccagcagcatccccccatct

SEQ ID NO: 2928 - DNA, 121 bp, Artificial Sequence
  Synthesized
  misc_feature (61): n=c or g
tcttttcacttttagttgcctgacaagaagagtctttgagcttgaatacccagacctgatntgagagcagcatttcaaatacttctctccttctttaagatctctgtctttctgcgatggt

SEQ ID NO: 2929 - DNA, 121 bp, Artificial Sequence
  Synthesized
  misc_feature (61): n=a or g
gaatgagtgatgtgatacctgacatttttatattaagattaatgacctaagccaacagacntataatgtccttcccatacatgtatttatttgttgctttcactttaaatacaaaatatct

SEQ ID NO: 2930 - DNA, 121 bp, Artificial Sequence
  Synthesized
  misc_feature (61): n=t or c
gaaaagttctaggagaatagtactaatattaattaggaagagtgattgaaaagcaagcagngacttctgtaactttcctaacagaaactgggacctgaggtggttgctttttttctttttc

SEQ ID NO: 2931 - DNA, 121 bp, Artificial Sequence
  Synthesized
  misc_feature (61): n=c or g
tgctgcgttcagaccctcaccacagggatgagcacacagcaagtgagctactgaccctgtnccaggctgctgctccttctcaaagatgcaacgatggaccatgtgctcctcctttttctgc

SEQ ID NO: 2932 - DNA, 121 bp, Artificial Sequence
  Synthesized
  misc_feature (61): n=t or c
ctgctacttgcccaagctgaacggtggcatcactgacatcacatataaagtcagtctccanctatttgacaatgttctttaagtcctgggaggcttcctgctggctcagggagtgtctgtg

SEQ ID NO: 2933 - DNA, 121 bp, Artificial Sequence
  Synthesized
  misc_feature (61): n=a or g
tagcaacagggtaaattttcacagctgactctccctcttgtaggattttctttggcatggnctgacacatccttggttttcttgtcacttgaagatttggccatattttacagtaactcct

SEQ ID NO: 2934 - DNA, 121 bp, Artificial Sequence
  Synthesized
  misc_feature (61): n=t or c
ttcaagttttgccttagaaagtacacagacaatgagctatttaaacctgctttggtgtatngtaattacattgcgctttttgctgccgtgtctttgttaggctctctattactctgcaaaa

SEQ ID NO: 2935 - DNA, 121 bp, Artificial Sequence
  Synthesized
  misc_feature (61): n=t or c
cccagctctagcagctcacagagctggatttctcagcacgatgaagcaagagggagtaccntctggccactgtaaatacagcttttcccaaaagcaaatgctgctgaatacgtcctatcta

SEQ ID NO: 2936 - DNA, 121 bp, Artificial Sequence
  Synthesized
  misc_feature (61): n=a or g
gtgagtactaccttacctcccaggttggctttagagctatgggcccacggtcctcagtttnggattcttgctttcttggagctaaccgatttagtttctttctcaatgcttccctaggatc

SEQ ID NO: 2937 - DNA, 121 bp, Artificial Sequence
  Synthesized
  misc_feature (61): n=a or t
accggcagttcgcacacggggcagggatcgctgagatgagacaacccccttcagcctgtgnacgcgggacagagataggctcggaacccgtctttttagtgggaattgatttatcttggcc

SEQ ID NO: 2938 - DNA, 121 bp, Artificial Sequence
  Synthesized
  misc_feature (61): n=t or c
tttgcaaaatcagggcttaggtatgcctctgtttaacgaagtgtaatttgacttggaaaangctttctcatgctctgttgacgccacattacaaactagttaccaaccagttagaaacact

SEQ ID NO: 2939 - DNA, 121 bp, Artificial Sequence
  Synthesized
  misc_feature (61): n=a or g
aaactttaatgcaaaaaaaattcaaaatgggacctccgagctgtttctagcagctccaacnctgttagtgtgccaaagcacatttgcagtgctgagagtgtcttgcctgattcaactctaa

SEQ ID NO: 2940 - DNA, 121 bp, Artificial Sequence
  Synthesized
  misc_feature (61): n=a or c
aagccctcgtagatcatgactaaaggacgtgttctttccttgaacattaagtgtggcaatncactctactaggactcaggactgatatttctctcctgcccagatgaacagatgccttgag

SEQ ID NO: 2941 - DNA, 121 bp, Artificial Sequence
  Synthesized
  misc_feature (61): n=t or c
aatgtaattcgctgtaggtctctgcttggttaagaacgttgcgtgcacgtagaagtaatcnggatggtaacacatagcaggatttgttttcaggaaagttcatccataactggccgtaata

SEQ ID NO: 2942 - DNA, 121 bp, Artificial Sequence
  Synthesized
  misc_feature (61): n=c or g
caagcaggcataagcccaaatgactaatggcacctttaatgcttgcaaacttttgctcaanatgtgtgaagttttcatgtttgagtgttgctgaaagataaacgaggagcaaagtgcacgt

SEQ ID NO: 2943 - DNA, 121 bp, Artificial Sequence
  Synthesized
  misc_feature (61): n=a or t
ttatgaagcattatgttgaaacaatcttcacatcttaggggatttttctatattggtggcngaaatttactggccaaattcctgtatgaatttgcaaggtggaccttttgatcccaaattg

SEQ ID NO: 2944 - DNA, 121 bp, Artificial Sequence
  Synthesized
  misc_feature (61): n=t or c
ctttttaaaatattgatgacaagcaagttcaatcagctccagcccaccaaatatcttttgntgcgcaacaaaaatgattatcatggctgcaaaataccatcgtgcaaagctgtaaaggtac

SEQ ID NO: 2945 - DNA, 121 bp, Artificial Sequence
  Synthesized
  misc_feature (61): n=a or g
ttcatagaggaaaacagaatgcactgaataaatttacttgcgtattttcacctaagggctntgtttgatctgctcttttgcaacaaccacactggacttagcagttcagtgcatctcttgc

SEQ ID NO: 2946 - DNA, 121 bp, Artificial Sequence
  Synthesized
  misc_feature (61): n=a or t
gcaagaaattggaatgaatcatttccccttttgtttacagattattgaggaattaacagcntatcaggtattgtttctgtcagaccaatggaaaggttccccttgttgattttcctgatgc

SEQ ID NO: 2947 - DNA, 121 bp, Artificial Sequence
  Synthesized
  misc_feature (61): n=a or c
gatgctatcttcttttttgaaagctgaaatagagaaattgacagttgaataaaaccaaacnaccaccacactaatagctatcattctgtataatttaaattggctggtaatattaatgata

SEQ ID NO: 2948 - DNA, 121 bp, Artificial Sequence
  Synthesized
  misc_feature (61): n=a or g
tctatgatttattctgaaaattcactgttacatctgaaaacagttactgtgctgctgcatncattctacccttctggacaaacattttaaccagtttctctatttccctttctgaagtcaa

SEQ ID NO: 2949 - DNA, 121 bp, Artificial Sequence
  Synthesized
  misc_feature (61): n=t or c
gtttgaagtactccctcttaaaaaaaaaaaaaaatcaacaacagttttttaaagctactantacgatattaagtgaagagtgaaaagtcagaaaatgataccaagtgcaaagtcaactacc

SEQ ID NO: 2950 - DNA, 121 bp, Artificial Sequence
  Synthesized
  misc_feature (61): n=a or g
ttcccttccagcgtgggacattccatggttagcaaagtgtctttctcattagagtgtacantaggcactaatggcgtgtgggctcaaacgtgctggaggatgtcagtgaaacaggaggtag

SEQ ID NO: 2951 - DNA, 121 bp, Artificial Sequence
  Synthesized
  misc_feature (61): n=a or c
ttcgttgctatacctgaataattctgtctataggtattttctgtgacatgaatgacactgngaagtgaaaatgagttttctcatccccctcatctcagagaaattgaatatcgtgtaccaa

SEQ ID NO: 2952 - DNA, 121 bp, Artificial Sequence
  Synthesized
  misc_feature (61): n=t or c
ttaagtacagattctatttgtagaataacaaaagcaagatagaactggtctgtgctccttngcttgcctcctttctcttctgtcttcactgagcactttaaatgggtgtaggtttgatgtt

SEQ ID NO: 2953 - DNA, 121 bp, Artificial Sequence
  Synthesized
  misc_feature (61): n=a or g
tttgagcttttaagtgttgagcttatccttggttcttgccaggactttaacagggagttanaattgtttcatgtatgatttatgccttttccatatccctctgtacaaatctagagggaga

SEQ ID NO: 2954 - DNA, 121 bp, Artificial Sequence
  Synthesized
  misc_feature (61): n=a or g
agaacaccggaagcctgctgtaattacagaaacctaggagttaggcaaaatacaaagccangacagcatgaggacaggcctttcccctcctttaaggaatgttagaacagcaccttagaat

SEQ ID NO: 2955 - DNA, 121 bp, Artificial Sequence
  Synthesized
  misc_feature (61): n=c or g
gtcgtggtataatggcctgtgagcagactctgggtgaaatgctgtgagagtgggtttagtntttagttctgtgcagagtttctgttacttggcctggagagagggatcgcctttggggttg

SEQ ID NO: 2956 - DNA, 121 bp, Artificial Sequence
  Synthesized
  misc_feature (61): n=a or g
aggcttctcctgaggaaagggagattcagtgaggaggacagaaataaattatctttcgacngagttaaggaggcaagcaaagactaatgagtggctgatggctggctcattagcagatgtc

SEQ ID NO: 2957 - DNA, 121 bp, Artificial Sequence
  Synthesized
  misc_feature (61): n=t or c
attgcaccagaccacataggcattgctgccatggaccgtaacctcatggtaagagagcaanccctatgcaaaactcctgtgccaggaaagctgcacaagggcctcaaggggatgaggtgtg

SEQ ID NO: 2958 - DNA, 121 bp, Artificial Sequence
  Synthesized
  misc_feature (61): n=t or c
agaacacagcaaacattaatgaaaggaagacaaaaagagtttaactatgcaaaaggtctcnccaaaaaggctgtgtcatcaataatgaaagtgaggcatattgcagaatattaagtttact

SEQ ID NO: 2959 - DNA, 121 bp, Artificial Sequence
  Synthesized
  misc_feature (61): n=t or g
ttagtggacttgaagtagcattgcagaagttctgttactgacttgagtaagaacagagtanactgtatatactcaaactcaaaaattaaaaaaagcctgtaacaactgattaagcactctt

SEQ ID NO: 2960 - DNA, 121 bp, Artificial Sequence
  Synthesized
  misc_feature (61): n=t or g
tgttggaaaagcatctgaaactcttgctagttttggctttagaatccctatctattcattnaaaaattgtgtttaggaatagtcaccaccaaaataaactgtagaattaacaagtaacaaa

SEQ ID NO: 2961 - DNA, 121 bp, Artificial Sequence
  Synthesized
  misc_feature (61): n=a or g
aaaaaatgagccagctttttcatcagatatcaaagatacctgctgaataggggctactgtncaaagaggcgatagggagaaagaagaaatcagagcctcaccttaacacggctggatggtg

SEQ ID NO: 2962 - DNA, 121 bp, Artificial Sequence
  Synthesized
  misc_feature (61): n=a or g
ctcattcaattagagtttatatattaatgaacagactccctattggtaagaagttctcttntttgggtactgcataaagggcaggaattttcagataagcattggctcatgttccacagaa

SEQ ID NO: 2963 - DNA, 121 bp, Artificial Sequence
  Synthesized
  misc_feature (61): n=t or c
cagttcagcatcccttcacttgctgccttttggcttcaggtaagagacaaaagtctatctnggctaaagaggctttaacagtttttagtaacttagaatcttaaaaaatcaagagcagtgc

SEQ ID NO: 2964 - DNA, 121 bp, Artificial Sequence
  Synthesized
  misc_feature (61): n=a or g
gttgtttttagcctggatttttatgagatgccaatctgattttttatgagatgccaatttngatgtcttagtgggaccccagcaaaatgagaaccactcagggcagcagtagaatttttct

SEQ ID NO: 2965 - DNA, 121 bp, Artificial Sequence
  Synthesized
  misc_feature (61): n=t or c
gcacgggctgctgcagctgccaacccctctgaaatagcagcagcagggaaagctaagaacncttttctataagaaagcaatgaagaagactcaagtcttaacaaatgaaagttctccagcc

SEQ ID NO: 2966 - DNA, 121 bp, Artificial Sequence
  Synthesized
  misc_feature (61): n=a or t
ctgagcattaccttctgttccctcactaatgcatatggttgtccacatttagaaatacttnttagttcttgaattttagttacttgaagttagacccccgaaggatttaagcaccactgaa

SEQ ID NO: 2967 - DNA, 121 bp, Artificial Sequence
  Synthesized
  misc_feature (61): n=a or t
tgactgtagtggtcatttgtgctgtttatataactgaagtcctgctgtccacatcactgcntggagtaattgctggagatacagcacatccttctagcctcttcatttccctactgcttga

SEQ ID NO: 2968 - DNA, 121 bp, Artificial Sequence
  Synthesized
  misc_feature (61): n=a or g
tgaaaaggtgagtaaattaaactgcagggaaacaattcacatcctgaaagtgttgtgttgnaataaactagaggcacttccttagtaaagacaatgaacattctttaaatagcactaagta

SEQ ID NO: 2969 - DNA, 121 bp, Artificial Sequence
  Synthesized
  misc_feature (61): n=a or g
agagatgggcaatccatcagagtttgtgtttgatggcattttccactacagcatagattcnagccggtaagtttgtgaggtctatctgttttgcaatccaaagcagtaagactaaggcaaa

SEQ ID NO: 2970 - DNA, 121 bp, Artificial Sequence
  Synthesized
  misc_feature (61): n=t or c
cgtctcaaaccaagaatacagacaggcttttcacaggtgtgagccatatcaggtgaactangatccatttcaagaccctatgcaccattttttgcaatggctgtctcccagctgcccgcta

SEQ ID NO: 2971 - DNA, 121 bp, Artificial Sequence
  Synthesized
  misc_feature (61): n=c or g
aagtgatctattatgataaaaagctgtgggagctggatgtttttaggcgacaacctaatgnaaacacaggagcagaactggagactgtatcagtaaattgcttggaaaaaggcgggaaggg

SEQ ID NO: 2972 - DNA, 121 bp, Artificial Sequence
  Synthesized
  misc_feature (61): n=c or g
gtctgccactttgttacctgcttcactttcggtgttcagctcttagccggaaagtagaaantttaacacggtctttctgcttaatagctaaaaggtgcttcaatgaatctcctgttttcag

SEQ ID NO: 2973 - DNA, 121 bp, Artificial Sequence
  Synthesized
  misc_feature (61): n=t or g
ttagattggtggttatgcgtaagtggtactttttccacttaacctctttgaaaaaatacanaattctcttcatagtctacaaggtatgaaattctacacattttctggaagcacaaatcct

SEQ ID NO: 2974 - DNA, 121 bp, Artificial Sequence
  Synthesized
  misc_feature (61): n=a or c
ttttatgagtctatttgaaccatctaacttaaaaggatttatgtatgagctgtacaaggantacattacaatgataacaaaattactatctaaaacacaatctctgcttggagttagtcta

SEQ ID NO: 2975 - DNA, 121 bp, Artificial Sequence
  Synthesized
  misc_feature (61): n=a or g
ggaacaaaggttctagatattaacgtatgaaaagagatccatattttcctacagagatganttaggcaacacttctgtctgaatcagcaaatcatctttttgtttgtttgtttttttaatt

SEQ ID NO: 2976 - DNA, 121 bp, Artificial Sequence
  Synthesized
  misc_feature (61): n=t or c
caggaagctgtggagagattttcccactgctggaatcagaactctaagtgtaggagctttntaaatgtaaagtactgagaaggtagaagttgggtgaagatgtaatctcaaaccaatttta

SEQ ID NO: 2977 - DNA, 121 bp, Artificial Sequence
  Synthesized
  misc_feature (61): n=a or g
tgtcttctctaagccactcttgttgtttttttttttttaacataacaagatttgatgaaantcattctgcacaacaaagcactcatccctttaacaaagattccctctgatctcaagctgc

SEQ ID NO: 2978 - DNA, 121 bp, Artificial Sequence
  Synthesized
  misc_feature (61): n=a or g
tacttgttttgcctttgcctaagagatggagccctctagttataactcttctctctttgtntatgtacctgtagattgtgatcaagttaacttttgaccttgtctttgataagttaaatcc

SEQ ID NO: 2979 - DNA, 121 bp, Artificial Sequence
  Synthesized
  misc_feature (61): n=a or c
ccctggaacgagtgctgtcgcacatttaacgacactgtggtcgtttcttacctttaaaacnagttgagattaacacgattattatttttaacttaacaaaaaattcattatctacactgtc

SEQ ID NO: 2980 - DNA, 121 bp, Artificial Sequence
  Synthesized
  misc_feature (61): n=t or c
atttactaagcagatcaagaatcagctttgaagaagctgatgaaagaagttcagaccttantggaagttcagacccaaatcttaagttcatcagaggctaggagagatccagagatgcaca

SEQ ID NO: 2981 - DNA, 121 bp, Artificial Sequence
  Synthesized
  misc_feature (61): n=t or c
aaacagcagcatttttgtacctgatagttaaaatagaaggtttgcacttcagagaaagcanctagcactagaaacactgtttaaatgcataatcgagacactgctaccataacagagaaaa

SEQ ID NO: 2982 - DNA, 121 bp, Artificial Sequence
  Synthesized
  misc_feature (61): n=t or c
attctactgttttttcccatttatctccccccattccactgggaagaggatgagtgagtgngtggctgctgctgggttaaatcacagcacacgttactgtccagactggggctaatggaca

SEQ ID NO: 2983 - DNA, 121 bp, Artificial Sequence
  Synthesized
  misc_feature (61): n=c or g
gtgtttgaaaaggctttttcttcgagatttttggaatgtaattgctcactactcaccactnctgatgtgtaacagctcctggtttctaccagagagatgtgcgttttgcaagtaagcaaaa

SEQ ID NO: 2984 - DNA, 121 bp, Artificial Sequence
  Synthesized
  misc_feature (61): n=a or c
gtgttgccaccctctgatactaggaaagatagccaatatgttttccctgggaagaatgttntctcttacacagaatgcaataggactgagcacagaaatatggtgtagagtgcactccacc

SEQ ID NO: 2985 - DNA, 121 bp, Artificial Sequence
  Synthesized
  misc_feature (61): n=a or c
agcaaatgtagttctctcatcctctctgggaggtggccatttccagtctcttgagtttaancacaagttaagtcacagaaacgttagcaggcaattttgtgggaaaacctgaatgatatat

SEQ ID NO: 2986 - DNA, 121 bp, Artificial Sequence
  Synthesized
  misc_feature (61): n=a or c
gtgccaatctgctgaactgtttttatagcattctcattcttctgtgctaaagaagcaaaanatgaccaaggtgactgatggtggcagtgtcagaggggagagatgaacacagatgctctgc

SEQ ID NO: 2987 - DNA, 121 bp, Artificial Sequence
  Synthesized
  misc_feature (61): n=a or g
tttattctaagactgatatgagatccgtggcttcaaaggatgagcatggtatactcagganctcagtgagtgttttcctctctagttactctgctatatattaaaactcagcaatattgtt

SEQ ID NO: 2988 - DNA, 121 bp, Artificial Sequence
  Synthesized
  misc_feature (61): n=a or c
aacattttaaattgccttcatgtctgaaagcagatttctacagaaagcaaggagctccaanagcagcctgcagagctgagcttgaaatgagtgttatatatgctgtgccttacagcacagc

SEQ ID NO: 2989 - DNA, 121 bp, Artificial Sequence
  Synthesized
  misc_feature (61): n=t or c
agtatgcagcaagccgatctacagatgctcatttagagttgtgttggctaagtgaggatgngctttggcaggggaactttggtcagctgacagtgactcctagaatactctaaagtgaacc

SEQ ID NO: 2990 - DNA, 121 bp, Artificial Sequence
  Synthesized
  misc_feature (61): n=a or g
gtaggccttgctgtaccagcagaagtacaaactacttgctgtttatatagtggtactcacntactacgttttctgtctttttctgacttggctttcctttgttcttaaaacatttgcatag

SEQ ID NO: 2991 - DNA, 121 bp, Artificial Sequence
  Synthesized
  misc_feature (61): n=t or g
atatttacagagagggattagactgttataatgtttctagggaacaaaatagctttgtgtnagagggaaaccaagttacatcatgttatacattagaaatgtccaggaaatttctacacat

SEQ ID NO: 2992 - DNA, 121 bp, Artificial Sequence
  Synthesized
  misc_feature (61): n=a or g
gagcaaaccagaaccaacatagaggtgataatttctaataagtggaagaaatgctaatctnaactccctttgggaaggcaccaaaatctgggacttcccaattaaaagtaatcaggctact

SEQ ID NO: 2993 - DNA, 121 bp, Artificial Sequence
  Synthesized
  misc_feature (61): n=a or g
agtggcagtgcagtccgggacaaaagaacttcacaatggtattctggaaaagtgaggtgtncttatgggggaaaattcagttgccataaggaaagtaagaagaaatcagatactacttttc

SEQ ID NO: 2994 - DNA, 121 bp, Artificial Sequence
  Synthesized
  misc_feature (61): n=a or c
agtatcatatggctatgtttttctaatttaatacttagaggttacacaacagtctgcaganggcatgattagctgtattgatcaataagtagcaaaatgtaaaactaacatcataatatgt

SEQ ID NO: 2995 - DNA, 121 bp, Artificial Sequence
  Synthesized
  misc_feature (61): n=a or g
ttaaacttaccaaggttcatctgtaggctcccagcataccaaacatacactacatgtaaancacatggctctgtcatctcctgatgaagcaggctataaatataaaaagaaacaactgaaa

SEQ ID NO: 2996 - DNA, 121 bp, Artificial Sequence
  Synthesized
  misc_feature (61): n=t or c
acgttaaagttcaggcccaagtttatttgggaaaggcacctttctatcacacacgtgcacnaaaaccttcagacaaatgcccccctgtaagcgccgtactggtggggctgtgttatactta

SEQ ID NO: 2997 - DNA, 121 bp, Artificial Sequence
  Synthesized
  misc_feature (61): n=t or g
agccacctaaaagctataaattaattattggactggtggctatacttttccctgtgcacgnaaatggagtatcagtaactatggtgctctatattatatcataatcatatactatttcata

SEQ ID NO: 2998 - DNA, 121 bp, Artificial Sequence
  Synthesized
  misc_feature (61): n=t or c
tcatttttgttttcatttgttgtctgacttgattagatagctggattatcctctgttgcangtatatgcagtgtatggcaagtcagtcctaaataaatacatagtaaaattaattcaatga

SEQ ID NO: 2999 - DNA, 121 bp, Artificial Sequence
  Synthesized
  misc_feature (61): n=t or c
acacaactgaacaataaatgaataaattgctagtaataccctgttcttactcaatactatncacccatagatttcaaagctcttcccaaagcaggctggcattattatacatactttcctg

SEQ ID NO: 3000 - DNA, 121 bp, Artificial Sequence
  Synthesized
  misc_feature (61): n=t or g
ataatagttatttcaacagagtgttcaaattcccccttcagaatacagaaatctaaacttngagttgcagagtgaaatgcagcttcaaaatttcatattcccattttccattttagcagtt

SEQ ID NO: 3001 - DNA, 121 bp, Artificial Sequence
  Synthesized
  misc_feature (61): n=a or g
gaaccagtaattaaatgcagatttttcttgagccaggaggcagtgagctttgcctcttgcngttgcttagccttcgtggcctaacatttcatacataggtttgcagggcctgcccttccta

SEQ ID NO: 3002 - DNA, 121 bp, Artificial Sequence
  Synthesized
  misc_feature (61): n=a or g
gatcctgaccttgagaagctgacaatgagtcgtcacaggttgactaactcccaagccacantttttttcttatcatccttgccattagcaggagcccaacatctgatataggaaacaataa

SEQ ID NO: 3003 - DNA, 121 bp, Artificial Sequence
  Synthesized
  misc_feature (61): n=t or c
gtctacctactacacataggctaattattttgctcataccaaataatcccattcccaattnttcatctatacgtattagctatattggtttttctagaataaataccattttcatatttgc

SEQ ID NO: 3004 - DNA, 121 bp, Artificial Sequence
  Synthesized
  misc_feature (61): n=a or g
aaaggccgtgaagaaatagggccttcaagatgcacggtagaacgataatgcaaagcagagncagttaggcagtcttgttcccagtgtgccccgaatgttaagcactcagcactgtaagaac

SEQ ID NO: 3005 - DNA, 121 bp, Artificial Sequence
  Synthesized
  misc_feature (61): n=a or g
ttcaatactacagtttcagacgggggttttaccatacctatcaattgctgcacttccagancagttccacgtcttcaggaactccagaactgcaacaaccaccaagcaacccaactgctgt

SEQ ID NO: 3006 - DNA, 121 bp, Artificial Sequence
  Synthesized
  misc_feature (61): n=a or g
agaaggcaatgcaaataatactgaatatggtacagtgtagactatcgagggtgaagtgcancattccagtacctctgtgatttctacttaagagtgtttgaaacagtcttacatctgggta

SEQ ID NO: 3007 - DNA, 121 bp, Artificial Sequence
  Synthesized
  misc_feature (61): n=a or g
catatttgactttcattttgggaggtcactgagatgtctgataacgagataaggtagtatntgtttcgtggaaattgataatagggttagctgaaggatgcattactagctgtctactaag

SEQ ID NO: 3008 - DNA, 121 bp, Artificial Sequence
  Synthesized
  misc_feature (61): n=a or g
atagcatgaatatgcagtgaatatctgcttgcagaacgaccttagcagtatttgctccccncaattcccacctgagagcatggcatctgccacctttgctaaacctagcagtatcctaggg

SEQ ID NO: 3009 - DNA, 121 bp, Artificial Sequence
  Synthesized
  misc_feature (61): n=t or c
agaccttttgaaacaccactggaagtcaatgtcagcatagctaacaattggcaacaacaanagagaggcagtatgggaaggcaccaacaaagtgctgtactgagggtgactgtcatcagtg

SEQ ID NO: 3010 - DNA, 121 bp, Artificial Sequence
  Synthesized
  misc_feature (61): n=a or g
gttctgctaatttaaagagaaacagtcatacagaaagaaaatgtagaaggaggttcttagnagtgttctttggacatcttggaattttttcactattgaggtttcttctcttctttcctcc

SEQ ID NO: 3011 - DNA, 121 bp, Artificial Sequence
  Synthesized
  misc_feature (61): n=a or g
tgttgggtgaggatttttggcaaagacaaaaagaagacttcctcccctcattttgatacanttcacaaccaaatgacacgcagagcagtggttaggtcaaagagggcttgctaggctgatg

SEQ ID NO: 3012 - DNA, 121 bp, Artificial Sequence
  Synthesized
  misc_feature (61): n=a or c
atggcaagaattatagaaagatcagtggctgacagctgtgtccttaggaatagggtgttanaggaaatcttaattctgtcatgtcctaagttttgagaacatgagtttgcaatacaagcat

SEQ ID NO: 3013 - DNA, 121 bp, Artificial Sequence
  Synthesized
  misc_feature (61): n=a or g
atcagttactttgttcagtacctcttagttcaactgctgtttcagactgtgggctctagcntgaaggtttaagtgctgcaaagaacacaaaggcagaaatagatctgacaacacaggttat

SEQ ID NO: 3014 - DNA, 121 bp, Artificial Sequence
  Synthesized
  misc_feature (61): n=t or g
ttaaaccaatgtctaccgctccttccaagatctttgagaaagacctaattttattgtcccngggtggaaacaacattggtgtacactcagcattcatgaaaaatgtgctataactgttttg

SEQ ID NO: 3015 - DNA, 121 bp, Artificial Sequence
  Synthesized
  misc_feature (61): n=t or c
aacaaaaacacctcagagcaaacaacaatcgggtcatgaatgtgacattaaaacaattctnaaagaatgactctgaaaactagaaatatgggaaccaagaggaaaaactgagcaaaaagct

SEQ ID NO: 3016 - DNA, 121 bp, Artificial Sequence
  Synthesized
  misc_feature (61): n=a or t
tcaagctacaattaagaagtattttgaagaaatttataaaaaagaagctaaaatgaatatncagttggaattgtcagaattttcataacattacactcccagagaggatacattcatgtat

SEQ ID NO: 3017 - DNA, 121 bp, Artificial Sequence
  Synthesized
  misc_feature (61): n=t or c
tgagctacaaaaaccactggtagaatcttctgcgcaatacctcagtatgccggtattgccnttcttcaaacatctccacttacaaaatttctgcctcttattgtgcatatttcaaaaactc

SEQ ID NO: 3018 - DNA, 121 bp, Artificial Sequence
  Synthesized
  misc_feature (61): n=t or c
ccatttgaggagcagaaaaactaccaccctgaacctgggtccaggagaagcttgttaaacnttccaagagaaaacattaagagcagtgccacttcaaacccaaacaggcaactaactctga

SEQ ID NO: 3019 - DNA, 121 bp, Artificial Sequence
  Synthesized
  misc_feature (61): n=t or c
agtaaataaatctttcattactgacacatttccactgaaaatctgaagcggtccaaacacngaaaaacaggaggtgatggtaggcagggaggagatgacagcctggtggcagacagtgaat

SEQ ID NO: 3020 - DNA, 121 bp, Artificial Sequence
  Synthesized
  misc_feature (61): n=c or g
tccctggtgtggttttcctgatccatacgatggccaagaagcatgggacaaggccagcagnactgtgttttgtgaagatggttgggaagagtccaacctaactctgtgccttcgcatttat

SEQ ID NO: 3021 - DNA, 121 bp, Artificial Sequence
  Synthesized
  misc_feature (61): n=t or c
gtagcgtgtttcatggaaagaagaccacaagaaaaacaaaaactaaaaggaaagttgaaanacctccaattaaaaaccaacatatgacaaataatgttacatttctttgcagttttaagat

SEQ ID NO: 3022 - DNA, 121 bp, Artificial Sequence
  Synthesized
  misc_feature (61): n=a or g
gaactctgcaagaggtccctcttctgatcctctgtgcatcctggaggtttctccatgcacngaaaacgttaagaggagagcacggagtcagggagttggcacaccctcctgacacagactg

SEQ ID NO: 3023 - DNA, 121 bp, Artificial Sequence
  Synthesized
  misc_feature (61): n=a or g
ggaggtggctaggtgagggccctgcttttcctgtgggatctgatttaagaatccagtaacntctgctgaaaagcatgtctgcctcatttgccttcaacatctcttccaactggtgtgagtt

SEQ ID NO: 3024 - DNA, 121 bp, Artificial Sequence
  Synthesized
  misc_feature (61): n=t or g
agtgaagatgatagggatttttaaaaataatttatgcactgtagaaagcagtgatgagcantatgaaaatctaaggagcatggtggcaaacaaccagttgcatttctgcaatcactacgag

SEQ ID NO: 3025 - DNA, 121 bp, Artificial Sequence
  Synthesized
  misc_feature (61): n=t or c
gtaatgaaatgttgaaagacctggcttaagcccaggctaacactggtcaccttgcagcacnccagagtgcctacaaagacagatgctggtgacccctaaatcccactgaaaaatgggatct

SEQ ID NO: 3026 - DNA, 121 bp, Artificial Sequence
  Synthesized
  misc_feature (61): n=a or g
atggaatagtttaaaatcagcttctctgtcacacatctcagtaataggtcacatacagagncttcttggtcctgcttgtgtttagaatgcctttttcagatgattatctccgagttcgata

SEQ ID NO: 3027 - DNA, 121 bp, Artificial Sequence
  Synthesized
  misc_feature (61): n=a or t
atgggtatcagtttgaagccatatcttgattgaaagggaagtgcaacattaaaactatatncatctcaatacaaccttccctagtatctaaacatgtctacaaagcaattatacattttac

SEQ ID NO: 3028 - DNA, 121 bp, Artificial Sequence
  Synthesized
  misc_feature (61): n=t or c
gattgtcttctgcacaactctgcaattgaaatgtaccacaaaggcagcagaaggcaatcangactggaatatgtatcacagagtaaaaatctagatacgacccttctgaattctatgatct

SEQ ID NO: 3029 - DNA, 121 bp, Artificial Sequence
  Synthesized
  misc_feature (61): n=a or t
gatcagtatgacagagaacacaaaatcctgaatctcagcccagggcttccactacaggatnctctttatatttatttaaaagtgtctgctgacaaaatgagatgctgtgctgaagcgccag

SEQ ID NO: 3030 - DNA, 121 bp, Artificial Sequence
  Synthesized
  misc_feature (61): n=a or g
agaccaggttcagcagaggctatcaggccatgactagagatttaggtgtctcctgcaatgncagagactttgcttcaatgtccccatgagtccaggctgcacacatggggaaggaggatgg

SEQ ID NO: 3031 - DNA, 121 bp, Artificial Sequence
  Synthesized
  misc_feature (61): n=a or g
tgccaacagattgtcctgattgaagaaactcattcagagtttaactattcttccttgttcncacatcagctataaacttgtttataaattaagcctacttcatgtaatctgtggtctggtc

SEQ ID NO: 3032 - DNA, 121 bp, Artificial Sequence
  Synthesized
  misc_feature (61): n=a or c
agatgtcctgctgacacagagaggctcatgagggggttaattccttacagcactctctatnctacaacatcagcccagtggatggctctagggggctacagaggcagaaagcaaatatagt

SEQ ID NO: 3033 - DNA, 121 bp, Artificial Sequence
  Synthesized
  misc_feature (61): n=a or g
aaaagctgcctagggagatgttctgatcatcagctaaacactgcatagaaacaatttgagnatatcacctgctttctgtgggaaacatgtcagcaagttttaagacctgatgttagttcaa

SEQ ID NO: 3034 - DNA, 121 bp, Artificial Sequence
  Synthesized
  misc_feature (61): n=a or g
ctttcaagtaggctctgttctgagtatatggctgtaaaagagttggaccaaatgatctccnaagttcatttcaaattctagttactacaaattgccatacaaaagaacatttcttaaacta

SEQ ID NO: 3035 - DNA, 121 bp, Artificial Sequence
  Synthesized
  misc_feature (61): n=t or c
tttctttctcccttcagcccttggacagtcctcttacccattcctctcctatggaaccctncccatgttggagcagccccagattcccacttggtccaaaacatgcatagcagctgcccta

SEQ ID NO: 3036 - DNA, 121 bp, Artificial Sequence
  Synthesized
  misc_feature (61): n=a or g
ggtttatgttttgtgggccttaggttagaaaggggagaaaatccatttgatcaaacctgantgatcagtgcacattttgaatgggagggaaatgcaggagtgagagatggggcaagctggc

SEQ ID NO: 3037 - DNA, 121 bp, Artificial Sequence
  Synthesized
  misc_feature (61): n=t or c
agctccttaagtgaggtaggaaatcaactcattcggtgcctttctttagaaacagaaaatngcaaacctttggctagaaggtgagctcagatagaatgcattactgtttcagaaatcaata

SEQ ID NO: 3038 - DNA, 121 bp, Artificial Sequence
  Synthesized
  misc_feature (61): n=a or g
ctaacagaaaagccaaactcctactaactccaaaggaattggatgtctttcacgtaagtcncaataataaatgagggagcatataagattcaagatgtgaaatatcatgatatgatcttta

SEQ ID NO: 3039 - DNA, 121 bp, Artificial Sequence
  Synthesized
  misc_feature (61): n=a or g
agccttccaaccttagtcctacaagtggtgcagctgaacgtggtgaacaactcagagactncacatgcggttcctgagagtagggtgaatagggatgacttccataagggaaaagccaaaa

SEQ ID NO: 3040 - DNA, 121 bp, Artificial Sequence
  Synthesized
  misc_feature (61): n=a or g
gccagtggttttgttcacctcgtatatatttttaataatggtctttaaaggtctctttctngatgattcagaagagtgaactacttctaatatgctcatgaaggatcccttaaagaggaaa

SEQ ID NO: 3041 - DNA, 121 bp, Artificial Sequence
  Synthesized
  misc_feature (61): n=a or g
ttgcagctccgtctaaatggaaactcacggccagacacagtaactgagaagagcactgctncactcagtgaggatgaacccactgcactcgcttggacgctggctcttagaaacgaatggc

SEQ ID NO: 3042 - DNA, 121 bp, Artificial Sequence
  Synthesized
  misc_feature (61): n=t or g
agtactaatattcttagaaagggaaggactgtcttatctgtgtggtaaagcaaggacacancctcacttgttacatgccacctcgatgctttaatctaagaaaacaaataaggcagactcc

SEQ ID NO: 3043 - DNA, 121 bp, Artificial Sequence
  Synthesized
  misc_feature (61): n=t or c
gtaaactccatttactttcaggattctatgccaaacatgaagatttcagggatatgagttngtttctctgatgctgatgagaattttaacctcagtcaaggaagtgtctgggcctgaagga

SEQ ID NO: 3044 - DNA, 121 bp, Artificial Sequence
  Synthesized
  misc_feature (61): n=t or c
ttgaagaaactaggaaggaatgcaggggctgctttctttcccctttacctaaagggacagntgagcaactcagcttgttttatatactcagtttttaaatgcaaaaaaaacctcaacaacc

SEQ ID NO: 3045 - DNA, 121 bp, Artificial Sequence
  Synthesized
  misc_feature (61): n=a or c
tctcactcttattccctaaaactctttactcccacattttttagcatcttctttcccctanttgagcccaaaattagaaaacagatgtaacaagtctatgcaaacatttgaataaaattca

SEQ ID NO: 3046 - DNA, 121 bp, Artificial Sequence
  Synthesized
  misc_feature (61): n=a or t
ctacggcattttttctttccagagtaactatgatcttttcagtattatcagacttgacttngggtcaaagaaggaccttgtaaccaaagacaccagaaaattcctactttctgggtacatg

SEQ ID NO: 3047 - DNA, 121 bp, Artificial Sequence
  Synthesized
  misc_feature (61): n=t or c
gaaggaaaccattatcattcagttacgctctgtaaaatacatgctgccacatctgcttttncaaagaagttggtggattcttgataaatgcagtactttaactcctaggtacccattatgt

SEQ ID NO: 3048 - DNA, 121 bp, Artificial Sequence
  Synthesized
  misc_feature (61): n=c or g
agccattattttagccagatggcattgcaaggaaacactgtaagtctgtttggatgcagtntaaccagttttgatccaaacatgacttgaatcattagtttctaaagaggcatttgtattc

SEQ ID NO: 3049 - DNA, 121 bp, Artificial Sequence
  Synthesized
  misc_feature (61): n=t or c
atctcatatggtcaccagtttctaaagcatgtattagtggtacatgaaaatctgggcaacntaaatggtaaactttttaaactgtgtgtgtgtgtgtgacaacaaagtctaattgtctgta

SEQ ID NO: 3050 - DNA, 121 bp, Artificial Sequence
  Synthesized
  misc_feature (61): n=t or c
attcttacacaggaattatcccataccgtgtttttccccttagagtatgccccaagtgggnaggcagcctttgctaataagcctgcgaggaaaagccttgcttagaaaagttaaaaaacct

SEQ ID NO: 3051 - DNA, 121 bp, Artificial Sequence
  Synthesized
  misc_feature (61): n=t or c
tccttgttcctactgtgtcgggtggggttttttttaaggggggctgttggtcaatttcttnagtttctttgttgtcttcctgaaattatccagggagaagtgaaaagctttcggcaataaa

SEQ ID NO: 3052 - DNA, 121 bp, Artificial Sequence
  Synthesized
  misc_feature (61): n=t or c
tccagttagttgcatcatgtgacataagaaaatatacagccttatatttggctctatgtancaggcatatacactaagtggagcacaaacaaaaagtgagaagagtatcggaagggagaaa

SEQ ID NO: 3053 - DNA, 121 bp, Artificial Sequence
  Synthesized
  misc_feature (61): n=t or c
tcataatagacctattttgcactagatgaaatcctgtttgctttttctctgagaaaggccngaatttacagtctttaggttgccttgttatccccatgtgactctttggccgaataccagg

SEQ ID NO: 3054 - DNA, 121 bp, Artificial Sequence
  Synthesized
  misc_feature (61): n=a or g
aagctgaactggcaaactgctaaagaaggtgaaataatgggcttccagccttcactcaccnggctgagctcaaagcagtccatagcactaaatactaatagttcagctctccggagacagt

SEQ ID NO: 3055 - DNA, 121 bp, Artificial Sequence
  Synthesized
  misc_feature (61): n=t or c
gagactggaagacaaaaatcaagtttagaactaggccaacatgaggcagaaagtcacaagnagggtggcacaactcaggaatcttcttgtctgactggtagcaaatgcgtggactttccca

SEQ ID NO: 3056 - DNA, 121 bp, Artificial Sequence
  Synthesized
  misc_feature (61): n=t or c
gggtaataagctttaactaactgaggagctttcaggacaccagtaaacatatggtaccttngacctctggctcagagaatgagatttatttcaaaatattatttagtagatatttcagaag

SEQ ID NO: 3057 - DNA, 121 bp, Artificial Sequence
  Synthesized
  misc_feature (61): n=t or c
cagaaataataaatgttacaaaacacagattactttttcaatttgcaccattcaatgtggngattctctggggaagacagactgggaaacgtggagcacagaggatttgatgaatgaacac

SEQ ID NO: 3058 - DNA, 121 bp, Artificial Sequence
  Synthesized
  misc_feature (61): n=a or g
atgttcagattgttaacaagtacaccaatatggcttttattaacaggtttcctgtcacatntggaatggttggcatcaaggccttattctcagccagcccagtcacatatacaaaacccat

SEQ ID NO: 3059 - DNA, 121 bp, Artificial Sequence
  Synthesized
  misc_feature (61): n=a or t
tgatccaaatgtctgcgcaaaagtttttcccaaagcaaggcacccaaaagacctgtgctcngaaatagctttccttttacaagattgaatggtgacctcctccttatcactttgccatgct

SEQ ID NO: 3060 - DNA, 121 bp, Artificial Sequence
  Synthesized
  misc_feature (61): n=t or c
tacatctaatcagaaccattacattcttggccatcttaaaatgttgggctctttatattgncagccaaacaggtgtaagccatctacaggaggaatttatattgtttagaaattttaaata

SEQ ID NO: 3061 - DNA, 121 bp, Artificial Sequence
  Synthesized
  misc_feature (61): n=a or c
tcagttgtttagatgttgctcattttagtgctcccaaagcacatatctgttggaaggtccnagacgcagctcacaaaatagatatatacactatcagagttacatggtgatcagaatctgg

SEQ ID NO: 3062 - DNA, 121 bp, Artificial Sequence
  Synthesized
  misc_feature (61): n=t or c
tatggtgaataaagaaacagaaagatggaacaactatctttttagtcaaactatgctttcntcctgtcctttcagttttccaccagttcaagttttctctaaacatatgaatatatttata

SEQ ID NO: 3063 - DNA, 121 bp, Artificial Sequence
  Synthesized
  misc_feature (61): n=a or g
caatgtaccataaagatctccaggcagatacatgatcacacacacagctttaatcttgtantcacattcaggtgttggctacatcaacttgtgctttttctagcaatgacaaagctgcttg

SEQ ID NO: 3064 - DNA, 121 bp, Artificial Sequence
  Synthesized
  misc_feature (61): n=t or g
ctgcaggtatagttttgtttttatttctaaactgtatcagaaaatgcaagggaatatttanacttttgttagacccatatttagacccataagagaataattactagctatgggctaataa

SEQ ID NO: 3065 - DNA, 121 bp, Artificial Sequence
  Synthesized
  misc_feature (61): n=t or c
tgaaaaaaagaagttgcaggcttagtgaagaggctttaattagcaaaggtctaggatttanagcatagtaaacccgttccttcccatgaatgtttcctataggatataacctttatgtttt

SEQ ID NO: 3066 - DNA, 121 bp, Artificial Sequence
  Synthesized
  misc_feature (61): n=t or g
agctaaaatcctgagtagcttttaaaataatggtaggtcaaacatatttactctgatacanttttaagagctcagcagatttttttgatagtgtaggtgtagccaaaaaaaacctactgaa

SEQ ID NO: 3067 - DNA, 121 bp, Artificial Sequence
  Synthesized
  misc_feature (61): n=a or g
tttcaagaaagcaaatgccttaatctactgactgtcagagcagcaaattagtcagccagtncttcatgacttccagttttgcattcattcacttaaactgtagggctacagggcaagagag

SEQ ID NO: 3068 - DNA, 121 bp, Artificial Sequence
  Synthesized
  misc_feature (61): n=a or c
ttttggtgtccttggatctgggctggtgcagtgcaaagctgactgctgacagagcagggtnaggctgagtgatggcaagggcccagcattcctgcttgagattgcataaggctgattaaag

SEQ ID NO: 3069 - DNA, 121 bp, Artificial Sequence
  Synthesized
  misc_feature (61): n=t or c
aaaagaacttgtgatgctcatattttcaggaatctagcatgagaatcagtaggaacctccnttccagtgagagacaggaatatttattgtatgcagcttcagtgcctgtcagccttattag

SEQ ID NO: 3070 - DNA, 121 bp, Artificial Sequence
  Synthesized
  misc_feature (61): n=a or g
ggagatgctattaatggcagaaattcagagagagggaactacatgctcctggtctcactgngaaggacactggggtacatgacgatctgagtatccttactgctttaggaaagaagcccaa

SEQ ID NO: 3071 - DNA, 121 bp, Artificial Sequence
  Synthesized
  misc_feature (61): n=t or c
gttccgtacttctgcacttagctatttggtagttcttctgcataagcagtgtcttccaagngttctattctcctgaaacaagatcactttcactccatgatgctgcaggctacgcattagg

SEQ ID NO: 3072 - DNA, 121 bp, Artificial Sequence
  Synthesized
  misc_feature (61): n=a or g
tggtaaatcttttagggcttctgtaaacatacagtccaattgtgaaactagggaggtaganatataaatttgaaggcttaaagttagagcagctactatactatgtatttctaccacatct

SEQ ID NO: 3073 - DNA, 121 bp, Artificial Sequence
  Synthesized
  misc_feature (61): n=a or g
ggctttttgactttcctctggcatgtgcttctgccctaactctattacttggcaaggcgtntgttatgtccatgttaggtatccgtcacactattggctttttattttaactgcttatact

SEQ ID NO: 3074 - DNA, 121 bp, Artificial Sequence
  Synthesized
  misc_feature (61): n=t or c
atttatctgtcagagtttctacctaagtttggcagtaaaattgtaagagcaactcaaatantgttagtgatgctgatgcacacaaaatccagcacctgatctttatttcaggcttatcatg

SEQ ID NO: 3075 - DNA, 121 bp, Artificial Sequence
  Synthesized
  misc_feature (61): n=t or g
ttaggattttcctctttttcataagaattatatttgtgttattttgcaatgacattaaatnaggaataggttcaggaatgtatgaggacccaaatgaataaataattgttcattctacttt

SEQ ID NO: 3076 - DNA, 121 bp, Artificial Sequence
  Synthesized
  misc_feature (61): n=a or g
tcgggccatgggatctctagcatgtaatgagaatcacttacagttctgccaccctccagtnctgcatagtgatttgcttaactatcatcaagcgtagattgcatatggaaaagggggaaaa

SEQ ID NO: 3077 - DNA, 121 bp, Artificial Sequence
  Synthesized
  misc_feature (61): n=a or g
tctgcttcagtcactgtgtggcaaaattgccatccttgcacactcatgtgaatactgtgtnatgactgctgttgggctggggtgtattcctcactccctctgttttgaaaatctgctggag

SEQ ID NO: 3078 - DNA, 121 bp, Artificial Sequence
  Synthesized
  misc_feature (61): n=a or g
aataatttagctccttaaaaataaataaataaatgccaaaacgatttctgttatttcaggngacgtatgaatcttcttaacacgacattcacagtataaaacagacacatacttctccaca

SEQ ID NO: 3079 - DNA, 121 bp, Artificial Sequence
  Synthesized
  misc_feature (61): n=t or c
aaaaatcaataattattcccagcaatcatacaacatgtaggctgactactctctgtcagcnttgtctatcattctctcatcttctccactagattgtttatcaatgatatccatacaacat

SEQ ID NO: 3080 - DNA, 121 bp, Artificial Sequence
  Synthesized
  misc_feature (61): n=c or g
aatatttttgcattttactttgatgaatttacagcatataagctatttatactttcaaaantgttcagtaatacttaggggaacttcacaagtatgtacattaatgtcagcatatcaagcc

SEQ ID NO: 3081 - DNA, 121 bp, Artificial Sequence
  Synthesized
  misc_feature (61): n=t or c
caggctcctgtcctctcctgcctctcagttcaagaatctccatgccatccaagctggagantcagcctatagtttgctcttctcctgaacccttttttggagagattttatgagaggccat

SEQ ID NO: 3082 - DNA, 121 bp, Artificial Sequence
  Synthesized
  misc_feature (61): n=t or c
cactacaaacccctgaccttctgaaggtactagttataaaaaacaactgtccagaaagttnctagaatagtagtatgaagatcagcattttgaggtaggtatgagtttgttatggagatta

SEQ ID NO: 3083 - DNA, 121 bp, Artificial Sequence
  Synthesized
  misc_feature (61): n=a or t
tccatcaggagtagcacctcgggtttttcaatacatgatgaaatggatgcattttcatcanatcttcatttaaataaactgaactcatgctattacttctcaatcacctgttcttcatatt

SEQ ID NO: 3084 - DNA, 121 bp, Artificial Sequence
  Synthesized
  misc_feature (61): n=a or g
tagaagttagcatggcagttgaagactgatctagaaagcactgtatatccacatgctacancttggttatttggcagatcagtttcgataagtatcatgttgtgatgcactgaaagtatgt

SEQ ID NO: 3085 - DNA, 121 bp, Artificial Sequence
  Synthesized
  misc_feature (61): n=a or t
gctcatctaatttggaaggagaattcactctttgtatgttgtttgcagtaatactttcaangcatcatgatggaaactaagattagtttctctagcttttgtgtttttgcaacaatacgcc

SEQ ID NO: 3086 - DNA, 121 bp, Artificial Sequence
  Synthesized
  misc_feature (61): n=t or g
aatgttgctgactgaaagcctctccaattgggctgtgccggtccacttgcaagttaatatnccaaatgtggttgctgatatgttatcaattcagatgggttcctactgtcatggggcaccc

SEQ ID NO: 3087 - DNA, 121 bp, Artificial Sequence
  Synthesized
  misc_feature (61): n=t or g
gctatttgcacctgaaagataaggtgtttgttactagcagacacaatttctggaaaatatntgatttcagcataattctttgcatcagctaatgcattcagcatctaaaatctatcagaca

SEQ ID NO: 3088 - DNA, 121 bp, Artificial Sequence
  Synthesized
  misc_feature (61): n=a or g
aaactacaaataaatttgtaacagcataccaacaaaaagactgatttagatttgacttgcntacttggaagcactgtatcctagagcaggaaggcaacagtttctctccacatagctttag

SEQ ID NO: 3089 - DNA, 121 bp, Artificial Sequence
  Synthesized
  misc_feature (61): n=a or g
ttaatattgaaaatgtctctaacaattctgctctagtttccttcaatttgacagcatctgnaataagcaacagtcctcagcttttggtttgtttgtttgtttttgctggctggacaacaca

SEQ ID NO: 3090 - DNA, 121 bp, Artificial Sequence
  Synthesized
  misc_feature (61): n=t or c
tgcctgcctcaaggggcagctgctggtggacaagggcaaacacacaaagatgcacattgantctagtgaccttcccagtccaggagaagatcgccaagccttgctatgcccttggaaatga

SEQ ID NO: 3091 - DNA, 121 bp, Artificial Sequence
  Synthesized
  misc_feature (61): n=a or c
aaatagtttttgtacttgattctttttctgacagaactagaacattcaattcagaaatgtntagagattagacagccagttttttaactttattcatccaactatgaaccttgttccaaga

SEQ ID NO: 3092 - DNA, 121 bp, Artificial Sequence
  Synthesized
  misc_feature (61): n=a or g
atgtgttatggtactgagcacttaaagtgctcaatttatttatttagataactacttaccntttagactgtggttcctgaaggctgcgtgtgtcataactgatctgagggatgctgtgtca

SEQ ID NO: 3093 - DNA, 121 bp, Artificial Sequence
  Synthesized
  misc_feature (61): n=t or c
tccagctttcttggctcttgttccctagatggcagagaactttaaaagctcttgtgattcnatcttcacaaatgctcgagcaaactactgtttgctatgatagaaaactgaaattctgcca

SEQ ID NO: 3094 - DNA, 121 bp, Artificial Sequence
  Synthesized
  misc_feature (61): n=a or t
cagagaactgcctgtgaagatgtgtgaggcagccctgggcagcctagaaggaggcagaagngatcatttgtaatttctggattttaaatgttggagctgaacttattttcatacatcattg

SEQ ID NO: 3095 - DNA, 121 bp, Artificial Sequence
  Synthesized
  misc_feature (61): n=a or g
ggttgaagtgtgttgactgtgacctccatccgtgcctcacagcctgttggaatctcattancctcagaggtatttcacagcatttttagtgttcggtagtacaggatgctggtgaaatgca

SEQ ID NO: 3096 - DNA, 121 bp, Artificial Sequence
  Synthesized
  misc_feature (61): n=t or c
ttttcctctcaactgcagtacctcgagcaaattcactacttagggtaattatttcctactnttttgagtatcagtgaagtcatcttttcagttctgaaatctgacatgttatactctccag

SEQ ID NO: 3097 - DNA, 121 bp, Artificial Sequence
  Synthesized
  misc_feature (61): n=a or g
ggactatatatatatatatatatgcacatatatatatatttatacatggactacatagatngattttttccacctatctatctaggtcaaggatggatcttcacactttactattacatgt

SEQ ID NO: 3098 - DNA, 121 bp, Artificial Sequence
  Synthesized
  misc_feature (61): n=a or g
aagctgcaaattaatttttcttgcagttgaatagtattctttacagtggttctcatttcantatctattttgaatccaggtttctgtacttgggaggaacgcattctttcaccaatgtggg

SEQ ID NO: 3099 - DNA, 121 bp, Artificial Sequence
  Synthesized
  misc_feature (61): n=t or c
caaaagtaggactgccactaactgatggccagaccaaatcccatccaggaagacagtcagnctgacttggtgtcccagaagagagtccttcctcccttcctagtctccattttctcctggt

SEQ ID NO: 3100 - DNA, 121 bp, Artificial Sequence
  Synthesized
  misc_feature (61): n=t or g
aacattacgcagcaaaaacatcctgccattttttgaggtaacaactgaatctgaactcctntaaagcactgctgctctggtttggcactgcacagctagcatgctatctgggagactgagg

SEQ ID NO: 3101 - DNA, 121 bp, Artificial Sequence
  Synthesized
  misc_feature (61): n=c or g
cagctgtgccttcttggcagttaaaggaggagttagcaacttggatcgctcataaatccantttggatgatagttaaagataagaaaatagtcaaatctgactagttatgtttctagtcca

SEQ ID NO: 3102 - DNA, 121 bp, Artificial Sequence
  Synthesized
  misc_feature (61): n=a or g
tgatagcctttctgatgacaaacatcaatccacacattttttaaattcaaatcgtgttgtnattttgcacttggggtccgtatttttctctctgccttaagaactggcataaatctacaca

SEQ ID NO: 3103 - DNA, 121 bp, Artificial Sequence
  Synthesized
  misc_feature (61): n=a or g
tcctcccattacttttttttctctaacacagctgactgcactagagacactaacactgacnccaaggcagtcctggtccatgcttttaacttccagtttctttccctgctagtcttgtgca

SEQ ID NO: 3104 - DNA, 121 bp, Artificial Sequence
  Synthesized
  misc_feature (61): n=c or g
gaagttctctatagatatatcacattcaatatcgtcaaaggtaagctttgcattagcacantgagaacttcagtacaaaccattgagattctcgcaaacactggcaaggaattcacacaaa

SEQ ID NO: 3105 - DNA, 121 bp, Artificial Sequence
  Synthesized
  misc_feature (61): n=a or c
atgtttggcttagatatccttggttgatatctatttcttctttcctatacatggagttaanacaaagtagtagaaacctgatatggaatcttgtattaaaagtcttgtatcaaatgccaat

SEQ ID NO: 3106 - DNA, 121 bp, Artificial Sequence
  Synthesized
  misc_feature (61): n=a or g
cttcctttgctgaatacagaatatactacaacttgaggttgcactccttttataagaaacntaaactcacctgattatggtctaagtaatacacacagtatcatatttttttttttcatgc

SEQ ID NO: 3107 - DNA, 121 bp, Artificial Sequence
  Synthesized
  misc_feature (61): n=t or c
tccagatttagctgacagctaataagcagtatttctcaagggctggtacaagagccaaagntgttcaataacttcatcagcaatctggatagtggaatgtacctcagcaaatttttgggta

SEQ ID NO: 3108 - DNA, 121 bp, Artificial Sequence
  Synthesized
  misc_feature (61): n=a or g
ttttgtaagaattatataactctccagccatcataagctcaaatgctaagaggaaaactcnaatgtttctcattttaacagcactaaaacccagttaataaagcattacaagatgttttgt

SEQ ID NO: 3109 - DNA, 121 bp, Artificial Sequence
  Synthesized
  misc_feature (61): n=t or c
gtttcctcagtttgcagtcctttatatagccctgtgtatagtcattaatgtagctggatangatggtatctagctgtgcattttcttcctttcactaataagttttgcttgattaagtaga

SEQ ID NO: 3110 - DNA, 121 bp, Artificial Sequence
  Synthesized
  misc_feature (61): n=a or g
agagaaggtgaggctatttttgttatcttgagagaaataatgactttttaggaaggtgatntaatcgtgttcatgttggtgtcttaaaattgctgattgagatgaaagttttgatgagcaa

SEQ ID NO: 3111 - DNA, 121 bp, Artificial Sequence
  Synthesized
  misc_feature (61): n=a or g
catttctctgtgtctgcagagctattgtacagttggtgtacaatcatgatttcaaagtacnacagaaaccttgttaatgaaggccgtggattctaaaacaacaaaaaatcccaacaacaaa

SEQ ID NO: 3112 - DNA, 121 bp, Artificial Sequence
  Synthesized
  misc_feature (61): n=a or g
accagtgctgagtacaggggaataattacttccctgacacgggtccatgtagaagcttatnagttctgggagaggctttggttgtgtacagtgaagtttacaatccaagaaaaaagtgata

SEQ ID NO: 3113 - DNA, 121 bp, Artificial Sequence
  Synthesized
  misc_feature (61): n=a or c
ctttgaagaagggttagtttttttgttctgttatccttgtagatagcatgaaacctgcagnttcactgtcaaaagttaaatggaaagacctgcaatgtttacctagtaaaaattgtacaat

SEQ ID NO: 3114 - DNA, 121 bp, Artificial Sequence
  Synthesized
  misc_feature (61): n=a or g
gcaggacagagggaataaaaaggatgagaaagctcatggagagagggagattagttaccanttactgctgtgggcaacatagactgctggcagaaaaataatttattgccgaataaaatag

SEQ ID NO: 3115 - DNA, 121 bp, Artificial Sequence
  Synthesized
  misc_feature (61): n=a or c
aaactatggagaaattcagtgtatggagatgcgtttgcttgtcttcataagtttcccatanaataaccatagcgtgattgagttttcctctgagagcctgaataactcagttgtgtttaca

SEQ ID NO: 3116 - DNA, 121 bp, Artificial Sequence
  Synthesized
  misc_feature (61): n=t or g
ttaaaataaggaagtcactgaaagtcagattcttaagcagtgtgttaattagtttaactcngccttggctgaagatttggcctgagggttgctaccatctccattcttcatgtgtttctag

SEQ ID NO: 3117 - DNA, 121 bp, Artificial Sequence
  Synthesized
  misc_feature (61): n=t or c
cttgattaaggaaattgcacttgtgcatgtctgctgtacatgactgcctatctgaactcangactccttttcttttagggttcagtgccagacctcactggttacaggagcatggtcacta

SEQ ID NO: 3118 - DNA, 121 bp, Artificial Sequence
  Synthesized
  misc_feature (61): n=a or t
tttaccactaagtttgcctttgcaagaagccagaaaaactcacagtgaattcaatctcacnttgttctagtacattattttattctatacttctgccacccagacagtgactccagttatt

SEQ ID NO: 3119 - DNA, 121 bp, Artificial Sequence
  Synthesized
  misc_feature (61): n=a or g
acttcagtttatgaaaaaatattatccatctgacaaattttgtaaaaattacagctttgcnaagttacacatcagagatgagaaagtccctctagtcttgctcaagactcatgaagtcact

SEQ ID NO: 3120 - DNA, 121 bp, Artificial Sequence
  Synthesized
  misc_feature (61): n=t or c
gtaccctgcaagtgaattcacttccagaatctgcctctgcataaataggtatgggtgtcangtataccaaaaatttgctgttaacatactactataccattgcacagactactgttaacta

SEQ ID NO: 3121 - DNA, 121 bp, Artificial Sequence
  Synthesized
  misc_feature (61): n=a or g
aatgcaatcttattgcatgaagatgaattggtaaagactatcctccagccggtttagaacnaaaacagttagctgaaaaaaagtaaagagctgtagaatgacagattagcagctaaagcat

SEQ ID NO: 3122 - DNA, 121 bp, Artificial Sequence
  Synthesized
  misc_feature (61): n=a or t
tgcttcatgtctcgctgtcatccatgtggtttccaaagaggcccataacacctgcataatnctccattctgcaatccaggccagtgaagggagggaaggaaccccttctgcagggttatag

SEQ ID NO: 3123 - DNA, 121 bp, Artificial Sequence
  Synthesized
  misc_feature (61): n=a or g
agaagctgttttacaatgagcaaaaactttcacatcaggggcagtatcaagcccctgatcntacctgtcaagatcaggcaacattcccaattaggcagtgagaattttactgcagccagaa

SEQ ID NO: 3124 - DNA, 121 bp, Artificial Sequence
  Synthesized
  misc_feature (61): n=c or g
tgtacaaaccaccaaaagccgccaccatcccaggttgcatgcagcaacccattttaggcangaaaaacaatcagtgcagtgtgagatcagatgggatagggcaacgggagcgtgatgaata

SEQ ID NO: 3125 - DNA, 121 bp, Artificial Sequence
  Synthesized
  misc_feature (61): n=a or g
ttacgattgagatgattttcaaagagttttaaagagcaagctaaacacctacattatcttncctacctatcacatctctgagatgtcagccctgttgaataagacatttttcaccatcacc

SEQ ID NO: 3126 - DNA, 121 bp, Artificial Sequence
  Synthesized
  misc_feature (61): n=a or g
ctagcagctcatcagcctgtgcctcctacatacaacagaaattatttctggtggcgtcacngaagtggaagtcatttgtgtgaaacttcctactcccctgaagaggttgttgtgggaggct

SEQ ID NO: 3127 - DNA, 121 bp, Artificial Sequence
  Synthesized
  misc_feature (61): n=c or g
agacaattttatgtggcactgtaatgttatttgtatgccgagtgcttttacatgccattgntaggtcatattgcccacctgtgtgcgtctgtgggcttgtgagtgttccatatggcacact

SEQ ID NO: 3128 - DNA, 121 bp, Artificial Sequence
  Synthesized
  misc_feature (61): n=t or c
ctgtctgctcaccccagttgggtgaaagggccatctgatgactctgtagttgtttctttgntttgtttttctgtagttatgagttgtgcaaagtaattacgtgggtgtgtgctgcagcacc

SEQ ID NO: 3129 - DNA, 121 bp, Artificial Sequence
  Synthesized
  misc_feature (61): n=a or g
aacaatgcgtatgaaagaattcgacttcagaaacttgcttttgtccaccgagctgttagtnttgccacagaccctaatggatgcaattttgctgttttgcaatcagaccctaaaacaaggt

SEQ ID NO: 3130 - DNA, 121 bp, Artificial Sequence
  Synthesized
  misc_feature (61): n=a or g
gttttgtgtgtgcttggttcattaccatctgtcagatgatgcatggtaatttgttaagagntggtaataaaaatgttcacatgattaaaagcaattagcatagcataatatattgcttttt

SEQ ID NO: 3131 - DNA, 121 bp, Artificial Sequence
  Synthesized
  misc_feature (61): n=a or g
cttgactactctgacagtacattgtaaaatcagtatctgtactaccttctatactataatntgatttcatcagatgatttttgagctatgtcatgcaatttctagaagatctgtcgcagaa

SEQ ID NO: 3132 - DNA, 121 bp, Artificial Sequence
  Synthesized
  misc_feature (61): n=t or c
gtatagctacagcttgactcctaactcatgattacaaattacttcagaatatttagttggnagtaaattccccatatttgctttccttcatgcatactaggaaataaacaaaagttatgtt

SEQ ID NO: 3133 - DNA, 121 bp, Artificial Sequence
  Synthesized
  misc_feature (61): n=a or g
agctgttcccagaatgcagcaagcatcccagctatgtgcagctgctcagagtaccaccctncccccaagcatctttgccaggtgcccctggacacaggctggtgattcaaaaggagtgaca

SEQ ID NO: 3134 - DNA, 121 bp, Artificial Sequence
  Synthesized
  misc_feature (61): n=a or g
gatctaattttaaaaccatgtttgcatgctcacaggttgaaagttaaactaatgagaatanttagtcataaatgaaattacgttttacccaatgtcagttcttcaagcacaagagaagtta

SEQ ID NO: 3135 - DNA, 121 bp, Artificial Sequence
  Synthesized
  misc_feature (61): n=a or g
gcagaacctcttacctcagtgttattgcctaaatccagtgttctttgtgtagatgtttaantgtctgttgacaaattgaatactaaagtgttctattctatattgcagtaaaatccaagtt

SEQ ID NO: 3136 - DNA, 121 bp, Artificial Sequence
  Synthesized
  misc_feature (61): n=a or g
ctgcactaacctcatggcgttcaacagggctgagtgcacgattaccaagaaaaggcactgnggcttttgaaaagaaccattgaagtgcatgtgtctccttgctggagtcctgctgcaaaga

SEQ ID NO: 3137 - DNA, 121 bp, Artificial Sequence
  Synthesized
  misc_feature (61): n=c or g
ctggagtgtgatggtttgaattctcagattcagatattttttgagaaactatcattacatntttgaagcgttgtggctgggtttaccttcaagggtttttggcttgatctgggagagttca

SEQ ID NO: 3138 - DNA, 121 bp, Artificial Sequence
  Synthesized
  misc_feature (61): n=t or c
acaagccaaaagcaatcttatccattaaactatataaaaaaaagcacaagaacacaaggangtattttgttgtttcctggtacttaaatgaccatatttgacaattactggctctgcagta

SEQ ID NO: 3139 - DNA, 121 bp, Artificial Sequence
  Synthesized
  misc_feature (61): n=t or c
tgcatttcatgactggaaatacttgaatgtccagtcagcttggtggtgtaatttttaatangaacaacttgttgacttatacagagctcagactcctagtaatggttctgggtcacagaag

SEQ ID NO: 3140 - DNA, 121 bp, Artificial Sequence
  Synthesized
  misc_feature (61): n=c or g
aggacaagaaattgtgtcagctttttgaacattttgtttattgttgcaggttagaaattgntccaggattccagaccttatgaaagagagatattgctgaattactttgctgcaaaagggc

SEQ ID NO: 3141 - DNA, 121 bp, Artificial Sequence
  Synthesized
  misc_feature (61): n=t or c
ataataagaatcgctactgtcttatatacaggtgtgtccaggacattcagtaagtgcctantgtgacccagttatctgatcctgtttggaatgtcgtgatgagaccacgtgaatggtggtg

SEQ ID NO: 3142 - DNA, 121 bp, Artificial Sequence
  Synthesized
  misc_feature (61): n=t or c
tgagtttcacacaaaagaagattgcatttataactcgtgtgaggatcttaggattcagtgnttccaggtattcctcctctccaaaaatcaggtcagctacctcagtatttagacatagtgc

SEQ ID NO: 3143 - DNA, 121 bp, Artificial Sequence
  Synthesized
  misc_feature (61): n=a or g
gtgacaaccagttagtaataagtgcacttccaggatttctctgattagcttctcaaacccngatgagctacttgagagtaaatgcactgaaaatacaaccgtaagagaccctgagatgtcc

SEQ ID NO: 3144 - DNA, 121 bp, Artificial Sequence
  Synthesized
  misc_feature (61): n=a or g
ctccctttccctctcctacagtgttttctcttagccttttcactaactccttatttcatcngtctcttcatcatcccaatacacagtgacataaatatcacaaaactctctccaatcactg

SEQ ID NO: 3145 - DNA, 121 bp, Artificial Sequence
  Synthesized
  misc_feature (61): n=t or c
cgacctgtgttaatttacatgatgtgatttacatgatgtgaccatttcttgaatatatggngattgtagtgcactttagcactacttcagaatttgttatgttaagggggactgattagca

SEQ ID NO: 3146 - DNA, 121 bp, Artificial Sequence
  Synthesized
  misc_feature (61): n=t or g
tgcatttaatgacacagaacagaatgtggaaaagacaataagacaatcaggaagtgaaacntaaaaatatctttagtagaaatactcattgcaatcaaggtgacttttttctggagagaaa

SEQ ID NO: 3147 - DNA, 121 bp, Artificial Sequence
  Synthesized
  misc_feature (61): n=t or c
atcaaagtagctttgaagaacaggttaagagccatccttacatccaagtgtagagaagganagtgaaaaaaagaagtaatttcaagaaatggtaaggagaggttttaattctttaccctgg

SEQ ID NO: 3148 - DNA, 121 bp, Artificial Sequence
  Synthesized
  misc_feature (61): n=a or g
agccatcattccaatgacacaactctcagacaagaattgtaacactgaaaacatgagcgangatgggacacggtatctaacatgcttgcataaaccacaccagcagagggaagcaatgatg

SEQ ID NO: 3149 - DNA, 121 bp, Artificial Sequence
  Synthesized
  misc_feature (61): n=t or c
gccaaagcaaactcaagcagaactgagaatttgcgttgagatggctgtcacaaaggatggntgttcattcaaatcaagaaacattggatcagttcgcttcaaatcgcagtagagacctatt

SEQ ID NO: 3150 - DNA, 121 bp, Artificial Sequence
  Synthesized
  misc_feature (61): n=a or g
acttgacatttatttttcctttgtctgaatccgcaccttggatttgctcaagcacacgggntcctcacacacaccttccgttgagggaaatgcagcagcattcacgttcagtgcttttggg

SEQ ID NO: 3151 - DNA, 121 bp, Artificial Sequence
  Synthesized
  misc_feature (61): n=t or c
ccagtgtttgtctccagcctgttgctgacaggtcactcatggacgttagatccctgactcnttccttagtactcatagggatgcttttcccaaagtctacttctatgctcctaccttattt

SEQ ID NO: 3152 - DNA, 121 bp, Artificial Sequence
  Synthesized
  misc_feature (61): n=a or t
gtttttgttttgttttgttttgtttgtttgtttaaactgtttcaccttcagttaagtgttngggtatagtctgtgtcatatagctaagtactgtgactgaacaagttgagaaagacaccag

SEQ ID NO: 3153 - DNA, 121 bp, Artificial Sequence
  Synthesized
  misc_feature (61): n=a or g
atgaggcaggtagtaataaaatgtgaccataactccagacaagctcccagctattctgttnaaaaagttaaacgtggaaaaaaattaacagactggttatgcagcctaagaggacagaaca

SEQ ID NO: 3154 - DNA, 121 bp, Artificial Sequence
  Synthesized
  misc_feature (61): n=t or c
atacagacattggcattaatcacccgggcaacttcacacacaggtaatattaagtcccttnctctattttcttccttattcaaattcacattcaaatggctgtaaaatctaagttgagtgc

SEQ ID NO: 3155 - DNA, 121 bp, Artificial Sequence
  Synthesized
  misc_feature (61): n=a or g
acaaaacataaatataatattctagctggaaagtgttcaaatagaaacaacagcgccagcnttctttactgtctgattttagtttctcatgggcaatcccactcaaagttcctctccttga

SEQ ID NO: 3156 - DNA, 121 bp, Artificial Sequence
  Synthesized
  misc_feature (61): n=a or g
ttacaaaatatttattctaaaactctacgttattccagatagaacaaatattgttaggaanaagctactggttattatacacaattatttgttcctatgggtcatgtactttaagctgtgg

SEQ ID NO: 3157 - DNA, 121 bp, Artificial Sequence
  Synthesized
  misc_feature (61): n=a or g
ttgatcttttgaacaacttttacatcttcttgtggaaggtggtagcttctatagcgtgganaaaacgtgaggattcctattcttctgaactccagggagagagggtaacgatttatatctc

SEQ ID NO: 3158 - DNA, 121 bp, Artificial Sequence
  Synthesized
  misc_feature (61): n=a or g
tgggagcaggaggagagatatcacagtgtgctgttaaaaacagctctctgttgatgcacancgttatgaatttctgctcttagcatcatctttcgaaagtgttctgtatatttattaagga

SEQ ID NO: 3159 - DNA, 121 bp, Artificial Sequence
  Synthesized
  misc_feature (61): n=t or c
cgttgtctgagcactatcaaacacaaatgaagcaaaggaaagatttcactgctcagttctnatgaaacgttaatgaatgtatttttaaaatatctatatttattcagccaaagaaacaatg

SEQ ID NO: 3160 - DNA, 121 bp, Artificial Sequence
  Synthesized
  misc_feature (61): n=t or c
gattactgaacagcgctttataataggagctggctaccaccgtaactacagggtggctaanatctctaagcagtaataaagtattctgtttgtgtaattcaaataataatgttgacattgc

SEQ ID NO: 3161 - DNA, 121 bp, Artificial Sequence
  Synthesized
  misc_feature (61): n=a or g
ggagtatgggaggttctgcatcccaaacaggctattttttacttaatttgaacagggcaanagaataattgatggtagctgagctgggctatgtcaggacctgtgcaagtcatctggatat

SEQ ID NO: 3162 - DNA, 121 bp, Artificial Sequence
  Synthesized
  misc_feature (61): n=t or g
tcgttttagtgttcctcttgcataccacactgtcataattaaaacagtagtactggagctncagaacaataaaaaatcttaattgttacacagttgcatgaataacgtttcaggttttgaa

SEQ ID NO: 3163 - DNA, 121 bp, Artificial Sequence
  Synthesized
  misc_feature (61): n=a or g
actttcttcattcttggacactggatctataggcctgtgacttgcacattggatttgtagncacatggcatttcagaggcaaagtagtatatgtatacatataaaagttgtacgtgctgga

SEQ ID NO: 3164 - DNA, 121 bp, Artificial Sequence
  Synthesized
  misc_feature (61): n=a or g
attgtttgtgaaaacttgcaaaaatacatttacactaaaaagttacatttacactaaaaanttgacacgcattcctcaacacatgagcaagcagacaaaaatagagagagaaaagaaggaa

SEQ ID NO: 3165 - DNA, 121 bp, Artificial Sequence
  Synthesized
  misc_feature (61): n=a or t
agtatgtattttagtactggaataccttaggtagccaggccatctctaataacttaaggcngggatagataggctatggtgaagaaatgacttctggaatggtatctctgtatggtgttct

SEQ ID NO: 3166 - DNA, 121 bp, Artificial Sequence
  Synthesized
  misc_feature (61): n=a or c
atccagacagtcgttttacatataaaaacaaatggattatctataccaacataatatgatnttcattctattaggctatgaagtcacaaatgtaaagcatggctgctatgttcagacttga

SEQ ID NO: 3167 - DNA, 121 bp, Artificial Sequence
  Synthesized
  misc_feature (61): n=t or c
aaccttgcctatggataccagcattttgaaaactgaaagttaggttctttcatcacaaacnaaaacacatttctatttcacctgtgaaagaaggaatagactggcattccaaatcacatta

SEQ ID NO: 3168 - DNA, 121 bp, Artificial Sequence
  Synthesized
  misc_feature (61): n=t or c
aaatagatgaggcctagtttgctataggcttcttacagacctcctagcactttccttcttnccctttcccctaaatcctctcctcatctgttcggctggcttcacatcaactctgcttcaa

SEQ ID NO: 3169 - DNA, 121 bp, Artificial Sequence
  Synthesized
  misc_feature (61): n=a or g
agggcttttcccaattagtgacttttaggaaaagcaaaaatgtctgtggcaatgactaacnttctttccctttctgctcaggaatacaaatgagctgacctacaaggcaatgaacgatatg

SEQ ID NO: 3170 - DNA, 121 bp, Artificial Sequence
  Synthesized
  misc_feature (61): n=t or c
tctttggaaaaaagaagattaaatacttttaaaagttaggcccctgatcagctggaaacanggttagatttgaggaagaagtaaaagcaatttcaggcactgtcttcctttcctcagttca

SEQ ID NO: 3171 - DNA, 121 bp, Artificial Sequence
  Synthesized
  misc_feature (61): n=t or c
gcaagtcatcattaaaatggccatttgtgggtaagaacaaaatcctgagaaaaggttagcnctcacatgcttttgaaaagccatgcgctttgttaaacaaaaccaccacaacacaagctgc

SEQ ID NO: 3172 - DNA, 121 bp, Artificial Sequence
  Synthesized
  misc_feature (61): n=a or t
caattcaaaaacatactggtcgttttatacgtaacatttaaaaattatactaaccatttancaaacaaaacacactacttggtttctgtttctgcacatgacaagactttaagtagaccac

SEQ ID NO: 3173 - DNA, 121 bp, Artificial Sequence
  Synthesized
  misc_feature (61): n=t or c
aagatgcattcagcacttaaggacaaagatttctcaaggatgttagaactgaccaaaatangaaagctatttcagatcataactttcagctatctgcaatagctctattttaaccatttta

SEQ ID NO: 3174 - DNA, 121 bp, Artificial Sequence
  Synthesized
  misc_feature (61): n=t or g
gtctccattcagtgtgcccgagtaggaatggttcctgactagtgtgaaatcctgagatatntcctctggagcttcctggccagtccatccagggcagcacagtctctgacacagcttccta

SEQ ID NO: 3175 - DNA, 121 bp, Artificial Sequence
  Synthesized
  misc_feature (61): n=a or g
tgagctgctgtctcgtctgttgcccagatgttctcacctcaggtgcactgcctgtgcttgnagaagtgtgggttccttgcctcacctgaggtttaccatcaccctgctctcagccctgcca

SEQ ID NO: 3176 - DNA, 121 bp, Artificial Sequence
  Synthesized
  misc_feature (61): n=c or g
aatccccttcgtgaaagccgtcaaagcctaaaatgaaaaggaaagagggtggtagaaaganagcattggctgcgtttcccaagcaggcaagtcctggggcacaggcagacctgaaccaccc

SEQ ID NO: 3177 - DNA, 121 bp, Artificial Sequence
  Synthesized
  misc_feature (61): n=t or c
aaaaggaaagaagctaaaccgggcaggaagaatattctggcaccagttcctggcaggcacnggggccttgtttattatttcatgcattttctctcttctgctcatacagtcagctcagatc

SEQ ID NO: 3178 - DNA, 121 bp, Artificial Sequence
  Synthesized
  misc_feature (61): n=t or c
tcttttttagtaaatgaacaacgtgtttgtatttagatatgtatatgttctcatatcgctncagtactttctgcttgcatattagcaattattttcttcacttatacaagagaactttgtg

SEQ ID NO: 3179 - DNA, 121 bp, Artificial Sequence
  Synthesized
  misc_feature (61): n=a or g
ctttttgctatgcttaaatgattattttcgagtgtgctatgttattatttcactgtgaagngaaatttttatttgttccattactgagatttggtaatgaaagaattcagtaaatagcagt

SEQ ID NO: 3180 - DNA, 121 bp, Artificial Sequence
  Synthesized
  misc_feature (61): n=t or c
gttggagtcctggagggaaagggattaagtggaaagtgaaaccggtatataatgaatgaangaatgagatgggactttaggagaagctgatggctgtgcatgggttgtgagactttctatc

SEQ ID NO: 3181 - DNA, 121 bp, Artificial Sequence
  Synthesized
  misc_feature (61): n=a or g
acaggaaagaatagctttgggttatctggtgccagtgtgctaagagtgtctgttggactcnctgtattttcagatgaaaagtgacatattgaatctataaaatacacttctatattactgt

SEQ ID NO: 3182 - DNA, 121 bp, Artificial Sequence
  Synthesized
  misc_feature (61): n=t or c
aatgttcaactgtttgcagttctattgttagattgctttgttatgtgatacactccctgantgcatgcgctgtgacactgggaatcataaaacccccattttggaaatgaactctggtatg

SEQ ID NO: 3183 - DNA, 121 bp, Artificial Sequence
  Synthesized
  misc_feature (61): n=t or c
gaattattttgtgactggaacaatctatctgaatacaccatgaaaatctgcaaagatgtgnatataatgatgtatagtgtcctaatatattttctcagttctgtagtcaatgaaactctat

SEQ ID NO: 3184 - DNA, 121 bp, Artificial Sequence
  Synthesized
  misc_feature (61): n=a or g
tttctttagtttcatgcttaacagctgcaaagtgagatggcttctttcttctactaggtcnaacttaaacatggtcagctatcaaactctgacctgttagaatcatgggcctttcttttac

SEQ ID NO: 3185 - DNA, 121 bp, Artificial Sequence
  Synthesized
  misc_feature (61): n=t or c
tttgacatgaatcaactctgtaaatgtatgcaaagcaatattttctggtttgcaaatttantctgacattgggattttgtaacagaactatagcagtttgcattttgttgtacattatata

SEQ ID NO: 3186 - DNA, 121 bp, Artificial Sequence
  Synthesized
  misc_feature (61): n=a or g
ataccaattttcatgcactttaaataagagctgagtgaaacagctgtctgttttaggagtnccaaacattggtatcctgccatcacactacttgtgtgcatgtcaggttatatcatgttga

SEQ ID NO: 3187 - DNA, 121 bp, Artificial Sequence
  Synthesized
  misc_feature (61): n=a or c
aggtttagaccatatttatagataattctggacaaaaactaaaatcttacaacacattctngaggctagagtaagaaaacaattccagtatcaaaaagaatgcctggaattatggactcaa

SEQ ID NO: 3188 - DNA, 121 bp, Artificial Sequence
  Synthesized
  misc_feature (61): n=a or g
cttctcctcactgaggcaactcaaatagttgcatggtatagcagagcttgcgtggaggtanttgttactgtatacactcttctaactcctattaaagatcttttgggacctccataaggaa

SEQ ID NO: 3189 - DNA, 121 bp, Artificial Sequence
  Synthesized
  misc_feature (61): n=t or c
gctccttcccaagatgggacactttaaatagttgagcataagacaatgaaaaaagaaatanttcttgcttacagggagtaacttattattctctggaagtgagttagccagattctctagt

SEQ ID NO: 3190 - DNA, 121 bp, Artificial Sequence
  Synthesized
  misc_feature (61): n=t or c
cctaattgcaccaggacgctgtgagaacagacaggatcaggtacttcctttgcccatatanagtcttaccattagctgctctgaaaggaaatatgagcatagctacattcctggtttcata

SEQ ID NO: 3191 - DNA, 121 bp, Artificial Sequence
  Synthesized
  misc_feature (61): n=t or c
agaacctttacacatcttgatctactgtggtctaaaccacagcactgaggtcagcgcaagnttaggggatgcttctgtcctgttcaccatcttttcccagaggacatgaagatgttttaca

SEQ ID NO: 3192 - DNA, 121 bp, Artificial Sequence
  Synthesized
  misc_feature (61): n=a or g
ttattattccaccattctttggcgtagcaaagaaaggcatgaaaggatacaacaccaccanatttgaagtttgggaaaacaatggaagtaatgctgcttgatattcacagtcacgcaattc

SEQ ID NO: 3193 - DNA, 121 bp, Artificial Sequence
  Synthesized
  misc_feature (61): n=a or g
tacatgcattctagtaaattaaatagagtcagaacatgggtacagaacatacatacatatnctggaacatacttatctgctctattcaattgctagaacagtccttggcatgatttttgcc

SEQ ID NO: 3194 - DNA, 121 bp, Artificial Sequence
  Synthesized
  misc_feature (61): n=t or c
tcctttattctacctgtgatcctatactcatcatctatatttttaatccaagtcatagtgntgcttccaatgttgctggggtaatattgatttaaaaaaaattgtaacttctgaatagtgt

SEQ ID NO: 3195 - DNA, 121 bp, Artificial Sequence
  Synthesized
  misc_feature (61): n=t or c
agaacatacccatccttacaaaactggacagattgcctgtgttgttaaatgtcccaaagangggaagtggtacagagcagctgttgtgcagcaggtatccccaaatgaagttgatgtgatt

SEQ ID NO: 3196 - DNA, 121 bp, Artificial Sequence
  Synthesized
  misc_feature (61): n=t or c
ttctagaggtgtatctagaggtgaaaggatgtttccttatgtcttgtgactcctatccttntcttccttggccgtttctcccagtttggtatgggcaaaaatcagaggtgtgaggtattcc

SEQ ID NO: 3197 - DNA, 121 bp, Artificial Sequence
  Synthesized
  misc_feature (61): n=t or c
gcaccttagttcaaaggcgaattctgggcaatgtctggagatacctaaataacatcagctnccaaagactcctgagaaccactccagtggactgtgatgagcaacccccaatatatattcc

SEQ ID NO: 3198 - DNA, 121 bp, Artificial Sequence
  Synthesized
  misc_feature (61): n=a or c
ttcattaaaaaataactcctcaaatgtccagctctgagatttttaagcttaatttaatggnaatcatggtactgggagtcaataaaaagaatgaagatgaagttctattttccagttctgg

SEQ ID NO: 3199 - DNA, 121 bp, Artificial Sequence
  Synthesized
  misc_feature (61): n=t or c
tcatttctttttttatttgtttgtttccacaacagaaggaatcggcaagggagctgtatanatcagtcactcttcacatagcaaaataccacagccacattaaaataccatggtcatatct

SEQ ID NO: 3200 - DNA, 121 bp, Artificial Sequence
  Synthesized
  misc_feature (61): n=a or g
actttctattacttacacaaatggttgcttgggctatttttattcaaggaaatgaaggacnttcagaatttgagttcaaacattgccctacacccatctttccaagatacttgccaagtac

SEQ ID NO: 3201 - DNA, 121 bp, Artificial Sequence
  Synthesized
  misc_feature (61): n=a or t
ggacattgatactctgcttcccctggtgtgtgatgcattcagtcagctgcaattgctctgnggactgcattaagtgttttgactagatgactgttaattataacatgagtttacatgtcta

SEQ ID NO: 3202 - DNA, 121 bp, Artificial Sequence
  Synthesized
  misc_feature (61): n=a or g
agaaaaatgtgactgagtatcaataaaagataaaatctacatccatcaagcagtagatacntaaagaattgctggggattcaaatccaaagatgattctctcctagcaagcaagatcacca

SEQ ID NO: 3203 - DNA, 121 bp, Artificial Sequence
  Synthesized
  misc_feature (61): n=a or g
atggaagcagcgttgccccacagcagctcccaatgccactgcagggcacagtttgccagcnttcctacgagcagatctatgcacaggtggtgaaccccactcagaaacacacagggataca

SEQ ID NO: 3204 - DNA, 121 bp, Artificial Sequence
  Synthesized
  misc_feature (61): n=t or c
aatgcatccaaagaacaacgtcatgctggtcagcctgatgtgataaccactgccgaaatanaacaaaaatactggaagaaagcacatgagatgctgaaaaaatgaccagtccatttgtgac

SEQ ID NO: 3205 - DNA, 121 bp, Artificial Sequence
  Synthesized
  misc_feature (61): n=t or c
gcatgtggagtgggcaggactgcacctgctgagacttgcagaagttgggcagctgggaagnatctctgccagtcattcttccaaaggaactctgcagaaaagggtgttcatgaacatgcaa

SEQ ID NO: 3206 - DNA, 121 bp, Artificial Sequence
  Synthesized
  misc_feature (61): n=a or c
cctctgctgtgattagtgtaaaaatgaattgtaatgactcagtatcagcttgataggtatngaaatagacaggaaatagtcgtgggaaaaactgccaaaaatctgaagagcagctgacaga

SEQ ID NO: 3207 - DNA, 121 bp, Artificial Sequence
  Synthesized
  misc_feature (61): n=a or g
ttcttgcagcttccttcctcccttcagtgctggcaggtctggaggtttcgtgacgtaaatngtgccttttgaaggtgcgtgcttgaagaatttcagtcttgtgtgtttaaacaagagaaaa

SEQ ID NO: 3208 - DNA, 121 bp, Artificial Sequence
  Synthesized
  misc_feature (61): n=t or c
ctgttagggacatctgcggagctggagctgagtctcctgagtgacacctagagaccgtttnagtgagatcaacattagttaggaccagcaccagagcatggtgcatcagaaaggcatggtg

SEQ ID NO: 3209 - DNA, 121 bp, Artificial Sequence
  Synthesized
  misc_feature (61): n=a or c
gtggccaccaaagtgctgtctctgtggtgtgggagtgatgcttgtccacactgtattcccnaaagggcaacaaaatgcccctctgcaggtagcatccaggaggttcttaacggatccccct

SEQ ID NO: 3210 - DNA, 121 bp, Artificial Sequence
  Synthesized
  misc_feature (61): n=a or t
aaaccctgcagttgtatcgctgagcagaaacagaagtggcttagcaggtgaaaagtgtttncgtgcaaatgggtgtgtcggacatcatctgcagcgctgttgttattgccagtggtggctg

SEQ ID NO: 3211 - DNA, 121 bp, Artificial Sequence
  Synthesized
  misc_feature (61): n=t or c
ctgctaagaccttgactgtcatctaatccaataaattcctctgtgggagaaagcatcatcncgctcttctggtttatacaagcttgaggatgacagcaggagaaatgagttgctgaacgtt

SEQ ID NO: 3212 - DNA, 121 bp, Artificial Sequence
  Synthesized
  misc_feature (61): n=c or g
aagtgatctgacatcctctgcagagaggcagaaacacagcactgtagcattcccgagatgnagaaactgagctgatctgattttctaaagatagttgggacactttgatcgcatagaagca

SEQ ID NO: 3213 - DNA, 121 bp, Artificial Sequence
  Synthesized
  misc_feature (61): n=t or c
ccctcatttccacaccgctcccatcttttctctttggctttgttctagccagctgatactncttttcagtctctctgggctgaacacgggataaagttgcaaagtttaaatcaggaggttg

SEQ ID NO: 3214 - DNA, 121 bp, Artificial Sequence
  Synthesized
  misc_feature (61): n=a or g
acgtgagtcttttgtagcaaatggcatccgtgtccaggcatgttcctatcacctcacatcnatctataaaattaaattaactgggggccttgctataggtcttgtcctttactgaaattga

SEQ ID NO: 3215 - DNA, 121 bp, Artificial Sequence
  Synthesized
  misc_feature (61): n=a or g
actgcacaatggagtcaaaactggaatgcctgcatgccttcaaactgctgagcatcaaggntagcgcttcaagattttggttttattcgagaggaaaattagattatgcttcacttggcta

SEQ ID NO: 3216 - DNA, 121 bp, Artificial Sequence
  Synthesized
  misc_feature (61): n=t or c
aaggaaaatttgggcttcattggaaagatagtacagttggtgctattcaggtaggaaatangatggtctgtggtgtcatcagtcttgtgttgctctgaaaggcattactttagattaagcc

SEQ ID NO: 3217 - DNA, 121 bp, Artificial Sequence
  Synthesized
  misc_feature (61): n=a or g
gcagcctgaggctgaaataaaacttgcaagggacagaacaacagccaaggacaggaggtcngaggaaggattcggtccaattcacgtaggcactcaatttgcaaattagttttatgcgcca

SEQ ID NO: 3218 - DNA, 121 bp, Artificial Sequence
  Synthesized
  misc_feature (61): n=a or t
tttatgaagaaatggaaaacgtggggaaagaaaacaagaagagatccaacagtgtcccctnatccatacctccttaaaatgaagatctgagaattagtgctgctccataagggagaaggta

SEQ ID NO: 3219 - DNA, 121 bp, Artificial Sequence
  Synthesized
  misc_feature (61): n=t or c
gactgcagcatccacctccctgagatgaggatgctaccgagagaggcagcctcaaggttgngctttgcacatgggctgctgcaagccaaaggctcaccctggagcaaggaaggctgagcca

SEQ ID NO: 3220 - DNA, 121 bp, Artificial Sequence
  Synthesized
  misc_feature (61): n=t or c
ctctccggcccaggagcagctcctttcgaggcacacaagcacccaggggaagaaaaaatgntttcatttcctacccagctttgtccagaccttggggaaacttcagccttgaatcaacagc

SEQ ID NO: 3221 - DNA, 121 bp, Artificial Sequence
  Synthesized
  misc_feature (61): n=a or g
ctctgcaccacttgttctctaagtagaaagagaatcctgtattctgctgctctcgtctgtngacaaaggatggaaaagcaagtgactaccaaaaaaattcaaattcctatacctgttatca

SEQ ID NO: 3222 - DNA, 121 bp, Artificial Sequence
  Synthesized
  misc_feature (61): n=a or g
tgagctgtcagtaaagttcaggatgcttcttgcattctccagagaggcttctccattccantcctaagagctgtaatactggtgatggtgaattgtcccctgtatggatgagggggctcat

SEQ ID NO: 3223 - DNA, 121 bp, Artificial Sequence
  Synthesized
  misc_feature (61): n=a or g
gaaagtattgattagggaggatcagtagcagtttataaaagaattggcaataaaggcttcntgcctttgcagggcatgagttttgtgagagggctgtcatctgggcttcccgcagttggtg

SEQ ID NO: 3224 - DNA, 121 bp, Artificial Sequence
  Synthesized
  misc_feature (61): n=t or c
cacttttcctgagcttgtccagatgccaaagatttgttttgtgcctttattcatgtgaaangctctcgttgtttcatgctgctgatctcacagaaagcaaacctgggatctctcagaagca

SEQ ID NO: 3225 - DNA, 121 bp, Artificial Sequence
  Synthesized
  misc_feature (61): n=a or g
tcctgcccgttttcttagtgcatgcatttaacatttaaaaaatccctcttagagtctcatntatcagcctcctatctgaaaatgcacagtgaatcaaattttataccagtctcaaagtcac

SEQ ID NO: 3226 - DNA, 121 bp, Artificial Sequence
  Synthesized
  misc_feature (61): n=t or c
gggatcaagctcacgctgacccccaggaccactctcaccacaacaccctcagccctcactnctgtgcagcctgggagaacctgctgcattgggaaggaggtgaatggaggagatgcttcgt

SEQ ID NO: 3227 - DNA, 121 bp, Artificial Sequence
  Synthesized
  misc_feature (61): n=a or g
tgaagagaccaagaagcttttaaacttagaaaaccacattttatgtgaatagaagcaagangcctccattttcaaagggaaaaaactcaaagcaagcagggaacagaaaagaaataaaaag

SEQ ID NO: 3228 - DNA, 121 bp, Artificial Sequence
  Synthesized
  misc_feature (61): n=a or g
gcacagaacaaaggtttgcatttgcaaatcaataaaaataaatgtgaagtgaagacgcggnaatattttaacataaatctgcataaacccttaccctggaaatgcctgtgcacgtgttggc

SEQ ID NO: 3229 - DNA, 121 bp, Artificial Sequence
  Synthesized
  misc_feature (61): n=a or g
agaaaggaatctcccttctgctgagctctgagaagcattcaccaaccatgaagcatgagcnaggaaacaaaataaccacagtgattctgggtttgtttgtttgtttttcatacaatgggat

SEQ ID NO: 3230 - DNA, 121 bp, Artificial Sequence
  Synthesized
  misc_feature (61): n=a or t
tatatgagctgattactgctgcctgtgctgtacccacaccacctttatcattaatgaaacngttgaagacagccggactcaatgttgacccttgaggtacaccatttcttactgacctcca

SEQ ID NO: 3231 - DNA, 121 bp, Artificial Sequence
  Synthesized
  misc_feature (61): n=c or g
attcggcaacccgctgtctacctccttccatccacaacgagcgagtgattgagggcagggntgaggcagcactagagtcagagctaggcacagtgtagggaggctgtggaaggggatgagt

SEQ ID NO: 3232 - DNA, 121 bp, Artificial Sequence
  Synthesized
  misc_feature (61): n=t or c
aagatacctttgtagcttggcactgaggagctgacaagttgaggtgtgttcctgctggtgngtgctgggagccccatgttatactggcttgtcagtggcaggaaaaggggctgggagtgat

SEQ ID NO: 3233 - DNA, 121 bp, Artificial Sequence
  Synthesized
  misc_feature (61): n=a or g
agagaaaggctgagagtatggaatatatttaagaagttgaaactttaatgatataagttgnagatatgagagttagcaggcgtttttattctgaatttcctgcatggttggtttgtgtgtt

SEQ ID NO: 3234 - DNA, 121 bp, Artificial Sequence
  Synthesized
  misc_feature (61): n=t or c
gcactcagtggcttagcaggaccagaaagctccagaagtaaaaggcttcagatgagactcnatttcagaaagagctccatgctgagctcagtaactacttgcaagaacctcatttatagga

SEQ ID NO: 3235 - DNA, 121 bp, Artificial Sequence
  Synthesized
  misc_feature (61): n=t or g
ctcagattttcacaaaatggctacaaaaggaaaggggttgacagaagattcctattgctgntgctgatataaaactacatggagaaagacgttctctctttctttccttacaacttctagt

SEQ ID NO: 3236 - DNA, 121 bp, Artificial Sequence
  Synthesized
  misc_feature (61): n=t or c
ggcaaaatagtttgatgtcagtgagcttaatactcagaagtcattgctgggagatggaagnggtcacactgttcattctgtgctgtaggtgcagtattgggctgctgtgagccacctgagc

SEQ ID NO: 3237 - DNA, 121 bp, Artificial Sequence
  Synthesized
  misc_feature (61): n=t or c
ttttcaaacacatgctaaagcaaaattagatcacaataacctacattcctccaacacgccntcctgatgcgaatctcaaattttgtttcaaattcagagatttgttttccttgttaaagac

SEQ ID NO: 3238 - DNA, 121 bp, Artificial Sequence
  Synthesized
  misc_feature (61): n=a or g
gggggaaaaaaaaagtacttttctaaagtgcttgcttatcaatggaaagtgaacaaagtcnccatccacccaggtgtatttcctagaaaacttaatactcgggtggcaggacaggtctcat

SEQ ID NO: 3239 - DNA, 121 bp, Artificial Sequence
  Synthesized
  misc_feature (61): n=t or c
tgggacaaatcaactctcagtgttgccttccccacaggcgctcacttaaacatctcatcanctcctggcatggtacaaaccatcaccaattgttgcaaagctcagacaagggcagtctctg

SEQ ID NO: 3240 - DNA, 121 bp, Artificial Sequence
  Synthesized
  misc_feature (61): n=t or c
gaactgtggcaaataaagctgtctgtagagtactgagaattttcagccctcctagaattantgatagggctcatgtcttgtatctcagtgaaacatagctttcctctactcctaagaatat

SEQ ID NO: 3241 - DNA, 121 bp, Artificial Sequence
  Synthesized
  misc_feature (61): n=t or c
cagggaagtgttaaaccatacatctccacatttgtcacgcgctttggccacataagcaagncactcaattcctgcctggagcaaaatatttacattgatgaaatcacattcttgcttcaac

SEQ ID NO: 3242 - DNA, 121 bp, Artificial Sequence
  Synthesized
  misc_feature (61): n=a or g
aatgctctagtctacacaccagaataactgctactgcttgccatcatgattctaaggcatnaattctaatgtagatctcccttacttcaaggaaattatctgtgttctgcgaaaggttgct

SEQ ID NO: 3243 - DNA, 121 bp, Artificial Sequence
  Synthesized
  misc_feature (61): n=a or g
cattaacagtttcattttatatctatttagtggtaatattcccactattgcagaaaataanttacagatctgtagtatctgaaattgtctcttcatcccaaccaacgttgaaccatacagt

SEQ ID NO: 3244 - DNA, 121 bp, Artificial Sequence
  Synthesized
  misc_feature (61): n=c or g
actcctgttcgaagttaaagctttttcaccttctaattgtccacattttgggcataggcancattttagactagaactaacgttgccctgttggtagtttatgacatagttttgtttactt

SEQ ID NO: 3245 - DNA, 121 bp, Artificial Sequence
  Synthesized
  misc_feature (61): n=t or c
tatcaagcagtaggactattgagatgttagtacttttctagcaaaacgacatctagtcagntttataactgtctagtatctttaaggtaagcttggttctggcatctgtaaattacagttc

SEQ ID NO: 3246 - DNA, 121 bp, Artificial Sequence
  Synthesized
  misc_feature (61): n=t or c
ttagaagtttttattattattatttcttatgaggctccataaaggaatactaagctattcntagtggagttaagtttgtgaagaaaatggaaacctccatcttaggtgacccaactatagt

SEQ ID NO: 3247 - DNA, 121 bp, Artificial Sequence
  Synthesized
  misc_feature (61): n=t or c
gtgtagacggggtaaaataaaaggaaaaagaagggaggctgtggaatgggagtaataatgngagagtttcataattacttttaattatttcacttacgttatttatagtattagctagaca

SEQ ID NO: 3248 - DNA, 121 bp, Artificial Sequence
  Synthesized
  misc_feature (61): n=t or c
gctgttgacaaaagtttaagggaattgaaatgaagtctgaaatatccttcctgccttcacnatggaagccctagggtgctacagactgtgaaagattagtaattagaggctcaccttctgt

SEQ ID NO: 3249 - DNA, 121 bp, Artificial Sequence
  Synthesized
  misc_feature (61): n=t or c
accagcctgagcagaaatgggatgggaggaggggctgtatctttctttttagcacagccangagtgagctgttctgtattacataacactgagtaaacatgcccaaaatatgagattcgtt

SEQ ID NO: 3250 - DNA, 121 bp, Artificial Sequence
  Synthesized
  misc_feature (61): n=a or g
ctcaggcacaattacatggtaaaaaccctttaacctttgtattggatgtactcagaagctnccagatacactgcccagcccaagctgctgccttccatctcagccactgaagacctgcatt

SEQ ID NO: 3251 - DNA, 121 bp, Artificial Sequence
  Synthesized
  misc_feature (61): n=a or g
gacagacagatcttccattcacttgttcacaagtggcagaatctaacacgggtgtatgtcngaattctttagttcccaagatcttttctaaggtgttagcttattcataaggaaagattaa

SEQ ID NO: 3252 - DNA, 121 bp, Artificial Sequence
  Synthesized
  misc_feature (61): n=t or c
cccctctgctgctttggctgctgctgctgtgcagtagctgagctgagccctaaaagctganatggcttggaatgggccaagccaggaagcaaatgcaaggtaaagcaagaggtgggggggg

SEQ ID NO: 3253 - DNA, 121 bp, Artificial Sequence
  Synthesized
  misc_feature (61): n=t or c
ggcttccctggtgatatataggggaaggagtgacagacctttacataatttgtaaaagacncatttttatataatacattcataaaaacagcagctgagattgatgaaatgctttggctgt

SEQ ID NO: 3254 - DNA, 121 bp, Artificial Sequence
  Synthesized
  misc_feature (61): n=t or c
acagtgcaagctcatatttatactgcaaaattgcaagatgataataagagataacggagtnatttatctaatcaataaaataatgactacgtgcttcatgcaggaccagaaacaatgctca

SEQ ID NO: 3255 - DNA, 121 bp, Artificial Sequence
  Synthesized
  misc_feature (61): n=t or c
agagtattccattgcagatctttaaagtcaggactaaaatctgcctctcccatctacagcnatttggcacccatagcttttttcagccagacaccactatcataacaaaatgttcagaagc

SEQ ID NO: 3256 - DNA, 121 bp, Artificial Sequence
  Synthesized
  misc_feature (61): n=a or g
aaccgggggagagctagaaaaacccaaagggctagctgtagctgcaagggatccacagcantatgaagtagctgcatcagggaacacatgagccatgctattttcactcttaaatggattt

SEQ ID NO: 3257 - DNA, 121 bp, Artificial Sequence
  Synthesized
  misc_feature (61): n=a or g
cttagcaagtcatgttcagcttcctggagttcatggaaggacctcaagcaggaggtgggtngtgtccatgagctgtaaaggcaaagcatgggttctttgctgctgctgccgtatttcttac

SEQ ID NO: 3258 - DNA, 121 bp, Artificial Sequence
  Synthesized
  misc_feature (61): n=a or g
tgtctgccttcttgttttgcacacagggccactctgacagccagctggcagaatgtttgcntccccaagacaaaaaggaaggggttaactttcatgcagtgactgaagctgggtcagtcct

SEQ ID NO: 3259 - DNA, 121 bp, Artificial Sequence
  Synthesized
  misc_feature (61): n=a or g
tgtgtaaatcttctgggagaaggaattatacagaagaaagcaaacagaattttcctaaaancatctcttagttttgggacagcaaaatagaaggcttgacattttgttacctgcaaaccga

SEQ ID NO: 3260 - DNA, 121 bp, Artificial Sequence
  Synthesized
  misc_feature (61): n=t or c
agatcaaaggaaaactgtagacttgagccgagatgtaataaagagggtctgcatgcatttncaggtatcccaaaatagatgccagtgattgaaatgcatctactaaagtgaattttctgat

SEQ ID NO: 3261 - DNA, 121 bp, Artificial Sequence
  Synthesized
  misc_feature (61): n=a or g
gtatcactcttgaaaatagactctgctggtcaagcttcgctcctcagccaatagttacctngccatttttaagtggagcccagccatttcttcagtagagcaccacatgattttaaataca

SEQ ID NO: 3262 - DNA, 121 bp, Artificial Sequence
  Synthesized
  misc_feature (61): n=t or c
ttcttaccctgtgtgggcaagaggaaagatttctttgggatcacctttatctttactgcgnaagaagaacaaaagcagtggtggtggattttttttttttatttttaagtaggatttcttg

SEQ ID NO: 3263 - DNA, 121 bp, Artificial Sequence
  Synthesized
  misc_feature (61): n=c or g
aggcatgtatcttggtcttcatctctgaggagctctagttcagaaatgcactggcagtacntaacattacagcatgagctgaggtgctatatatctgagcaatgaacagcttagtcttgta

SEQ ID NO: 3264 - DNA, 121 bp, Artificial Sequence
  Synthesized
  misc_feature (61): n=a or g
gtaggagaggctcagacagttgtctcagcaccacagagcctcaagcccagcagcagggcanacagtagcagaccaagtggctccttcactgcacctgcccaaagttgtgtcagtaggtggg

SEQ ID NO: 3265 - DNA, 121 bp, Artificial Sequence
  Synthesized
  misc_feature (61): n=a or c
gctaagccacaggaggaaaaaagacttggggactgctgagctaatgatgtgacaggagagntgaaatcccccaggactagggcctctagaggggaccagaggccctaagttgaaataacaa

SEQ ID NO: 3266 - DNA, 121 bp, Artificial Sequence
  Synthesized
  misc_feature (61): n=a or g
tttgtctaggaacaggtagctcttagtacagcctaggtctacagccaaatgaagaaatccntccagcactggcctctttttatacgttcccagattccaaaataacatttttgtatcacat

SEQ ID NO: 3267 - DNA, 121 bp, Artificial Sequence
  Synthesized
  misc_feature (61): n=a or t
tatttgatgcacaatgaacatggttaagtgttaagaacaaagttcagcttttagaaagacnttgattgattatgttcttttaaagtattttaaagtgtctttggttgcgctggtgtccatg

SEQ ID NO: 3268 - DNA, 121 bp, Artificial Sequence
  Synthesized
  misc_feature (61): n=t or c
aaacttaatccagggaccagaggctgcagtactcagagctcttgcaaagctgaataagtgngcagcagcccagggaaaggagtggctctcaaaggagaggttgtatcggaacagacacgaa

SEQ ID NO: 3269 - DNA, 121 bp, Artificial Sequence
  Synthesized
  misc_feature (61): n=c or g
ttttgtcccttctatttaaccttggatgaatttatagattatattcatttagcgacagatnccaggaaatattctctaaagagaatgcatttatggagtattgcatttaccacttaataga

SEQ ID NO: 3270 - DNA, 121 bp, Artificial Sequence
  Synthesized
  misc_feature (61): n=a or g
tttgataggtaacttaaaacactttgttagttagttcttaatcctctgctggaaaagcacnaggaaatgccagtattctttatacagatagcctacagagtgccttattgcaattgtaaga

SEQ ID NO: 3271 - DNA, 121 bp, Artificial Sequence
  Synthesized
  misc_feature (61): n=t or c
gaagaagaatgcagcacagaaagatgagagtgggagctgcctgttgtttgaacctcacagngctggtttgagaattaatggtttggtggtgctagttacatagggcatgaacagagaggtg

SEQ ID NO: 3272 - DNA, 121 bp, Artificial Sequence
  Synthesized
  misc_feature (61): n=a or g
atgaaatagtttttgtcctgtttagaagtgtcaagaggtgacaagatgctttatgtaacantggtttagtaaatatacaacagctgcctatctcaaagtagtatttctgagtggaaatgac

SEQ ID NO: 3273 - DNA, 121 bp, Artificial Sequence
  Synthesized
  misc_feature (61): n=a or g
tgagaactgggtcactcaacttgaagccaacataaaaatataaacattgcatgtacttcanctgtgtccctaatttgatagaaacgctgtcatttgtttgattcagatgtggctgtgctgg

SEQ ID NO: 3274 - DNA, 121 bp, Artificial Sequence
  Synthesized
  misc_feature (61): n=t or c
ttattgaaggaaaagccagcacacttgtcttcctcttgatgtaagctgttcttttctgcanaggcaatgtacaactgtagggagaggcaggcagctgcttgaagaaacagttgctactgaa

SEQ ID NO: 3275 - DNA, 121 bp, Artificial Sequence
  Synthesized
  misc_feature (61): n=a or t
tgcagaagtgttcaacaattgtcagtctccgtgtggagaattgctctggcaacttggggcngagcatccacatcaaagcagctaatgcattgatttttatttttctttaaatcaacagatg

SEQ ID NO: 3276 - DNA, 121 bp, Artificial Sequence
  Synthesized
  misc_feature (61): n=t or c
gtggctctgtgtgtagaacacaacataaggtttgtgaagctctcaaaaattagaaaagcangttgctttgtatctcatttctatgtaaaattaatgaaaataaagcagtgcacttcccatg

SEQ ID NO: 3277 - DNA, 121 bp, Artificial Sequence
  Synthesized
  misc_feature (61): n=t or c
tatgctcgtaagtagtacaactacaaagaataccaatgaatcaatcatctgttgctcttanaactcggctgacaattgtgctgttgcagaattactgtttggagaggagaagcatgcgcat

SEQ ID NO: 3278 - DNA, 121 bp, Artificial Sequence
  Synthesized
  misc_feature (61): n=t or c
cagctctcgttacaacattactacacaacacagtttattttatatagcattcagaagacanagtctcacacatacattaaagaaagggggagagaaagagaagtagttgcaaacaaaaaga

SEQ ID NO: 3279 - DNA, 121 bp, Artificial Sequence
  Synthesized
  misc_feature (61): n=t or g
ctcagtatttcaaaggctgtttttaatctatgtttttgtccgcagattaaaggttttctantgtctgaggctgacaagaatgagtacccgaacatttgcattgcaatcaggctattcataa

SEQ ID NO: 3280 - DNA, 121 bp, Artificial Sequence
  Synthesized
  misc_feature (61): n=a or t
acacttgaacataccaaagtaacaacaagatttcaagttagaaagctcagatgtgtgaggntgtaaactccccagagcagatgtcacagctgaaatcttgccaccatgaagacatagggaa

SEQ ID NO: 3281 - DNA, 121 bp, Artificial Sequence
  Synthesized
  misc_feature (61): n=a or g
acacttatatgacattgcacttcagaagcttcgattgttccctctttttctgttatctgcnctcattttattaacatgacttgatagagtgggatataatccctcagtcccgagtgctcct

SEQ ID NO: 3282 - DNA, 121 bp, Artificial Sequence
  Synthesized
  misc_feature (61): n=a or g
aatgctattgaatgaaatgtaaatgaaataaatagatatgaggttgtgtttggtagtgtgngcagtgtgtactgtctacaaagaattcaagaaaacaaagcgtactgtcatgaaaatgatc

SEQ ID NO: 3283 - DNA, 121 bp, Artificial Sequence
  Synthesized
  misc_feature (61): n=t or c
tttatttatttatctacttatttctgtattaatagctttgtctttttaagagaagaagacnttcctccaccatctttctctagcctctgctttattttattttttgcgacatcccacactt

SEQ ID NO: 3284 - DNA, 121 bp, Artificial Sequence
  Synthesized
  misc_feature (61): n=t or c
tggctactattgtttgtttacttggtaaataaattcatactgatggagaactgcacagganatgaagagtggagggaatgatgaaaaatgagatattactatcttttccttaatcttgaat

SEQ ID NO: 3285 - DNA, 121 bp, Artificial Sequence
  Synthesized
  misc_feature (61): n=t or g
aactggtagttaaagcatgaaatgtttaagcctggagatatagtgaagtgcagatgtgtcnttctttgaataaaaactaatagttttgctatggaatcatagctgcaggctttttaggagc

SEQ ID NO: 3286 - DNA, 121 bp, Artificial Sequence
  Synthesized
  misc_feature (61): n=a or g
attttgaatgtgtagaaggggaaaggcatggataatgctaatggttcaatagcttagtggntagtgatggtgatagaaggatggttggactagatcttgtaggtcctttccaaacttgtga

SEQ ID NO: 3287 - DNA, 121 bp, Artificial Sequence
  Synthesized
  misc_feature (61): n=c or g
cacagcactcaattaaatctaatgtccctctctttgaagggttccagctccagggataccnacgttgtctctgtctaaacaaacaggcatagattgtgcttgtttaggaacagttgagtca

SEQ ID NO: 3288 - DNA, 121 bp, Artificial Sequence
  Synthesized
  misc_feature (61): n=t or c
aaaaaacgcatagtctgagtcctaattctataaatggcaagaagaatttggttacacctanatcagtgatagaaatctagttctcatggcaaactatgcattattgctttgcaggaataaa

SEQ ID NO: 3289 - DNA, 121 bp, Artificial Sequence
  Synthesized
  misc_feature (61): n=a or g
ctacgtctcttcaaacacttttggtcaccagtaggctgctccaatgattcttctaggcacnagaaagaaagtgacaactagggaaataataaaaataaaaatatcccttgggatattactg

SEQ ID NO: 3290 - DNA, 121 bp, Artificial Sequence
  Synthesized
  misc_feature (61): n=t or c
tttcagtggtgtgttgaaacaaatgtacccactctctttgtctctgtctcagaagcaaacntctgtgtctgtcctccagataggagagcagaagtgagtgctttgaacttggccttccaaa

SEQ ID NO: 3291 - DNA, 121 bp, Artificial Sequence
  Synthesized
  misc_feature (61): n=a or g
gcagagttactgataattatcttcacattatgctatgccacaaaacatactctgttatatnaccacatacttcaggcaaagaaccagagagatatccaatttctgcataccaagttcaagt

SEQ ID NO: 3292 - DNA, 121 bp, Artificial Sequence
  Synthesized
  misc_feature (61): n=a or g
taactcaaatatttctgttatttgacaggcctgtttaactttcacaatttcaccccctttnctctgaatttcctcctcgttaaagtctgtttaactttaccaactttagttcctttattct

SEQ ID NO: 3293 - DNA, 121 bp, Artificial Sequence
  Synthesized
  misc_feature (61): n=t or c
aaactaggttgatagtattttttaacccttcagagcagaactgacagtaagcagtccaatngcaaattaacaaagactacaaaacatattatcccatttaaatgtcattgtggctctcaat

SEQ ID NO: 3294 - DNA, 121 bp, Artificial Sequence
  Synthesized
  misc_feature (61): n=t or c
tatttttatgcagaaattctctaacaaatagctactatttgagtggacttaggacaaaacnggaggattcctactgctgtattcccatgctagtgcttggagtatagttcacattagtgag

SEQ ID NO: 3295 - DNA, 121 bp, Artificial Sequence
  Synthesized
  misc_feature (61): n=a or g
atcagatcttcaaaattatattgttgctactgcctaatccttgagatgattaaaactaaangaatggtactttaactatttggcctcctccaaaaatcaacatgaaaataaaaaaatcttg

SEQ ID NO: 3296 - DNA, 121 bp, Artificial Sequence
  Synthesized
  misc_feature (61): n=c or g
tattgctttctcaaatgaagaggatattaatgtttatgccagtaagaatgagatcctaaanacataatgaatacagacacccatttatagtcaggaaagaaatacaataaaggtgcctgaa

SEQ ID NO: 3297 - DNA, 121 bp, Artificial Sequence
  Synthesized
  misc_feature (61): n=t or c
ttgcattccttaagggaagagggagatgcttagtttaaaatttaggaaacatataaatgancactcttctcagaatgaatttcaacatgaatgagaaaaatcttagtctatattttttaaa

SEQ ID NO: 3298 - DNA, 121 bp, Artificial Sequence
  Synthesized
  misc_feature (61): n=t or c
cagtactgcagaactggacgcagctgctacattgttcacaccttgctgccatgcaggtaangcaaggggtatgtaaatgccctttattcagaggagagcaagagggactgtagataaattt

SEQ ID NO: 3299 - DNA, 121 bp, Artificial Sequence
  Synthesized
  misc_feature (61): n=t or c
aaggaatgagagaaacagaatgagaatgcagaaaaaaagtagttcaaggaacaaaagatangtaaacaaggtaagagaagcagaaaagcacctggtgtgagagtatggaaggagtggagaa

SEQ ID NO: 3300 - DNA, 121 bp, Artificial Sequence
  Synthesized
  misc_feature (61): n=t or c
ctaaccacaccactctgtgtatctgttgattatacactaaggaagtatacagtttgtgcanctaaaaacgttgcttgctttaaacactggcaaggattattcagtgcaatttcaaccatct

SEQ ID NO: 3301 - DNA, 121 bp, Artificial Sequence
  Synthesized
  misc_feature (61): n=a or g
ccagctgcctgtggctaccgacttgctgcttgtcagttgataggatttggcaaggaatacnttcttgaaatctttgatagctgcagacagcaacagcttggtcatttctctgatagacagc

SEQ ID NO: 3302 - DNA, 121 bp, Artificial Sequence
  Synthesized
  misc_feature (61): n=a or g
catgtaagcgattagtcggccatccaaaaggctatactaaatgacagatagctttcaaatnaaagaaataaggagcgctggcactgcaggctgcagacactacaggctgataagtgttttt

SEQ ID NO: 3303 - DNA, 121 bp, Artificial Sequence
  Synthesized
  misc_feature (61): n=a or g
ttatgaagaacgagcaggaatgggaaaaggcagtggcagtacaagacaatatgctgttcantatgctagttcaacgtcagcacccagacccagccattacaatttgcagcagaaacaggat

SEQ ID NO: 3304 - DNA, 121 bp, Artificial Sequence
  Synthesized
  misc_feature (61): n=c or g
agggactgcagaaatgaatcacaccatccgatggtgagattaaacccagcagcttttgggngaagcgcatcatctcactgatggaaacacagcagctccctacagcgggatgagggacctg

SEQ ID NO: 3305 - DNA, 121 bp, Artificial Sequence
  Synthesized
  misc_feature (61): n=a or g
ctcatacagtatgcaataaatgagccatgtgacaaaagacaagcaaagagtgagtacgagngagtacaggcatgtgcacaattctgggagttccacatcagtaccagaatatgccacagtc

SEQ ID NO: 3306 - DNA, 121 bp, Artificial Sequence
  Synthesized
  misc_feature (61): n=a or g
tgtgaaacagtctctgaggcttttctgcataaatcatttgcatgtttgctggtctaatatnttacctgttatgtgcgcacattccctcaatatcttagtttgtgaatgattactcactgaa

SEQ ID NO: 3307 - DNA, 121 bp, Artificial Sequence
  Synthesized
  misc_feature (61): n=a or g
gactgcgctcacagaggtgtatccctgacttgggggactgcaggttctgctatgaagagtncagtgctacagccctgctgctgctcagagggccaggagagccaaagtgctctctactcac

SEQ ID NO: 3308 - DNA, 121 bp, Artificial Sequence
  Synthesized
  misc_feature (61): n=t or c
actgtggtccaaatggatcaagtacaaagccaaacaccgcttcgtttctaatatatatttnaaattaaaattgctgaagcaaattatctatttcctctaaaatcagtgtacacaagagagc

SEQ ID NO: 3309 - DNA, 121 bp, Artificial Sequence
  Synthesized
  misc_feature (61): n=t or c
aaagtaatcaagaagcccaggagctctgcaccagacatctcaaaccattcagacacagttngtcagacacgaacatgaaagatgtttttccaaacttgcagcagagaaatgatcaaaagtg

SEQ ID NO: 3310 - DNA, 121 bp, Artificial Sequence
  Synthesized
  misc_feature (61): n=t or c
cttcataatgaattaaacatatttctataactccagaaggtgaagaattcagtccaagatnctcctgcttcattttatttctctggtaaaaattatattttattaaccagacttttacatt

SEQ ID NO: 3311 - DNA, 121 bp, Artificial Sequence
  Synthesized
  misc_feature (61): n=a or g
gatgtttacgataaaatacaagttttctgtaagctgcctcgggttttgtttgtagtggacnttcttgatacgtacagtgatgttttgttctctgggaacatttgttcttttgttgtttgcc

SEQ ID NO: 3312 - DNA, 121 bp, Artificial Sequence
  Synthesized
  misc_feature (61): n=a or g
acacaaaagcatttctatgtaagcagtatcttcttcttttctaagtcttaactaagtttgnatgagtaatgagaatttgcactgctgttgctgtccttttcttttaccagaagcaaataaa

SEQ ID NO: 3313 - DNA, 121 bp, Artificial Sequence
  Synthesized
  misc_feature (61): n=a or g
caggttcagatctccaatctgaaacctgcatgtaactccatccctaccactgacacacccnatgatgtgctcaacttctgcacattctccaaattcgcaacagaacagaaagtctgtcaga

SEQ ID NO: 3314 - DNA, 121 bp, Artificial Sequence
  Synthesized
  misc_feature (61): n=a or g
acagcaggtataagctctgctcaaatggcacttccgcccagaccaccatcacctgcccacncgtcatcccaagcacaagcagctggattccaaacccaaccacagttgctgtgcctctcca

SEQ ID NO: 3315 - DNA, 121 bp, Artificial Sequence
  Synthesized
  misc_feature (61): n=t or c
gccaaaggaacatcaccacgggttttgtagctaggagatgaaatgctcacacgcacatttngcagcttccactgagtcaggaggaagctgcctaagcaagatgagctgaaactggcctaga

SEQ ID NO: 3316 - DNA, 121 bp, Artificial Sequence
  Synthesized
  misc_feature (61): n=a or g
aagaagaactggggttgcactcgccagcagcaaaggagttgagtgaggaccaattggaaancacgttctctaagcacataagagaaacaattcctgtaatggaacctaagattattcaata

SEQ ID NO: 3317 - DNA, 121 bp, Artificial Sequence
  Synthesized
  misc_feature (61): n=a or t
gaaaactttaaagatgacagtaacattccattgtttttcttctttctcataataacagatntggaaatctggagtgagtatatcacctggtaatgtttttttaggactatctaggaaggta

SEQ ID NO: 3318 - DNA, 121 bp, Artificial Sequence
  Synthesized
  misc_feature (61): n=c or g
ggaactgctgaattcatttgctgtcttttaatacaacctcactggagaataagactttaanttaaacttttgagcttgatttttgaattgagtagaaaatttgaatatgaaaaccgtaaac

SEQ ID NO: 3319 - DNA, 121 bp, Artificial Sequence
  Synthesized
  misc_feature (61): n=a or g
tcagccacatcagttgctgatattaggatattgaaaaccgtctgaaaatacagcaaatacnagatttctaaattctctgaacttaaagcatcttagtgctccatcacattgacttcgcggc

SEQ ID NO: 3320 - DNA, 121 bp, Artificial Sequence
  Synthesized
  misc_feature (61): n=t or c
ttccacatggcagtgtgcatggccaccttttaaaacttatgcaatcaactattcttgtacnaccgtctttttactcaaaagcatctagtgatgctcatacagtgacccagcacagtagttt

SEQ ID NO: 3321 - DNA, 121 bp, Artificial Sequence
  Synthesized
  misc_feature (61): n=t or g
ctgaattaaaactaagctatcataatgaaaatgattaacacttttgaaagagatcactaanccatagattttccaaattgataatcgcagtactcaaattagtggcatctgattttcctaa

SEQ ID NO: 3322 - DNA, 121 bp, Artificial Sequence
  Synthesized
  misc_feature (61): n=a or g
agtttgagttgtggtttaaacaagctaatttcttcatcaatttgttctgtcttgccttgcntgattgaaggtgccagcagtgcatcttctctaagcagtttgtatgtctcaccttctccac

SEQ ID NO: 3323 - DNA, 121 bp, Artificial Sequence
  Synthesized
  misc_feature (61): n=c or g
gtaacacagagcccttttttatcctgaccccaaatccccattccttaacattcattttgcncaaacgtgagaagtaatttatgcgtcagcccacagattaatattacatactattcatctt

SEQ ID NO: 3324 - DNA, 121 bp, Artificial Sequence
  Synthesized
  misc_feature (61): n=t or c
gaaaatgaacctccaaaaaaaaaaaaacctcacctctccccttaatcccatttaattctanatttctctttgaatttatagccttgtcagtgttccatggggtttggtgggaaaaccagca

SEQ ID NO: 3325 - DNA, 121 bp, Artificial Sequence
  Synthesized
  misc_feature (61): n=a or g
tgcggctacatgctgtccaccgatgtgaaggattcctctgcctatatcaatctgacgtgcngtagaagtgtgcataaaaactatgttgttagggtggctcaggccaccaccacaggccaat

SEQ ID NO: 3326 - DNA, 121 bp, Artificial Sequence
  Synthesized
  misc_feature (61): n=a or t
gaggtcccttccaacccaagccgtgctatgattctatggcaccccatgctctcaatgaggntcgagagcactgtggtagaataaaaaagcattctgccgtgttttgcaaaagggaaaaggt

SEQ ID NO: 3327 - DNA, 121 bp, Artificial Sequence
  Synthesized
  misc_feature (61): n=a or g
catgcttgtagggagatgtcctagcaatctcttctggttcttttagcagggatttagaacntgttttgaagcctgcttggacaggaaatgttttgcattgggattatgcgtgtcggttctt

SEQ ID NO: 3328 - DNA, 121 bp, Artificial Sequence
  Synthesized
  misc_feature (61): n=t or c
atcacctcagtcaagaaaggaacaagacaaagtacaaatgcttaggtgcttcacagaatgngctctgtagtatatgtatctagtttcacagtgcacagtgtcacaaacaagccagacagat

SEQ ID NO: 3329 - DNA, 121 bp, Artificial Sequence
  Synthesized
  misc_feature (61): n=a or c
aaaacatgcatcagagtagatgcctacctgataaaaacttatgcagacaactattctgttncaaccatggttccatggtgggaaatccagtttgttttcaggatttgcaggcaattaagag

SEQ ID NO: 3330 - DNA, 121 bp, Artificial Sequence
  Synthesized
  misc_feature (61): n=t or c
acttattttcacacacagcatcttctcgaaataaggaaatacaaaagaaagtaacagcagnagctaataaaagcagttaatcctttaaagctagtatgtgttatatgtaaacaaatattaa

SEQ ID NO: 3331 - DNA, 121 bp, Artificial Sequence
  Synthesized
  misc_feature (61): n=a or g
tgtttaacaagtagtgagtagcaggatcccaatatttcattaaaatgatatcactgttgcncacctgatatcatgacaagggtcacgcttaattttacattgcatttgaatttcatttttg

SEQ ID NO: 3332 - DNA, 121 bp, Artificial Sequence
  Synthesized
  misc_feature (61): n=t or g
catttttccgtttacttcagacccatagagcagggctatttggaactacccaagcaggccnaacagcaaattcttattcaaaccagattcatagaaacttcagccactataacagtatcaa

SEQ ID NO: 3333 - DNA, 121 bp, Artificial Sequence
  Synthesized
  misc_feature (61): n=a or g
atgcacacccctcagatttgctacagactgagtctggaaaaaagaatctgaaagaaaattngacttaagaaccggtttcacttgtaatattcttcaatccttgtaaacccagcatttaatc

SEQ ID NO: 3334 - DNA, 121 bp, Artificial Sequence
  Synthesized
  misc_feature (61): n=t or g
tattttcaaatttctggctacttaccaggtgattagatgagatgcatgctaacttctgtgnatgcaacctaatagagagaagaaaaatgaataaataaataaatgatactttagaatttcc

SEQ ID NO: 3335 - DNA, 121 bp, Artificial Sequence
  Synthesized
  misc_feature (61): n=a or g
agaatgaaagtatatgtttcagaaatgtgcaagagtgaaaatctagtatctacaataatantctatgtttgggtgacgctgtgtacagcaagcatttggttaggaggaaataagacttgtt

SEQ ID NO: 3336 - DNA, 121 bp, Artificial Sequence
  Synthesized
  misc_feature (61): n=t or c
gactggaagtgctgtttgcacaactctgtgaacactctgagcagtggagcactgacggcanatgcagtgatgtgtgtacacgtcatgttagcctggctctgaggaggaaagcacctgtaga

SEQ ID NO: 3337 - DNA, 121 bp, Artificial Sequence
  Synthesized
  misc_feature (61): n=t or c
actgtttgcaagtgctcggcttcagaaatggtggtgatgttgcttgaacttgtatagtttntgctccagagctgttttacatcggctagggagattctaaaagtgaacagctagtaaagga

SEQ ID NO: 3338 - DNA, 121 bp, Artificial Sequence
  Synthesized
  misc_feature (61): n=a or g
tgctgcatttatggccagagcttcatttcaccctgcagacatctgaccacagcaacctacntttccaagcaggagtcacagatctgctcacattgcagagagaagccttcagggctttcag

SEQ ID NO: 3339 - DNA, 121 bp, Artificial Sequence
  Synthesized
  misc_feature (61): n=t or c
gttgtttgtgtgagacagcctccaccactgcacctatttacgtatcagtaggctgtactgnacacgtggcagaaaaataactggagctttagaccaaatgagcctctcagtcacagagttt

SEQ ID NO: 3340 - DNA, 121 bp, Artificial Sequence
  Synthesized
  misc_feature (61): n=t or g
acaaaacatccagcaggttgtgcacttctgggtgatgggttggaatagaactcatccctgngcaattataacccaaataagttttcattgtctgatgcagccttaaatgaagagtaagctc

SEQ ID NO: 3341 - DNA, 121 bp, Artificial Sequence
  Synthesized
  misc_feature (61): n=a or g
atcttcagggtcttgcatcctttttggagttgtgatagagaagctgtgagctataaacgcntcagactgaccccagagacaggagtggtttaaccctcatgtttctcttctctttgcaatg

SEQ ID NO: 3342 - DNA, 121 bp, Artificial Sequence
  Synthesized
  misc_feature (61): n=t or c
ggttcagctgaggtaaatccaggatcacactggtgaagctagcaggctgtgttcatcctgntgggacagggtgctgagataccctggtgctcagggctacagaaaaagcttcaggttgatt

SEQ ID NO: 3343 - DNA, 121 bp, Artificial Sequence
  Synthesized
  misc_feature (61): n=a or c
ttgacatttataaagcaattcactatttttattattgttctcctattcttgctctgtgttnactcgattccaccttaatgatttgtttgttttatctagtcttcaacaactctgctggatg

SEQ ID NO: 3344 - DNA, 121 bp, Artificial Sequence
  Synthesized
  misc_feature (61): n=a or t
aggttcacaaaggaagaacctgagaaggcataactagtatcagctgaggaactgagcagtngggaaaaaaatgggataggagcatgttaggtgtactgagtagtggctattccaactgtat

SEQ ID NO: 3345 - DNA, 121 bp, Artificial Sequence
  Synthesized
  misc_feature (61): n=a or t
tttaatgtggagtttgactagagataaccaggccttgcaaagcagacactcattcagaganatgtccttgcatgccttccatgtacctctgaggtcagtaactcgtcctcaagaattttac

SEQ ID NO: 3346 - DNA, 121 bp, Artificial Sequence
  Synthesized
  misc_feature (61): n=a or c
acaatttgaacatgtgctcatgtttcataggctatagattcagtagtaggcaatgtcatgnagatcaaatggctcaatgacctcagtctataaacccttgcacagtagaagtcagtgttag

SEQ ID NO: 3347 - DNA, 121 bp, Artificial Sequence
  Synthesized
  misc_feature (61): n=a or g
ctgttggttagggttgagtttggcttggaggtcggggagtgatgattataaaggaactagnattaaaggaggagtaagagggaaagcagacaattactgagaacagagaaaccacatagtg

SEQ ID NO: 3348 - DNA, 121 bp, Artificial Sequence
  Synthesized
  misc_feature (61): n=a or g
aggatttgaagccttttcagaaaggattctcgacatgtaaaaggtgttttaaaattcacanagaccttgagtctatttaagtgcccatcaatctatcactattttactcactgagcaagag

SEQ ID NO: 3349 - DNA, 121 bp, Artificial Sequence
  Synthesized
  misc_feature (61): n=t or c
ctttcttactttgaattctttcctttgctggataacctgggagtatccgtctgcactgttngctcacgtccacaaaacttgcagaaatccaattatgtatgccctctgtcctttttgccag

SEQ ID NO: 3350 - DNA, 121 bp, Artificial Sequence
  Synthesized
  misc_feature (61): n=a or g
catgactttttttttttcttttttaatatacggccttgtttgagtggtagagaattctggnggtgaaagaactgatactctgaatctggaaagacagtttgttagcagtacaattaggaag

SEQ ID NO: 3351 - DNA, 121 bp, Artificial Sequence
  Synthesized
  misc_feature (61): n=a or g
atatacaggtcttggcagccataatacatttgggcaagttggtgtttgattgattctgtcnggaaattgatccttgtcatgacatctgggatgtcccatgggttcttctgcttgccgacat

SEQ ID NO: 3352 - DNA, 121 bp, Artificial Sequence
  Synthesized
  misc_feature (61): n=t or g
aactgtgcaagtggtatgcacacagaccaaggaaagaggacctgcctcatccaaaatagtntcaatcaactattgcagccccactgcaacagacatgatcccctctcccttccacgcaagt

SEQ ID NO: 3353 - DNA, 121 bp, Artificial Sequence
  Synthesized
  misc_feature (61): n=a or c
gtaaccaattggagaaatagcttcccatcagctccaccatgagcaaacctgcaaaaacttnagtcaacaaagtacctttaaaaaggtacaaatctgacacagcagttgcaattaaaacaaa

SEQ ID NO: 3354 - DNA, 121 bp, Artificial Sequence
  Synthesized
  misc_feature (61): n=t or c
cttatctgcatctgactttgattttttgtcttcttgattcataaatactgagtggatgatngaaggaaacagctcacaactctcccctctccctgctttctggttccttctttataccaag

SEQ ID NO: 3355 - DNA, 121 bp, Artificial Sequence
  Synthesized
  misc_feature (61): n=t or g
gaataattctgttgcctttgttatgtgaattatagccaaagtaaatgaaaagttatccaangaaaagaaagtctgcacagttttgcttcatgagttcttttccccctttttagcattatcc

SEQ ID NO: 3356 - DNA, 121 bp, Artificial Sequence
  Synthesized
  misc_feature (61): n=a or g
agagaagccctattttcaagacgttcctgttacagtgcagttgaacagatgaaggcttttntaagatataaatacagaccgtaacagagcttgagggctttctctcttttttattactctg

SEQ ID NO: 3357 - DNA, 121 bp, Artificial Sequence
  Synthesized
  misc_feature (61): n=a or c
agcttaaagcctcttacttactccaagtggctaaatgaagtattaaatgataccatctagnaagatttctcagtacccagctattacaaatactgatgttctgcatatgcagcaccagaac

SEQ ID NO: 3358 - DNA, 121 bp, Artificial Sequence
  Synthesized
  misc_feature (61): n=t or c
atactcttggctcatatatggagctgattcatggcaaaccctagcttctcaacatgaacantgatcccattcacttccatattcacatccatttaagcatgtaaaaaccccataaccagcc

SEQ ID NO: 3359 - DNA, 121 bp, Artificial Sequence
  Synthesized
  misc_feature (61): n=t or c
tatttacatgcagccacatttgaattcgtgggtttttctaaactgaggttcacaaaactcncttcatcaaaccatgcctccatgactaccaaaaggacaaaaagccaaaagtaaatgatgt

SEQ ID NO: 3360 - DNA, 121 bp, Artificial Sequence
  Synthesized
  misc_feature (61): n=t or c
gccatctcaggctcacgccatttgtccccagactatattctgtaatctgttcaagttattntttctgcatcttgttaattcctttctgcccctgacatttaagccttttcacttctgcaaa

SEQ ID NO: 3361 - DNA, 121 bp, Artificial Sequence
  Synthesized
  misc_feature (61): n=a or g
attgcaaggaggccagcactgcttttcttttgcatctgtttttaggggggattggagtacngcctgacttactgccttagtctaattttcaggactgtggaataaaaatcatttgctgtta

SEQ ID NO: 3362 - DNA, 121 bp, Artificial Sequence
  Synthesized
  misc_feature (61): n=t or c
agctgacagtgaattttgtcttaattttctgtacagacataacacatattaggaagcaganaggtaattcagaatacactaataacaccaataattgtacatagagggtttaattgggtga

SEQ ID NO: 3363 - DNA, 121 bp, Artificial Sequence
  Synthesized
  misc_feature (61): n=t or c
gtgtgcatagttcaaagtaggaccacaaggaaaacgttcgtaattgacaatgtaaaataantgtgaaaggtagagtcactcctttgtgatagtgtttgtctaaactctttacaaactgaat

SEQ ID NO: 3364 - DNA, 121 bp, Artificial Sequence
  Synthesized
  misc_feature (61): n=a or g
tctgaaaggaaaggaacaacaagaaaggcagttacagcagcaggtatgctctcttttcccnttacttgttgctggatgtaaccgaaatgctggcccttgggctcactgaggagctatctcc

SEQ ID NO: 3365 - DNA, 121 bp, Artificial Sequence
  Synthesized
  misc_feature (61): n=a or t
ttatatcctatacaaaaataatgccagtaggagatatgccatgagaaaaaagcattgatcnataagcacagatctatatgtggatcaaacactgactgtatttggcaaaagtcacatctga

SEQ ID NO: 3366 - DNA, 121 bp, Artificial Sequence
  Synthesized
  misc_feature (61): n=a or g
ttgatagattaaatcagttcctagggataatggcctgccactaagctaaaagtaattaacnctgtcatagttgggatgagaaaaaggcaaaatgtacatcctacttgaaagaagactttgt

SEQ ID NO: 3367 - DNA, 121 bp, Artificial Sequence
  Synthesized
  misc_feature (61): n=a or g
gatctcaacacctgttttctatttagggtataacagactggtttctattccattaccttgnaagttaaatgatatgattacataaaggttgtaaaacagcactgagacatataaagttttt

SEQ ID NO: 3368 - DNA, 121 bp, Artificial Sequence
  Synthesized
  misc_feature (61): n=a or g
cattaaaaaggaagagattgaattctgtacaaaattgagctgctagaactgaattaaggcntgctcctagcccagggcaagctttgtatgtaaggcctacctacatgtgttgttttttttt

SEQ ID NO: 3369 - DNA, 121 bp, Artificial Sequence
  Synthesized
  misc_feature (61): n=a or g
ttcatggtgacttgtcttttttttcttttcctacaataatgaatggctataaactcctagntggctgtaccgattactcagtgagaatgtggcattctgtgaagaaagaaaaagtagatga

SEQ ID NO: 3370 - DNA, 121 bp, Artificial Sequence
  Synthesized
  misc_feature (61): n=a or g
tctctgcctagatcacacatacaactcctgttaccacaacaagcactttcacaacagtttncaaggacaatcaaggcttcgctgcatgggcagcagcaaagaactgtaagccaaagggctg

SEQ ID NO: 3371 - DNA, 121 bp, Artificial Sequence
  Synthesized
  misc_feature (61): n=a or g
aaaagctttttcttgtgttcagatggaatattatattttctcatgttttcatttgcaaccnttgcctcttgtcctatcagtgagccttctttttcattcccttctatcaggtatttataca

SEQ ID NO: 3372 - DNA, 121 bp, Artificial Sequence
  Synthesized
  misc_feature (61): n=a or g
atgttttccaggaatagttttaccctagatctggtaatatctttggactgcccatatagcntaacacacctcactgtgccagaagcaaaaaacagtgatgctttttggtgtatatgaagaa

SEQ ID NO: 3373 - DNA, 121 bp, Artificial Sequence
  Synthesized
  misc_feature (61): n=a or g
tctccttgtctctgtacacttaacgtgtctgttcacaagcgtgtctatcagcatctctgcngtgcatgagagcaggcaagagggttttgacttaagactgcacttccatcagagcaaaaga

SEQ ID NO: 3374 - DNA, 121 bp, Artificial Sequence
  Synthesized
  misc_feature (61): n=a or c
tgcacttttcaaaccataaaaaggtgctggagctttgcagttgtggcaatcagcattcccnctgttaccacgctctccgagtttgcaaaacctctgaatcgctgaacacaagggccagata

SEQ ID NO: 3375 - DNA, 121 bp, Artificial Sequence
  Synthesized
  misc_feature (61): n=a or g
ctacacccctgtaaatcaggcagaaatcaggtagaggaagcctaccaatttaatcagagtncaggcagcaggatatttggaaagcacgaggagatgctacactctttcccagaccttatca

SEQ ID NO: 3376 - DNA, 121 bp, Artificial Sequence
  Synthesized
  misc_feature (61): n=t or c
cagatgactcttctgctactgatgtgtgcacctctcttttgcaggcacatatatggatatntgcatggaaagtctgtgagtgcttgcatacccacgatcaaaccacagggccctgaattgt

SEQ ID NO: 3377 - DNA, 121 bp, Artificial Sequence
  Synthesized
  misc_feature (61): n=a or t
ttatttgatcttagcccaatctaactagattttgacatagtttcttttatttcaggcatcntaaaaaaattagattcttataagcaataatcatacttttaagcaaattccatatattaat

SEQ ID NO: 3378 - DNA, 121 bp, Artificial Sequence
  Synthesized
  misc_feature (61): n=a or c
taattttcttctaatctgatcgggcctttatggagatgttagaaattcttagttaaacttnatcagttgaagagcataaaaacccagaaatcttgtacatcatggttccagtcccagtgta

SEQ ID NO: 3379 - DNA, 121 bp, Artificial Sequence
  Synthesized
  misc_feature (61): n=t or c
caacagtttagtctaagatgttgtttcgagtcacgtcatagtgcagtaccagcgagtatgnatttcaagattcttactgctaaatagttaaatagtagtacataatgtattgcaaccattt

SEQ ID NO: 3380 - DNA, 121 bp, Artificial Sequence
  Synthesized
  misc_feature (61): n=a or c
tggtacaatttctgcatctttccagcaaggcatttatggactccttgtagatggaaaaagnactttgtgctttaacagtcacaccatctttgacaagagtgcatactggctccagagaact

SEQ ID NO: 3381 - DNA, 121 bp, Artificial Sequence
  Synthesized
  misc_feature (61): n=a or g
gtacaaacagaactgcttgttcaaatccactccagagttcgacaggtccttttccggaagnaaatttattctgtatcagtctgaagtcttcagacttgaagtgttgactgccaaaatgcat

SEQ ID NO: 3382 - DNA, 121 bp, Artificial Sequence
  Synthesized
  misc_feature (61): n=a or g
gtatgaaacacagtcctatggccatttctgcaagtcacagcacacagtgctgcttggagancgttgtatgtctcaccttcaccttctttacctcaaactctaaggtaaaaatcatgtagtt

SEQ ID NO: 3383 - DNA, 121 bp, Artificial Sequence
  Synthesized
  misc_feature (61): n=a or t
aaaaggagaaaatagaaaaaaatcagatacaacatccattgtactgggaaactgccactgntgctttcagaaacaattgcaagtgcgctgtgttgttttttttttttcctcactgttgtca

SEQ ID NO: 3384 - DNA, 121 bp, Artificial Sequence
  Synthesized
  misc_feature (61): n=t or c
tcctgatgttatcctttagctggaaagctgtaggaccatatgcaccctattcctttccacnctaaattctgcagaaatctcacttagttgatcattattcactgaagatctctttgcttca

SEQ ID NO: 3385 - DNA, 121 bp, Artificial Sequence
  Synthesized
  misc_feature (61): n=t or g
cttgctgtgttttgttgtcatatctcagtcttaagattaaagagcaaaaactacagcaagntaatctaatctgctctgctgtgaccaatctcaagaagcagtttgaagaaggtttacattc

SEQ ID NO: 3386 - DNA, 121 bp, Artificial Sequence
  Synthesized
  misc_feature (61): n=t or c
gattcatatttgcacaaatagatcgaaggctggaattgccttgtgttgaaggtgatccttngtgttgctgcatcaagccttccaagttgctgttcactgccttccaagttcaggaatctaa

SEQ ID NO: 3387 - DNA, 121 bp, Artificial Sequence
  Synthesized
  misc_feature (61): n=a or g
tgccttacagttaaaatatttgaagtatatgttggtagttttattgcaaagctcttcacantgaattttgtaatgtactataatatctgagacctactgtcaggtggctataagcccggtc

SEQ ID NO: 3388 - DNA, 121 bp, Artificial Sequence
  Synthesized
  misc_feature (61): n=t or g
aattggaagccaagttttgaagagaatatgaattctcccagccactgctgtatcaccaacnaaaaggcatatctaacacacagggaagtggtaggagctggggacacgacagcccacttag

SEQ ID NO: 3389 - DNA, 121 bp, Artificial Sequence
  Synthesized
  misc_feature (61): n=a or g
gaagctgggcgtatctcccaggatactcatatgacagaaaaaataaaggcctttctgcaancatataagagatttttaaaccattatttagtttacctgaagtaagttttcttcttcacag

SEQ ID NO: 3390 - DNA, 121 bp, Artificial Sequence
  Synthesized
  misc_feature (61): n=a or g
ctctagcaattaatcatcattttattaaaagtgtgcagatgagagtgtcctttatgatggntcagagatattctggccactaagattttcagaccttgtgtaatggtttctgcttttaaaa

SEQ ID NO: 3391 - DNA, 121 bp, Artificial Sequence
  Synthesized
  misc_feature (61): n=t or c
tgtcatcaccactcagacctctctcccagtcccttctgctgggctgcagagcggacacttnggctccctccttcctgctgattcactgctgatgagaaactgcaccctgtcatctccagtt

SEQ ID NO: 3392 - DNA, 121 bp, Artificial Sequence
  Synthesized
  misc_feature (61): n=t or c
taatgcacgttcctgctacagtcttctttcatgattcttcataataattcactgttcttgnactagaccaggaagagtgaagtcttggaagaatagtttctgccagaaaaggagtagactg

SEQ ID NO: 3393 - DNA, 121 bp, Artificial Sequence
  Synthesized
  misc_feature (61): n=t or c
aatttcaaaaacatttcaagtgacaaatcctctttctggtaggaaatatcatctctcctgnagataacacattttgtttttcatgaaaagtagatgttccagaagactctgactacctttt

SEQ ID NO: 3394 - DNA, 121 bp, Artificial Sequence
  Synthesized
  misc_feature (61): n=t or g
gccagcttagccagtaactatatccacagcctactgagcatgacagtatgaatggatgganaacttatcaaagcccaaggaaagacatactgccatagaggatgtacagtactccacctgt

SEQ ID NO: 3395 - DNA, 121 bp, Artificial Sequence
  Synthesized
  misc_feature (61): n=t or g
aaactgaggtaacattaacatatgaagttcataagacttcactgcaactgcagtaatactnctatgtttccgcaatccatttgagcatttctaggattttgttcactggttcaaatttaag

SEQ ID NO: 3396 - DNA, 121 bp, Artificial Sequence
  Synthesized
  misc_feature (61): n=a or t
ttaatgaagtaacctaacatcactataatgaaacactggtacagatacaagtgtgttccgncaggctgttgatgttagcaggctctgggaaactgctgcttgagaataaggaagaaatgag

SEQ ID NO: 3397 - DNA, 121 bp, Artificial Sequence
  Synthesized
  misc_feature (61): n=a or t
acctaacatttcattaggtgtcacagcttaatagaaaatcaataaattcagagtgcaatcngcagcttagtatataacaagtatatatcaagtctcctatgtctatggagaatgtaattgt

SEQ ID NO: 3398 - DNA, 121 bp, Artificial Sequence
  Synthesized
  misc_feature (61): n=c or g
gcattttttatgccatatcctgccagggatgctgataaaacagaaaacatctgaacagctntatgttatggagaacaattcaaacccacttgttcaagtatacctttccaatgagcatgcc

SEQ ID NO: 3399 - DNA, 121 bp, Artificial Sequence
  Synthesized
  misc_feature (61): n=a or t
gaaaattaacatttcttggtttcagcgtgcttactatgcagtaccatatctttaacattcntaatcaaaattaagtggtaagtaatactgttgtgaagttaaatatttgggctccatatgt

SEQ ID NO: 3400 - DNA, 121 bp, Artificial Sequence
  Synthesized
  misc_feature (61): n=a or t
ttgtaagaactgacagtgtgtgtgaccataatcgtttaaatgtagactcagtacaccatanccttcgcctgtggttagtattctgttcattcctaagatgttgcacagagttctgtgtaac

SEQ ID NO: 3401 - DNA, 121 bp, Artificial Sequence
  Synthesized
  misc_feature (61): n=a or g
ctgaaaagagggactgaaaaccaggcacttcaacaactccagttaagctgaatttgcatcngctagaaactgcatttacatcatcagctgcttccatgtacaagaaattatgctcacagaa

SEQ ID NO: 3402 - DNA, 121 bp, Artificial Sequence
  Synthesized
  misc_feature (61): n=t or c
gatttgataatacttttcttctaaaagcaagacaaaacaaaaagcaagaagaacctacagngttttttctgttctcgagactatgtaaagtcttaggtcctggtaggagataaaggaagac

SEQ ID NO: 3403 - DNA, 121 bp, Artificial Sequence
  Synthesized
  misc_feature (61): n=a or t
tactggaatttaaataggtgaagtgagagttacggactgagtaagctgagaagactgctgnacctaaaaattgtacctcaactttccttgaaaaggaaacattacgtacattatgaaatcc

SEQ ID NO: 3404 - DNA, 121 bp, Artificial Sequence
  Synthesized
  misc_feature (61): n=t or c
agaattgttctgagagtaaaaggtgaaatggaaaagtaaaagctggcgctctgcaacctgngttatgttcacaacctgaaactactgctccatacagctgtacaaagcagtttgaaaaaat

SEQ ID NO: 3405 - DNA, 121 bp, Artificial Sequence
  Synthesized
  misc_feature (61): n=t or c
tggggttgcagatatgggcgagccttttaaaaatgggtagtaggatggtaaaaaatattgnttaaaaaatgtgtgcataaataaacacatatacgtacatgtaaatatgaagtgtatttct

SEQ ID NO: 3406 - DNA, 121 bp, Artificial Sequence
  Synthesized
  misc_feature (61): n=t or c
ttaaataaacctggttgcttaaatttgtttattctactcaactcttcaatattctaaatgnatggatgacttaaaatgtgtgacatgtctataatgcatttgaggtcatgagactggtttc

SEQ ID NO: 3407 - DNA, 121 bp, Artificial Sequence
  Synthesized
  misc_feature (61): n=a or g
ctttacttcagtgggacatggaactaagtgaactataccaaattcaccaagttccaggtgnttctggaaagttcaggcctgcaaggtatatgccagacaacagattgtaatttctaataaa

SEQ ID NO: 3408 - DNA, 121 bp, Artificial Sequence
  Synthesized
  misc_feature (61): n=t or c
aataaaccaatgctaccttaggggtgaatttcactatctactagtgaagagtaatgttctnttacagctgtgtggtggactgcattaaataacactagttataatttcttatgtaacagaa

SEQ ID NO: 3409 - DNA, 121 bp, Artificial Sequence
  Synthesized
  misc_feature (61): n=t or c
caatacaaatattcagttgaagatctttatctagttaggatgtgaactgttttatgtgtgngtactgtattattattgttttattaccataaaaaattgcatttttagtgagttttctgat

SEQ ID NO: 3410 - DNA, 121 bp, Artificial Sequence
  Synthesized
  misc_feature (61): n=c or g
tttccttatgagttgctgatttttaaatttaggtacagcaccaaattcaagtcacaggagnatgtgatgagtttatattgtgtaccatactatttatattatgaattctctcaatttatta

SEQ ID NO: 3411 - DNA, 121 bp, Artificial Sequence
  Synthesized
  misc_feature (61): n=t or c
tctttatgtatttctatatgagagaaaataccctgtttctgaatcagtcaaatgagataanaaattatttcagataattatagggatctagagaggtgagactaacagcaatcagacaatt

SEQ ID NO: 3412 - DNA, 121 bp, Artificial Sequence
  Synthesized
  misc_feature (61): n=a or g
aagtctgcataaggaagagatattgtgctatgtgtaaataagtcagttcactgtactcatntatatcatagtttagataagtcaaccacgtaaaaattcatcttcttttttcaaacagttc

SEQ ID NO: 3413 - DNA, 121 bp, Artificial Sequence
  Synthesized
  misc_feature (61): n=a or g
cagaaaatcaaagaacaaagcaccaccacaatactcaacaaaacttgttttttgcgttatnatattattaattactttcttgtaattggcacatcagataattatttagataatgaaatta

SEQ ID NO: 3414 - DNA, 121 bp, Artificial Sequence
  Synthesized
  misc_feature (61): n=a or g
gacttgcccaatacagaaaacactgcatgtgagaaccaggatcccacagaccctaagaccngggattccaccacactacatctttaagtgctttcagttaattcaaaactatttctacatt

SEQ ID NO: 3415 - DNA, 121 bp, Artificial Sequence
  Synthesized
  misc_feature (61): n=t or c
gatgtaaaatctaaatacgtaatgtagaaagcagaggtgaaacccacctgttagatcattnaggttattattggtgtttgcgttaactccccgttcatttattagacatcgatcggttctg

SEQ ID NO: 3416 - DNA, 121 bp, Artificial Sequence
  Synthesized
  misc_feature (61): n=a or g
gtttttcttataagggtaacagaaagcaacaagagcacctatcactgaatgttcagtggtngccattatacaatgtaataagcagtgcctgctgatacgatgcaatagtaatttgctttgc

SEQ ID NO: 3417 - DNA, 121 bp, Artificial Sequence
  Synthesized
  misc_feature (61): n=a or g
gatttaaggtgatatttcaaatgaacagatgagggcgtagcagggaagaatgaagacatgncagaaattgtaagtattgtataacacacagaagataatgaggggtgcaaggtctgtaacg

SEQ ID NO: 3418 - DNA, 121 bp, Artificial Sequence
  Synthesized
  misc_feature (61): n=t or c
aaatactttgtgaattaatttatttttagtctacattagtttgaacaggaaatgtcatatnttccttctgagagaagcattaacaaatgaattactctgctaatgttacagttgctgtgaa

SEQ ID NO: 3419 - DNA, 121 bp, Artificial Sequence
  Synthesized
  misc_feature (61): n=t or c
tcagctcttatttccaagccgtatgtttgtgaatgccaaaacagctgcagaattgtcagtncaatttcattctattttttaactgtttatttttcactgtgtacttcagctgttctctaat

SEQ ID NO: 3420 - DNA, 121 bp, Artificial Sequence
  Synthesized
  misc_feature (61): n=a or g
gtagcactctcttctttcttctctgttgtttcaccttcttcctcacaactttcagttccancatgtacttcctcactttgaggctcaccgtcccttctagctttgaatggctcaatcccaa

SEQ ID NO: 3421 - DNA, 121 bp, Artificial Sequence
  Synthesized
  misc_feature (61): n=a or g
gagctttacctttagattatctatttgcaaaacctaagtttaataaagaaaacacagacantgttatagcagaccaccactgcttaatattaacagaagtgaatattagcttttttcttta

SEQ ID NO: 3422 - DNA, 121 bp, Artificial Sequence
  Synthesized
  misc_feature (61): n=a or g
actgattgcagccgtgactctctgctgttgcagggcagtagttagaggtgtgaatcagtgnctgatctctgctggcagtcttctgccctgattctgatagcaatgatagctatgtggtgcc

SEQ ID NO: 3423 - DNA, 121 bp, Artificial Sequence
  Synthesized
  misc_feature (61): n=a or g
gatcagactggggccacacgcatttttattgaggacacagatctgcactgaatgagttcantgcattatgatgcagttggtctgtgacagaggcaggctgtttaaagtgggccatgatcaa

SEQ ID NO: 3424 - DNA, 121 bp, Artificial Sequence
  Synthesized
  misc_feature (61): n=t or g
gtttgtctcaccttctgcaaagctatttggtgatagttttagaagattatttgaagttctntcccttggtacattttcctttcccacttatttggttgaatttacttttcatttctatttt

SEQ ID NO: 3425 - DNA, 121 bp, Artificial Sequence
  Synthesized
  misc_feature (61): n=a or t
agacacaattctctattattctaatgagatgggaaatttcaaacttgcatcgactctttcngtagaactgagacttacttagtgtgaatttaagttgtctctcctatagatgagatcttgt

SEQ ID NO: 3426 - DNA, 121 bp, Artificial Sequence
  Synthesized
  misc_feature (61): n=t or c
atgaatagaatgtgattagaatttaatgtgctacagttttatttgcaaaatacacaggtcntgtataaaacctctttttataatgtactctccagaagccttggggatccctgtttaactt

SEQ ID NO: 3427 - DNA, 121 bp, Artificial Sequence
  Synthesized
  misc_feature (61): n=a or g
agaaaagagaactactaagtctcagtaaagtccacatcaaagaaacataatgactactgcnagggtgttagattgagcatattttatatttccaaaaatgaagtgatcaacctcaccaaag

SEQ ID NO: 3428 - DNA, 121 bp, Artificial Sequence
  Synthesized
  misc_feature (61): n=t or g
tattttgaattatattctcttactgatttcatgtaaattgagaatgagcccagaacaagangtttgctttcattagagacgtggtcctcactgactgtattaaactaaatatacacagagt

SEQ ID NO: 3429 - DNA, 121 bp, Artificial Sequence
  Synthesized
  misc_feature (61): n=a or g
aaacagacacttctccctttcagctattaaaacgtcacctacccagaagttcatggctggnagcaacagctgtagcacagtgcatgggagaaatctcatatctagttgtgaacatcaacca

SEQ ID NO: 3430 - DNA, 121 bp, Artificial Sequence
  Synthesized
  misc_feature (61): n=a or g
agatctgttagtgttgttaaactgaagactcctgtttacctacagagtaggcattgtgcanagagctgaaataagagcttcccttccctgactcacttttgaccttaacctagaccactca

SEQ ID NO: 3431 - DNA, 121 bp, Artificial Sequence
  Synthesized
  misc_feature (61): n=a or t
agaatttttctcaggttctatattcagtaccatacataagatgatggaaagcaggtttgtntttaaacagttaaatgtatcacaagccaatcaaatgatctcatgaattattttgtagaca

SEQ ID NO: 3432 - DNA, 121 bp, Artificial Sequence
  Synthesized
  misc_feature (61): n=a or g
aacctgtttgcccatctggtgcttttcacttggcagtaacttatgatactgctggggatgngacccttggaggaaccagctcaagtcttaaggcatttcacaataaatgtgccagtacaca

SEQ ID NO: 3433 - DNA, 121 bp, Artificial Sequence
  Synthesized
  misc_feature (61): n=t or c
ataataaaaggataaataaaaataagtaaaaggttcttcatctagacacctgcatccaaanaaggtgatttctcattttatttaatcctttatcctacagtattacccagccttactgtgg

SEQ ID NO: 3434 - DNA, 121 bp, Artificial Sequence
  Synthesized
  misc_feature (61): n=a or g
cccagaaagaaagcaacaatatctcaagaatcaaaaaacccacaaatcttcaaattcaaanttaccctggtgagttttctacatttaaacttgtattctaacatcagcagatctattcatt

SEQ ID NO: 3435 - DNA, 121 bp, Artificial Sequence
  Synthesized
  misc_feature (61): n=a or g
acctcctctaggcagcagcagaatagaatcaataaaacttcaattcagatgcagggtcagnctttagaatgctaagtttgatttgtactgtgtaccagcaatgaaatcagcggctctctca

SEQ ID NO: 3436 - DNA, 121 bp, Artificial Sequence
  Synthesized
  misc_feature (61): n=c or g
tttcatagctaccaacaggaggaaataaaagctgatgtcaaaggcaagatgaacaggttgncttgaccagctattcctctctggggagaaggttgcctactccattagcataaatataaaa

SEQ ID NO: 3437 - DNA, 121 bp, Artificial Sequence
  Synthesized
  misc_feature (61): n=t or c
gtgctggaagagctgcactggtggttggcttctctgtgaagacagccggtatatactgacngactgcatcaccttaaagtcaccacagagactgctgctttttactaggtggacaactgtt

SEQ ID NO: 3438 - DNA, 121 bp, Artificial Sequence
  Synthesized
  misc_feature (61): n=t or c
gccagcttctcattgctttgcctcttgggtattcatctggatttgtactggagagatgctnagtgctctgttaaagtgtctcgtaccaatttactaatggcagaaaactgcccagattctg

SEQ ID NO: 3439 - DNA, 121 bp, Artificial Sequence
  Synthesized
  misc_feature (61): n=c or g
tgagtcttgtatttactgagttgcattaggatctgatttgtgggcatgaagtattatctgnttaggttttatttctggtgcttttaaacgctttgttcaaaaatactgtatcttttaatct

SEQ ID NO: 3440 - DNA, 121 bp, Artificial Sequence
  Synthesized
  misc_feature (61): n=a or c
gcattatttaattgcaatgtgcaacagtaatattttggtataactagaagtcaaaagcttnattcaataatgaaatgctgagtgtttggacttactgaggtttagttctctgtgtatgagt

SEQ ID NO: 3441 - DNA, 121 bp, Artificial Sequence
  Synthesized
  misc_feature (61): n=t or c
gtagtagatacctgcaaccggagccagggaaactattaatcatgttgttctaaaatgatgntggaaagttgtagggttatgagtgtgagatctcctatgcagcctctgacagtaagttctg

SEQ ID NO: 3442 - DNA, 121 bp, Artificial Sequence
  Synthesized
  misc_feature (61): n=a or g
taaaattagaggcattccttgcagagtaactgtgtaccaaagattcaaaggacggattacnccattatcataaaggtatgctttcagggctcattccttttgaggcacatggtttgctatg

SEQ ID NO: 3443 - DNA, 121 bp, Artificial Sequence
  Synthesized
  misc_feature (61): n=t or c
taccaaaatgttacgggatagggcagaactgtattgcaatgcaattacatggtcacacacngctttttactctgggacatctgtctcattcattgccctagggggacatacgtgtgggtaa

SEQ ID NO: 3444 - DNA, 121 bp, Artificial Sequence
  Synthesized
  misc_feature (61): n=a or g
agatgacagagcatggtcagtaaaggataggaactgcttcagccagtgtagctacagattngcaaatcttggtctggttacttgcagtattagattaaaatcaggtagtcaatttactgcc

SEQ ID NO: 3445 - DNA, 121 bp, Artificial Sequence
  Synthesized
  misc_feature (61): n=a or g
ctttctctctttaattaaaaaacaaccaaaccaaaagtgcagaagtggttgcaggactccnaaaatgcttagtgctgctttttgagctggctggggagagccatccctgcatgcagcaagc

SEQ ID NO: 3446 - DNA, 121 bp, Artificial Sequence
  Synthesized
  misc_feature (61): n=a or g
aggatagggagctcctgtaaatttgccccagcttcctcagatatacttctgcccaaatatntttcccctctaaaagctggaatgctttattgaaattaaatggaaacgaaacctgaaagtg

SEQ ID NO: 3447 - DNA, 121 bp, Artificial Sequence
  Synthesized
  misc_feature (61): n=t or c
aaagaaagatattaaaaggctgcgtttttctcagttagtgaacttattaactgtgctctcntcttttataaaaatgctgcattgttctctaacaatggtcctcagcccttgagaaacatga

SEQ ID NO: 3448 - DNA, 121 bp, Artificial Sequence
  Synthesized
  misc_feature (61): n=a or g
ggagcaggccaaattccagaggaaataacaaccaaatattaactgcgtatattgagagcanccactggtttaggaaatccattggccacaaagtcctaaagcttgaggatcttgtagggag

SEQ ID NO: 3449 - DNA, 121 bp, Artificial Sequence
  Synthesized
  misc_feature (61): n=t or c
caacgagcaaagacaaacgaaacataatcctgcacgtctgtacattctggaggctgtcctnttcatttggtgtcagtactgaaccaaaagtatttagagaggcaatattattgaacacaac

SEQ ID NO: 3450 - DNA, 121 bp, Artificial Sequence
  Synthesized
  misc_feature (61): n=t or c
accatgcaaggacagtgttgttcccacagcctctaatgcatgcaattcatatggctagatntggtaaattactccagatataaggtgaggtactactggggaaaacaaaaagtaactatat

SEQ ID NO: 3451 - DNA, 121 bp, Artificial Sequence
  Synthesized
  misc_feature (61): n=t or c
aactcatcagggttagcaacactgctagaaaatgcattccctcatagctacttctacctgnccactgccatgggcaacctcccagccccatctgcagggcagttaatgtgaaagccatgtt

SEQ ID NO: 3452 - DNA, 121 bp, Artificial Sequence
  Synthesized
  misc_feature (61): n=t or c
gtgctattcggtatttgtatttcctgtagttacacacaccacaaatacaccagtagagacncagagtttttgcttgttcctgtcctaaaacaaagaccagatgtggaagtcaaaccttatt

SEQ ID NO: 3453 - DNA, 121 bp, Artificial Sequence
  Synthesized
  misc_feature (61): n=t or c
ctttttactcattaatcaaagtctgtcttggctcttcctacctttaaaacaaattagagangaacaagtgtaggactttttttatacaaatagatataaatacatatatacttagagaaag

SEQ ID NO: 3454 - DNA, 121 bp, Artificial Sequence
  Synthesized
  misc_feature (61): n=t or c
agacatttgtatcaataaatccccaaagctaccacagcacaataaaggcacctggcacagngaggagtcattacattttattaagaagtattgaaataaaacgttggaatgtgtattactc

SEQ ID NO: 3455 - DNA, 121 bp, Artificial Sequence
  Synthesized
  misc_feature (61): n=t or c
taaaggtttcatgcagaatcagtgatttactgatggctgtttcctgcctgcagtttcattnatctggtaaaagtctttatttgtaggtgaagtcatgccttaggaggtctgtataagaatg

SEQ ID NO: 3456 - DNA, 121 bp, Artificial Sequence
  Synthesized
  misc_feature (61): n=a or g
ctgcttcctgttgaagttaaaagaggaaaacttttgttgtgctaatcactatttctatcancagatatcttgatgtttctggaaatatatgaactgacagctggctaatgtgtttaaatac

SEQ ID NO: 3457 - DNA, 121 bp, Artificial Sequence
  Synthesized
  misc_feature (61): n=t or c
ctagctcagaatgccttactgttctatctatccatgttgctggccttgaatatgccatacntcatcaagtattcacaccgattctgaaatgctttctcagaaattggaaaaagtaaatgga

SEQ ID NO: 3458 - DNA, 121 bp, Artificial Sequence
  Synthesized
  misc_feature (61): n=a or g
gaagtaagcaggatgcgctgagggcctggagcgagatttgtatgggaacattgggcctttncatgacattctgagtgaattcgggttttcagcttgggttcatggaaggatttcagatagt

SEQ ID NO: 3459 - DNA, 121 bp, Artificial Sequence
  Synthesized
  misc_feature (61): n=t or g
aacacagacaatgcgagctggttgtttcattgtcccaagccaatgtatttcacccagcttncagcatagcccaggaatttccaacaattcccaatcccatatggctcagtaaagacacact

SEQ ID NO: 3460 - DNA, 121 bp, Artificial Sequence
  Synthesized
  misc_feature (61): n=a or c
atttataagagatcttcttgcatgttgtaccttgttccatttgatttatggcacagacacnaccttatagtaccgcagatagatcctgttattgaagaacactggccaagagaacgtcaaa

SEQ ID NO: 3461 - DNA, 121 bp, Artificial Sequence
  Synthesized
  misc_feature (61): n=t or g
acaaattccttccttgatttcaggcaaaaagggaatcaaatccaaatgttgcaactactcnaaatgcacacaagaaatgatttctctgtctatgttgcatattgttgctggaattttaaaa

SEQ ID NO: 3462 - DNA, 121 bp, Artificial Sequence
  Synthesized
  misc_feature (61): n=t or c
tagctacacttatacctagaatacaaactaaagtatgttagagttactttaaggtggatgngtatctgacacatcctgcactacccacttgcagatagaatgcagttttgaaatttttcct

SEQ ID NO: 3463 - DNA, 121 bp, Artificial Sequence
  Synthesized
  misc_feature (61): n=a or g
caagcaccataagcacaagagaaacacattccaggcttttcttgtgccaacacaacggccnacgtggtgcagcacctcttgcacttccccgttccttttccagccccaccagggctcagtc

SEQ ID NO: 3464 - DNA, 121 bp, Artificial Sequence
  Synthesized
  misc_feature (61): n=a or t
agtttacttttgtctctcaatgttttgatcccgtttctcactctaatatgtttaattttcntatttttagcagaagatacggagaatcatgtcctgcttaatcagtaagtctgggggaaaa

SEQ ID NO: 3465 - DNA, 121 bp, Artificial Sequence
  Synthesized
  misc_feature (61): n=t or c
atttcattgtccctctgcttttttttttttttaacccccatcaatacatttggctcacagngcttatatgttcctcactaaagtgcagtgatgtcttgagatgaaaggcaaaataagaaat

SEQ ID NO: 3466 - DNA, 121 bp, Artificial Sequence
  Synthesized
  misc_feature (61): n=a or t
ctttaagaagaggacagatacttaaggatggttggcattaagatctgaagatggttatacngtacattgcctgaaactttacaatgctgtgaacatgtgaagatgattgatgaatgcattt

SEQ ID NO: 3467 - DNA, 121 bp, Artificial Sequence
  Synthesized
  misc_feature (61): n=a or g
ttcttggcacatgggtgacattttagtcagaatatctaagagttgaaaataggtgcccatnctttcttaaagatgtctttcccctctgcataagtagtctcacataaccaacagatgatta

SEQ ID NO: 3468 - DNA, 121 bp, Artificial Sequence
  Synthesized
  misc_feature (61): n=a or g
gcagaaatccctgtcagcttgaaatggtagaaaattccttctcagcttttggtttggcacntgacatttagttttgtaagcaagacaggtcagccagaattctctgcagcacctgcatgcc

SEQ ID NO: 3469 - DNA, 121 bp, Artificial Sequence
  Synthesized
  misc_feature (61): n=t or g
tttagctaaaagagaagaccagtgctccggtgcacttcagctaacgcactccgtgccgttnatttgctctcaggaagaggaagctcgcacatggcgccccatgcggctactggcaactccc

SEQ ID NO: 3470 - DNA, 121 bp, Artificial Sequence
  Synthesized
  misc_feature (61): n=c or g
tgtgacacgtgctccatcagtccacctaggcgtacatcagaaaagcagcaaacacaagttntactgtgggaagacagctctttcaacctgataaaaataaaatgttccaaccgaccactca

SEQ ID NO: 3471 - DNA, 121 bp, Artificial Sequence
  Synthesized
  misc_feature (61): n=c or g
tagcagccaggctttaatgagctgtgtgtgtcacactctctagttgtgctgccactgcatntaggctgcgtatggttgtgtgatctagattttatggatcacattttaactttttgtttgg

SEQ ID NO: 3472 - DNA, 121 bp, Artificial Sequence
  Synthesized
  misc_feature (61): n=t or c
agaagttttgttttatattgttcatataaacacagaagtaatgctttgcaataaatttgtntcggtattgtaagaaggaaaatataaatgaaaagaaggccaagaaatagacttctagtca

SEQ ID NO: 3473 - DNA, 121 bp, Artificial Sequence
  Synthesized
  misc_feature (61): n=a or g
tccccatttgctgtgttgcaaagtatggacttacttccctgttagcctggtaaacatgctnggatgtgagaagaatggggttttttaaagcatggcaaagaatgctacccttggagaacat

SEQ ID NO: 3474 - DNA, 121 bp, Artificial Sequence
  Synthesized
  misc_feature (61): n=a or g
aaatccttctgaaaggacagccactgaaagcatgactgctgtagcttgcttcgtcaggggncacactacactgagttgtaggggaaacttatttactacccacaccttgttttactgctaa

SEQ ID NO: 3475 - DNA, 121 bp, Artificial Sequence
  Synthesized
  misc_feature (61): n=a or g
ggacttttatctggcagatagagctgtttctattgcccagctaagcacctgggtggttgtnaagcatttaatttgctctgatgtgaatatcattatgattaacttactacagaaattatct

SEQ ID NO: 3476 - DNA, 121 bp, Artificial Sequence
  Synthesized
  misc_feature (61): n=t or c
cttggaactgttccattattggcttgatatataatagaaaatataatgtccttctgctctngcacaaatgaaatgttccgtgctttcagttataccatgtactcaacacacaagacagaag

SEQ ID NO: 3477 - DNA, 121 bp, Artificial Sequence
  Synthesized
  misc_feature (61): n=a or g
attcagtacatccagataaaaccatgctagaaggttattgttgatgctttgtttgctcatnctatacacaccatctattatatataatccctggatatcctgaaaaatcattgctaaaatc

SEQ ID NO: 3478 - DNA, 121 bp, Artificial Sequence
  Synthesized
  misc_feature (61): n=c or g
cttcaaagtaaccatatataaaccgaagaacaataacttgggctccttaagaaccaggaanccttacttttctactgaaatgaacagctttgatctcggtgctcaccaagtagcctccccc

SEQ ID NO: 3479 - DNA, 121 bp, Artificial Sequence
  Synthesized
  misc_feature (61): n=t or c
cattttcatgaaacgttaaaaaatctggaaatcccagtctgaattcagttactataaaganttaagtaataatagagtcttcaaagctcctggataacaggaaggttttacccattcttgc

SEQ ID NO: 3480 - DNA, 121 bp, Artificial Sequence
  Synthesized
  misc_feature (61): n=a or g
acagggccacgtgaagagccagcagatgtttctgctgcaaatcattacctgactcagcctntgtgccacacggagctgaaccacctcgtacccaaacaatgggcgcttttcacatctcaaa

SEQ ID NO: 3481 - DNA, 121 bp, Artificial Sequence
  Synthesized
  misc_feature (61): n=a or g
aattttcagtatgcaacctctgaaataaatcagcgttcagagctttcagactgctgagagngcaggcagaggaacccgggtttttaacgtggcatttctctcacgtactttgatgtcaaac

SEQ ID NO: 3482 - DNA, 121 bp, Artificial Sequence
  Synthesized
  misc_feature (61): n=t or c
ttttgcagtgattttatacacaagagcaatgtataaatgtcttaaaaacatgcaagtagantttaacctaaaggcccagaagtccaggcatcctgctaagtcattggaaagcagctggctt

SEQ ID NO: 3483 - DNA, 121 bp, Artificial Sequence
  Synthesized
  misc_feature (61): n=a or g
agcagccagaagtgaatgactacgtcctggtatacagatgatatgctattcctcagacttnagggtatttttcctggaaacctctttcttatgtatctttgctccagctagtgaaagatga

SEQ ID NO: 3484 - DNA, 121 bp, Artificial Sequence
  Synthesized
  misc_feature (61): n=t or c
attgaacaccatggtggcgcttccactgggcacttcttcccattaggcaagcttgtagtcngtggttttggagtacaaatctgaaatggcctccagaattgctgtctcagctccagccatc

SEQ ID NO: 3485 - DNA, 121 bp, Artificial Sequence
  Synthesized
  misc_feature (61): n=a or g
agtgtgccctgtgcatctgccaccactccacaagtaaaggggaaaaagtatctaagacacncaacaagatttccagtacatacgttgtaactaagtatgtgaaacataccatcaggctaca

SEQ ID NO: 3486 - DNA, 121 bp, Artificial Sequence
  Synthesized
  misc_feature (61): n=a or g
aaacaaacaaaaaaaaacctgcaacagagacttaaaagaaatcactctacacttacagacnttgcagataaagactgcaatgaataacgtttacaagaaattattcatattactacatcta

SEQ ID NO: 3487 - DNA, 121 bp, Artificial Sequence
  Synthesized
  misc_feature (61): n=a or g
cactatgcaggcctcagccttgcatgtgccacagcattttccaggttcctctgtatacttntaaccctattttgaaagaaacagagagggaatattgttgaaccaggacactaagcttaaa

SEQ ID NO: 3488 - DNA, 121 bp, Artificial Sequence
  Synthesized
  misc_feature (61): n=a or c
gaaggaagtatttcacattttgcacttatgattcattcagtaaacagtcgtcagagggttnatcaagattgaaaatactgggctcatgaaagctgctctccaatgatacagtaaatcagta

SEQ ID NO: 3489 - DNA, 121 bp, Artificial Sequence
  Synthesized
  misc_feature (61): n=t or c
actattccagtgactctaatggagaagttggatgttacatgaaagattctagctctcatcnattaattatcatcttcatctacttttctcttttctccctctcaccatccagtaagaatta

SEQ ID NO: 3490 - DNA, 121 bp, Artificial Sequence
  Synthesized
  misc_feature (61): n=a or c
tcacgctgcagccagattgctgatgctggaaaacatatttgtacaactctggtgcagtttnttcctctttgttttacaaatcatacgtacagtgctgcattcaaacggtaattattaaatg

SEQ ID NO: 3491 - DNA, 121 bp, Artificial Sequence
  Synthesized
  misc_feature (61): n=a or g
acatacactgaagttactatgctctagggtaaaaacaattttcttctcctttatttggttncatatatcaggttggaggccctacaaggatagagaaacacacttccctaggcatgtcaag

SEQ ID NO: 3492 - DNA, 121 bp, Artificial Sequence
  Synthesized
  misc_feature (61): n=t or c
atcagctgagtgcctgataaatcatcacagctcaagcaccttggcagctgacagctcttcngaaaacagcgacttcaagaaagaaatggagcttacttgcaggcgggcgcttactcctgat

SEQ ID NO: 3493 - DNA, 121 bp, Artificial Sequence
  Synthesized
  misc_feature (61): n=a or g
ttctgtgattctgtgacttcttctgccatgactagctagcagctaaggagcaggaatgcancgaatccacgcttttccaccaagggtttgcaaattgattgaacatcctttggggtgtttt

SEQ ID NO: 3494 - DNA, 121 bp, Artificial Sequence
  Synthesized
  misc_feature (61): n=a or g
tgggcctaaaagctgatattgatattggtgagtgtgtgctatgttgagcatgtgctcccanacaattatttttcaaggctaagtcaaaatttttcagtaaattatttttctaagcgaagtt

SEQ ID NO: 3495 - DNA, 121 bp, Artificial Sequence
  Synthesized
  misc_feature (61): n=t or c
tttgtcactagcatagctatcaacacgtcgtaatttggacatgtctgttctgaaatccagngcagcagcaaacaattatatctacttcaaaaaaataacactatagttgctagtgtcaatt

SEQ ID NO: 3496 - DNA, 121 bp, Artificial Sequence
  Synthesized
  misc_feature (61): n=a or c
tctttcttttcaacagccactataaaataacagaaactgtgttctcagaggttcagtttgnagagcttgtgcctctttgctttcttttaatttgtgaatgattgctaacccccactggcat

SEQ ID NO: 3497 - DNA, 121 bp, Artificial Sequence
  Synthesized
  misc_feature (61): n=t or c
cgttatgctcctgcttataatgcctctggacctggcaggtataggggcatctggttgaatnctaactgattcttcatacgtctcaagtattattatggctcaacgcagactgagagtgtgc

SEQ ID NO: 3498 - DNA, 121 bp, Artificial Sequence
  Synthesized
  misc_feature (61): n=a or g
tgtgttgggttgccaactttcatacagaggttgtgattaactggattcttcccctgccccnttatgaacataaaatattaacagtggtttttagtaataagtatggagggatctgacttga

SEQ ID NO: 3499 - DNA, 121 bp, Artificial Sequence
  Synthesized
  misc_feature (61): n=t or c
gctgttactcactacctaattgtggttgaattccttagcctaattttgctctgcctattgngtatttagattggagatgcactggggcaggaattttattaataaaaaaaagcaaaaatgt

SEQ ID NO: 3500 - DNA, 121 bp, Artificial Sequence
  Synthesized
  misc_feature (61): n=t or g
cacacttgtaggataattaagaatccacagccttagcggtttcttagcagaattatcttcncccgtgtggtttcagtgtggccctattagttggcttgtgtaccttgctatgatgtagtgc

SEQ ID NO: 3501 - DNA, 121 bp, Artificial Sequence
  Synthesized
  misc_feature (61): n=a or t
aggacaaaagattctaaaccctttcacctcattctccaaggcacagtcatttgctgtgaancagaatgagaggtttttgaagaggtatggttttgtctgataccacttaacatttccgact

SEQ ID NO: 3502 - DNA, 121 bp, Artificial Sequence
  Synthesized
  misc_feature (61): n=a or g
ggcttcttagtttgagctgtcttgcctcctgttaaaacacaagttctgcgaaagagaaaangagcttctatattcttttaagtactttacagtgtcattaaaaatagaacatgcaaatgta

SEQ ID NO: 3503 - DNA, 121 bp, Artificial Sequence
  Synthesized
  misc_feature (61): n=t or c
cctgcaagtatctttacactctggaaagttggagaccgcatgagaaatttgtctgaaatanagataagccctctgtttaataactcaggcctataccagagttcattaatattgtcttaac

SEQ ID NO: 3504 - DNA, 121 bp, Artificial Sequence
  Synthesized
  misc_feature (61): n=t or c
actgcctgtggctgatccgcatccgtcggaataaggtaatttttaatagaaagtttgaacngcggcatcagggctacaccacgttgttttatcattatgacatttattctgctatatagcg

SEQ ID NO: 3505 - DNA, 121 bp, Artificial Sequence
  Synthesized
  misc_feature (61): n=t or c
ctgctgttctatacttaaatactaccaatttggagtcatcttgaacagacgtcaggaacgnacgataaaggcaactaatagatcacataataacagtgtttatgagaagagttccagtttt

SEQ ID NO: 3506 - DNA, 121 bp, Artificial Sequence
  Synthesized
  misc_feature (61): n=a or g
tctgtaaatctggagtaatagtgacaaattgttttctccaaatttatattgttgtgtgtcnctaataaatttggtccaaggtctccagtactgtggttatataagaagtctgagccctagc

SEQ ID NO: 3507 - DNA, 121 bp, Artificial Sequence
  Synthesized
  misc_feature (61): n=t or c
tttcctaaggcaccagcctacgtgacccattttcttaatcttaatgcccacatattctatncaaagctgcaaggtactttgggcaataagtttagctttctgcttcaagcattcactacta

SEQ ID NO: 3508 - DNA, 121 bp, Artificial Sequence
  Synthesized
  misc_feature (61): n=t or c
tccaccacttcagtagaccacccctttgtcatcagcatggcaaacctgtgacctcttaccnaaacctgttttgtttctaaagaaacccactgattaattgggtttgtctggtccatatcct

SEQ ID NO: 3509 - DNA, 121 bp, Artificial Sequence
  Synthesized
  misc_feature (61): n=t or c
ttccccattagctgggtgtgcctacttacatggttccctttcctgctgttacaattcccanaccagtttaactcaccaaatatatggaatctaactcttcaaatatactgaataaatcccc

SEQ ID NO: 3510 - DNA, 121 bp, Artificial Sequence
  Synthesized
  misc_feature (61): n=t or c
tcatataaatgatactggcaataaacttccttttaaaacagtattttacatactaacattntgtactctctactgtccttttctactcacttctctggctgagataaagggcttaacttca

SEQ ID NO: 3511 - DNA, 121 bp, Artificial Sequence
  Synthesized
  misc_feature (61): n=a or g
ctctcacacaagcattcttacaacttcaggtgcagcttcaagagagaaacaaaagatcaangccaaaaagaaacacgaaggattttaaaaggcactcattattatacaagtctggcattat

SEQ ID NO: 3512 - DNA, 121 bp, Artificial Sequence
  Synthesized
  misc_feature (61): n=t or g
gatatacaaaccccgaaataaggcacaccaagaaaagcacagcagagacacccactgcagnatgaaatcagctcaacttactccctctatctcgacatcagcactgtcacagccagcagcc

SEQ ID NO: 3513 - DNA, 121 bp, Artificial Sequence
  Synthesized
  misc_feature (61): n=t or c
ctcagtgcacctctttgccaatcacaaacaggttgggaactgcttgctgtagctatccccnttgcatcccttcactctgccaccaagacctggcgttataataagggatttacggacacct

SEQ ID NO: 3514 - DNA, 121 bp, Artificial Sequence
  Synthesized
  misc_feature (61): n=a or g
aacctggttttcagacagctgcagctgctgggtgaagttcccgggtcatctgagcatcccnagccatcaatgtgtgtaatgcaaagtgacagggctgtggctgaaaatgcccttttttgct

SEQ ID NO: 3515 - DNA, 121 bp, Artificial Sequence
  Synthesized
  misc_feature (61): n=a or g
ccactttatgttaaagtgtttgtcaaggcaagcaaaaagcaatggaaagacatgctcccanactctgagattttagtctacaaccaatagcctgagtttggatgttcgaaagcatacacag

SEQ ID NO: 3516 - DNA, 121 bp, Artificial Sequence
  Synthesized
  misc_feature (61): n=a or g
ctatctcagttagcatcctgtaaggctgctaaatgagatagagccgcatgagcccaagagnagaagaaagttatattttaacaccatctttatcaagtacgtaggataatattccacagga

SEQ ID NO: 3517 - DNA, 121 bp, Artificial Sequence
  Synthesized
  misc_feature (61): n=t or c
ttacacatgcatatctatactatatggaaacaccctgtgcaacttgtgcatgtaggtgtangccctacccagaaaagaaagaagtatgtcaatcaatgcttaggaatgcttcagaatcaaa

SEQ ID NO: 3518 - DNA, 121 bp, Artificial Sequence
  Synthesized
  misc_feature (61): n=t or c
aaagtaccactaatactataggtccaggaaaacaaagaacacaagggtcaagactctcaangcactaagaggatctgcaactccttacttgtatttctctccataagtttcccgcatatct

SEQ ID NO: 3519 - DNA, 121 bp, Artificial Sequence
  Synthesized
  misc_feature (61): n=t or c
aaaacacttcttagctatactggtaccttacaaggttactaacccaccccataacatagcnaggacgacactgatcccaactgcacagtgcactggcacgttttacaaggcactggcaagc

SEQ ID NO: 3520 - DNA, 121 bp, Artificial Sequence
  Synthesized
  misc_feature (61): n=a or c
tcaacaaagacacctgtgagcaactcaatggagggacagctacgttattaagtgaatcagntaagaaagttactctctgacaactttcagcaacagaattaaaggaaagatgatgcattag

SEQ ID NO: 3521 - DNA, 121 bp, Artificial Sequence
  Synthesized
  misc_feature (61): n=t or c
atccaacaaggggcataggtaactagctgtcccttttggtactgaagtccatatccacagnctcatccagctgctgcataaccctggaaaggctttttacatccagtttccccaagtgcct

SEQ ID NO: 3522 - DNA, 121 bp, Artificial Sequence
  Synthesized
  misc_feature (61): n=a or g
ccgactgccctgactgctctggtggcccctctgggtctgaggctgacacaagcatgagaancaccagctcactacgcagggccactggggaaagaagtgtgactccactctggatctgacc

SEQ ID NO: 3523 - DNA, 121 bp, Artificial Sequence
  Synthesized
  misc_feature (61): n=t or c
tgtgctataggaagccactacgtgctggctactagtgggcctgtatgcacagctgtgtcantgctgctccttggaaggaaagggaatagatctgtgggactgcagtccccatccgagcagc

SEQ ID NO: 3524 - DNA, 121 bp, Artificial Sequence
  Synthesized
  misc_feature (61): n=a or g
ctacttccacagttgacaagaaattctactacaacgaggtatgtatttctgacacgaaccnaaatactacatagattagtctcgttttgaagtaaaaaataaagcatttggcatatttctt

SEQ ID NO: 3525 - DNA, 121 bp, Artificial Sequence
  Synthesized
  misc_feature (61): n=t or c
tgctattattcaagcagtctgaatgctgctgcctgctgctccctttctcagttccaggacngggaaaggagtgttccttcccaccagctctatccgtggagaagaatcataatagatctac

SEQ ID NO: 3526 - DNA, 121 bp, Artificial Sequence
  Synthesized
  misc_feature (61): n=a or g
aaaattacacaccaatcctagctcccacaactaacagctggacatacagttgtacagctgnataggcatttttaatatttctccacactaagtatactaccggtagaattcaagaatttcc

SEQ ID NO: 3527 - DNA, 121 bp, Artificial Sequence
  Synthesized
  misc_feature (61): n=a or g
tcagtcactctgacctgaaaatcactttagctgcccagctgggccatcttggtctgactcntggggtggaagagccttttgtacagcagcctccatcctgcctgcctgtagcacaaatgct

SEQ ID NO: 3528 - DNA, 121 bp, Artificial Sequence
  Synthesized
  misc_feature (61): n=t or c
ttaaaaaagtcaaattcagctttttagatttattttcctatagagaatacagtgcactgtngtggaaaaaatggggggaggaaaatgaatatattcacatgtttggagaacgctttgcagt

SEQ ID NO: 3529 - DNA, 121 bp, Artificial Sequence
  Synthesized
  misc_feature (61): n=a or g
ctcttggttgtggtaagatcaaataaaatgttcacaaagatggggacactcttctatttgnatagtagttcttaccagtcaaatataccactgtgtatcaaaacaactttaagcaaacatt

SEQ ID NO: 3530 - DNA, 121 bp, Artificial Sequence
  Synthesized
  misc_feature (61): n=a or g
aatacagccaccgatgtgtattttgctgtgattctatagtaatgttctacgcatctaaatnttaaaaggcttgaatgtagctttcagaaggcttactgaaaatcctgtgaactagttcaaa

SEQ ID NO: 3531 - DNA, 121 bp, Artificial Sequence
  Synthesized
  misc_feature (61): n=t or c
tatggtaggctacagaaaaatttatttatttgcactgtgttcaaatatttcttcctccttntttctctcactctgtggataattctttaaaacctactcatgggggatgaaagcttcaatg

SEQ ID NO: 3532 - DNA, 121 bp, Artificial Sequence
  Synthesized
  misc_feature (61): n=t or c
ttaatttttccaccacaatcaaaattaaaataaatcagaatagaaccttcttaggtactantggctcttcgtaaaggcagaagtaatcagatatttttttccccattgagagtactaaagg

SEQ ID NO: 3533 - DNA, 121 bp, Artificial Sequence
  Synthesized
  misc_feature (61): n=a or c
acaagcaaatgatatccttgtatactaaatataatcagaagagagcttttaaggttatgtntttaatttcagctgagccttttttctatcacgtgaaagtgaagaaaatgtatttcacttc

SEQ ID NO: 3534 - DNA, 121 bp, Artificial Sequence
  Synthesized
  misc_feature (61): n=t or c
cacaggtggtagtctggaagactaattcacacaagtcagcagtggtgaactcagcaccccngaatggacagtatgtcctgcttccagggttgagcaggagcagaagtttatctggatacaa

SEQ ID NO: 3535 - DNA, 121 bp, Artificial Sequence
  Synthesized
  misc_feature (61): n=a or g
agagacaacttcaattgtggcaagagttgtgtccaaaatagaatacagaaaatcctggaancttcaatttaaaactgtaatgaaacaagccaaagtgctcttgagcctctgtatgataaaa

SEQ ID NO: 3536 - DNA, 121 bp, Artificial Sequence
  Synthesized
  misc_feature (61): n=c or g
acatttgtatgaagtagaaatattttataatttctggtgccatttgtacaccggatgtaantttttatgtggatttatgatgttcctagttttgcaggtattaattgtgcagtcctttgtt

SEQ ID NO: 3537 - DNA, 121 bp, Artificial Sequence
  Synthesized
  misc_feature (61): n=t or c
tcttctactatgaaaccacttgaaaaataaccatgaaataacacagggaaaacatctgcanggaatacagcagaccaccagtagcgaagcacaggaaagccaagagaggaggatagaaaga

SEQ ID NO: 3538 - DNA, 121 bp, Artificial Sequence
  Synthesized
  misc_feature (61): n=a or g
ccttgtcagtcagctctgaaacagcaccttctcaataatgtgatgtttcttcctaaaagantattactataataaagagaaacattgcttcttgtggttgctggtttgggtcctgggggag

SEQ ID NO: 3539 - DNA, 121 bp, Artificial Sequence
  Synthesized
  misc_feature (61): n=c or g
gtttctgaattacaatcagagatagattgacgtgaggaacataaagttaggttttaagtangaaggaaagatatcttcctaagtttatagtgctaattatgccactaccacaacatcagta

SEQ ID NO: 3540 - DNA, 121 bp, Artificial Sequence
  Synthesized
  misc_feature (61): n=a or t
gtagcatgagcaaacagttgaaaaaacaattgattttgtagaggtatgtatatttttcccncaaagtgtgtcgtaaaccgatgtgtgggttgatctttttagagatggaaattgatagagt

SEQ ID NO: 3541 - DNA, 121 bp, Artificial Sequence
  Synthesized
  misc_feature (61): n=a or g
taaggctacaggacatcaaacccaatggaaaattgcacttctgtgacctacactcctctcnggctttgaaggagctcacaccaccttcagttattttgacagtaaagaaaggtaatgaaaa

SEQ ID NO: 3542 - DNA, 121 bp, Artificial Sequence
  Synthesized
  misc_feature (61): n=t or c
gtgacagtggttaagcacggggcttggccaggcaaatgaattgaccaactcatgacttgantacttacgtgtaatggacctcttttgtgtccatctttttccatattcctgtgtttgttct

SEQ ID NO: 3543 - DNA, 121 bp, Artificial Sequence
  Synthesized
  misc_feature (61): n=t or c
ggacgcagacttcagaccaaactgctggtaactaagctttttatttctgttgctcaggcancatctcttgcccaagtcctttccactggatttggttctgattccgtgtgtgccgctccac

SEQ ID NO: 3544 - DNA, 121 bp, Artificial Sequence
  Synthesized
  misc_feature (61): n=a or g
cttacaaatagaaatgaaacctggtgttgctgtgagtttgatttctagctgagcagtatgngttattccattgggcttttcccagttaaggtttctgtcatgtttttcacttctttctaaa

SEQ ID NO: 3545 - DNA, 121 bp, Artificial Sequence
  Synthesized
  misc_feature (61): n=t or c
catacgctcttctgttccattgctagttggcttttgattagtgaacacaaggactgaacantgttttacactgtaggtgactacagatacatatatggcaagaaactattttcaagtcttt

SEQ ID NO: 3546 - DNA, 121 bp, Artificial Sequence
  Synthesized
  misc_feature (61): n=a or g
cctactactataagagtcaaaataaaatatttaagtaatttttcagtgaatgtcacagcantggtgacacatttgctgtaaaggctttactcttgttaaatcaatacagtctgcaatgcaa

SEQ ID NO: 3547 - DNA, 121 bp, Artificial Sequence
  Synthesized
  misc_feature (61): n=a or t
acagaaagaaaaaaatccttaatatctactcaacatttcccattcttccaaataacatatnttgcttctcattctattgccgcatagttccaagagcctggaaccatctcttctgcaacca

SEQ ID NO: 3548 - DNA, 121 bp, Artificial Sequence
  Synthesized
  misc_feature (61): n=a or g
atagaaccttatttacttgaagcattcagctgtatttagaatggctatatattatttgcantagtggggctaaaatcttcccgattctatgccacaaacacctgataatcagcatttttct

SEQ ID NO: 3549 - DNA, 121 bp, Artificial Sequence
  Synthesized
  misc_feature (61): n=t or g
ccaaagagaagtgaaaaagccttgtgaatggacaaaacgtaatagttgccagctagagaantttccttctactccatacttctgtttgtagcaaatctgaacttttaacaaaaaagattgt

SEQ ID NO: 3550 - DNA, 121 bp, Artificial Sequence
  Synthesized
  misc_feature (61): n=t or c
tgcatcacagtgcacactcttcactcttcacacaatgagtttgccctataaatacacagcncatgatgagtaggtatatatgtgatatatacctgtttatggctctgctaagtgctgtgga

SEQ ID NO: 3551 - DNA, 121 bp, Artificial Sequence
  Synthesized
  misc_feature (61): n=t or g
tattggtggatcactgtgatgctgcacatctaaggctgtgcttattgagagtctgacatcncacagtgcacctgtagagcattgagtggaacaaggccttaatcatgtttttaagtgcaca

SEQ ID NO: 3552 - DNA, 121 bp, Artificial Sequence
  Synthesized
  misc_feature (61): n=t or c
cttttctccttgatgacttttccatctgccctgaaagcccagtaaagtctcatttaagagncctgtgcaaaagctgttatcaacttcagcaacagacaggcatttttctgtgtcctcattg

SEQ ID NO: 3553 - DNA, 121 bp, Artificial Sequence
  Synthesized
  misc_feature (61): n=t or c
gatgtagggagcatttctcttttggtttttgcagagctgaggcttgcttgggcggttgaangagtcccagcaaaaagtgaaaggttgtgatgaggactggcagtgagcagtcatcagatct

SEQ ID NO: 3554 - DNA, 121 bp, Artificial Sequence
  Synthesized
  misc_feature (61): n=a or g
gacttcttgagcatttcagtagctctcaaggtcttcttactgcagtcctacatttttcctnttttattctaatgaaagtgttttatttctattaattttctgattgctgattatctgccca

SEQ ID NO: 3555 - DNA, 121 bp, Artificial Sequence
  Synthesized
  misc_feature (61): n=t or c
atttggatagtgttttttcccccttttctttacaaccacttgaaaacatgttcatgctcanatgttcattatcaactacaatcttattagggaaaatattctaaaaagaaatccaggtagt

SEQ ID NO: 3556 - DNA, 121 bp, Artificial Sequence
  Synthesized
  misc_feature (61): n=a or g
atggtatttataaaattgttgtaccactttgtttatccttgacaatgcttacatccagtcnctgaactctgtcccagatctccttgcatggttacaaacatatatttttagaggaatgctc

SEQ ID NO: 3557 - DNA, 121 bp, Artificial Sequence
  Synthesized
  misc_feature (61): n=a or g
ttacctcctttgcagggtttaattcctagagggccttaggcttcctcgttgtgtccctacnggccctgacagtattactgtattcttcccagatacgcaggtcctgattccacattttatg

SEQ ID NO: 3558 - DNA, 121 bp, Artificial Sequence
  Synthesized
  misc_feature (61): n=a or g
gatcttcagcacagcacaagtactgctgcatttaggtaagggaactgttcttctcttttancataaccagggatttcatatgtaaaaggcatcaagtgatgccaatctgcagaagacttct

SEQ ID NO: 3559 - DNA, 121 bp, Artificial Sequence
  Synthesized
  misc_feature (61): n=a or g
gtactttctttcaagctattttcagaaacagggttgtgggtgtggttatactaattttccnatcacttctccatttcttaatgtattttaaaatagtgaaaaatatgctttattctaatta

SEQ ID NO: 3560 - DNA, 121 bp, Artificial Sequence
  Synthesized
  misc_feature (61): n=t or c
agatgctcctattccttttccagatggttaactttggtatgagtcagtctaggtcgaagangtgaagaataactaataaggcttttttaggtaaaggtaaaggctttttttatatttattt

SEQ ID NO: 3561 - DNA, 121 bp, Artificial Sequence
  Synthesized
  misc_feature (61): n=t or c
cagtgagcccagacatttaatccttgggttattgttcagggacctggtggaaagtcaccangaccccatctgacctcctacttccctggttttccttccacagacggagtacgtaaaggag

SEQ ID NO: 3562 - DNA, 121 bp, Artificial Sequence
  Synthesized
  misc_feature (61): n=t or g
tgggcattgtgcctccagcaacaccttgtgatgtctcagagaaaaacactgggcatgacanaaaggcaaggtctcctgtaaataaccaacaaccacacaggcaagatctgatgagtaatgt

SEQ ID NO: 3563 - DNA, 121 bp, Artificial Sequence
  Synthesized
  misc_feature (61): n=a or g
caaagagcatcagccttgccttacacactattaacttctactgatggacaaaacatgtacnttttgtggtgaaggaaaaggtgatttaagtccttaagaaattaatggaacttcagagtga

SEQ ID NO: 3564 - DNA, 121 bp, Artificial Sequence
  Synthesized
  misc_feature (61): n=t or c
atattgcttaatacttaattacttgcacctgatctttttatactgttcaccaagatatcangtagaattctataggcacacctttagaacactactcagaagtttaaaagtaaacccaatg

SEQ ID NO: 3565 - DNA, 121 bp, Artificial Sequence
  Synthesized
  misc_feature (61): n=c or g
ttttcagttccaattccaatttataacactaacaagcacgtgtccaatttccaagtggagncatggaaagaaatttggatatgtaaaagaattcaagtttatcaagggtgacaaagtcact

SEQ ID NO: 3566 - DNA, 121 bp, Artificial Sequence
  Synthesized
  misc_feature (61): n=c or g
aggaggagaagggctgaaggcagcaggacaagcaacaaagccagccagagttgttctctgncaagtcagcgcaaggcatgtcatggcaacaggggcatcaagcaagggacatcaaagggaa

SEQ ID NO: 3567 - DNA, 121 bp, Artificial Sequence
  Synthesized
  misc_feature (61): n=a or g
tttcattcttgaatgtttcagagttttcacttggctgatctgtaataaatgcattctgcantctacaatccacaaaatcacaggaggctgaggttggaagggctttctggagattgtgcag

SEQ ID NO: 3568 - DNA, 121 bp, Artificial Sequence
  Synthesized
  misc_feature (61): n=c or g
cgtcttcctccatacttggtagataagcaagaaatcagaaaatgcacagcaatataacccntatagtatggctgtgatcaatcattcttttagcaacataaggaaagaatattccccccat

SEQ ID NO: 3569 - DNA, 121 bp, Artificial Sequence
  Synthesized
  misc_feature (61): n=a or c
aatagtagaggaacaacaccaggatcgacctatgaaccaatgagccaaaatagcacgttgntttccctggtgagtgggtaagcttgctttggtgaaaagcttaatactatacagagagtga

SEQ ID NO: 3570 - DNA, 121 bp, Artificial Sequence
  Synthesized
  misc_feature (61): n=a or c
ctgaagttatacctgggctttggtaaagacagtgggaaggtgtagagacattcctttttgncattccacttcctatactcattggatggacagaaatttgaactttgttttacctactagc

SEQ ID NO: 3571 - DNA, 121 bp, Artificial Sequence
  Synthesized
  misc_feature (61): n=a or g
gtttacgaccagtttatactcatttgatcttattccagcattgtcttggattttaacctcncactaatttaggaaacaaagtgagaatttttaaaggagaaaaagggattacactgtttaa

SEQ ID NO: 3572 - DNA, 121 bp, Artificial Sequence
  Synthesized
  misc_feature (61): n=a or g
cttgtttgtctcagtgatctcagtcatttcagctgtgatattaactcagaaaagccacacnagaccttgaagagtgatgatgggagaaggtgtaaggactgttggtattctacactgtttt

SEQ ID NO: 3573 - DNA, 121 bp, Artificial Sequence
  Synthesized
  misc_feature (61): n=t or c
ttttttctttgctgccactttagggttagcttctttgtcacatatgacagaatagtcttcnagaaacgggctgagtggcaaaccatgaagagggagattgtatccactgccctcaagaaaa

SEQ ID NO: 3574 - DNA, 121 bp, Artificial Sequence
  Synthesized
  misc_feature (61): n=t or c
cacggttcagttaaaccttcctatccacatttcacaaatgggaacgatgatacagaagagngaactgacttgcctaaggttacacaaatagtcggctgtcaactcaagtccaacaaggtcc

SEQ ID NO: 3575 - DNA, 121 bp, Artificial Sequence
  Synthesized
  misc_feature (61): n=t or c
tcaaagtgacaataatgattaaaaaaacaaagctgataatattggtaaacaggaaaaggangtgtgttgatgaattactgcatgaagaagagttgtgtagaaccaggcactgagaatggca

SEQ ID NO: 3576 - DNA, 121 bp, Artificial Sequence
  Synthesized
  misc_feature (61): n=t or c
tgtcctagatatgacagagtgcatttgtgtacacagctgtgtatgcaggaaaatcactttnatggtaaaaagcagagtcgcataacaggaacgtgaagtttggtaggagactcaggggtgt

SEQ ID NO: 3577 - DNA, 121 bp, Artificial Sequence
  Synthesized
  misc_feature (61): n=a or g
agaattttgtagtatcaagtaaaagttgaaaggtaaaaacttgaactcgggagaatcaagntgtccttgtcaaatagtaaaaataccactgcacaaagcactgtgtaaagtcaaggcaatc

SEQ ID NO: 3578 - DNA, 121 bp, Artificial Sequence
  Synthesized
  misc_feature (61): n=t or c
ctaaattcacaaaatattaggggttgaactagaaaaaagaatgatggaacagctgcagagnttccaagttgtaacacactttgctgaaaagagctcatttgcaagaacagccaacagttat

SEQ ID NO: 3579 - DNA, 121 bp, Artificial Sequence
  Synthesized
  misc_feature (61): n=a or g
atgaatgtatcaccgagaaaaatgggagcacctggataaatcaatacagctgttacattcntctcagccttttactttgccaggtatttaatagaatccttgcacttgctagttacaaact

SEQ ID NO: 3580 - DNA, 121 bp, Artificial Sequence
  Synthesized
  misc_feature (61): n=t or c
tcaaagttggtatcatccccgctaaactgaacagccctactgtatgttgcagagaactccngaaggggagataccatgggactaaggcttaaaatggctgcatttttagagaaaccacatt

SEQ ID NO: 3581 - DNA, 121 bp, Artificial Sequence
  Synthesized
  misc_feature (61): n=a or g
aaaagcctgaactttgtgtacaaatgtggatgacgtgtctgaacctcccatttctcttgcngaccatacaggttgtgctttttcccacagctttgaaggctcattggcttaagaagcctta

SEQ ID NO: 3582 - DNA, 121 bp, Artificial Sequence
  Synthesized
  misc_feature (61): n=a or g
aacaatgaagtgttggaagcttgtcagaatttccgaaagagctgaatctatagctaattcnttatattaagatcttcacacagcaattttctctgcttccagaaaagcataccccaaactt

SEQ ID NO: 3583 - DNA, 121 bp, Artificial Sequence
  Synthesized
  misc_feature (61): n=t or c
gtgaatacagcctgcagtaatgacttggatgggtacagaacttcttttaaagcctgtatgntattactggtgaaataagtgtcacagagcccagttttgtgccttaaaatgaactaacctg

SEQ ID NO: 3584 - DNA, 121 bp, Artificial Sequence
  Synthesized
  misc_feature (61): n=a or g
ccattagattgcaaagaagcatagagggaagaaccctgtgcaacagtctggagccagcaanccctcatttgcagcagtgaattgatgaattttcatgatatctattagtagtaagctgcag

SEQ ID NO: 3585 - DNA, 121 bp, Artificial Sequence
  Synthesized
  misc_feature (61): n=t or c
gaggtactcttcacatctccctgcctttggaccacatacttcaaatcatttggagaaaaangataagagctggccagttcttgttttttttttaaatgaattggtttttgatttctggagc

SEQ ID NO: 3586 - DNA, 121 bp, Artificial Sequence
  Synthesized
  misc_feature (61): n=a or c
tcattcccagcaacatgcataggagatttaattcattagttcaacatcaactggagaagantggcaagtctttgataagacttctgtttggatgacagcaatagtgtgtgtaggtttagag

SEQ ID NO: 3587 - DNA, 121 bp, Artificial Sequence
  Synthesized
  misc_feature (61): n=a or g
cacatgggaccattctgggctatgtgcttatatggctttatatttaaagtcaaaatgagcngtgctcagagtttatgtgcttctgaggtaaggcagacacttcatggggtgtgtttatgtt

SEQ ID NO: 3588 - DNA, 121 bp, Artificial Sequence
  Synthesized
  misc_feature (61): n=a or g
aacatttttcttaaagagggtattaacaacagcagtggtcatgtcagcacttattgatacncttttgccattctcatcagtggggaggtgaatgttcccccagcagccactcacaccagct

SEQ ID NO: 3589 - DNA, 121 bp, Artificial Sequence
  Synthesized
  misc_feature (61): n=t or c
aaaactttgcccatatttagccaagtttattcttgaaagataaccagctcaagaggctcangctcacatttcagagcctgccctccttgcctgagcaaaatggatgtgagtcagcttttct

SEQ ID NO: 3590 - DNA, 121 bp, Artificial Sequence
  Synthesized
  misc_feature (61): n=c or g
ttcctagtgatgcaagtcagtagacgcccatcaaaatcttttctgcaaaccaagcccatgntgggttaaataatgcctttccttgctcatctgaccagctcaacaactcaaggaaagcctt

SEQ ID NO: 3591 - DNA, 121 bp, Artificial Sequence
  Synthesized
  misc_feature (61): n=a or c
aactcttctaatagaggggttactgactccttacttcctcagattcacattaataaatatnattccaaagaaggcccaacatcagtttcctcttgagaaaccttcttagcctaaagatcga

SEQ ID NO: 3592 - DNA, 121 bp, Artificial Sequence
  Synthesized
  misc_feature (61): n=a or g
aaatgaaaccaggagcagagaaaatcacacccagcccagcagtggcaaaggaaaaccagcnctgctgtgagcttcacactctgcttctcaggaagctccgaatggaagtgtttgggaagat

SEQ ID NO: 3593 - DNA, 121 bp, Artificial Sequence
  Synthesized
  misc_feature (61): n=a or g
gtagaggttttctgtataactactccaggaagacaggactttctgtagtgtagtatttatnctggaaatatagtctttgcacatggaaatttttgactccactgtcttaaaaagtttgcta

SEQ ID NO: 3594 - DNA, 121 bp, Artificial Sequence
  Synthesized
  misc_feature (61): n=c or g
attctgttcctcctccaaactcagtgacgttactgatatccacaagatgctgattaatttnttggtttttttattcccattgtatctatcccacagaatttagtgagaaagtttatttctg

SEQ ID NO: 3595 - DNA, 121 bp, Artificial Sequence
  Synthesized
  misc_feature (61): n=t or c
aaaggggcatagggaatgtgggcactatttatttctcctacttggcctgtgatttgggtgncctaatattttcttaagctccaagctaggccaataatgaagaatgagacactagttttgc

SEQ ID NO: 3596 - DNA, 121 bp, Artificial Sequence
  Synthesized
  misc_feature (61): n=t or c
catcataagcccacaggtacaaaaagccaagaggtactttcctgccccaactgggctgagngtcttatcttctggcagcttgagaagcagattgtaggtccggtatccaatctttcacaga

SEQ ID NO: 3597 - DNA, 121 bp, Artificial Sequence
  Synthesized
  misc_feature (61): n=t or c
taaagacatgaaaagagcatggccagcggggtcgaggaaagtgatcctctgtctatactcngccctcatgaggccacattcagaatactgtgtccagttctgggctattctcttttaagtg

SEQ ID NO: 3598 - DNA, 121 bp, Artificial Sequence
  Synthesized
  misc_feature (61): n=a or g
tgtttctattgcttgctctcctagccagagcaataccagtttccatctcctgctgctccantgaagctgtaattcttttttccagaatgaaacaacttcagtggcggagaatgaaacagac

SEQ ID NO: 3599 - DNA, 121 bp, Artificial Sequence
  Synthesized
  misc_feature (61): n=t or c
gacagttatggttcttggctttcccacatgcttctagtttcacaggtatcaaaacatatcngtatgtgacctttaactcttcaaaggtacccagaaatccatgctatttcggttgcgtgct

SEQ ID NO: 3600 - DNA, 121 bp, Artificial Sequence
  Synthesized
  misc_feature (61): n=a or g
atttgcccattgctgggggctactagtcccaggaaggaaatccacaaaaccagcagaaacnaactggaagattgagctggaaagaaagccagggtccctttgggaaaaaaaaagaagaaaa

SEQ ID NO: 3601 - DNA, 121 bp, Artificial Sequence
  Synthesized
  misc_feature (61): n=t or c
ccaaatgtaacacatcagacagcgatggggagaggacgctcaagtaactgcatcctgcctngcatatctctgggtcagggctgcttgctccagcccagctgtctcagagctcggagccata

SEQ ID NO: 3602 - DNA, 121 bp, Artificial Sequence
  Synthesized
  misc_feature (61): n=t or c
agatagactgtttagccagtgaatgtgtctcctcttatggtggattagcaagtggagaganctgattcttgttggtactgttaagtaggaagtgtggcatgggttgagacactaagtttta

SEQ ID NO: 3603 - DNA, 121 bp, Artificial Sequence
  Synthesized
  misc_feature (61): n=t or c
gccacaagcatcagctccttcaaaatgtttgaaagctgatgggtataatttggacaacttnatacaaagaggttgagcacaaggaagaatctcacagatccacatgctgttcctcctccca

SEQ ID NO: 3604 - DNA, 121 bp, Artificial Sequence
  Synthesized
  misc_feature (61): n=a or g
aacagttttctccaaagaaaaatgtcctctttgtctaaaaatacatcctcctgatatgctnatgggcagaacgaaaatgaaaaggtatctgaattccatgttcaaacaacgtgcttactct

SEQ ID NO: 3605 - DNA, 121 bp, Artificial Sequence
  Synthesized
  misc_feature (61): n=t or c
tctcttggccaacaccaaacccattatctcctgccacagctatttattccctgcttaccantgcttgaaaattcagtgtttaaaccccaaagaggctctggaagcatcttgctgctgtata

SEQ ID NO: 3606 - DNA, 121 bp, Artificial Sequence
  Synthesized
  misc_feature (61): n=t or c
ggctcccagaagatccactcctgctgagaacgagcagaattttcttaccccaacacagacntgagcttatttaaaaccctcccagagagcaaagcctgaagtcccatgagtcattttctcc

SEQ ID NO: 3607 - DNA, 121 bp, Artificial Sequence
  Synthesized
  misc_feature (61): n=t or g
ctttcctgcccctccgctggtgccaatgcacatgcgtgcatgacatgctaagcctaagctncaaaaaacacacttactgggacctgctgctggcaaatgggactcacaggctcctctgtcc

SEQ ID NO: 3608 - DNA, 121 bp, Artificial Sequence
  Synthesized
  misc_feature (61): n=t or c
ccactacccctgtaggtaagctaataacactcctgaacttactacgcttcagagatcgcangctgagactgcaaactgctcatgacagaaactgcacactcctctattcccacagcgactg

SEQ ID NO: 3609 - DNA, 121 bp, Artificial Sequence
  Synthesized
  misc_feature (61): n=c or g
tttaacaataatactttctttacactgcacttatccactgcaaatccagtctttcagttgnaatttggagccatcattgtttaacacgttgacccacttttaggcatctgtgaaacacatt

SEQ ID NO: 3610 - DNA, 121 bp, Artificial Sequence
  Synthesized
  misc_feature (61): n=t or c
ggtagaacagatggcgtatgaccctagcaacatgccacctggtattgaacctagccctganaagatgctgcaggtaatctactgtttgtgtagtactccttgggtgaaatgcagctgattt

SEQ ID NO: 3611 - DNA, 121 bp, Artificial Sequence
  Synthesized
  misc_feature (61): n=a or g
gagggatgggattccttatgtgtttggggcttttttccttaccatcagaaaagcatgtganctgtagaaaatatactttaaaatcccgtctttcaaatgcacaccattttacagaagctgg

SEQ ID NO: 3612 - DNA, 121 bp, Artificial Sequence
  Synthesized
  misc_feature (61): n=t or c
ttaaaagtttgctgtctgtccttcccattccctgtgactaatttggcatttccagttcctnatatcttggatgagccggttgttcagcttgtactcactgaacagggaaaaaaatcttgtt

SEQ ID NO: 3613 - DNA, 121 bp, Artificial Sequence
  Synthesized
  misc_feature (61): n=a or g
aatacagaaagcaaagttagcaccagactacttagagaacatcaccagcaatatgaagtcncttatacctcacagaacagccacaacaaggcaagttagaaacttgctaatgagtctgata

SEQ ID NO: 3614 - DNA, 121 bp, Artificial Sequence
  Synthesized
  misc_feature (61): n=t or c
gtggaagctgaggtaaaacaggctgaaaaggacacaaaccttttccagcccattgtaactntgtgaacaatacacagaaagcctttctaaatactggctctattcaagttaggactgcact

SEQ ID NO: 3615 - DNA, 121 bp, Artificial Sequence
  Synthesized
  misc_feature (61): n=a or g
tatttataaatacagcactcaccactttgaggtcatcattttctaatgcttatgcaaaacnatcagattacgaggggatcatctatttctaaacagaagctatatactgtaattgtggggc

SEQ ID NO: 3616 - DNA, 121 bp, Artificial Sequence
  Synthesized
  misc_feature (61): n=t or c
ttaccaaactaaggaactgggacatgcatttgcatttattttagcagtacagttaagtaangaactctataatagtttagttcataaggctcatgagttgactaaaagtactgaagaaaaa

SEQ ID NO: 3617 - DNA, 121 bp, Artificial Sequence
  Synthesized
  misc_feature (61): n=a or g
aagggaggagaagtgaaggcgtgttggaagtagaaggtaacaataagacaatgtaggtcancacgctccttgtgcctacagcccagctattgtcaatgtcttttgttgcctctgctaccag

SEQ ID NO: 3618 - DNA, 121 bp, Artificial Sequence
  Synthesized
  misc_feature (61): n=t or c
acctgcacttgctgatttgtaactgattcattaagagcttccatcagtccgaactggctgngatctcacagagatgggatgtaaatatgatcagtgcaggtgagcctgttcacagttctcc

SEQ ID NO: 3619 - DNA, 121 bp, Artificial Sequence
  Synthesized
  misc_feature (61): n=a or g
ctgaagcatggaaggaaaacttccatggcaacttgggcaagcactcatgttttcagatganaagttcctcttgcttttgctttacagcagccctagacatgcatattccgtggagattttc

SEQ ID NO: 3620 - DNA, 121 bp, Artificial Sequence
  Synthesized
  misc_feature (61): n=t or c
ggaggtgagaaatacacagaacaccttgactgcttcaagacgaagcttattacaagtcacncataagacacctgcaactacaaaaggctatgttccagttctgtgcctaacataccatttt

SEQ ID NO: 3621 - DNA, 121 bp, Artificial Sequence
  Synthesized
  misc_feature (61): n=a or g
aaatggttcttcaaacagtagcttattctcctattaagtgggtgtgcttattcaggctggnaggtcatgctgctgtctgctaccttgcagctggttaatgtgggaataattttaatcaatc

SEQ ID NO: 3622 - DNA, 121 bp, Artificial Sequence
  Synthesized
  misc_feature (61): n=a or g
ccccactgctgcagccgtggtgggttggtacccagagcagggatggggagctcctcctgtncacttggtactcagtttaccttgttgatgagcagaagtgctatctgctgaaactttttaa

SEQ ID NO: 3623 - DNA, 121 bp, Artificial Sequence
  Synthesized
  misc_feature (61): n=a or g
atacatcccttgtccaacacaataggaaaatgagtggtggcctcaacagttagacccacancaaagtatttttatttactttagccacattcaactggccaaatttatgatcaacttaata

SEQ ID NO: 3624 - DNA, 121 bp, Artificial Sequence
  Synthesized
  misc_feature (61): n=a or t
aacatcagcgtttcagctggtagctaaggcttgaagacatacactcaagtcttgtctcatntttgcttactgagaatcacaccttaaagtatctccaatttctactgatgcaaatttaacc

SEQ ID NO: 3625 - DNA, 121 bp, Artificial Sequence
  Synthesized
  misc_feature (61): n=a or c
aaaataaggagccccaaaaatttataatctaaataaatagagaaaacgtgacattcaaaangactgccaccctcatttcaaggcaattcaagatgatggaaactggtagattaaagtaaaa

SEQ ID NO: 3626 - DNA, 121 bp, Artificial Sequence
  Synthesized
  misc_feature (61): n=a or g
aattttggcacaaattgaattttatcagcttgcctaatctcccttcacttaactataaacntacatttaacaaaaagttcttctttgacaaacagtgccagaagaaatacttgagatgaaa

SEQ ID NO: 3627 - DNA, 121 bp, Artificial Sequence
  Synthesized
  misc_feature (61): n=a or g
ctttgcacaaattattacaagattcacctggttttatgcagagaagcccagttaaattccntcctcactgcactgagtttgggcagcagcatcactgcgcttggtgtaaatcacagcacgc

SEQ ID NO: 3628 - DNA, 121 bp, Artificial Sequence
  Synthesized
  misc_feature (61): n=a or g
tcaaaacaaacgacatcagcacaaccaaaaacactattcagaatcatattttagaggaccnactgccttaagtatgtgacatcttagacttcaagtttttgacatcacctgacggtgtccc

SEQ ID NO: 3629 - DNA, 121 bp, Artificial Sequence
  Synthesized
  misc_feature (61): n=c or g
ttatacctgttaaccccttcacagatgcaacacattaagcaggagaaaaatatctgattgnaggatctgttgagcccttcatttctaaacagtgtttttgctgtatgagtttcactgcaaa

SEQ ID NO: 3630 - DNA, 121 bp, Artificial Sequence
  Synthesized
  misc_feature (61): n=a or g
atggtatattttgtcagcttttggcaagagaaaagcaacctttgaaggactctcagagacnttattcaaatggctggtactgtcccttcttggctgtagttcaagcaatgacatgagaaag

SEQ ID NO: 3631 - DNA, 121 bp, Artificial Sequence
  Synthesized
  misc_feature (61): n=a or g
attattggtgtttacattttcatctggccgagtgagctaagaccgttatccagcaaaagangagagcaatccagaattaagcatactttatgccaaatgcatttggttgctggtggtttcc

SEQ ID NO: 3632 - DNA, 121 bp, Artificial Sequence
  Synthesized
  misc_feature (61): n=t or g
ttaaaaagcccaaatcaagtgcctctacaccattgtatacggtgtgggaagtaagtggganaagtggaaactgtggtgtgctgggaaaatgatgatcctgttgctatcacggaaacatggt

SEQ ID NO: 3633 - DNA, 121 bp, Artificial Sequence
  Synthesized
  misc_feature (61): n=t or c
cagtttcttcagtgcacagtcaacagcaataacatgttcctttcatatgggacatttcttnatagtgtccttcgttctactggacttggtgagcatattttaagcatatttgaataaaggt

SEQ ID NO: 3634 - DNA, 121 bp, Artificial Sequence
  Synthesized
  misc_feature (61): n=c or g
tttttgtgaaaaaaactatttcttccatccttcaagcatctcacttgaggatttgtactgnatatggctggaagttaagttttccatgtggtttatctctagtatattgtgccttgagatc

SEQ ID NO: 3635 - DNA, 121 bp, Artificial Sequence
  Synthesized
  misc_feature (61): n=t or c
gacgctccacaaattctgtggcaatctataatgtgcaataagtgacaaagaaaaagcagcncctacaaattattttaagaagagctgcatttctctaagtgaacattctcttgcgtgcaaa

SEQ ID NO: 3636 - DNA, 121 bp, Artificial Sequence
  Synthesized
  misc_feature (61): n=a or t
gtattagtaaccaccagtattgctttttttcatttggttttgtctgtcctctttctaagtngaaaaagtcagacgttctgagattgattgtgttagtcttttttcagtataaaaccttatc

SEQ ID NO: 3637 - DNA, 121 bp, Artificial Sequence
  Synthesized
  misc_feature (61): n=a or g
atttgtgaacatgcttggagtcgttgcccttccctcccacatacaattatgtgcggagtcnccaaaaatgggctgacacaaatgtagcacatctactgccctttccaacacattgtctgtc

SEQ ID NO: 3638 - DNA, 121 bp, Artificial Sequence
  Synthesized
  misc_feature (61): n=a or g
ggggaatgaagaagctccaaagggaaagtaccagatgggactcacagtcactgaatctacntggtctggttgtattggcagagaatctgacaccagaaaagttaagcgttgaagaagctgg

SEQ ID NO: 3639 - DNA, 121 bp, Artificial Sequence
  Synthesized
  misc_feature (61): n=a or g
agatttaaaatgtattcaggtagctaagattgttgactgcttcagtgtaggagatttctgnggaagaacattttacctgctctctttcctgacatgcttgtaatacacaaataaagaattc

SEQ ID NO: 3640 - DNA, 121 bp, Artificial Sequence
  Synthesized
  misc_feature (61): n=t or c
atcaaagtgatgttctttgggtatgacctgtcttaaatctgcagctgtctggagaagtttnccctgaagggaatgctgagggtgtactgagatatcagcttctcagatgtgtggctggagt

SEQ ID NO: 3641 - DNA, 121 bp, Artificial Sequence
  Synthesized
  misc_feature (61): n=a or g
gcacactctgatgatattcaaggagtaggtgtagcaagctgtgggaaccaagaaattaagnaaaatattgcagcgctgtcaagagtaggtgtagacattttgtacctgctaaactaaagcg

SEQ ID NO: 3642 - DNA, 121 bp, Artificial Sequence
  Synthesized
  misc_feature (61): n=t or c
caggtctgagagcatgccaggccacctgtggccacaggaaaagcaaatcctggcaactttnaaactaatttcccagatcttgccatataaatgaagtgagagatttactttagcatttgca

SEQ ID NO: 3643 - DNA, 121 bp, Artificial Sequence
  Synthesized
  misc_feature (61): n=a or g
aacattcattttcagtcccactgagtcacccagaaaagctggctctctaaaaatgaggccngtggagtctgagatccagccctactttccttcactccaacttggaattgttgtacagtta

SEQ ID NO: 3644 - DNA, 121 bp, Artificial Sequence
  Synthesized
  misc_feature (61): n=a or c
accaagtagaaatagttaaagaactgtactgttccacacctgcctttctgtgttgtattgngcctttcctttgatcctttttctcaagcagtggttagttaagaggggcctggtcagtact

SEQ ID NO: 3645 - DNA, 121 bp, Artificial Sequence
  Synthesized
  misc_feature (61): n=a or g
tccaggtcctatcttttctccagcaagtacatccagttcatttaaattgcagcagccccancaggaagaacctcctacaaggatctgctgggacttcatagtgcctgggcacagggaaatc

SEQ ID NO: 3646 - DNA, 121 bp, Artificial Sequence
  Synthesized
  misc_feature (61): n=a or g
accatctccagagaggtatcagccttatgtatttctaattagtgctgcttgagaagtgtgnagtgcccgccgagcacgctttgcacttgttttgaggcattctgtgagggctctatgggct

SEQ ID NO: 3647 - DNA, 121 bp, Artificial Sequence
  Synthesized
  misc_feature (61): n=a or g
tcatctatcctaggtgctattttattttcccattgcatagtgtaattctaggtacacgatntttgggaacttctcaaataagttgtcttgaactgcataataatgtaactctgacttcttg

SEQ ID NO: 3648 - DNA, 121 bp, Artificial Sequence
  Synthesized
  misc_feature (61): n=a or g
tatttggtggagctcagccttataattatctgacttcttgccagcgatgtctgcttaccantgctcacacacggggcaggatagcaatgacaattatgctttttttggccgtggtcttaca

SEQ ID NO: 3649 - DNA, 121 bp, Artificial Sequence
  Synthesized
  misc_feature (61): n=a or t
tgggtatgagatcagattggagtttttcctctagtttttgcagtgctctaccaattagacncccactactcacagagtatattaagccacagacatgtcagccttattttgccctattgtt

SEQ ID NO: 3650 - DNA, 121 bp, Artificial Sequence
  Synthesized
  misc_feature (61): n=a or c
tgtgagatggcagaagtagtggcatgccacgctctgggcccacaagccaaagaaacaagancccccccaggaaaaataggtcttgttttaaagaatgaatatactgtgatatcaggagaga

SEQ ID NO: 3651 - DNA, 121 bp, Artificial Sequence
  Synthesized
  misc_feature (61): n=c or g
tgaaatatttgtgtggtcttgaacatgactgcacttcacattgacagtcagcgtgctgatntcaactgtttgttgtcaacatgcaggtgtttagatgccgttcctccttctgcaatagact

SEQ ID NO: 3652 - DNA, 121 bp, Artificial Sequence
  Synthesized
  misc_feature (61): n=a or g
catgggcttcttcagccacttccacgtgggtagggggaagatgcagccgttaagtcactgnaaaacatgacaggcaagagcaagcatgccatatgggcaggctgatcttctgtctaagaag

SEQ ID NO: 3653 - DNA, 121 bp, Artificial Sequence
  Synthesized
  misc_feature (61): n=a or g
gaggcactaatattccaggtttttagggttgtgggtttatttgcatgtcacttaatagtgntatttgctccagagattctctctgcaaaactgtagtgcatgaaagctttccttgtaccta

SEQ ID NO: 3654 - DNA, 121 bp, Artificial Sequence
  Synthesized
  misc_feature (61): n=t or c
tgtctcttacagtgtttactgtttgatgggaaagtccagtttttgagaatgctcctctgcntccaaacactagcctggaaagctggctcctcctgtgttttggagtagtgcaggatgtagc

SEQ ID NO: 3655 - DNA, 121 bp, Artificial Sequence
  Synthesized
  misc_feature (61): n=a or g
gaagaactgctctaacaaagcagctgctggcattaaatagggcttcagcaactcctctgcnggaggcaagctgctcttttcgggtgcgggacagggcacgtctgaatctctctcgctctca

SEQ ID NO: 3656 - DNA, 121 bp, Artificial Sequence
  Synthesized
  misc_feature (61): n=t or c
caagccacctacagccttggtagcaacagaaacaacatagtttatgcagtggataatgaangtgagctaattgttccaccgttgtgccctgttttgagcagttggacacagctcaccagta

SEQ ID NO: 3657 - DNA, 121 bp, Artificial Sequence
  Synthesized
  misc_feature (61): n=a or c
tttgccagtaatgaagtcactacatgaagaacagagctacagaccaagttccctggctttncttaagaccaaaatacaactgcatgatatactcatgagtttctgctctgcttgtaaaatt

SEQ ID NO: 3658 - DNA, 121 bp, Artificial Sequence
  Synthesized
  misc_feature (61): n=t or c
tttatgttttgaattatgacatttgttattataccttaagtagacttagtaatgcagtacngctgcttaggatgcgttctcaagttgtcagttaataaatggtttttcataaatcctataa

SEQ ID NO: 3659 - DNA, 121 bp, Artificial Sequence
  Synthesized
  misc_feature (61): n=t or c
cattggtaggtttttaaattcaccttgcggctaactgactttgtctcatatttcctaacangcagcattgttttctccatctcctcttctctccccaccaccaggtaagccacacagcaca

SEQ ID NO: 3660 - DNA, 121 bp, Artificial Sequence
  Synthesized
  misc_feature (61): n=a or g
cacaccccaaactccacttcaaatttcagctgaaaaaaaccaacacttcatatagtgagcntttcaaggttagctagctcactagggactgcattctgtcattactgcaagaaatgattca

SEQ ID NO: 3661 - DNA, 121 bp, Artificial Sequence
  Synthesized
  misc_feature (61): n=a or c
attgctattacacgttctgctttctcaaagacaaaacagaaaacatgaagagaacgttaanaacgttaacaacaattacttaagcatttaaaggaagatactgacagcacagtgaacaaca

SEQ ID NO: 3662 - DNA, 121 bp, Artificial Sequence
  Synthesized
  misc_feature (61): n=a or g
gcttggggcagtgtctcctcctgtctcccaatagcctgtgtccttggcacttacaactgcntctggtttcagctgaatctttaccagtgctaaagtagaatggggaggagggttttgtgtg

SEQ ID NO: 3663 - DNA, 121 bp, Artificial Sequence
  Synthesized
  misc_feature (61): n=t or c
ttcaaaatagcacactttctataagctgtatcttcaactcctaaagcaccaacaaaagcanggtcaaagaaatcagcatcaacattttctgatgctggacatctagtaggtggcacaagcc

SEQ ID NO: 3664 - DNA, 121 bp, Artificial Sequence
  Synthesized
  misc_feature (61): n=a or g
ttaaaaatcctttaaaaacaagtgaagctgctgtttcagaattcatgagcagaaaaagcanccttagcctccctgcaaatactttatgctgatggaattatttctgtttcttatctcaaaa

SEQ ID NO: 3665 - DNA, 121 bp, Artificial Sequence
  Synthesized
  misc_feature (61): n=a or t
aaagtatttccatcatctctgtgaatatcagcatcatagatagctcagcttctgttttatnactgttttattagacatccctggaccattcttttgggtgatttttttccccccaaatctc

SEQ ID NO: 3666 - DNA, 121 bp, Artificial Sequence
  Synthesized
  misc_feature (61): n=a or g
atacacgaaaccatcagagagaccagttgctatgttgaatactgttctacagcttcacagnatggtaggtgcttagactattttcccttagccaggtgccgtggacttacagagtgacagt

SEQ ID NO: 3667 - DNA, 121 bp, Artificial Sequence
  Synthesized
  misc_feature (61): n=a or c
aaagactgtgatgtttaagtattccttacatgcagacttaagtgccatgagtgactccagngcatggcgagttctatgtctcaggacagaacagaatagttcaggctagtttgtgcaaccc

SEQ ID NO: 3668 - DNA, 121 bp, Artificial Sequence
  Synthesized
  misc_feature (61): n=a or g
aggcgtgctagcttaaactgataacttcatacaattgctgtgcagacacaaattggtgtgnggcaaccatcaacatgtcagagttaagtctacagtgaagatttactgtgtgcactgacaa

SEQ ID NO: 3669 - DNA, 121 bp, Artificial Sequence
  Synthesized
  misc_feature (61): n=t or c
ctctgtgtgcctggagtgcatgcattcaggtcactgcatcatggaagtctattatacatgngttgtttttaaagtgatttctgattgacagagcacagagttggcatctaattgatgtgaa

SEQ ID NO: 3670 - DNA, 121 bp, Artificial Sequence
  Synthesized
  misc_feature (61): n=a or g
agaaacggtgtgcaaacaaactaatcatctgacatctcagcaacgagcatggggaagtgcnagttatgtgcatcagtaacttgtgcaagggatctaattaggaacagatgcttaaactttt

SEQ ID NO: 3671 - DNA, 121 bp, Artificial Sequence
  Synthesized
  misc_feature (61): n=a or g
gactgtgttgcaagtaataccaacaggtatataaggtgtgaaacacacaaagtaagctgtnccactgcaaagtgtaatgggacacatgcagggtggcccttcgtagggagatagggttgtc

SEQ ID NO: 3672 - DNA, 121 bp, Artificial Sequence
  Synthesized
  misc_feature (61): n=t or c
tttcctagttgcagctcatgagaaatggtctgctgaatgttcagtgtgaccagatgaagangaaggagctacagagggtgagatgaagagcgtgggctttgctttacacatttacctcaat

SEQ ID NO: 3673 - DNA, 121 bp, Artificial Sequence
  Synthesized
  misc_feature (61): n=a or g
gtaaatagttttattcacattggattaacagcttgcttatagctaagtactaggatgatcnttaataaactctatttactgatggacaggaaatggctctacctcaccaaacctaagagac

SEQ ID NO: 3674 - DNA, 121 bp, Artificial Sequence
  Synthesized
  misc_feature (61): n=a or g
cagctgcttgctgcatccgatggcttaatggtggagactgccatctcccagccagctcagnagaagttttagttcacacagctccttctcccgatgcaatctccacactgccgaagtccac

SEQ ID NO: 3675 - DNA, 121 bp, Artificial Sequence
  Synthesized
  misc_feature (61): n=a or t
atttgtttatatttgttattaatccatctctaagtttcatacgttcattttcttagctgtncttctttctgtggctatttgtttttgcttaaaacttgcatgagaaataaggcctttacat

SEQ ID NO: 3676 - DNA, 121 bp, Artificial Sequence
  Synthesized
  misc_feature (61): n=t or c
gtattttatcctacttataaatgcttggaattttggaatttacaagttttctgttaatggntgcttaaatttggataggctatgaagttatttcacctgacagctgttttatttttacatc

SEQ ID NO: 3677 - DNA, 121 bp, Artificial Sequence
  Synthesized
  misc_feature (61): n=a or g
cagccacagcaggggcacgaggtagctcagggttggaggtggcatcaagttcagcgtgaanggctgttgtgaacacctctactgtgtatgttcgtgtggtaactgcagatggaaagtgctg

SEQ ID NO: 3678 - DNA, 121 bp, Artificial Sequence
  Synthesized
  misc_feature (61): n=a or c
tcagcaaaaatctcttagcatagcctaaacagctcaattcctattgttcaccacattctangttacaggaaagaaaatacttttacttttgaaactgctccagcagcccatcatttttctt

SEQ ID NO: 3679 - DNA, 121 bp, Artificial Sequence
  Synthesized
  misc_feature (61): n=a or g
atcagacaccattgctttgaatattttgatgaattaattcataaataagctcctttctgcncgaagcccatctaaataaattgtatttgagggaagggaggtggaagagaagttgtgggtt

SEQ ID NO: 3680 - DNA, 121 bp, Artificial Sequence
  Synthesized
  misc_feature (61): n=t or c
ttaatgagttttcccagaagtacatttggcaataggacacttaaagaaatgacttgtttangtgggaaatgcccttcttaaatcaaaggccaaacccactgcaactacttctgtacaaaga

SEQ ID NO: 3681 - DNA, 121 bp, Artificial Sequence
  Synthesized
  misc_feature (61): n=t or c
cagtatccttctgactgctactactctttcatttgtaccatttacagtccatacatacagnccacctgagcagactgcattgattcaatggctccccaagtagaaggtaacggacacttga

SEQ ID NO: 3682 - DNA, 121 bp, Artificial Sequence
  Synthesized
  misc_feature (61): n=a or g
taagccttggagtaaaggggcattaggggcattaaatgtcaaaataagggtggaaaattcntaaggaagctaattgggaaactttctttaaaactatactattatggattttatctgtaaa

SEQ ID NO: 3683 - DNA, 121 bp, Artificial Sequence
  Synthesized
  misc_feature (61): n=t or c
gacaaagaatttgtcctctcttttcctgttgggtacatctgctccaaagagcccaagcacnttaaaagaatctcctttttcaatagtgacattattcacagattaggtaagttagactgta

SEQ ID NO: 3684 - DNA, 121 bp, Artificial Sequence
  Synthesized
  misc_feature (61): n=a or g
agtcagaagggaaaggaatttcaggcaccaagaaaatccacagggaagtacaggaactccntatctgagaaactcaaactgtaacttcctttccttcattatagttccatccatcattata

SEQ ID NO: 3685 - DNA, 121 bp, Artificial Sequence
  Synthesized
  misc_feature (61): n=t or c
acttttgatgcttgttcccaagagacagctaccgctacagactctatatctgggtgcacantcttgaacagccaggtctaccagtcttagtggacttgggtgctttgttactgctccttct

SEQ ID NO: 3686 - DNA, 121 bp, Artificial Sequence
  Synthesized
  misc_feature (61): n=c or g
aaagcagtgaattagtgagttatctgcaagaggcataatcaagacttcagagtaggaattntctcactgctgcatttgaaggcctttccctggaccctggtaggaactcttggcaacacta

SEQ ID NO: 3687 - DNA, 121 bp, Artificial Sequence
  Synthesized
  misc_feature (61): n=a or g
ttaatgaaatgcttcagcatgtgactaacaaggaaattggaacttgctgccttagtttgcntgaactgattgcctgaaacatattattgttgtgctgttcagctaataacaatctaacatt

SEQ ID NO: 3688 - DNA, 121 bp, Artificial Sequence
  Synthesized
  misc_feature (61): n=t or c
ctgtcttcttttgttcttttgtctgagccttacacagaatggaaccttccttaatgaccgngcaagcaactcgttgactcaacaactaacctttatgactgtctgagaatgaaagaatgga

SEQ ID NO: 3689 - DNA, 121 bp, Artificial Sequence
  Synthesized
  misc_feature (61): n=a or g
tcatcaccatggaaaactgtaagaggagagcttagtggaagatgaggtggctttcaaagtnaaatggaatacatcatcttgggatactgctagaattgttgctccttctgtgatccattgt

SEQ ID NO: 3690 - DNA, 121 bp, Artificial Sequence
  Synthesized
  misc_feature (61): n=t or c
agactattactgatacctgaaaaataagagcttagcttattttctgctgaggaataccagnaaaagccctaggctgtattggagtttatttccttttaattacatgttacaacagatttca

SEQ ID NO: 3691 - DNA, 121 bp, Artificial Sequence
  Synthesized
  misc_feature (61): n=c or g
tcctgcatggacttcagtggcacaacgaatggatcactatcacccatacgtggccctcagnctggggctccatctgctcagtaagagaagtaggctgtggctgagctgactgtgtttttgc

SEQ ID NO: 3692 - DNA, 121 bp, Artificial Sequence
  Synthesized
  misc_feature (61): n=a or g
tatattagatgtggctcctcaaagaatgaaaattcagaggaccaaaatacacatcgttccntgtctccttgcttctcgtaatgcttctccaacatcgtatacacctttcttcctctgtctc

SEQ ID NO: 3693 - DNA, 121 bp, Artificial Sequence
  Synthesized
  misc_feature (61): n=t or c
tctgaagcagtctcctcatctttctaaaaagagatactgggaactgttctactttgaatgnatcttcctgaaaccaggtgcctgaagttttggaatttttagtccacaggtacctgtaatc

SEQ ID NO: 3694 - DNA, 121 bp, Artificial Sequence
  Synthesized
  misc_feature (61): n=t or c
ggcttagttcttagctaaagcagtgaaatccagtagggtacaaaatgttgtcgatgggctnacagtgtcgttttgttccttctgggcgctcctcggtccccaccgtccccatgtgtgtttg

SEQ ID NO: 3695 - DNA, 121 bp, Artificial Sequence
  Synthesized
  misc_feature (61): n=a or g
cacagcctggtcagagggctgctaattagatagcaatgccctccttagagaacgggggtgntggtcatcagctgagccctctgaaaaggctgtggcttttgcctgcacatttggacactgc

SEQ ID NO: 3696 - DNA, 121 bp, Artificial Sequence
  Synthesized
  misc_feature (61): n=a or t
aagggggagatgtgtcagcctagtctaaggtgttctaacctaaaattttaatgtagtctgngacagagatttgaaccagattaaaaatgtgggattctagcctctcccagtaaaatgtggt

SEQ ID NO: 3697 - DNA, 121 bp, Artificial Sequence
  Synthesized
  misc_feature (61): n=t or c
catttcggttttgcagcagcaacccctgtaacaaacaccagtgggagaacagcatcagagnatacaacactgcccttcattgcaggtaaccagtaggattaacttcagcacggctttggaa

SEQ ID NO: 3698 - DNA, 121 bp, Artificial Sequence
  Synthesized
  misc_feature (61): n=t or c
acagaggaagaagtgctcttctctctccagttttcttctacacactgccctctctctaccnccatagctctatcaaactttaccagttggtatcagagtctagaagaaaagtagtttccat

SEQ ID NO: 3699 - DNA, 121 bp, Artificial Sequence
  Synthesized
  misc_feature (61): n=a or g
agccatggcgtttggctttgtcgcatggcatttttgattcaccttcaacacataagctgangaaactcctaatccctttctgaaagatgctgaataattttaataattagttaatatcaga

SEQ ID NO: 3700 - DNA, 121 bp, Artificial Sequence
  Synthesized
  misc_feature (61): n=t or c
gaaaaaacatgttttggtacttatacaagctacatccagctcaaaacggaagccttttttncagtggcaattaatgagaatcattatttagaaattaaaatggtaatggtcttctcacatg

SEQ ID NO: 3701 - DNA, 121 bp, Artificial Sequence
  Synthesized
  misc_feature (61): n=a or g
tccatttaggtctgaaaatctcaatgcaggtttagagacaaaaatttaagtacctcaacantggggaactgctttgcacagaaactcaccttcagctttgcaatggaacctaaccacttct

SEQ ID NO: 3702 - DNA, 121 bp, Artificial Sequence
  Synthesized
  misc_feature (61): n=a or g
cgagctcctagtgcacctcacctgggttccagcctcatgcccatctctgagacaccaaganctgacgttctgatgcactcgagcatttccctccctcctttgcttgccttagtgctgtgcc

SEQ ID NO: 3703 - DNA, 121 bp, Artificial Sequence
  Synthesized
  misc_feature (61): n=a or g
gctgttgtttgctgtgttttctattgcattatagtgttacaatgtcatatcagtgataacnggtttatattcaagtaagcgatgccttttgcccccaggccaatgcacggtaaatgcctga

SEQ ID NO: 3704 - DNA, 121 bp, Artificial Sequence
  Synthesized
  misc_feature (61): n=t or c
tgccctcctgctctgggacagctggaagcctcccgacctccttggaaatattcagagttgnctcacaaacaactggagtctttctcctcactccccaaagtcccccagaagaatgcaatag

SEQ ID NO: 3705 - DNA, 121 bp, Artificial Sequence
  Synthesized
  misc_feature (61): n=a or g
ggttcataggcaaagtctggatttgaagtcctaatgtctgtgacacagcccagaaaatcangtctccttttacaatatggaaacctgacctgctacagaatattatgatcgctctaatggc

SEQ ID NO: 3706 - DNA, 121 bp, Artificial Sequence
  Synthesized
  misc_feature (61): n=t or c
agtttcctctagctcaatcttgatggctttctctataacctgtagatatcatctggtttanacttggctgagaaggccactcctcataccccttagtcagaacagaaggcaaacaagtcaa

SEQ ID NO: 3707 - DNA, 121 bp, Artificial Sequence
  Synthesized
  misc_feature (61): n=c or g
catcaaacaggattcagcaatgaactgaaagtgttttgagcatgaatgcttccatacttanacatctctaagctggaaactgcgtccgttatttctctgcaaatgcatcaggttggggctg

SEQ ID NO: 3708 - DNA, 121 bp, Artificial Sequence
  Synthesized
  misc_feature (61): n=a or g
aattcaaactcatctacagccaaaaatacatacactctaactgcagtacattatgggaaangctacattccccttttattgcccatgtcatcactggtccagaattaatgcctgtgcccac

SEQ ID NO: 3709 - DNA, 121 bp, Artificial Sequence
  Synthesized
  misc_feature (61): n=a or t
ttcagaagtaaattaaattgctcctttttccttaagatctcctcccgaattctcagagtcnttcgcataaaaatttgcagctcatgtatgcatcttagtttaggccatacacatttttctt

SEQ ID NO: 3710 - DNA, 121 bp, Artificial Sequence
  Synthesized
  misc_feature (61): n=c or g
taaaagaaacaagttagccctccaacttggtaaagctctcctttatcccaaagaaacgcantaattgcttatagccatgtattcttagctgcaacgatgtcactgttttccgaaaagtaga

SEQ ID NO: 3711 - DNA, 121 bp, Artificial Sequence
  Synthesized
  misc_feature (61): n=a or g
gaagtttgacttggcatccttcaattactagtctaattattcttctattatttaggcagcnagccaaaggtttcctgggtgcataggaagttaataggggagatgaagcaagattgcgagg

SEQ ID NO: 3712 - DNA, 121 bp, Artificial Sequence
  Synthesized
  misc_feature (61): n=t or c
agtcctctgccctaccacacagccaagcactttgaagctgataacatgcactgtgcgatcngccagtgctattgatatggtttttgggcttcaagatcttataagttactaaagatgctat

SEQ ID NO: 3713 - DNA, 121 bp, Artificial Sequence
  Synthesized
  misc_feature (61): n=a or g
cacattttccaaccatcctgagttggtctctaatagggagctgcgctttattccaggtccntgcagacacactgacaaaccaacagcactgctgaaatgcccactcctgtccagatttctt

SEQ ID NO: 3714 - DNA, 121 bp, Artificial Sequence
  Synthesized
  misc_feature (61): n=t or c
ttgcaacccaggccattctaggattctatgataagacaaagaagaacagtgcagcatcacngcacaccaagtcctgtctgaaaggtaggcagcagcagacaggcttcagagcaaggaaaat

SEQ ID NO: 3715 - DNA, 121 bp, Artificial Sequence
  Synthesized
  misc_feature (61): n=a or c
gtgagtgtctgactgaggcatcacatccccgctgtaccatcactgagtaaaactgagcgcnggctgaatgctaccacttcaggagcacaccgtggatgaatgcaataagggaaatttttct

SEQ ID NO: 3716 - DNA, 121 bp, Artificial Sequence
  Synthesized
  misc_feature (61): n=a or g
aaccagcaacaacaaaatttcattgatctttcattcatcctaaagagttagtgtgttaacncagttaaaaggatggaaaacatgcatgtggagcaagctttgcaggagtggcactgtgttc

SEQ ID NO: 3717 - DNA, 121 bp, Artificial Sequence
  Synthesized
  misc_feature (61): n=a or g
acccaacacattccctcggggaaaaatacacacagtaagtatgtacagtttcatcaccggntgaactgccacaaagcctcatcctctatgaacaaagacgctgcagtgcgtttccacgagc

SEQ ID NO: 3718 - DNA, 121 bp, Artificial Sequence
  Synthesized
  misc_feature (61): n=c or g
agctcttgtttattttctttctgactcactgctcagaaagttccttgattccaatcaatcntaacaatgctacagaggaaacaactccagactaggaaggaggagaaaaatcacaagtagg

SEQ ID NO: 3719 - DNA, 121 bp, Artificial Sequence
  Synthesized
  misc_feature (61): n=a or g
ctacctccaggtaaaaaatagtttgttgaaagatggtactgtgattctgaagctagaaatnttcttgatatgtcttgtatagctcagctatgaagtgacataatttgcattcactgcttaa

SEQ ID NO: 3720 - DNA, 121 bp, Artificial Sequence
  Synthesized
  misc_feature (61): n=a or c
aagtcataagtcatcacactaccgatataaaggaatacttactgaaccaccaatccaaaancctacaatgctggcattggaagaaaccagaaagtactgtttaactcaactggcaacattt

SEQ ID NO: 3721 - DNA, 121 bp, Artificial Sequence
  Synthesized
  misc_feature (61): n=a or g
gttgggacacactactgtgatcttgttctcaacattccttcatctgatgctgaacagtatncattttgtaaaatcacacatgggataaattgttcaataaataactgcagtgcaattcatc

SEQ ID NO: 3722 - DNA, 121 bp, Artificial Sequence
  Synthesized
  misc_feature (61): n=a or g
ttaataatcacaattctaattccctttataagagcttttatggttcactctgagctcaccnacagctgtcatagctttacctggggatgccatactccacggacagactgagtactgatgt

SEQ ID NO: 3723 - DNA, 121 bp, Artificial Sequence
  Synthesized
  misc_feature (61): n=t or c
tatgcactgacaaggaaagtttgctggaccttggtacgaaggtatgtctgtgattgcaagntctgggaatagagtctggatgtacaacgattcttttttcatacggtttctaccctaatag

SEQ ID NO: 3724 - DNA, 121 bp, Artificial Sequence
  Synthesized
  misc_feature (61): n=a or g
gttgtgacaaagtaagccgcctctcctgttcctttcaccgtgattcccaagtcaaaacttntgatttttacttcttgcttatgttctttcaataaagttgactgtaaatacagtaacttcc

SEQ ID NO: 3725 - DNA, 121 bp, Artificial Sequence
  Synthesized
  misc_feature (61): n=t or c
cactcttaaccgaaatttaataggaagcctttgaattggagctctgcataatatttcctcnttggcaatcctgctcatcatcgctgacagttaattctttcaaaagattgttttgcgtaga

SEQ ID NO: 3726 - DNA, 121 bp, Artificial Sequence
  Synthesized
  misc_feature (61): n=t or g
agcagcagttctgtctcctctgctctcctcttcatcttgctttgattttctctagtgttanctgtgagttcacagcataacgacacatctctccatcacttccacgaggggacgtttctgt

SEQ ID NO: 3727 - DNA, 121 bp, Artificial Sequence
  Synthesized
  misc_feature (61): n=a or t
tttgacctgaagcagtctgggacctcagtgttctgttctaccaaactttaggaagagcagnaacttctgccaaagggaggagtgagctgttcaggagacagaacttcttaagcctccccac

SEQ ID NO: 3728 - DNA, 121 bp, Artificial Sequence
  Synthesized
  misc_feature (61): n=a or g
agtgtcaacagaaatttatagtctttaaagcagtatttaagttatcaaagaaaggaggagnaatgttattcagtacctgaactaagtaatcagagggagcgttcagtaagaatcccactgc

SEQ ID NO: 3729 - DNA, 121 bp, Artificial Sequence
  Synthesized
  misc_feature (61): n=a or g
tgacacaatttctttaccaagcaaaaaagccaagaggtctaacactttgctcatacaagcntgtgtacatacatgagcttgtggtaagaggatatgaaggtaagctacaccaagagaccct

SEQ ID NO: 3730 - DNA, 121 bp, Artificial Sequence
  Synthesized
  misc_feature (61): n=t or c
gaggcttagaaaaaaattaactgagaggtttcatgaaccccatttgggctactggagctgntactgcattatacacttgtctcaagctgactgaagcttccaggaaacttcagtgtattta

SEQ ID NO: 3731 - DNA, 121 bp, Artificial Sequence
  Synthesized
  misc_feature (61): n=t or c
gtgagatgcaaaaatccatccacgcatcacccgaagttcaatcgcaaatcctgcctgtgangtcaagtaaattacctggacttcaaactggatactaaaaaaaaattgttcttcagaagag

SEQ ID NO: 3732 - DNA, 121 bp, Artificial Sequence
  Synthesized
  misc_feature (61): n=t or g
tactgtaacaatagcaaaggctgtaactctgttatagtcacaaaaatctgctcatgcagtntcaacagctgttttatgtaaattgtgttgtaaaactttacagttaaaatcgttctcattc

SEQ ID NO: 3733 - DNA, 121 bp, Artificial Sequence
  Synthesized
  misc_feature (61): n=a or g
tcgtggataaatttgagattgcaggacccttaataaattctgcagcagtaacagcacttanaactgtcttagtccagattaactagagacttacagggctcctaaaatatgggagcttgta

SEQ ID NO: 3734 - DNA, 121 bp, Artificial Sequence
  Synthesized
  misc_feature (61): n=t or c
agtgaaataccagtaacatattttacttcaccaaagcttgaatgcaaagagggaagtatgngcaaataagtctgttggcaaagaaagaatgctcaaaactgcaaaggcaagtgttgtgcta

SEQ ID NO: 3735 - DNA, 121 bp, Artificial Sequence
  Synthesized
  misc_feature (61): n=t or c
tgaagggctcaacattcaaactgtggtacttgggtacttgggtgttataaatcaacataangtgaaagaatgaactgtaaaccagccggaagtgctgtaagctgctctcagctgcttcaaa

SEQ ID NO: 3736 - DNA, 121 bp, Artificial Sequence
  Synthesized
  misc_feature (61): n=a or g
acgatttcagttgtgaggtaggctgtaggaaaagatgtcctccgagattccgcagcactcncttcccaaaaaggactgtgagtagaggaatgggggaaagcgtggggagagccatggcagg

SEQ ID NO: 3737 - DNA, 121 bp, Artificial Sequence
  Synthesized
  misc_feature (61): n=t or c
ccctcatcgattgcaggcacagagcggcctcgtggctgggactgtaaatttggcatctccnagctctgcctacaccatctatcagatcaacagaggaaggcatctatcggttaaatgtatt

SEQ ID NO: 3738 - DNA, 121 bp, Artificial Sequence
  Synthesized
  misc_feature (61): n=a or g
ttttatttttaaaggactgtcttctagattctgaaagctgctcctggatcagtttcatacntacatgtctccaagctagaatgcagaggaagttcttacctggccctacagtgatctcttt

SEQ ID NO: 3739 - DNA, 121 bp, Artificial Sequence
  Synthesized
  misc_feature (61): n=t or c
atagtacatccagaacaagactgtacagcatctcagtgtataaatttctactatttagagncagtggctcagcactgatttaggaggacaaaactgagcagtcttgcataatttgaaggaa

SEQ ID NO: 3740 - DNA, 121 bp, Artificial Sequence
  Synthesized
  misc_feature (61): n=t or c
cttaggccatgtgatctacatccacagggacaagggggggaggaggggtgctaagtaacangaaaccagtgattatgcatcacatgccttggtcttgtgtttacaagtcatctgaatagct

SEQ ID NO: 3741 - DNA, 121 bp, Artificial Sequence
  Synthesized
  misc_feature (61): n=t or c
cagctaggtaaatgttactgactactttcacatagtctatccgctgcattctattgaaggnagaggtagatataagacaacggaaacataatgatttgcatgcatgatacatatatacact

SEQ ID NO: 3742 - DNA, 121 bp, Artificial Sequence
  Synthesized
  misc_feature (61): n=t or c
tttggaattacagatgcaactcccatctgggaattacatgtatgcagactgacagtgtaanaaaggcccagtgcataggcttttagcaccttttctagcatttatgttagtaatgcaaaga

SEQ ID NO: 3743 - DNA, 121 bp, Artificial Sequence
  Synthesized
  misc_feature (61): n=t or c
cccactggaaggcacaattatctctatgggctgttaaagctttggctccatacctttcacnctttcatacctgtatctagacaaattatggtgcttcacagccatttaaaatttctgatta

SEQ ID NO: 3744 - DNA, 121 bp, Artificial Sequence
  Synthesized
  misc_feature (61): n=t or c
cctctggacttcaagcaagtggaatgtcaaaccaacattgaatagcttatggaaaaggggntgctttcaagaatagatttctttgttttaactggatacaatttttttttctgcttctgtt

SEQ ID NO: 3745 - DNA, 121 bp, Artificial Sequence
  Synthesized
  misc_feature (61): n=a or g
gctgtgctctaaagtggtttgaagaatgtttatgccactataggtaaactgatgtttcccntgtctcttcctgtgacagactgtgccatgtgttactttgtgcagacttttttttggcagg

SEQ ID NO: 3746 - DNA, 121 bp, Artificial Sequence
  Synthesized
  misc_feature (61): n=a or g
ctttaaaacccctgcaaagaaactccaggaaattacaccatggggacaaaatatcttttanctggtaaggtataaagactgatggtaaaatgactgataatgcaattgttgaacacttgca

SEQ ID NO: 3747 - DNA, 121 bp, Artificial Sequence
  Synthesized
  misc_feature (61): n=a or g
acgctattaagtcaaaaatgcttgatggtgcagagataagtagctgtgctgttacttgcantgcagaaacaaaacacagagcattggttttgtaatgctgaaaaacagcttgatgggcaca

SEQ ID NO: 3748 - DNA, 121 bp, Artificial Sequence
  Synthesized
  misc_feature (61): n=t or c
gactaatttagaatgttttcactttacttaagtaacaaaaagtgatattatttagccaatnaaaaacaccatgactaaattacattgctacctcagttggatcattaatttcatacgctag

SEQ ID NO: 3749 - DNA, 121 bp, Artificial Sequence
  Synthesized
  misc_feature (61): n=t or c
agatttgagtcattcagtctcagtattatattcagtacttatttgcaccttctgtttttanacctaactgcttcctcttgcgtttcttgtaggaaacagagatgaaggtacacatgcacac

SEQ ID NO: 3750 - DNA, 121 bp, Artificial Sequence
  Synthesized
  misc_feature (61): n=a or g
atccccatgtcagtattgtggtaaaaatttctcatttcaccaaatactcgtgggctctcangactcagataattaaactatgtaagaaatccacagaagatttgtaacagttttctcagca

SEQ ID NO: 3751 - DNA, 121 bp, Artificial Sequence
  Synthesized
  misc_feature (61): n=a or g
accagatagttaccatcaacacaaaggcaggtatttggtggcattgttgccagactgtgtncgtgctgatcatcaacacccaggaaaatacatttgcacacgtaacacacccatgtgagag

SEQ ID NO: 3752 - DNA, 121 bp, Artificial Sequence
  Synthesized
  misc_feature (61): n=a or g
acccctgacagcgagtgctgttgctggtccaacgaggcacccaatttttcttgtataagancagtaagaggcattttccaggatgaatccctacacaagggcaaccctggtatccagacag

SEQ ID NO: 3753 - DNA, 121 bp, Artificial Sequence
  Synthesized
  misc_feature (61): n=a or t
gtaaaggagatttataaagcaacggatagtttttattgaacaaggccaagttaacagacantttcagaaccctaagctcacctagaggcacaaagaactcaagaaagtatcaaaaaagtta

SEQ ID NO: 3754 - DNA, 121 bp, Artificial Sequence
  Synthesized
  misc_feature (61): n=a or g
gtttttgttttctctagtgacctgctttgctgtttgtccaattccatctcattaactgctnaacacagattctgcgaagacagtgtcatatctggacctttgcattcagtatccttctgac

SEQ ID NO: 3755 - DNA, 121 bp, Artificial Sequence
  Synthesized
  misc_feature (61): n=a or c
tattgtgccaactctgttggatatcacaaacgatgcaaaccttgtttccctggaaagtacntcaatatcgagtcagaagctctattgtattttgcacagatatgcaaattatgtctattat

SEQ ID NO: 3756 - DNA, 121 bp, Artificial Sequence
  Synthesized
  misc_feature (61): n=t or c
tttgttattaaacaagaacagtaacaggattttcctccttttcttggggaagtaaagatcntgctctaacaatttcggcctgctacaaaaaagtccagggaagaaatctcgcctcatactg

SEQ ID NO: 3757 - DNA, 121 bp, Artificial Sequence
  Synthesized
  misc_feature (61): n=t or c
ccactttagattggtttaagaggcagcctaatggccctgagagaaagagagtattattctnggattactgaataacagagttgtctagagttattgaacagctgattagtaaaaatctttg

SEQ ID NO: 3758 - DNA, 121 bp, Artificial Sequence
  Synthesized
  misc_feature (61): n=t or c
gggcagatgtgcttggtgagttaaaaaggagcaagggcataatcttgctccagaagagtgncatgaaattagcagtgcccagatgtgagtgccttgctttcagaactctttccttcccact

SEQ ID NO: 3759 - DNA, 121 bp, Artificial Sequence
  Synthesized
  misc_feature (61): n=a or g
ggcttcagaggcattcccaagtaacctcagcaaaatgaacgtgaggggaaggtacaggagncgggggaggccttaatgcacatcgattctgcagccccccacttctcaaacatgaaagaag

SEQ ID NO: 3760 - DNA, 121 bp, Artificial Sequence
  Synthesized
  misc_feature (61): n=t or c
tttatctgcttgcaatgatagcaaggtcattgaagtttgtattggcatggaatggaactcntgtttctaatgaaaatacacgttgtttccctgcttcccttagtgagtcaggggcagaaca

SEQ ID NO: 3761 - DNA, 121 bp, Artificial Sequence
  Synthesized
  misc_feature (61): n=a or g
atcacatcccaggcagtgccagtccacttgccaatgttgctctgctgtcatgcttcttcangaaccatcccatgtgtgaaataatgtgctgtctctgtacaattcattttcaaatttccag

SEQ ID NO: 3762 - DNA, 121 bp, Artificial Sequence
  Synthesized
  misc_feature (61): n=a or g
acaccagtaacttccctcccggcaactccccgctgctcttgagctgctagtggagtgtctntacaagcagaactactccccatctagcagggagccacatattcagttgaaggagctccaa

SEQ ID NO: 3763 - DNA, 121 bp, Artificial Sequence
  Synthesized
  misc_feature (61): n=t or g
tgtctgtattttacagtgacaaaacagaagtaaaaagaagtctgttgtctgctcttgttgnagtcaaaataaacaaaacttaggaaaacagttttccattcattgtagacttaaaaacaaa

SEQ ID NO: 3764 - DNA, 121 bp, Artificial Sequence
  Synthesized
  misc_feature (61): n=t or c
aaaaatgtcaatctgtcttttatgaagctgaaccactccttttcttcagtctgccacagtnttgctgaagactgtaagactctggaactgcagaagtagcattagctatgtttgatcgtac

SEQ ID NO: 3765 - DNA, 121 bp, Artificial Sequence
  Synthesized
  misc_feature (61): n=t or c
cagcctgggcggaacggtgcctggtttgtaactagcatcagctaggtcactttatcactanaggtgataaaagggaaggactttcttggaggaaggggaggaattcattactctctccccc

SEQ ID NO: 3766 - DNA, 121 bp, Artificial Sequence
  Synthesized
  misc_feature (61): n=a or g
tagatgtgccagccaaaatattgttattctgacactgcattccttcaggaatacacagacntacgctatagaatgtagctgggctgatctctctttaaatataaatcattagagttccact

SEQ ID NO: 3767 - DNA, 121 bp, Artificial Sequence
  Synthesized
  misc_feature (61): n=c or g
gtggcagtttagctgtgactctgcaaagcggaaaaaaagctgatgtctgtgaactctgcanccacactctctttatgggaactttgcaatagctgtgcaattgctttcttgagccagggcc

SEQ ID NO: 3768 - DNA, 121 bp, Artificial Sequence
  Synthesized
  misc_feature (61): n=t or c
tcaaaatttaaaaatccttggtattagaaatgattaccatagccctagatgcgtctcacantaacaagctttagtgtcacattcacattaggaggttaggattaacagaggattggcgttg

SEQ ID NO: 3769 - DNA, 121 bp, Artificial Sequence
  Synthesized
  misc_feature (61): n=a or g
acagacctcatgttgtaactttaccaatgtatcagcctttctctcctattgttttgcatcntatttcaaaatacagttcttcaaaggatcaactatgtttcaattccattcctttcaaatc

SEQ ID NO: 3770 - DNA, 121 bp, Artificial Sequence
  Synthesized
  misc_feature (61): n=t or c
tgaaaacaccaggcatgaacacaagtaacaccacaccttatctgttacagatgtgcagttnccctgacagcacgtattaactattttatacagtggtttcagtcagtttccacttatacct

SEQ ID NO: 3771 - DNA, 121 bp, Artificial Sequence
  Synthesized
  misc_feature (61): n=a or g
ggtccgcactctccggatttcctatgtgttggaaagaatgtttaattcttcctctctgaangaagcaaacacctctgccattcctcaactcaacattgagcaggttgtgataattgctaca

SEQ ID NO: 3772 - DNA, 121 bp, Artificial Sequence
  Synthesized
  misc_feature (61): n=t or c
caaattgtgttagaagttttaatattttatttatattctgtattatgtgaaatctaaccantgaagaactgataagcagtatagttttgatttctcaatggaaatgatactcctctcagtc

SEQ ID NO: 3773 - DNA, 121 bp, Artificial Sequence
  Synthesized
  misc_feature (61): n=t or c
taagtacaaaataaggacaaaacaatgcttattctttatctgtctctgcctgccttaatgntctctgaacttacaggatgggagtgagggctgattcctgttacttctttagctattcgca

SEQ ID NO: 3774 - DNA, 121 bp, Artificial Sequence
  Synthesized
  misc_feature (61): n=t or c
atatcattttatgtagcaaaaagggaaggtgacagtagaagacaaagcagcaatgattcangtcctgtgggcattataagaaatgtgttttcagaaagagtccaaaaagtgaaattagcct

SEQ ID NO: 3775 - DNA, 121 bp, Artificial Sequence
  Synthesized
  misc_feature (61): n=t or c
ctatccagacttagtctcctcctagagccacagttgagcgaggattcattgaagcaacttntgcatgatgacacattacttattcataccacagaaagactggagtgcaaggtctttgttt

SEQ ID NO: 3776 - DNA, 121 bp, Artificial Sequence
  Synthesized
  misc_feature (61): n=a or g
agggcaaaagaggattctggtctctgtttccagaatgttgtatcagccctgcaaacaatanagcatgcccagtaatgcctttgtgcagctgaatgacccaatagttaggtttgagtgctat

SEQ ID NO: 3777 - DNA, 121 bp, Artificial Sequence
  Synthesized
  misc_feature (61): n=a or g
aatacaatgctaggagataggatatctgggaagaagatggggcatttgggaatatcgagtntgtttgctagttattaaaactatgtcaatttctgctacaatatgtaattgtaggtggata

SEQ ID NO: 3778 - DNA, 121 bp, Artificial Sequence
  Synthesized
  misc_feature (61): n=a or g
taactatttggctgaattcctcaacctccagggtacttattcatgtaacatttttgctgantaactacaatggaatcaatgaaaattctagtattttgaatttgagtggtaccagcaatca

SEQ ID NO: 3779 - DNA, 121 bp, Artificial Sequence
  Synthesized
  misc_feature (61): n=a or g
tggggctgtacaagtaaattatatcttcactgtgttcatctgtggctttgattgacaaatnttttgagttaaacatttaaattacaacaagaacgaaatggtttcacggctctttatgaga

SEQ ID NO: 3780 - DNA, 121 bp, Artificial Sequence
  Synthesized
  misc_feature (61): n=t or g
tttccttgaagcctagatattgtttatgttactgcaggccagcgtgggtcaaaattctttnaagagagtagtagtaatgtgaattcctttgcatacacagaaattgaaaagttctaggtta

SEQ ID NO: 3781 - DNA, 121 bp, Artificial Sequence
  Synthesized
  misc_feature (61): n=a or g
aaaaagagttcactgtgggacagatagtcttttaacttagtcatctggcatcagctatggntgggtcagagtgtgttttttggcattgtacagccatatttttttctggacagtcttgatg

SEQ ID NO: 3782 - DNA, 121 bp, Artificial Sequence
  Synthesized
  misc_feature (61): n=a or g
aataaggcacaaattgatcaataagggctcccttttaaaagtcgtatggtttgtaaagtgnaaaaaaaaatctgatttcaaacatttttatttatttactgcttagctttgtttcagagga

SEQ ID NO: 3783 - DNA, 121 bp, Artificial Sequence
  Synthesized
  misc_feature (61): n=t or c
gaaatgctaatctaaccacatctactaatcactgttttaccccacaactcaaatcatgctnttctgccccaaaaaggtcatgtgcatattggtttgcattagatagttgctctgtaggaat

SEQ ID NO: 3784 - DNA, 121 bp, Artificial Sequence
  Synthesized
  misc_feature (61): n=a or g
atctacttctgaagaactacaatggtgaaggtaaaagatacaatttgaagtatatactgcntgtatcattactgtcattaagatgaacagcatgtcactaggaaatcctgcagttcctgcc

SEQ ID NO: 3785 - DNA, 121 bp, Artificial Sequence
  Synthesized
  misc_feature (61): n=a or t
agtgcctaagtcatgcaaattactcactgtttacgctaaaagacaaaaccgaactcatgcnctctataaatagatggcttagcttgtttaaagccactgtgactcctttactgaagcgact

SEQ ID NO: 3786 - DNA, 121 bp, Artificial Sequence
  Synthesized
  misc_feature (61): n=t or c
aggatggaggagagcagtagatgtgtctgtgatcggtgggacggaaaaatctgggtcttgnggtgagcactacagggcagtgtttgctgctgttctccatgctgagtgggaacgagttttt

SEQ ID NO: 3787 - DNA, 121 bp, Artificial Sequence
  Synthesized
  misc_feature (61): n=t or c
cctgctttgtttttattttggtcgttgcttttatatgatgctggtttgtttcattttctangtagaaagctttctgtgggtatatttggaggatttcctgcattgggttgggatttcctgt

SEQ ID NO: 3788 - DNA, 121 bp, Artificial Sequence
  Synthesized
  misc_feature (61): n=a or g
tgcttaagacaaatgattgtgcattgtagctgtggcagaagctgtgataattttccagatnaaagggaaattcagatagttttatttcagttctgattctcatggatgatggtgataagat

SEQ ID NO: 3789 - DNA, 121 bp, Artificial Sequence
  Synthesized
  misc_feature (61): n=t or c
agtgtatccctcagtctttcctgggtgaattttggagtgttctgacttgacgttttgctgntgtgtttttggaaatgcagcatgtgaaacctttttagaaatgggataacagcacatcctc

SEQ ID NO: 3790 - DNA, 121 bp, Artificial Sequence
  Synthesized
  misc_feature (61): n=t or c
tgccaacaaaggctgtgcagaaggaaaggacaagctggagcggtacagcagggctctccangctcccatgtctggtagccacagttaactcatctgatgtgcatgagaatcaggggagaag

SEQ ID NO: 3791 - DNA, 121 bp, Artificial Sequence
  Synthesized
  misc_feature (61): n=t or c
aatcatatatgtcactttgtcttctagttgggaaaactgtttttcttgtagaagggaattnccagagcatttacaggctttcagctgggatggccactattctgacttgaaaatgaaggtc

SEQ ID NO: 3792 - DNA, 121 bp, Artificial Sequence
  Synthesized
  misc_feature (61): n=c or g
accagatagaatcagattatcatttttatctttgagtagtttcacaagttttggacatcanaggtcagtttgctggcaagacattgtgagaagtctttgacttagtgtaagcaccactcgg

SEQ ID NO: 3793 - DNA, 121 bp, Artificial Sequence
  Synthesized
  misc_feature (61): n=a or g
ggatatatagatccagtttgcagatctcttttggtgtgcaaggtcaggaatggagctgaanaaacagaagcattcattcatccactggaataggttgcccggagaggtggtcagtgcctca

SEQ ID NO: 3794 - DNA, 121 bp, Artificial Sequence
  Synthesized
  misc_feature (61): n=t or g
aagtggaaggaatgcaggtacaggtttttccagtgcacgccatccaagtgtttgcactcanttttctatgaagtgagcgtattaagaagatactgctgatgctttttcttgttcttataga

SEQ ID NO: 3795 - DNA, 121 bp, Artificial Sequence
  Synthesized
  misc_feature (61): n=c or g
attctttactcctctggatctatcactgtcagagtaggccagttttctagctaggtctaantactgagcatatgcaggagccagaatagaagttgcctgcctttatttaatcctcctccac

SEQ ID NO: 3796 - DNA, 121 bp, Artificial Sequence
  Synthesized
  misc_feature (61): n=a or c
gttttctacagatcatgtactgcctgtgagaacatctgctttcagaagtcaatactattcntttagaatgcataaggctatggaagtgcttagtagcatttatagcattttacggagttta

SEQ ID NO: 3797 - DNA, 121 bp, Artificial Sequence
  Synthesized
  misc_feature (61): n=t or c
catgaaaatgtggagttgcccttaatttccctttgctagggcttttatctgtattaatcanggatcatcctccatttccctgagatcttaatatattacagattttccctgatattcagcc

SEQ ID NO: 3798 - DNA, 121 bp, Artificial Sequence
  Synthesized
  misc_feature (61): n=a or g
agcttgcccaaagtttatgtaatacagaaagtgatgcttgttctatagctttcctttgctnaaagcacaagagacataacatccactgactccatctgaaaatacatcctgcccaggccaa

SEQ ID NO: 3799 - DNA, 121 bp, Artificial Sequence
  Synthesized
  misc_feature (61): n=c or g
tttgtttctaaaagactacaaatacaattccagtattctccttgagtgacaacctaaatantacaacctaaatactgctgttcctgttgaatggaatactttaatagactgcattaacatc

SEQ ID NO: 3800 - DNA, 121 bp, Artificial Sequence
  Synthesized
  misc_feature (61): n=c or g
cctcctgctgcactaagctaggtactgccttctgaggcctgagcttgtagcaactgaagancgatgctgaaccatagggaaaataaagcctgcgtgtgtgccaggagaggacagcagctat

SEQ ID NO: 3801 - DNA, 121 bp, Artificial Sequence
  Synthesized
  misc_feature (61): n=a or g
ttttctggaaaatatagctcaagaaaagaccaacagagatcagaagttactaagggataanaagaagatagcctcacttacaccagcctccagttaaaattgaccttctccaaagagtgtg

SEQ ID NO: 3802 - DNA, 121 bp, Artificial Sequence
  Synthesized
  misc_feature (61): n=a or c
gagatgggttatataattgcaattttttttttttatttttaagtaacaaagagatagtttnataaaataacctaaatttcacacagaacttactgctgcaaaacaggatggataagtatac

SEQ ID NO: 3803 - DNA, 121 bp, Artificial Sequence
  Synthesized
  misc_feature (61): n=t or c
ggaccttgtgcactcctttgatgttgctagaggttcaccactgtaaaaactgaataaagcnggaagggtatccaagtatctatcgatacgtataggttgtggtatagcatcacatccgtgt

SEQ ID NO: 3804 - DNA, 121 bp, Artificial Sequence
  Synthesized
  misc_feature (61): n=t or c
agggtcgctgtttcttctgtattgacatccttcacacgctctcccttttaatcagcgcagnataaatgaatggtacattaggagtaccaatgcatggagctattgaaaatatgcagctgga

SEQ ID NO: 3805 - DNA, 121 bp, Artificial Sequence
  Synthesized
  misc_feature (61): n=t or c
tgtggaaagtctagtggcaaaccactggccacatcaagtcttcagtgggcagcaaagcagngggctcacactcaaaaccttctgcctcatccatactaaatcttcctttgaaaagcacagc

SEQ ID NO: 3806 - DNA, 121 bp, Artificial Sequence
  Synthesized
  misc_feature (61): n=t or c
gctttcgaaaaagggttttcctctgaagtcgtagtggggggctggaaaagttcttccctgntgcttctaacgtggtcatttcaagagatctacacgttgcccagagtggagcaagttcttg

SEQ ID NO: 3807 - DNA, 121 bp, Artificial Sequence
  Synthesized
  misc_feature (61): n=a or g
gccttagttaaacaagctcatttttggatgctagttaattagcctcaaatcctgccagccnggctaacagatgagagctgtcaggagcactgaaaaacaccctccgtcagtcctactgcac

SEQ ID NO: 3808 - DNA, 121 bp, Artificial Sequence
  Synthesized
  misc_feature (61): n=t or c
aaggtaacttggttttgtaataggtccaataactaaggtgtcttaagcatatcactgaatngaactgcgctgaagagcatggcagcaatctcataaggagctccttgccatggtgctgtgc

SEQ ID NO: 3809 - DNA, 121 bp, Artificial Sequence
  Synthesized
  misc_feature (61): n=t or c
gtgtaatagttcagcatttctcttatcccagcttcagatggagcctcacgctgtacaacantcatttccaaacctgaaaactcagtctccgaaatgtcagcgttattttaggcctacagta

SEQ ID NO: 3810 - DNA, 121 bp, Artificial Sequence
  Synthesized
  misc_feature (61): n=a or g
attgtactttactctgtttgggtggagagtatgttctgaatctgaaggtcggtttttcccngaaatgaaccatggagtctggatgctaggatgatctattcaagtctgagactccgctcta

SEQ ID NO: 3811 - DNA, 121 bp, Artificial Sequence
  Synthesized
  misc_feature (61): n=t or c
acctacttcacataagtctactgaccttggagcacataaagctttcccttcagaagggacngctcacagtgacttgtgattaactttcttaaagaaataaaggcaccaggcagcaatccag

SEQ ID NO: 3812 - DNA, 121 bp, Artificial Sequence
  Synthesized
  misc_feature (61): n=a or t
acagcagaaccaactgctccaaaactgcaattctctccactgcctctgaatggagtcctcnctcaggtttggatacagggaatgaaatgattagcatctagctatatacacattactctac

SEQ ID NO: 3813 - DNA, 121 bp, Artificial Sequence
  Synthesized
  misc_feature (61): n=a or c
tcacagcatgaatttacattgaaaattagtttctgggttcgggcagcacagttttgcctcntactggggcttcgttatgctacttgctgatacagcaccctgacgtgagattagcctgctt

SEQ ID NO: 3814 - DNA, 121 bp, Artificial Sequence
  Synthesized
  misc_feature (61): n=a or c
tgtctgttcaggtgagcaaaatcccacgtattccaagaaagttacaggttgggtcatcaantgggcaaaaaggcatggccccgtttgtatttttgttttattattttttgagcagagccat

SEQ ID NO: 3815 - DNA, 121 bp, Artificial Sequence
  Synthesized
  misc_feature (61): n=t or c
ctgcccacgtgtgttctgctgggttagcgtggtgctgtacttgtggacaaaaggagcagtnctcctgggcacacaaccctgctgtgccacactgatgactggaggcctttctagtaagatg

SEQ ID NO: 3816 - DNA, 121 bp, Artificial Sequence
  Synthesized
  misc_feature (61): n=t or g
ggattaaatggaacacgaaggcagtattaggctgtgcagaaattattcaggtcgtacctgngtggaatatcacctaccccaccagaaaaagagatttggatgaacaaggtggaggcaacgt

SEQ ID NO: 3817 - DNA, 121 bp, Artificial Sequence
  Synthesized
  misc_feature (61): n=a or t
atctacatgttgatgttagtgatggcagggtgacacagtgtcttcctcctgcctagcagcngaagtgtttctttatctctcgttaatgctcccggtatttccccatgagaaataatctctc

SEQ ID NO: 3818 - DNA, 121 bp, Artificial Sequence
  Synthesized
  misc_feature (61): n=a or g
aaaaaagtctcccagagaacaacagaatggtgcaaaagcttcagaaaccttactacactgnaaggatacatggggggattcacatatagtgctaagcacacatagctggcttgcgttctga

SEQ ID NO: 3819 - DNA, 121 bp, Artificial Sequence
  Synthesized
  misc_feature (61): n=a or g
atgttctcatccctgaccttctactcatatttgaggcagtggggctttcaggcatatactncttttcatcctcctttggtagggatgtggagagttccccaaaaagttcctttagtcagtt

SEQ ID NO: 3820 - DNA, 121 bp, Artificial Sequence
  Synthesized
  misc_feature (61): n=a or g
ataagtacagtgtaatgccaggatggatcaggccccctttatggtgaaaaacagagcaaancagaccagattttagagaaataaatccgtccctcatccaactcaacactgggatatttcc

SEQ ID NO: 3821 - DNA, 121 bp, Artificial Sequence
  Synthesized
  misc_feature (61): n=t or c
ggtgaaatattaacagtcagtcgcaatggtaacttgttactctgtgctgttacccatcatncgccagtatgcaaagcagagtgatatttgagttaaggtttgcaaattaaaaccaaacacc

SEQ ID NO: 3822 - DNA, 121 bp, Artificial Sequence
  Synthesized
  misc_feature (61): n=t or c
agcaaatgttagcttcttactgcatcattctctttagaaatgacctgcagaagggaaagcngcatagtgacttcagtcactacttcacctcagaagtcccacttgtcatttgcagatttat

SEQ ID NO: 3823 - DNA, 121 bp, Artificial Sequence
  Synthesized
  misc_feature (61): n=a or g
ctgtggatttgaaccacagaaggttattattctgccttaatttggcacactttatggatcnagaactctaagaaatgctcagataatgagaaagacccaaatattcccaaggtgattttta

SEQ ID NO: 3824 - DNA, 121 bp, Artificial Sequence
  Synthesized
  misc_feature (61): n=t or c
atttcagaaacttctgagagctaatgtttggcacagttggtaactttgaactatagcaatnatttcacatagaaaaagatagggaggattctttaaattgaagttctcattgatccatatg

SEQ ID NO: 3825 - DNA, 121 bp, Artificial Sequence
  Synthesized
  misc_feature (61): n=t or c
acttcgttcttttcagctctgcacatccttttatgtcactgccatgatttttagcttgttntttgtcaagcattttctgtcttccttcaaatcctcccttgtaattaagcttcatcttcaa

SEQ ID NO: 3826 - DNA, 121 bp, Artificial Sequence
  Synthesized
  misc_feature (61): n=a or g
ccagtatcaattcatactttttcactgtaggtgttcaaggcaaggtcatccaacagccatntgaaatggaattcactctttcgttctgttgatagaaaagtaagagtcagagcaaattaaa

SEQ ID NO: 3827 - DNA, 121 bp, Artificial Sequence
  Synthesized
  misc_feature (61): n=a or c
gatctactggctttagcttgagctctttatcaagtcacatcccctttgctggtggtgtgtncccagcaggcctaggtgcttcctctcgagctgctgtccctcatgagctgcagctaccatg

SEQ ID NO: 3828 - DNA, 121 bp, Artificial Sequence
  Synthesized
  misc_feature (61): n=t or c
gtctttcaggatggtgaaggaatgactgtgtatgtgggtggcattaaaaacaaaatttggngtgtttttgaggctatgtcttcttccttgtgtaccacattagatagggttttagcactta

SEQ ID NO: 3829 - DNA, 121 bp, Artificial Sequence
  Synthesized
  misc_feature (61): n=a or g
gtgtacgacagcatatggggagagtacaaatgcaagcagtgagcacagtcaacgtaactgngggtcactccagtgctcatcctttgctttgggccagtttgtctgtacggtcctagcttga

SEQ ID NO: 3830 - DNA, 121 bp, Artificial Sequence
  Synthesized
  misc_feature (61): n=a or g
gtatagcatttgcagtgccaaaggtttgcactgatttgctgttcccttgaaaattcacccnaacatgctcaagccattgacctccgagtacactcagaatttgcatttacattcaccaaaa

SEQ ID NO: 3831 - DNA, 121 bp, Artificial Sequence
  Synthesized
  misc_feature (61): n=t or g
tgtcatttttatacaaaagcatgacacgatcttccctttctcgtctcacctctgtaaatanctaagtattaatgagctcctctgaagctatctggctcaaaaacgtctgtttctcaagtgc

SEQ ID NO: 3832 - DNA, 121 bp, Artificial Sequence
  Synthesized
  misc_feature (61): n=t or c
gttcaaagacaaagtggaatgagaaataaaccagcaagtgacatgcaaacagcaataaccnaaagcatatgttaagagcttactaacacccattccactatggaattttttaaggctattt

SEQ ID NO: 3833 - DNA, 121 bp, Artificial Sequence
  Synthesized
  misc_feature (61): n=t or g
ttttctaagaaaagtgtacttaaaaacttttgtacatacaatcaaactcagcttaaaagcnacaagatcagaatagctttggactactgaactgctggtcgcagagttcattacctgaaca

SEQ ID NO: 3834 - DNA, 121 bp, Artificial Sequence
  Synthesized
  misc_feature (61): n=a or g
gttctgcctctgttggctgaacagtgcctgcttggtgctgagctcctgtttcaacaggctncagcctgagagtcactgagggttcaggacctcttcccactttctgactcgtggaaggcgc

SEQ ID NO: 3835 - DNA, 121 bp, Artificial Sequence
  Synthesized
  misc_feature (61): n=a or g
ctcagcactgtgccatgttttctgttttcaaagaaaagtaaagatgtcagtgttttacgtnctgtatagtgccctctttgcagtttgaattctatggcatgatttctggcattcagtgtct

SEQ ID NO: 3836 - DNA, 121 bp, Artificial Sequence
  Synthesized
  misc_feature (61): n=a or g
aaaattcttcttttcacatcataagctgcatgacagcaagacagagtgcatgtggccagantgcagcaaatgaaaggaaggatgtgtctctatctggacagaagaggcttcatttcttcca

SEQ ID NO: 3837 - DNA, 121 bp, Artificial Sequence
  Synthesized
  misc_feature (61): n=c or g
catgctgaactagagcaataactgagacaagggaacgtaagctttagggagacttgttctntggtgtggtttctaaactggtttattcttaaatcacaagttttaaatggagaatatgtgc

SEQ ID NO: 3838 - DNA, 121 bp, Artificial Sequence
  Synthesized
  misc_feature (61): n=a or g
gctctaatttacttttttctctctagctgctccattttttcagaacaataagacctctgtntatttattttatttctgtggtcacagaaataatgcagggaagcgactgaactgtaatgat

SEQ ID NO: 3839 - DNA, 121 bp, Artificial Sequence
  Synthesized
  misc_feature (61): n=t or c
ctacagtccattccaggacactgcttaaaacccttccgagcaagcattttccctgacacanatcctagcactttgcatggccactggtcacactcaattctcatttcacatcaccaacaat

SEQ ID NO: 3840 - DNA, 121 bp, Artificial Sequence
  Synthesized
  misc_feature (61): n=t or c
gaattacaatggccatactgtctgctggtgctgtaggaaaccaaagatattcctaagctangcttaacaagtgtcttgctatccaatagcatttatttactgtgtttcaatacctgtgtcc

SEQ ID NO: 3841 - DNA, 121 bp, Artificial Sequence
  Synthesized
  misc_feature (61): n=t or c
ataaaaattaacaggacagatatacaactgagcaccaggactcacagacaggctgctgatnaaggaaattttgctttaaaaagaaaggaaaccctcagaggggcatgctgacactttaaaa

SEQ ID NO: 3842 - DNA, 121 bp, Artificial Sequence
  Synthesized
  misc_feature (61): n=t or c
ccctctataagcctttttcccttcatacgcccacgcacagctcagaccaccagcactaccngagtctgccaacacgcacacgtacagcaccatacaatgaaggcctcactagcttaaagca

SEQ ID NO: 3843 - DNA, 121 bp, Artificial Sequence
  Synthesized
  misc_feature (61): n=a or g
agccaggatttgagtttgatcttgtgggtgtgttccactcaggatactctatggttctatnctgcaacacagaatgctagcttacattgtttttcctgaaacagctcacgtcttgcgttat

SEQ ID NO: 3844 - DNA, 121 bp, Artificial Sequence
  Synthesized
  misc_feature (61): n=t or c
ctgagaacattggtttgctgcttaactgcttttttacaattccttttaatccttaatcagngtaaaataatctctgttttagatgaaaaaaatcatcctaggagaagtgtatcttcagaat

SEQ ID NO: 3845 - DNA, 121 bp, Artificial Sequence
  Synthesized
  misc_feature (61): n=t or g
ctgttagagggcattgctgtcaccctttcccaggcactgtgtgaccaagagcgtacaattnaagcatagctgcatgtttaacaaagctttcattaggcgaatatcatggctaactgtttta

SEQ ID NO: 3846 - DNA, 121 bp, Artificial Sequence
  Synthesized
  misc_feature (61): n=a or c
tgagtgatatgagggagttctatggtcagagtggccagttgacctcttaaatatcagcagntgagagggagaaaatgtggtgaaaaggcagaagaatgaccatggagcaccagactgagcc

SEQ ID NO: 3847 - DNA, 121 bp, Artificial Sequence
  Synthesized
  misc_feature (61): n=t or g
agacatccatgacagcacagaaacgggacattcagctgtagaaagttaagctttgtgatanttctggtctttcaactctgcatagtacaaaaaacaaacaaagaaacaaacaaataaacac

SEQ ID NO: 3848 - DNA, 121 bp, Artificial Sequence
  Synthesized
  misc_feature (61): n=t or c
tggtgaaatctttcttgtccaacccacgtgtgcacacctgtgcagaggtttggctgaggcnaaaaccaccacctcagagtttgcttgagcccaatcccagcagctacctgcaatgctgagc

SEQ ID NO: 3849 - DNA, 121 bp, Artificial Sequence
  Synthesized
  misc_feature (61): n=t or c
atcagatttctttttcctgagcagtagttagaaaaaaaacaaatttctagtcttcataacntctaggaaaagatattgaaatcagggccaccatgaagctttcaagtgttatatcttaaag

SEQ ID NO: 3850 - DNA, 121 bp, Artificial Sequence
  Synthesized
  misc_feature (61): n=t or c
cgcactgcagctgatagacagccattattagccaaagttaaaagatttgcatgaccactgngcagtttttttctgaacaatactattaatatgcaaatttatatgcttcaattcaccacca

SEQ ID NO: 3851 - DNA, 121 bp, Artificial Sequence
  Synthesized
  misc_feature (61): n=t or c
aaagtttccagcatcactgatgaaaagaaagcagtcgaaatgaagaagtttgttttgctgntaacaagaacaagcatctaggacaactcatatttcagcaagaacaaataaaaaacagagt

SEQ ID NO: 3852 - DNA, 121 bp, Artificial Sequence
  Synthesized
  misc_feature (61): n=t or c
taaggtttatagcaagtttgttttcattcagtagaggcgtatgctattggctatttcaaanatgaggacacatgctttttgcaatgcttttgtggttaagtatccaaagagatgaaggaac

SEQ ID NO: 3853 - DNA, 121 bp, Artificial Sequence
  Synthesized
  misc_feature (61): n=t or c
tcacttggggagggtctccatgctcagctcccaacacagagatccccagtacaatcaccangctccttggagagctgaagcaatgcccattcccccttccagaaatagagaagctgcagtc

SEQ ID NO: 3854 - DNA, 121 bp, Artificial Sequence
  Synthesized
  misc_feature (61): n=t or c
cctttctctccattattaaggtgactgcccttagggtcatacaacaaagccagaagaagcntagaggtgtggagaacctctatcctgagggccctgctcctgccagctacactggagcctg

SEQ ID NO: 3855 - DNA, 121 bp, Artificial Sequence
  Synthesized
  misc_feature (61): n=a or g
gctgaatgggtcactggttttactggacttgcacaaaggacgttgtaaagatgcaagtgcngtccaactcttccaaggatgcagttatacttcctccatttttggcacaccttgactttgg

SEQ ID NO: 3856 - DNA, 121 bp, Artificial Sequence
  Synthesized
  misc_feature (61): n=a or g
ctgttatgtgagcacggctgctcagggaattacagtcttcatttttattttatcatgatgncatttttccaatcaaggctttaagtcagacttaaggtaaatttaagatatatttaagaaa

SEQ ID NO: 3857 - DNA, 121 bp, Artificial Sequence
  Synthesized
  misc_feature (61): n=a or g
tctgcttccagcagccctggtgtgcctgctgtgcccaagtgctgaactagtgaaagcctcnctgtgtagccaaggctgttcaggctgtttgtctgagtagtgagctttaaacgagctctgt

SEQ ID NO: 3858 - DNA, 121 bp, Artificial Sequence
  Synthesized
  misc_feature (61): n=t or c
ggcagagaggaatatttcaccttagattagatgcctggttgctgaaatttgttattaacgnagattatcaaagctagatggctattcagtaggctgaggatgaaaagtcatcaagtgtatg

SEQ ID NO: 3859 - DNA, 121 bp, Artificial Sequence
  Synthesized
  misc_feature (61): n=a or g
cattacatgccatataacattgtgaaaaaaaataccttgaaaaacagcggggaagaggtcnggacaggctgtggctgcctgggaactaggtgagcatcagctggcgggtcataagcaacta

SEQ ID NO: 3860 - DNA, 121 bp, Artificial Sequence
  Synthesized
  misc_feature (61): n=t or g
ttacccttaatatatttgtaaaaggatttcttgttctcaaagcctgtacaccttattcctnctttgcctgtgtgaaggatgatattacatctgaattcactacatatggtacattttaaat

SEQ ID NO: 3861 - DNA, 121 bp, Artificial Sequence
  Synthesized
  misc_feature (61): n=t or c
agcaggatcagctggataaaaatgatgttgtcttgatgcatggtggacagacaactctttngctcctcccaaagtgcataagcattgaaaaaattatttaaggtattgatttgagaatata

SEQ ID NO: 3862 - DNA, 121 bp, Artificial Sequence
  Synthesized
  misc_feature (61): n=a or g
ctttgatatacacccttttgaagttcaaagctttattaaggaaacagattgaagagatgtntattgtgtacacaacacagaaagagatccttttggatttttttaaaataatacatattga

SEQ ID NO: 3863 - DNA, 121 bp, Artificial Sequence
  Synthesized
  misc_feature (61): n=a or t
ccttccctcacctccctcatctcaaaacagcatcatttgtgaaaaattctaaaacaaacanttctctctgttccgtttttttttacgtttcttttctccattaacaaaaagtaacattttc

SEQ ID NO: 3864 - DNA, 121 bp, Artificial Sequence
  Synthesized
  misc_feature (61): n=t or c
acttctctgcccggtcaagtcctggctgaaggctgtgtgaaggtcagtacctcagcccttngacttgaagatgctggctggaagcaacaacagggaatatttacattacatgttagtcagg

SEQ ID NO: 3865 - DNA, 121 bp, Artificial Sequence
  Synthesized
  misc_feature (61): n=t or c
tagttcgtcttttggtttcagttgcttgatgagtacatcatttcggtgaaagtggatttcnttcaaccgatctcaggaataatgtctgtatagtgtagctggccttgagtagaagtaagac

SEQ ID NO: 3866 - DNA, 121 bp, Artificial Sequence
  Synthesized
  misc_feature (61): n=a or g
aggtgtattaacatcaacatttaataactttgcttctacccttctacagctttttttcccngggacttctgaccagagagggaacacttaaagtgtagtgaggatcagaggaagaaacaaa

SEQ ID NO: 3867 - DNA, 121 bp, Artificial Sequence
  Synthesized
  misc_feature (61): n=a or t
ggtttcctttcttgcacatgcaatttatttttgtttagctaggtgcatgtattaagtgttngttacaacagtccctccaggactttcttctcagtaattttccacttattgactgacttac

SEQ ID NO: 3868 - DNA, 121 bp, Artificial Sequence
  Synthesized
  misc_feature (61): n=t or c
gatcccatctgttatgaattgtacttcactgagttgaagtatggattttgaacacatcttngtgcaactctgaaccagtattgtgtatttattattatatttcttcatctatgctgtcaaa

SEQ ID NO: 3869 - DNA, 121 bp, Artificial Sequence
  Synthesized
  misc_feature (61): n=t or g
agatccataagtctgcattcagtgacagtcagagccttctgccacgtgtgtggatgtactncattctcttgtatttattttaggaagggtgagtgatatcgcgtttgacaactctgacgct

SEQ ID NO: 3870 - DNA, 121 bp, Artificial Sequence
  Synthesized
  misc_feature (61): n=t or c
gagagtcttgagggatgcactgaagacgatgactggatggcggtgtgcatgacatatcctnacaccctgtgggcaccacatgtccccacctgcaggttcggcccacaccaccactatcaga

SEQ ID NO: 3871 - DNA, 121 bp, Artificial Sequence
  Synthesized
  misc_feature (61): n=t or g
gtccaagcagaattaaatgcaagaagctctgtcacttctatgaatgctaagaaagtagctnttatacaattaaagttcaaggttgcatctataataggcttttcagtgtatttgaaagtag

SEQ ID NO: 3872 - DNA, 121 bp, Artificial Sequence
  Synthesized
  misc_feature (61): n=a or g
caaggggatttgtccctgcacttgctctgtttttgctttttcaggtttgtgcaatcacagncacaaggtgagtgcatgttgtcctaacaaaacactgaaaaagcagcatttgagctcagca

SEQ ID NO: 3873 - DNA, 121 bp, Artificial Sequence
  Synthesized
  misc_feature (61): n=a or g
tgaccactccagaaataaaatagtaaaataacatggtcaaaaggttgttttaaaggggggnaaagcacatttgttgaataattcaagtatttgtctgtctacagagatacaaagatttgtt

SEQ ID NO: 3874 - DNA, 121 bp, Artificial Sequence
  Synthesized
  misc_feature (61): n=a or g
gcagcgcgcgtttctttgcagccgagctgaacgttccttcagagaccttgctcttcctgcngtgcttatacgaggtaagcttttgaggtgaagtttccagtctttattgcttgtatttaag

SEQ ID NO: 3875 - DNA, 121 bp, Artificial Sequence
  Synthesized
  misc_feature (61): n=t or c
catgcatctcccaccaccaatacatatgtgtagctgcattaggacgtaagccaaaactcantggagtcaacttccgagctattgatcaggtcccatcagggcaagagaataaagattttta

SEQ ID NO: 3876 - DNA, 121 bp, Artificial Sequence
  Synthesized
  misc_feature (61): n=a or c
acacctctcattgtactgaaattctctctacaaattactttgagcttacctgttggaattnattgtttactttcttcaagtgtaagtaggaattcagcaaaatgaactaccattagaaagc

SEQ ID NO: 3877 - DNA, 121 bp, Artificial Sequence
  Synthesized
  misc_feature (61): n=t or c
tgtgccaagcatgtgagatgttctttcaccatctttttagctggtgcacttcttttggctntcacattgttctgaagagagaagagaatagtaactgtaaagacagagtgctcaattatca

SEQ ID NO: 3878 - DNA, 121 bp, Artificial Sequence
  Synthesized
  misc_feature (61): n=t or g
tcccttgtgctgtctttccattgtttctgcttctccattatgtcaaatttacatgtatttnttctcacaagcataactgcacttgcagtataatgtaatattgactcctttttttattgtc

SEQ ID NO: 3879 - DNA, 121 bp, Artificial Sequence
  Synthesized
  misc_feature (61): n=a or g
ctgcaatatttgcccaacagcaagtgacaggaaaagttgcaggttttcctctgccagcgcngagcgatgctggatggctgacgtgggtggcacctgatggtaactgcccacggtccctgct

SEQ ID NO: 3880 - DNA, 121 bp, Artificial Sequence
  Synthesized
  misc_feature (61): n=t or g
aggaaaagtcaaaatattaagaggtactcagaacaacggatccaatacagttccatttttnggggctttccttatgccaacactgaattcagactattctaagtttttattacctgttctt

SEQ ID NO: 3881 - DNA, 121 bp, Artificial Sequence
  Synthesized
  misc_feature (61): n=a or g
caactattcctcatcctccaatccctgctcacaatatccccagccaaaaacaaggtcaggncttgcttcaggcagaatgagcacacctgaggcagtgggaaggagaactatggtgacactg

SEQ ID NO: 3882 - DNA, 121 bp, Artificial Sequence
  Synthesized
  misc_feature (61): n=a or g
taaactgaagtgttagtacaggcatgaagatgatgctggcactttgaagagatgctctctntaaggaattttctcctgagtcttgagcctggttgtggtgtaacttggagaagaacctgcc

SEQ ID NO: 3883 - DNA, 121 bp, Artificial Sequence
  Synthesized
  misc_feature (61): n=t or c
ccttacttcaatccaggcagttctgtatgctttttaaacctgtgtagaggtggtaaaatgngtatatgttgaaactttttcttcctggcgctccatcacttggaaagcaatctgaggcttt

SEQ ID NO: 3884 - DNA, 121 bp, Artificial Sequence
  Synthesized
  misc_feature (61): n=a or g
cccttgcttgttgtgaatattatgaagagataaactcccactcagtgatggctggtgcatntaccaggtttccaccaagacaactttcagattatatctgtttgcttagaaaatgtttgta

SEQ ID NO: 3885 - DNA, 121 bp, Artificial Sequence
  Synthesized
  misc_feature (61): n=a or g
aattttcggtctgtgtccctgagcttactagtgacagaagtatttaaataaaatggtgtgnatgggatttgttatgttgtcttctagtgctggtagagactcctaataacattggtcggaa

SEQ ID NO: 3886 - DNA, 121 bp, Artificial Sequence
  Synthesized
  misc_feature (61): n=a or g
taaatgcacaaagtcaagtatatagttgatgagttccattctcagtgttttctatctccanagattctttctgctctaatgaaagcagagattccagagaagaagagatatttagagaata

SEQ ID NO: 3887 - DNA, 121 bp, Artificial Sequence
  Synthesized
  misc_feature (61): n=t or c
gttcttaatgctggtccctagagagcttttatgtacgtgccatttaattgcacaatgtaangtattgcttcacagctgcaataatagtgttgtgtgaaatgcgtcctggattttactttgg

SEQ ID NO: 3888 - DNA, 121 bp, Artificial Sequence
  Synthesized
  misc_feature (61): n=t or c
aaaaaacatccaagaaaggcctatgcctggcaaaactctgatgttgtgtaaaatcagtatnttggttaatcttatgattttctctgctaagatcatgtgctaattgaacagcacagaagga

SEQ ID NO: 3889 - DNA, 121 bp, Artificial Sequence
  Synthesized
  misc_feature (61): n=a or g
tgaaagtggaatttctttaaaacctcaccaagagatataatcactaatccctccagaagancacagtgtaacagtatttctgaaaaatcacatttccaataactttttacccaattataac

SEQ ID NO: 3890 - DNA, 121 bp, Artificial Sequence
  Synthesized
  misc_feature (61): n=a or g
ttctgtcctgctaattccatgcaacacagtgtgtttctcctcagtctctgcatctgtcccnctctgaagaaagtctatccctgctccagtgctgacagctccttctaaaagctgctgcaag

SEQ ID NO: 3891 - DNA, 121 bp, Artificial Sequence
  Synthesized
  misc_feature (61): n=t or g
tatcttagagaatgttgtttataaatgatagaaaacaaagtggtgaatattttgtgtcatnatatgaaccatcaacaaactttatgcttacaaactttctgtcacctctactgaaacagct

SEQ ID NO: 3892 - DNA, 121 bp, Artificial Sequence
  Synthesized
  misc_feature (61): n=t or c
accttttaaaaagtgtttatgtcatatatgatgaataaaataaaaactatgtataggcaancttacaacttaatagctcagcaggatgtaaaactccattcactacagtttgcttaaatga

SEQ ID NO: 3893 - DNA, 121 bp, Artificial Sequence
  Synthesized
  misc_feature (61): n=a or t
gcattaatcccaggatatgggtgcatgtctaacgcttgaaattgttagtgtgttagcattnacattttagttactgatgaatacttatgatctataaatatttactaaactcggttcacat

SEQ ID NO: 3894 - DNA, 121 bp, Artificial Sequence
  Synthesized
  misc_feature (61): n=t or c
gagctgtggatcttcagagtgcttacagcccttccttccctgatgttgtcagggaggaagnaccatgtagaaaacaattaacaaatgtgggaggggcacagccaacttgaagctctccact

SEQ ID NO: 3895 - DNA, 121 bp, Artificial Sequence
  Synthesized
  misc_feature (61): n=a or g
agtaaaattgcagcttaaatcagtggaaattttctctagggaaagtcttgcagtattggancaaactgagaacatacttttgaaaagctcatcaagaaagcaagaagaaattattttttat

SEQ ID NO: 3896 - DNA, 121 bp, Artificial Sequence
  Synthesized
  misc_feature (61): n=t or c
acagtcatcagtggcattttagagaaacaggaactatttcaacagtcggacaccctggatntttgctttggaaagcattcacatcaactcctccaatctgctctggcatgttttgacaatt

SEQ ID NO: 3897 - DNA, 121 bp, Artificial Sequence
  Synthesized
  misc_feature (61): n=a or g
aataaaaatgaaacttgaagtgtcttacttcaaacaaaaggagggtatttaaataggagantctcatgggaaagatttcatatcactacaaacagcacactggttcagaatataatggtaa

SEQ ID NO: 3898 - DNA, 121 bp, Artificial Sequence
  Synthesized
  misc_feature (61): n=a or g
aaaaaaaaaagattctgttgtagaagcacctcatctgactgctgaagatgttacccttacntgagctgaaacaggtgggcgtcctttccagcttcacctcactgttcttcatcattattgt

SEQ ID NO: 3899 - DNA, 121 bp, Artificial Sequence
  Synthesized
  misc_feature (61): n=a or g
agttacaaatcctccatatcactcacacagtacatctatttctctggctaatcagcaagancagggtctcgatgcaggcccaggcatgggatcgttaagaaattaaaattttcactccact

SEQ ID NO: 3900 - DNA, 121 bp, Artificial Sequence
  Synthesized
  misc_feature (61): n=a or g
aagaagagccttttttcctgctccatctctgagattcttttccaactagagcatctgtaanttctcttccagaaggggaccggtttgagctctgtaagcccctgtggtatgtgcagcctat

SEQ ID NO: 3901 - DNA, 121 bp, Artificial Sequence
  Synthesized
  misc_feature (61): n=t or c
gtgccgtgacagcaggtgcgtgcagcgcgggctgagctccctcatgggctggggctttcanggtcacgtgctgagagatgaatggaatcgccagagggttactaatacgctttaaaagaag

SEQ ID NO: 3902 - DNA, 121 bp, Artificial Sequence
  Synthesized
  misc_feature (61): n=a or g
tttgttcagtggaggagatgagctgaaggactgtgtgtaagaaaaaccttacaaaacactntggggtttgcaagctgtgttccccaaccttgcatacagcagtgagcggtatcagtgctat

SEQ ID NO: 3903 - DNA, 121 bp, Artificial Sequence
  Synthesized
  misc_feature (61): n=t or c
gtatgaaaagacatttgttgagatggaagttgcatttaatctaagatttgcttctgctttnaaaggaatgacagattcaaagaaaggatgtttttatctcttgagtggcttactgttatgg

SEQ ID NO: 3904 - DNA, 121 bp, Artificial Sequence
  Synthesized
  misc_feature (61): n=a or g
ctttcttattttttttcccctgaaagggaaactgagcaataacctgtcagtgatggaaccntctggcaaagccagcagcatttttgtgccccaaacagcacagttcagatcccatcctttg

SEQ ID NO: 3905 - DNA, 121 bp, Artificial Sequence
  Synthesized
  misc_feature (61): n=t or g
ttgggatagtaatttcttcggctgttccccaggtcactgtggaaccacttgcctttcactntggcagattaaggcagggtagggctgtcacacgcctgaagactcaatttcacaaacctgt

SEQ ID NO: 3906 - DNA, 121 bp, Artificial Sequence
  Synthesized
  misc_feature (61): n=a or g
cttaaataaacacaaagtgtgaaacaagatttccaaagtaaaaccaagacattacacaacnctcagtttcagttctgttctaacagaaaacccagacgttactcagaaccagcccctttga

SEQ ID NO: 3907 - DNA, 121 bp, Artificial Sequence
  Synthesized
  misc_feature (61): n=t or c
tgcttctctcaatcaccacgaagccactcctttggcttcttaaggagccagctctgccagnggcgaggagggaattgatgcattttggtggccctgaagatacagaaccaaaaactgtgtt

SEQ ID NO: 3908 - DNA, 121 bp, Artificial Sequence
  Synthesized
  misc_feature (61): n=t or g
atacaaaccttccaggactgcctccttgcaggctgagggctgctggctctccacactactntccggctatcctccccttttccacaagcaataaataaagaaatgagtgtagtgtagaccc

SEQ ID NO: 3909 - DNA, 121 bp, Artificial Sequence
  Synthesized
  misc_feature (61): n=a or g
tccttggtgctgtgtaatggccagtgggaaggtgtatgattttgggtaataactgcactcncatgattgtatccatcagcggagggttactcaactttattacaacatgtttatttttgtg

SEQ ID NO: 3910 - DNA, 121 bp, Artificial Sequence
  Synthesized
  misc_feature (61): n=a or t
caccccatgactacattgcaggagctgctctgctcctttggtgcaggtagaagaagcagcnacacagagaacatcccacttgcctattgagttatctttaaattatcaggaaaatctggga

SEQ ID NO: 3911 - DNA, 121 bp, Artificial Sequence
  Synthesized
  misc_feature (61): n=c or g
gatcttgacagtaggatcccaggaggaaatgggcaaccatccattttgtaacctccactgnttttgtcagcttgcaagttaggttccctgctccatagggtgtttataaatcgtacgcagg

SEQ ID NO: 3912 - DNA, 121 bp, Artificial Sequence
  Synthesized
  misc_feature (61): n=t or c
cttacagaccttttctaaccttaatgattctatgtcttagaatctatgtattctagtctanctgtgatgctaaggctgagttccttccccctgcttgcaaagcaactacgacaataccagc

SEQ ID NO: 3913 - DNA, 121 bp, Artificial Sequence
  Synthesized
  misc_feature (61): n=a or g
cagcacagaacaggacgcacaaaatctgatggaaagatttccagatgaaatgtaagtctanatgtttttactgaagttcaaagatcattaagaacttcaacttgcaagccatggaaaacta

SEQ ID NO: 3914 - DNA, 121 bp, Artificial Sequence
  Synthesized
  misc_feature (61): n=t or c
tgtaacgagtgcaaggaaattacaagctgctgtaaaaattacagagactaaaactaccatnttatcctgcattagaacaattttaacattgttagaggaatacatcttagcaattttaaaa

SEQ ID NO: 3915 - DNA, 121 bp, Artificial Sequence
  Synthesized
  misc_feature (61): n=a or c
ttgaggtcaggacttattagcataaatagacatagtacttgaaacagaagagacttgatcnccatcagatcatgcaggcctaacagtgaatacacatctagtaactttatcaagcaattaa

SEQ ID NO: 3916 - DNA, 121 bp, Artificial Sequence
  Synthesized
  misc_feature (61): n=t or c
attgtaaagaaaggtcttttcagcattccaaaatcaagatgcattagaggaaggattatantgtatatagggcccttcctatgtagaaatcaccaggtgtgattctagatttaaggaacaa

SEQ ID NO: 3917 - DNA, 121 bp, Artificial Sequence
  Synthesized
  misc_feature (61): n=t or g
cacatttgaatgtgtcatgatttgaagagttaatctgacatcttttccaggaggccagttngcgagggctgccaataaagacttggattgactctctctctgtattatctcacactccttg

SEQ ID NO: 3918 - DNA, 121 bp, Artificial Sequence
  Synthesized
  misc_feature (61): n=c or g
gcctctgctctgctacagtatttgacaaacacagctgaagaaaactatatgcccagattangaggctaacaagtattccccaaattaatgatgaactgcattcattttactttttgctctt

SEQ ID NO: 3919 - DNA, 121 bp, Artificial Sequence
  Synthesized
  misc_feature (61): n=a or g
ctgacggtgcccgtcctcctgcatggctccaagccctcctggtgccaggcagcggctgacncattctcccctcatctccaggtgtgcaaaacctgcccaagtaccaccagcagcatgcacg

SEQ ID NO: 3920 - DNA, 121 bp, Artificial Sequence
  Synthesized
  misc_feature (61): n=a or g
agaggagtgactgattgctttccagtccacttcaggagagaactggacagtcaaaaggttncttaacagaagcaacaacagaaagcttagttttctgcctgcatataattccacccataaa

SEQ ID NO: 3921 - DNA, 121 bp, Artificial Sequence
  Synthesized
  misc_feature (61): n=c or g
cccacaaaaagaaatgtaaaaccctgcagagcttcctaaatagccagacccctgaggaaanagtgatggctcacacttggctgtaaccacgcatggggtatatgaaaggtgagttcccaaa

SEQ ID NO: 3922 - DNA, 121 bp, Artificial Sequence
  Synthesized
  misc_feature (61): n=a or g
aattagattaggaagccctgattctaactcaaatttctttggtttagacctatttggaggntttggtagtgaaggagtgcaggcgtagaacaaaggagtgtacttacagcaagtaaaatca

SEQ ID NO: 3923 - DNA, 121 bp, Artificial Sequence
  Synthesized
  misc_feature (61): n=t or c
aatcccaatacacttgagaatacttcattttgcagacaaaattctaacagaaacatgctgntattccctcgcattataacttatctaacctatcagcaatactcaggctatatcctacatc

SEQ ID NO: 3924 - DNA, 121 bp, Artificial Sequence
  Synthesized
  misc_feature (61): n=a or t
tcttttgagacaaatggctctagctttgatttagctggagaagagaccagagcaaaactcngctgctcacaggcagaagagcacttgggtttctcatctgcatttgtgctttctccgagga

SEQ ID NO: 3925 - DNA, 121 bp, Artificial Sequence
  Synthesized
  misc_feature (61): n=t or g
cttctaaattcctctgcctggtcctcttaaataagaagtttcatcttaagtaaaaatactncatttatgtgtgaagataatttagatagagaacgcccacagccaatgccctatcccttac

SEQ ID NO: 3926 - DNA, 121 bp, Artificial Sequence
  Synthesized
  misc_feature (61): n=t or g
aagttactcttagccaggtataaaaagcagagcatgactttcatgagactgggagggaggncatgtatcgcagtcattataaaattccccccaaagtggataagccttcatcaaaccatga

SEQ ID NO: 3927 - DNA, 121 bp, Artificial Sequence
  Synthesized
  misc_feature (61): n=t or c
gtaatggaggcgtgatgaactcactgaacactggggcgaatgacaaaacaggagccgtgcncacacttagccaggttatggccagtttgtggcttggacctctgcctttctgtgttttact

SEQ ID NO: 3928 - DNA, 121 bp, Artificial Sequence
  Synthesized
  misc_feature (61): n=a or g
aaaattatggatatagcttgtctgatgccagcatgaaacagagaggttcagcagttacctntgttccctacaccaagcagacaaattagtattacctttttttctttttttgcctctatca

SEQ ID NO: 3929 - DNA, 121 bp, Artificial Sequence
  Synthesized
  misc_feature (61): n=t or c
cgtagtgacggtgtttttgaaaggcagtttagaaattcatttctggacatatttttcatcnatcctggatcttgtgtgcagtttgacttcctacatcataaaaatacactttactttgagg

SEQ ID NO: 3930 - DNA, 121 bp, Artificial Sequence
  Synthesized
  misc_feature (61): n=a or g
accctgctaggatatttttaaatggcatgtggtattagcatgcaatttaataataatcacnttagtccggagtctaaaacacagatttcacatcctcaaaacaccttctaccttgtgcaca

SEQ ID NO: 3931 - DNA, 121 bp, Artificial Sequence
  Synthesized
  misc_feature (61): n=a or g
ccatttaggggcacgtcttcctttgagtactggtcttctgaactgggattcattttgtccngatacagaggtctgtggcatggttggatcaacttttggatgtacaaaggacatttttctg

SEQ ID NO: 3932 - DNA, 121 bp, Artificial Sequence
  Synthesized
  misc_feature (61): n=a or g
ctttcttctttacatgtgaaatatgcagtcaagaacctgagaaaacagtggtgctacccanttatatgacaggaatggacaataagctgcacggtatctggatggctcagaaaaatgcctc

SEQ ID NO: 3933 - DNA, 121 bp, Artificial Sequence
  Synthesized
  misc_feature (61): n=a or g
actcattggggccagctgagaaatctggtgtcctgtgtgcatccacacacattatctgtgnctgtgcaacacccgagtatgcacaggcaagtttagaacagaacgtaactacgagatatgc

SEQ ID NO: 3934 - DNA, 121 bp, Artificial Sequence
  Synthesized
  misc_feature (61): n=a or c
tttttaatacttaagtgctgctcttcataagcaaatgaatatggaaaggggaaaagtggtnatcggtcagctgtacgagcaaatcgttacaggaacagagcagacttccacagcttcctga

SEQ ID NO: 3935 - DNA, 121 bp, Artificial Sequence
  Synthesized
  misc_feature (61): n=a or g
ccatcctctcttaattacaggtatactaggaaaaactaatgatcagaagcaatttatgcantggaaaagccttcaactctctggcatggcacactaaggggagatcaagcaacaggcgttg

SEQ ID NO: 3936 - DNA, 121 bp, Artificial Sequence
  Synthesized
  misc_feature (61): n=a or g
aacactttgcccttcttttctgtgtgcttatgataaatgaacgtgcaaaggcaaggaaaantgcatgcaagtttgaacacttttcctcagatgattgtctttagaaatttagtgtctagaa

SEQ ID NO: 3937 - DNA, 121 bp, Artificial Sequence
  Synthesized
  misc_feature (61): n=a or g
aaatcactgtgcattgtgactgaatggtggaatctgtggtcaaaactgtgcaaaaaagacngaccaaaggatgaaagcttttcatctcagctgtgaggagctatgagtgtggggctttgtc

SEQ ID NO: 3938 - DNA, 121 bp, Artificial Sequence
  Synthesized
  misc_feature (61): n=t or c
ctgtccctgtagccatgagagggtaactcccacatgacatgttttggctcattttgaagcnggcaaggcacgtgtatttcaacccagatttccttaggaaaggtatttcttttaagtcctc

SEQ ID NO: 3939 - DNA, 121 bp, Artificial Sequence
  Synthesized
  misc_feature (61): n=t or g
cctgtgttaccagagcagatgttgtgaccagtggttgggaactgctgtgtttcaaagcatncttgtttgtgtagctgtacttagcagcatctcaggatagttcttagaaccaggtgttgaa

SEQ ID NO: 3940 - DNA, 121 bp, Artificial Sequence
  Synthesized
  misc_feature (61): n=a or c
aatttcccttcattgcaaagtccttggtaactgtaatcaatgtatcatcatttcagtaggntgtacttggaattcattaggaattctgggccataattgcagtcagcagagagctctaata

SEQ ID NO: 3941 - DNA, 121 bp, Artificial Sequence
  Synthesized
  misc_feature (61): n=t or c
gtgacaggtagaagtgcaagctgcttgctgcttcaatttacatttttgttgatcagtttgngtagtatgcagacatacctgtacaaaggcaatctggcaaacgtcacttctctgaaaaaaa

SEQ ID NO: 3942 - DNA, 121 bp, Artificial Sequence
  Synthesized
  misc_feature (61): n=a or g
ttctttcttgactgcatgacatatgttcctctcatttgtaatgataatttaaatatattantgaaattgaatttctattaccgatgggtacactctgaagccacagttgtcacagacaact

SEQ ID NO: 3943 - DNA, 121 bp, Artificial Sequence
  Synthesized
  misc_feature (61): n=a or g
ctcgtgaactatggttttgcttttttaggcaaataaccacagagcaaaagtacagttgctntatcctatctgactcacctaatttaacgaagatgttactgaaccaaaagttttctattta

SEQ ID NO: 3944 - DNA, 121 bp, Artificial Sequence
  Synthesized
  misc_feature (61): n=a or t
acagttcactttgtctaaaatcaactgttcagtaatgtgagatttgtcgagttgcaaatcnggcaactgcacttaaatccaggaaacagttcggtgaggatgtggagttcctaaaactttt

SEQ ID NO: 3945 - DNA, 121 bp, Artificial Sequence
  Synthesized
  misc_feature (61): n=t or c
agtttctattgttaccttctctacagtgggagagctatacctctgcagctccttccacttnagaaagttattcctgcctttcagtgcatatgaaaggctaatcaggctgttgtgctcctgt

SEQ ID NO: 3946 - DNA, 121 bp, Artificial Sequence
  Synthesized
  misc_feature (61): n=t or c
gtcttaatgatagagtatgttatcttgctttattgcctgtaggagttcagtagctttatanattccacatgcaaacagttgccgagagaaaagaaaatgcactgaaacttcttagaatttt

SEQ ID NO: 3947 - DNA, 121 bp, Artificial Sequence
  Synthesized
  misc_feature (61): n=a or g
agctacaacatctccctgcagaaacaggaacacaaactaatgagattttctgttgtccagnccagacaatcatatgcagtacttatcgataaggatgacaatagtttccaactgctgcaca

SEQ ID NO: 3948 - DNA, 121 bp, Artificial Sequence
  Synthesized
  misc_feature (61): n=t or c
tgattcacagcactgctgaaaagtgtgctgattcataaaaacttcaacagtactctgtagnacaccatcatgcaaatgctttctgcaccttgatttaaggtacatttaataatcataaaca

SEQ ID NO: 3949 - DNA, 121 bp, Artificial Sequence
  Synthesized
  misc_feature (61): n=t or c
ccatatctgtttttccaagatggttgtgctgtccctctggttcactttgcatctcctatgncagtatatgtggaaggggaaagtaacttacgctttgctgttattgtggcctttagtaata

SEQ ID NO: 3950 - DNA, 121 bp, Artificial Sequence
  Synthesized
  misc_feature (61): n=a or c
ctaacataatttatgaaatcagcagaatttacaatgactctgtggttcaggagctcccatngcattataggcttattacagagcctccaggaagtaatcagtatttcatttacttaatatt

SEQ ID NO: 3951 - DNA, 121 bp, Artificial Sequence
  Synthesized
  misc_feature (61): n=a or g
gtaaaagtatcaaggcagcttaggacagaaagtgttattaagcaaagggcttgtggcagcngaacagccaggttccacagggaacaagctccctgaaaaatggattagtgcatgcgctagc

SEQ ID NO: 3952 - DNA, 121 bp, Artificial Sequence
  Synthesized
  misc_feature (61): n=t or c
aaaacccatctgtgaaaaaaggcaaagaacacatacattactggctaattatcaagtgttngcaattaaattctttatagaagaagggctgaaaatttgactccataaatctgatctacta

SEQ ID NO: 3953 - DNA, 121 bp, Artificial Sequence
  Synthesized
  misc_feature (61): n=t or g
ttatactgctggccaaagcatgagctattagaaaacacttgtccagaaaaaagtaaacctntttatacttcctagaggacactgatgctctgatcaatattagcaagtgatgaagaagttg

SEQ ID NO: 3954 - DNA, 121 bp, Artificial Sequence
  Synthesized
  misc_feature (61): n=a or g
ggccttccacactacagaattttaaccagtatttaaaaaggatgaagtaaatgctctccantgctggtcacacagtgctaacctgcatgctggaagccatggatacactcagcagatgagc

SEQ ID NO: 3955 - DNA, 121 bp, Artificial Sequence
  Synthesized
  misc_feature (61): n=t or c
gtgctgagctaccttgccaggttaaatcacaacaggtcagtttttactgaattacacctcnaaaaggagcctccaaaggaaagtcaacgtaaaggaaatacctggctagtataacacctca

SEQ ID NO: 3956 - DNA, 121 bp, Artificial Sequence
  Synthesized
  misc_feature (61): n=t or c
tcatccaaatgaatgaatagggctggcctggacagggaaatatcatcagggcatacggcanttattaagcccattcctgggcataatgagggttacatccccaagctgaatggtacaaaca

SEQ ID NO: 3957 - DNA, 121 bp, Artificial Sequence
  Synthesized
  misc_feature (61): n=t or c
acctaaactactttgcttctactgcatctagtgcaaaattataccaaggcatcttaatgtntgaagggaagaacacaatgacattcagttcatcttggcttttactggacccagttgctga

SEQ ID NO: 3958 - DNA, 121 bp, Artificial Sequence
  Synthesized
  misc_feature (61): n=a or g
tgaagatatcctaattcagactacacaccacttaaaccgtagtacaggacaaatcactacnaatttgttctactgggtagcaatttcaactgaagctcatagtcaaacactatatacaaat

SEQ ID NO: 3959 - DNA, 121 bp, Artificial Sequence
  Synthesized
  misc_feature (61): n=c or g
gttctgatgagcagaccttcatctaagtctgctgtctgcatgttggaataccagagagtgncccaaggacactctgaatacacccagaagtaatttgtgtgtttatgacctgaatcaaaga

SEQ ID NO: 3960 - DNA, 121 bp, Artificial Sequence
  Synthesized
  misc_feature (61): n=a or t
tttaatgtaggagagttccaggtcagagctagttgatagtccacactgaaaaatatgcttngatattggtcatgtgtaagaaaaaaaattcaaatcagtcctgctgtttatctgtgttaat

SEQ ID NO: 3961 - DNA, 121 bp, Artificial Sequence
  Synthesized
  misc_feature (61): n=t or c
ttacactgtagattaaaggaattcattttcagagaaaatatatggaaatctgctcttctangccacttcagtggttgaataaacttcacatagaccggtttgagcaaaagatgtttggggg

SEQ ID NO: 3962 - DNA, 121 bp, Artificial Sequence
  Synthesized
  misc_feature (61): n=t or c
aaacgtatcacaggaagaaaggaatcaggaactcatagtgaatagaaaggcacctaagatntgctaatactatactagtcttagtcatgtttttagctattaacccaggactgtcatgaaa

SEQ ID NO: 3963 - DNA, 121 bp, Artificial Sequence
  Synthesized
  misc_feature (61): n=a or t
tgttgccctctgactcagttagtctgggttcaacttcattttttgaagaagtttgttaccntgtttcattaccaggaagtgcattcacctcagactattgatcgctctctccatttagaaa

SEQ ID NO: 3964 - DNA, 121 bp, Artificial Sequence
  Synthesized
  misc_feature (61): n=t or c
gaattttctttgttgtgtaaaatttaaatgccactcagctgtcctcttagagtgccttttnactgcgtagcactacaaatcaacatgttttatcataatgttttgtaacgttaggcaactg

SEQ ID NO: 3965 - DNA, 121 bp, Artificial Sequence
  Synthesized
  misc_feature (61): n=t or c
cttttccaggacaatagagtatcagaggtagttctcagagccagatatgtgattattcctngtgaaaagtattctcagagtacatagctgctgcttttactgcaggactgtaccagagggt

SEQ ID NO: 3966 - DNA, 121 bp, Artificial Sequence
  Synthesized
  misc_feature (61): n=t or c
attgcaaactgtgctgtgtgcttcaatattacttctcaagttagaagtattcccaaggacntaactgacaggagagaggaaatcttgacaattgtgtgttgacaggacagaaatgactcca

SEQ ID NO: 3967 - DNA, 121 bp, Artificial Sequence
  Synthesized
  misc_feature (61): n=t or g
agttggttggagcatgcagaaagtattttggaagagagaagaaaacagttttaagggagtngggcttcagccctgccctctgtgaggtccgatgcctctcacatccctgctgggagctacc

SEQ ID NO: 3968 - DNA, 121 bp, Artificial Sequence
  Synthesized
  misc_feature (61): n=t or c
tctgcaaaaaaatggagttacctgtggatgttttacagctttctaatttgaacaacagacngacaactatggtacctctgtgagcggaggaaggtcttctcttctttcagatcttgggaat

SEQ ID NO: 3969 - DNA, 121 bp, Artificial Sequence
  Synthesized
  misc_feature (61): n=a or g
acagcttttagggctgcagaagaaaaaaaaggcccaaaggtctggtcacagttaaagatancctttggatggggtgtaaaaaagtgggggaaatgcaaaggatcaataatattttccagat

SEQ ID NO: 3970 - DNA, 121 bp, Artificial Sequence
  Synthesized
  misc_feature (61): n=t or c
tggagagatacaggttctgctggacagagtggcagggagaatgaggaaggaaagaggatgncccttgagaaggggcagctgatatgtacagagctgctctgtgagaaaacaaaagtttttg

SEQ ID NO: 3971 - DNA, 121 bp, Artificial Sequence
  Synthesized
  misc_feature (61): n=a or g
ctatttttttctgcaaggcccttgaattcttaggtattgcaacagtaaaataattgggacntggtagaggccaacttgatgtctcaaatctattgaaaacacttaaaagaagaaaaaggga

SEQ ID NO: 3972 - DNA, 121 bp, Artificial Sequence
  Synthesized
  misc_feature (61): n=t or c
actgatgtcattttacaaatgcagtatggatgggaaggtcacagtaattacttcagctgcnttctggagattcagcccaccagaatgtcttctggctagtcaaacaagtgttggacatggg

SEQ ID NO: 3973 - DNA, 121 bp, Artificial Sequence
  Synthesized
  misc_feature (61): n=a or g
tagcatttacttcctgcttcccattacaatgagcacagctgactaactggttattaaagcnctgggaacatctcctcagaaacagtgatagtttagtttgtacaagtcaatcatattactc

SEQ ID NO: 3974 - DNA, 121 bp, Artificial Sequence
  Synthesized
  misc_feature (61): n=a or g
tatacctatcttccaacctcctttctcgcctgtatttactataaaaatccaccctatcttngttattataagctaaactaaagatttccaattaaatattgtgaatccagatagatctgaa

SEQ ID NO: 3975 - DNA, 121 bp, Artificial Sequence
  Synthesized
  misc_feature (61): n=c or g
gcctgctttccacacactgcatttggaggtgtagtacataaaacttcaccaggttaatctngaaactgctttcccagtaaagactacagggaaaaagaatcaggacctagggtttattact

SEQ ID NO: 3976 - DNA, 121 bp, Artificial Sequence
  Synthesized
  misc_feature (61): n=a or g
atgggtagctgactgctggagaaccagattacaggatccctgtctgcggggtggatggccntaatgtaactgcatctcccagtagttccagagtaaggtctaaatgaaacagtagcatttc

SEQ ID NO: 3977 - DNA, 121 bp, Artificial Sequence
  Synthesized
  misc_feature (61): n=a or g
aaacagaaccctactgtcttatctgcctgcagtaaaataagaagtggtcattgtaaaaacntagccctccaattgaaactttggaaggatacatgatgaacacaactatttatatggcaaa

SEQ ID NO: 3978 - DNA, 121 bp, Artificial Sequence
  Synthesized
  misc_feature (61): n=a or g
gttgctggccttctctcagaagaattccagcatccagaccaagatcttgtactgcctatcnaaggccactggagtttggctttgctgaaatggacactaagccactggtaaataccctgag

SEQ ID NO: 3979 - DNA, 121 bp, Artificial Sequence
  Synthesized
  misc_feature (61): n=t or g
aatgctgagcatgtgcatctcaaggtggtataaacatctcctgcacaatgcaagccacttncttgcatagcctaccatactttttttccacggttgccattttcttctgtttagaagcgct

SEQ ID NO: 3980 - DNA, 121 bp, Artificial Sequence
  Synthesized
  misc_feature (61): n=a or g
gcttctatagatacaaaataggacctgattcttctgggggctgatggaggggtccccaaanctgcaatcctttacagccatccaccctgctctccctgctggctgcggggtttggctggaa

SEQ ID NO: 3981 - DNA, 121 bp, Artificial Sequence
  Synthesized
  misc_feature (61): n=t or c
ggaggcagagcccatcctctcccacccactggggccactgacacaccgtcttatggaaggntgaaaatgcaagcctcgagtggatgtttggatgttactgacttagttcagatgtgtcagt

SEQ ID NO: 3982 - DNA, 121 bp, Artificial Sequence
  Synthesized
  misc_feature (61): n=a or g
tgaccagactactcccacttgtagagaacccaaaatacatgcatgtgtgagcaagctagcnagatgggagctgaaattccagctgtaggcagggtcacccagcaacatcctcatttatacc

SEQ ID NO: 3983 - DNA, 121 bp, Artificial Sequence
  Synthesized
  misc_feature (61): n=a or g
tacagcagagctgagcagcatccaacctgcttgggcaaggtctttccatccctatcctttnggctggttggttttatccattctggtcaattttccaaattgattgtattaaattgcctta

SEQ ID NO: 3984 - DNA, 121 bp, Artificial Sequence
  Synthesized
  misc_feature (61): n=a or g
ccttccataatctgcccatagcccatacatatgactgcttggcaatcagattatctgcagnctgtctgggtgagctcagtgcaataagataactgtttactgaactacagggcaggctcag

SEQ ID NO: 3985 - DNA, 121 bp, Artificial Sequence
  Synthesized
  misc_feature (61): n=t or c
aatagaacttcctttcccatttcttcctttaagttcacagaggttgcaaggtttctgatangaacaacagccctttgagtaaaacttggcaggtttcacaacactcatttctcttaggcca

SEQ ID NO: 3986 - DNA, 121 bp, Artificial Sequence
  Synthesized
  misc_feature (61): n=a or c
tggaaccttacaaagtatttcctgatttgtcatgagaattcacccctgatcccaactacangcaatagcgttggcaaagggattcacctgaactgctctctcagtaagaatttctgtccag

SEQ ID NO: 3987 - DNA, 121 bp, Artificial Sequence
  Synthesized
  misc_feature (61): n=a or g
tacggaataggctgcaaaggaggttgtgggatctccagctgcggaggtcttgaaggagacnctaattaaactttgtcaggagtggcaaaggggaacggatttagctgcattgtatgtcttg

SEQ ID NO: 3988 - DNA, 121 bp, Artificial Sequence
  Synthesized
  misc_feature (61): n=a or g
atctgaccttttcattttaaatgaaaaacacttaaaagcctgcactgctttgacatatgcntttttatgtctttcccacacagtgccaatgtttgttgtttgcaagccaaagtccccagct

SEQ ID NO: 3989 - DNA, 121 bp, Artificial Sequence
  Synthesized
  misc_feature (61): n=t or c
taatgctatgatcctaagtgcagctttaagaagttttagctaaatcagagcattaggcagngcaggtcctttcatttatgtatcaatagagctttggttggttcaaaaagtttccaaatga

SEQ ID NO: 3990 - DNA, 121 bp, Artificial Sequence
  Synthesized
  misc_feature (61): n=t or c
agcactgagatgtcatgaatgcctgtgtgctatactcaccttccccatggtaccgggtgtnctgggtgcctactgatggcaggagagcaccctcagccccactgagatgtggggcactgtg

SEQ ID NO: 3991 - DNA, 121 bp, Artificial Sequence
  Synthesized
  misc_feature (61): n=a or c
ggccagcccagtctggggcatgcctgattatcatctccctttcctggtacaactgcacagngtagagcagagcccatgtctgagaggctgcgagacggggctgtgccatgcagacacattg

SEQ ID NO: 3992 - DNA, 121 bp, Artificial Sequence
  Synthesized
  misc_feature (61): n=a or c
tctggttactattgcagcaaaactacaaaaattggtgaactggtgtagacaaacgcaaganttaatgctatgcactggctcagagctcatgaagagagcagtgcgtgaagcagcagtccat

SEQ ID NO: 3993 - DNA, 121 bp, Artificial Sequence
  Synthesized
  misc_feature (61): n=t or c
atgaagagtggaggtaggaggagaggagcattgtttttagtgagttcagtagcatgcggcntgtgctttctggagtagcagcacggttttctctaagccaacacccatttgaaatgggctt

SEQ ID NO: 3994 - DNA, 121 bp, Artificial Sequence
  Synthesized
  misc_feature (61): n=a or g
tctccagctttctgcaaacaagttttcaactgcagcagaaaacgtgttcaatatacagaangaaagctggatctgagaacaaacacagaccagggcacctgcactaacccaaactgcagta

SEQ ID NO: 3995 - DNA, 121 bp, Artificial Sequence
  Synthesized
  misc_feature (61): n=a or g
gattgggcgtttgtaatgacatatagagttcagtttttctcacactatatgactgcaatcnttgtgttggttggatgatggaggaatgatggaagcactgggaacgctattcttaagatgg

SEQ ID NO: 3996 - DNA, 121 bp, Artificial Sequence
  Synthesized
  misc_feature (61): n=a or c
tccagaaagggcagatctgaatggaaagctttccttctgctcctgcctagatattttcccncggaaaggtatgaaccactctgaggctaaatgtgaaatggtttgctgtagagataaaatt

SEQ ID NO: 3997 - DNA, 121 bp, Artificial Sequence
  Synthesized
  misc_feature (61): n=t or c
atatcttctactgaggtaccatggagcatttccagttcacaggcagagagcagtcagaagncacggagttaaatggctacagcttcatgagcaggactgaattctggaacatgaagtgcac

SEQ ID NO: 3998 - DNA, 121 bp, Artificial Sequence
  Synthesized
  misc_feature (61): n=a or t
cacagaaggacagcggcctcagagcttcgcagcacttctttgatgtgactcccagcaagcngcagtgccacaacccagccttttcagcactgtgaatgaagggtagggttgaggccactac

SEQ ID NO: 3999 - DNA, 121 bp, Artificial Sequence
  Synthesized
  misc_feature (61): n=t or c
atagcagcatctaataagaaacgagacaattcaggaaagataaaataattttcaaaagacngggctggaacctgaactattgtttcttggactataataaattacatcaccgtaagcacta

SEQ ID NO: 4000 - DNA, 121 bp, Artificial Sequence
  Synthesized
  misc_feature (61): n=t or c
ttttgatataataacaaacaaattgttcaaattccactctgcatttttccaactaaaccanggcaataccaattcttcagctaactttaaaaaaaaaattcagtttcttatatcaaaactg

SEQ ID NO: 4001 - DNA, 121 bp, Artificial Sequence
  Synthesized
  misc_feature (61): n=t or c
ttacagggtacctgtaccaagactgaaacctattcaatggcaaacaaaataatgtctttgngccctgaaaaataaagaagcaagtatatatccatctatctaagcagatggataatgtcaa

SEQ ID NO: 4002 - DNA, 121 bp, Artificial Sequence
  Synthesized
  misc_feature (61): n=t or c
attaagccaaagcacgccatatgtttcaagggcttttaacctcctttcttccttgcgcagncctgtgctcaacatcgtgctgctgccatcagatgtgcctgtggctgggtgggaagggaag

SEQ ID NO: 4003 - DNA, 121 bp, Artificial Sequence
  Synthesized
  misc_feature (61): n=a or g
ggacagcaggaatggaaatggacttcgaagctgcaattcacattgaagttgttcccaaacntattaataatgccccaaaatccagttcagaaaccactgactggctgatgtctctcgatgt

SEQ ID NO: 4004 - DNA, 121 bp, Artificial Sequence
  Synthesized
  misc_feature (61): n=a or g
gaccatgtttaacagaaccaaggggatccttggaaggagtgatcaaagctgagcaagctgncagctgcagacatgagtaacatgggcctgggtagttctggtagcgtcccactgcccatgt

SEQ ID NO: 4005 - DNA, 121 bp, Artificial Sequence
  Synthesized
  misc_feature (61): n=a or g
tgcacagacctgggttgccttgtcgctgcttcatccctgggcactctcgttaagcacgacnttgaaagtgggtgaaagctgtcgggttcaacaggttccttactgacaggagtgcttgggg

SEQ ID NO: 4006 - DNA, 121 bp, Artificial Sequence
  Synthesized
  misc_feature (61): n=t or c
gagaatccttgcttgctactgaaaattgctttatagtgttagaatctaaagctttggcccngcaaaataattgctgggcaccactgcagcagtcagccgtgggtcaacacacaggaaaagt

SEQ ID NO: 4007 - DNA, 121 bp, Artificial Sequence
  Synthesized
  misc_feature (61): n=t or c
agagaatttgttcaaaatatgcaatttcctttcatacccaacaatgcactgtgtgaagtgnggaggagtgaaagtctcacctgttcttctgtttctgaccaggaagaagaaaggatgatca

SEQ ID NO: 4008 - DNA, 121 bp, Artificial Sequence
  Synthesized
  misc_feature (61): n=a or g
ataaggctgtacgacggtaggaaatgggaatatttctagaagtagcccaaagatttggtancagagtaattttttaccacaatttgtcttagttactctgccttctgatagaaaaataatg

SEQ ID NO: 4009 - DNA, 121 bp, Artificial Sequence
  Synthesized
  misc_feature (61): n=a or g
cgccttcgtttgactttctagactgtacatcctttagttaagctcatatgtgtattgatcntattctagcgagaaaaacatcatgatgtgcaccaggaagtttaagagccattttccttct

SEQ ID NO: 4010 - DNA, 121 bp, Artificial Sequence
  Synthesized
  misc_feature (61): n=t or c
atattatatgctcatctggtaatattatagtaagcaatattgctgatatgtcatgatcttncagttgtaagctgtcacagatattgtttgtacttcttttatttactatttatttatttgt

SEQ ID NO: 4011 - DNA, 121 bp, Artificial Sequence
  Synthesized
  misc_feature (61): n=a or g
ggttctgataacatgcagtatgtactcacgggatggtgagttgcaatgatgcaaaagcctnaaatggaagaaatgagtataggggggaaaaaaagaaaaagttgtaataagatttccactt

SEQ ID NO: 4012 - DNA, 121 bp, Artificial Sequence
  Synthesized
  misc_feature (61): n=a or g
ttttaaatttaaggaaatattttaatgcacagaaagccacctcccaaccaacaggaaatcntgttgtactacttttaacctgaggctcataagaaccttttctctgtgatgagcaggaaag

SEQ ID NO: 4013 - DNA, 121 bp, Artificial Sequence
  Synthesized
  misc_feature (61): n=t or c
agaggtcctgttgcaaggtgagggaaaggaacagaagcccaggcttttggaggcagttacnccaaacccttttaaatgagctgacgtccccagactgagatatcttaagtactgacatcac

SEQ ID NO: 4014 - DNA, 121 bp, Artificial Sequence
  Synthesized
  misc_feature (61): n=t or g
actttatgacatttaatttgtagaagagcttttggaaatagccgtgaacacaataaaaatnactttagacttccatctgttgagtagcagccacaaaagaggtgtctttgtgttaaatctg

SEQ ID NO: 4015 - DNA, 121 bp, Artificial Sequence
  Synthesized
  misc_feature (61): n=a or g
tgtctgacacgtaaatgagctttccatttctaatctttaacgtgatgagatgctgttgatngcagtgcatgctgagccacctggaagcccgcctttgtctggtgggtttggggcaccaagg

SEQ ID NO: 4016 - DNA, 121 bp, Artificial Sequence
  Synthesized
  misc_feature (61): n=t or c
ccctgatggagggagagtgagtgagaaatgggctgcagaggtggtttccaaggcctgcacntggcaagtgaattccagagttcttcgggacgcatcatctgatgacacaaaatactgctct

SEQ ID NO: 4017 - DNA, 121 bp, Artificial Sequence
  Synthesized
  misc_feature (61): n=a or c
ttgcatcgttgtgtgctctgattattgggctgcagccaatcagtgcatggcccagaaatanttctcctaagccagcccagcttacaccaaaagttacttcataaatgcctgcatcgttatt

SEQ ID NO: 4018 - DNA, 121 bp, Artificial Sequence
  Synthesized
  misc_feature (61): n=t or c
gttgcagtttatgcccattcggctgttggattgcattggttatagggtcaggtctgtgtgngagctcacccttacacctaatggacagcacctctgcttgtagaagcaactcgaggctgta

SEQ ID NO: 4019 - DNA, 121 bp, Artificial Sequence
  Synthesized
  misc_feature (61): n=a or g
ctgtgtgcaggacgtggaaggagcagttgtttatggtgaacatgggcatgtctggtaagcntggtgtcactgggacggcacacctacgttatcacatctttagatattctttagctggact

SEQ ID NO: 4020 - DNA, 121 bp, Artificial Sequence
  Synthesized
  misc_feature (61): n=t or g
gaggagagagcttgtgattctattatgatgtgcattaaactccccagaatgtaaattcttntattttatttattgggaacttgtcatggtattactttgtcaaaaaaaaaaagtccgtcaa

SEQ ID NO: 4021 - DNA, 121 bp, Artificial Sequence
  Synthesized
  misc_feature (61): n=c or g
tctacccaaccacactgcccatagtgaagaaccaggtcctaacctgacgagacactgctgngttacaacacacaaccttccgacagctgcctgctgagcgcagcgctgccttgtgcaggac

SEQ ID NO: 4022 - DNA, 121 bp, Artificial Sequence
  Synthesized
  misc_feature (61): n=c or g
tggcactcagtggaagctactgagtcagcatgacccacaacatggttccaaacctgaaatncaccactgcagccagggctctcagacatgctgtagatacagggagactgtgagtcccaga

SEQ ID NO: 4023 - DNA, 121 bp, Artificial Sequence
  Synthesized
  misc_feature (61): n=a or g
tgccatcagcgcagggatggcaaaatgacagcctcaccccgaagaaataatccaacagccnctctttcacccctacatttaatgcctgaaccctctccccagcttctgtagccatgcactg

SEQ ID NO: 4024 - DNA, 121 bp, Artificial Sequence
  Synthesized
  misc_feature (61): n=t or c
tctcccttttgcccagcagtcactgagaaaacacacacaggttctttcctcctagaaacangagacagccacctcatcccctccacccatggaatctgaactcagtcacctgaaactcact

SEQ ID NO: 4025 - DNA, 121 bp, Artificial Sequence
  Synthesized
  misc_feature (61): n=t or c
caccacaatttcaagctgatctcccacacgatttacgttcccactgatttcctgataaatncccacagcgcaatgctgggtgttttcccagctctgatgagttcccttcactcagcatcac

SEQ ID NO: 4026 - DNA, 121 bp, Artificial Sequence
  Synthesized
  misc_feature (61): n=a or g
tccagctgctgcaacctcatacagccaaacaggacgtgtgcaaaactcagaggcagcatcncagtgctctcagcataaatccttttacacgttattatcaagggcttgcaaagagctgctt

SEQ ID NO: 4027 - DNA, 121 bp, Artificial Sequence
  Synthesized
  misc_feature (61): n=a or g
catatcactgactaatttaagctgtcttttggtaatggaggactactgctgcagagtaatngagttatggcaagatatttttggacatggaaaatgaaaacttgaaaaaaaatgcaacaat

SEQ ID NO: 4028 - DNA, 121 bp, Artificial Sequence
  Synthesized
  misc_feature (61): n=a or t
gccacaaagagggcatattatctgctgcagaggcagagaattaaggtgatgaaccaagcancactcctcccatgtcattcccaaggtggttacctgcacacactacaccagctgatgtcca

SEQ ID NO: 4029 - DNA, 121 bp, Artificial Sequence
  Synthesized
  misc_feature (61): n=a or g
acattatagttacatgcctgttcagtccttctgagaacaggcagagcattccctccagttntaggcagagaggtaaacatcatcaatcttttttgccatctaatcatctctactaacatgt

SEQ ID NO: 4030 - DNA, 121 bp, Artificial Sequence
  Synthesized
  misc_feature (61): n=t or g
gtgaaacactgcagataaattcattacaaattcacagagatccagaacaatgcaaaagtgntcaaaaccagatgcccaggaagagagcaaaatagcagtatcaatcattttacaatcatag

SEQ ID NO: 4031 - DNA, 121 bp, Artificial Sequence
  Synthesized
  misc_feature (61): n=a or c
atctcacttgggagtctcctgatactcgttgtgataagaaccatccagtacaacatgacanggacacgggtaagagttactttgagtgcttctgtacacggtgaaggtttctaagttcagc

SEQ ID NO: 4032 - DNA, 121 bp, Artificial Sequence
  Synthesized
  misc_feature (61): n=a or g
taacatgatgataactgaagtgccgtacctgacccaagctggagagaagaagagatcatangactcctgtgtcctgaaaaaaagttattaaaacttgttcctgtgtaagagagagggagaa

SEQ ID NO: 4033 - DNA, 121 bp, Artificial Sequence
  Synthesized
  misc_feature (61): n=a or g
ccactgtggatgatgtgaatgtaaattctcctaattagtaaagagagggtactaaactacncactgtacttgattagcaaggcttagctttttgcagtttgagtcagggcgttataatgtt

SEQ ID NO: 4034 - DNA, 121 bp, Artificial Sequence
  Synthesized
  misc_feature (61): n=a or g
tgttttgttaacaggctaaaaaaatgtctactatgcaaaatggcaaagccatcaatgcccncactgttaagggtacgattgttcagggcagggaaaatcagcaccatgcgctgcgagggct

SEQ ID NO: 4035 - DNA, 121 bp, Artificial Sequence
  Synthesized
  misc_feature (61): n=t or g
cttttgctgtaagagtgaaccatctgagagacctgatctgttcccacatgaatctggttcncaaaggacgggcataacaaaatcagaaatttcaaaccaaacagtactggagttagcaagc

SEQ ID NO: 4036 - DNA, 121 bp, Artificial Sequence
  Synthesized
  misc_feature (61): n=t or g
tgcctctccctgctccttttggggtatacttctgcatctacaaaacaacccaaaggccatnagaactttccttccttccatacaccacttggttttcattaatgttttgtctccccttatc

SEQ ID NO: 4037 - DNA, 121 bp, Artificial Sequence
  Synthesized
  misc_feature (61): n=a or g
gttttatgttctcatttggtgatgctgatctccattttgagcagagtggaaaaagcacttngtgaatggaggggaaattataaaagcctcagcagaatttacctcatgggaacagtgaagt

SEQ ID NO: 4038 - DNA, 121 bp, Artificial Sequence
  Synthesized
  misc_feature (61): n=a or g
cactactctcccggtcttcttgcctcacccttgcaaggaaaagctcccattcctcacaacnccacctgggaactgcagagcttttgcctgaaggttaccagctgtgatggctggggtgggt

SEQ ID NO: 4039 - DNA, 121 bp, Artificial Sequence
  Synthesized
  misc_feature (61): n=a or g
atatggaggccacagctagatgggaagaaagaggaggctgagtggagagtagaggaaaagntaggcacttcagtttgacgagaaagatctgaagtttttcttatgtcgctaccgttctgtc

SEQ ID NO: 4040 - DNA, 121 bp, Artificial Sequence
  Synthesized
  misc_feature (61): n=t or c
ctgcattacaaggtagtagaaaaactggaagagaagcatagggatgctagaataataaganactttgagtattacacagcagtactgcctagacacagacatcataactaaaaagattgca

SEQ ID NO: 4041 - DNA, 121 bp, Artificial Sequence
  Synthesized
  misc_feature (61): n=a or g
gaccattcaacaatgtttcaactgctttaattcagtaaccctgtatgctctcaaatcaagnaggagttattagagaaacccaacatcatttcagttttataatcactgaagggaaaaaaac

SEQ ID NO: 4042 - DNA, 121 bp, Artificial Sequence
  Synthesized
  misc_feature (61): n=a or g
gagatatagaagggaagagcgaatccaagcaaggaccccaaaccgaaacaaaaatctggcngtcacgaagaaggaagtggagaatgcgtcaaatataacagaaaattattttgtacattca

SEQ ID NO: 4043 - DNA, 121 bp, Artificial Sequence
  Synthesized
  misc_feature (61): n=t or c
tgtcagtcataaaatacatgagcatacatgcaagcaggcatatttaagaggcagaaatganggcagaatatggagaaattgtgaggagagttaattgtctttgtttacttcacaggtacca

SEQ ID NO: 4044 - DNA, 121 bp, Artificial Sequence
  Synthesized
  misc_feature (61): n=t or c
cagtgtgttacatagatggctgtaatttttattatcccatgttgattcagtagtttagctngtgtctaagacatctcagtttcaggtacgttactgtaagtaaatacatgtgtgccactga

SEQ ID NO: 4045 - DNA, 121 bp, Artificial Sequence
  Synthesized
  misc_feature (61): n=a or g
tctttgcaacttctgcttctccatgcattcctcagtttcttccttatttctcatgaaatcncatcttttctctcttccccaggccttatcccacatccatcatcaagcttacacaagaatt

SEQ ID NO: 4046 - DNA, 121 bp, Artificial Sequence
  Synthesized
  misc_feature (61): n=a or g
taacctcctgagccaaacagtgtgcttcagtggctttaatcaaagcatggcttcatatttncttctgtaactccgtgataaattattaataacttattggcttcactgaggctataacaca

SEQ ID NO: 4047 - DNA, 121 bp, Artificial Sequence
  Synthesized
  misc_feature (61): n=t or c
attggattggagggcccttattttggtatttgatgctgtgagcttttgtcatcatcagtantgatgtgagtggactcttggtctgattctcctctctccttggagatgggatgtgtgctgt

SEQ ID NO: 4048 - DNA, 121 bp, Artificial Sequence
  Synthesized
  misc_feature (61): n=a or g
gggttctggggggcttgcttagcaattgacccttttttgaaatgctaagactcacactcantgatattgctaggcaactgaacagacatttcctttcaggctgtacgtggataccaggatt

SEQ ID NO: 4049 - DNA, 121 bp, Artificial Sequence
  Synthesized
  misc_feature (61): n=t or c
tcgcttcctcccctccaaagagaaaagagggtgctggggattttccattaatcatttttangctgagagctgtagctcccgtctgcattctgatcacttctgatctctgccaccatttttc

SEQ ID NO: 4050 - DNA, 121 bp, Artificial Sequence
  Synthesized
  misc_feature (61): n=a or g
gttcacctttatattctccacatctattttaggctagaagggctaagtgaatttccataanatgaggattaggaagaagatgggaaatgtttctccttaagagcagattgtatctttcaca

SEQ ID NO: 4051 - DNA, 121 bp, Artificial Sequence
  Synthesized
  misc_feature (61): n=a or g
agggatataggagaataattgttctctagtacgctgtagcagtgagaaaaccactatctcntttcaagaaatcaagaaattcaagaaattcaagaaataagaaatgttttcttcttcacgt

SEQ ID NO: 4052 - DNA, 121 bp, Artificial Sequence
  Synthesized
  misc_feature (61): n=a or g
aaccagtgactggctataggtgctattcatacaagcaaaagcggactccacagtttgacantgtttctgcattttccaaatgcccactctcccttcacctgcaattaactagtagtgtcag

SEQ ID NO: 4053 - DNA, 121 bp, Artificial Sequence
  Synthesized
  misc_feature (61): n=t or c
ctcctcccattgttttttttttttcttctgtcttcaaacaacatcactggtgctttatgcnaagctgtctgtctcatgtgagagcaccttctctgcatttaaactacatccttcttacagg

SEQ ID NO: 4054 - DNA, 121 bp, Artificial Sequence
  Synthesized
  misc_feature (61): n=a or g
ccgcatccatagcatcgcattcaccacaggaccagaacagaagcagatgcaaaaacacccnaagtccgagctagcaggagggtggtgcagaatgagtaaatgaatcccaaaggcattcagt

SEQ ID NO: 4055 - DNA, 121 bp, Artificial Sequence
  Synthesized
  misc_feature (61): n=t or c
caaatccacaggaaaggggatcctaaaggtgggtaccctattccagtgctcaactacacantctccaatgtaaaaattgaaacagaatcaacgctgcttcaaaattaatacctcttgcctt

SEQ ID NO: 4056 - DNA, 121 bp, Artificial Sequence
  Synthesized
  misc_feature (61): n=a or g
ggtggtggtgctggtgctggtggtgtttttttttttccctgggaatagcgacaatgtcctnttctacagaaggtgttaacaggcttaggatagagtgtgtgattaaggaagtgggtttaat

SEQ ID NO: 4057 - DNA, 121 bp, Artificial Sequence
  Synthesized
  misc_feature (61): n=a or g
tttagaaaacctgaggataagtcactttggtttcttgtccctataattttttcaggacacncactgctggactgtggttgtgctaccatgggatgctccctcagcaccccggactgagcat

SEQ ID NO: 4058 - DNA, 121 bp, Artificial Sequence
  Synthesized
  misc_feature (61): n=t or c
aatctttttttctccactaatagtataggaaagtaaactttaggtgagtgttacttctacncgctagtcacatacaatcttaattgaatcacaaagttcaaaaatcactgactctgcaaag

SEQ ID NO: 4059 - DNA, 121 bp, Artificial Sequence
  Synthesized
  misc_feature (61): n=t or c
aaagtgctatgtggcatcttttcatgaatcacctgtaagctcttccgttattctgacctanacgtcttcatcagctcttaaatgcggacggatagcacaactttcttcctggtctcctgga

SEQ ID NO: 4060 - DNA, 121 bp, Artificial Sequence
  Synthesized
  misc_feature (61): n=a or g
tttccacaacagatatgaaacaaagagaactaagaaatgtgttggcattcagaagagcagnaaagtaacactgttcctgtcactgttagaagattaaaatcctgcctggcagcctataaac

SEQ ID NO: 4061 - DNA, 121 bp, Artificial Sequence
  Synthesized
  misc_feature (61): n=c or g
tgtatccgaggttggtctgatttagtgctcagtggagttacagagttatgcctggtctcanctatcttttgagtgccaagaaactatgttattcttaacaacgtatgcttctaatccaact

SEQ ID NO: 4062 - DNA, 121 bp, Artificial Sequence
  Synthesized
  misc_feature (61): n=a or g
tacatacaaataagtacaataaaggcttgatatctgaacctacaggctgccacaactgtcnattctgtgcaggtgaacactaaaatgtcacagctttttgcacgctagttcccaaaatggg

SEQ ID NO: 4063 - DNA, 121 bp, Artificial Sequence
  Synthesized
  misc_feature (61): n=a or g
gttcttggatccagcttttgcatcaagtaaattacagaggtagttgtctgctgctgtcatncccatgataatcctgaggtgctgacactgacacatgcacccatgcaaagagacaaagtgt

SEQ ID NO: 4064 - DNA, 121 bp, Artificial Sequence
  Synthesized
  misc_feature (61): n=a or g
gaaaagtatttcttgccttccagtgtatataaagaggcatcttcactcagttcaatagagntttgtccttgtagagacctagaaaattattaatttgcctacacgtagacatctatcatca

SEQ ID NO: 4065 - DNA, 121 bp, Artificial Sequence
  Synthesized
  misc_feature (61): n=a or g
ttacaaagaggctgtttcagagatcatcagctctctattagctcgcctgcaatgtgctccnctagcagcagagtttagtcttctccaaattactgtagaggatttgactgtatcttgctga

SEQ ID NO: 4066 - DNA, 121 bp, Artificial Sequence
  Synthesized
  misc_feature (61): n=t or c
ccaccccactagtttcctaccccatgggcaacacctatcctatgggcatcacatacccctngggcatcacccaccccatggataacacccacccccacggggagcacttatcctataggca

SEQ ID NO: 4067 - DNA, 121 bp, Artificial Sequence
  Synthesized
  misc_feature (61): n=a or g
caaggcaggtcatgtgcctctaatatttatatgcacttccactcactagaaggtctagccnaagtctgggtgcttctccctgacctctctgtgtaattcccacgtcgtccacctccaggag

SEQ ID NO: 4068 - DNA, 121 bp, Artificial Sequence
  Synthesized
  misc_feature (61): n=a or t
ttttgccaccctcccaccactccacaaggactcctggaaatagcacaaacttctaagttcngtgcaaattcctgccttcaaacttagtattggtttcgctaaaaagcgtcggtgattactt

SEQ ID NO: 4069 - DNA, 121 bp, Artificial Sequence
  Synthesized
  misc_feature (61): n=t or c
cttttaagaactgtagattttggaccttcttgaaatgagcatgtattgcagctgaagaaantctgctctgaagtagagctcagaagttttaacacttcactgaaacaaagactgaacagta

SEQ ID NO: 4070 - DNA, 121 bp, Artificial Sequence
  Synthesized
  misc_feature (61): n=a or g
agcccattgaactctactgctgttctatctggctccagaaaagactgcagatatgcgtgtntggctaataggattgcagccatgctaatcctcttgaactcacgctgccatctctaacaca

SEQ ID NO: 4071 - DNA, 121 bp, Artificial Sequence
  Synthesized
  misc_feature (61): n=t or c
ccccaaaaatccctgctgagcagggatgggtggtacagcgggccaagcactggggttccangcatctctgcacacaggtctaggctcagaagcgacagaggttcaaatcccactacaggga

SEQ ID NO: 4072 - DNA, 121 bp, Artificial Sequence
  Synthesized
  misc_feature (61): n=t or c
tatgcttcagttcccatttcaggattttttgaatcagatacttgatccacctgttctgggnttggcataggatctggaacaggagggatatacaaggacaggttttcaatttacttgatct

SEQ ID NO: 4073 - DNA, 121 bp, Artificial Sequence
  Synthesized
  misc_feature (61): n=a or g
ttagacttgccactggatttccagcatggtagagattgatgaatatatttgatttagaagnattcacagaagcatcaatgttttccattttcttcccttctgcattcagcacgaggcaagt

SEQ ID NO: 4074 - DNA, 121 bp, Artificial Sequence
  Synthesized
  misc_feature (61): n=a or g
cccgggaactgaagacacagtgagttatcttgccaaaggaactctagctgtaatgcccccnttgcccaagcagtgcattgctcagctgcagagcagtgtgtgatggcacagcagctggcac

SEQ ID NO: 4075 - DNA, 121 bp, Artificial Sequence
  Synthesized
  misc_feature (61): n=t or c
gatagattaatctatactttttaaaacttcttactgcaaatttagagattttaagattggntaactatcacaaaatgttttctaacctactagaacatgtcagtctaactattatcctgtc

SEQ ID NO: 4076 - DNA, 121 bp, Artificial Sequence
  Synthesized
  misc_feature (61): n=a or c
tcgaggtgccgatcgccccttattagaagttctgctttagagctcagatatcccactttancaaatgaaactttgcagggaggataaaaatccagcttgggaacggccaaacaacccctaa

SEQ ID NO: 4077 - DNA, 121 bp, Artificial Sequence
  Synthesized
  misc_feature (61): n=a or g
aaatcactacacatgtctgtgcgtgctcactcatgaccaggtgtgacagcctcagcctccngcctgtaagccagccaggcagcagcagcgtgctgtgcccagcgctgcagcaattcccagt

SEQ ID NO: 4078 - DNA, 121 bp, Artificial Sequence
  Synthesized
  misc_feature (61): n=t or c
gggcttggagcagacccaggagacgtggctctgggtgtgctcgtggtagcacgtcttggangggtcgtatgtgcacagagtggtcttcttggcacggtccactttctcgtactccacgcgg

SEQ ID NO: 4079 - DNA, 121 bp, Artificial Sequence
  Synthesized
  misc_feature (61): n=a or g
cctcctgttttaagacaaaatgaaccagcttgaggtgagtgagctttacagtgagctttgnccttcctcccagcttcctaaagtttcttgtagtgactaggacttctctttatttgtatat

SEQ ID NO: 4080 - DNA, 121 bp, Artificial Sequence
  Synthesized
  misc_feature (61): n=a or g
agctgcatttagcaccaaaaaatgtggaaggaaaaaggcaacactgggcattaatctgatngggaagctcaagaaggggcagagcttttagtgagggcaattaaaaatccgtatatcacag

SEQ ID NO: 4081 - DNA, 121 bp, Artificial Sequence
  Synthesized
  misc_feature (61): n=t or c
ttatttccaaaagtgatgcacagatctctgaatgtcttgtgccagatatgtggacacccanagatcaggtgatgcatttatgtatccccattccaaataccttgctcagcccatcttaacg

SEQ ID NO: 4082 - DNA, 121 bp, Artificial Sequence
  Synthesized
  misc_feature (61): n=a or g
tttaggctttctttcctaaccctcctggtcacatgctccaaaagcatgtttgatggaattnttgagcttgaatctcatgccaaaattggagcaacggtatccagatttgaaagaggtgttt

SEQ ID NO: 4083 - DNA, 121 bp, Artificial Sequence
  Synthesized
  misc_feature (61): n=c or g
ggcagcagactcaagacaaggccatgctgcatggggagagctaaagacaacctggacctgntttcagtccctgagaaacctcagcatagtgcagtaactccggccaggggcaccactgcag

SEQ ID NO: 4084 - DNA, 121 bp, Artificial Sequence
  Synthesized
  misc_feature (61): n=a or g
ctgagtgcttagccttccatccacttgtcttccaaaacactaaattttctagccatcaccntcatttttaatgtagacagtgggaggtttgctggggtagcttctgtgaggagaggctgta

SEQ ID NO: 4085 - DNA, 121 bp, Artificial Sequence
  Synthesized
  misc_feature (61): n=t or c
ttcatagaaaagcatcccagctagtaagcaaagcttgttggtgaaattatactcaaatagnccattctgccaaaatcaaaattctttatgaagtcatatatataactagaaaatcagataa

SEQ ID NO: 4086 - DNA, 121 bp, Artificial Sequence
  Synthesized
  misc_feature (61): n=t or c
ctttaagcaccaaaagacaaaacaaacttcattcctttagaggtcgctttgcttttgaggngtgttgagccgcacaagtatttatttgtatttatctcttttaataatgctgtgcaatgat

SEQ ID NO: 4087 - DNA, 121 bp, Artificial Sequence
  Synthesized
  misc_feature (61): n=a or g
ttctgccctcggaagaaacgggagccgtcgcataaaagggggagaattcacagctcgttgnctgtctgcgcgtgaggctgaattacgaacggataatttattcgtcattagcaaatccccc

SEQ ID NO: 4088 - DNA, 121 bp, Artificial Sequence
  Synthesized
  misc_feature (61): n=t or c
gcctttcacctccaggaacccaggcagcagcagcgcaggtgttgcagtcaggccttgctanagcacaaccaaagcaccataatcagtattattgtatctcacagagaagaagagattatat

SEQ ID NO: 4089 - DNA, 121 bp, Artificial Sequence
  Synthesized
  misc_feature (61): n=c or g
gaaacccctcctcatctttgtaaacagctatgtgaattggttgaggttgctgagagaaacnaagggttggcattaaattaaatattgatcccaaagtagtatgctgtgcttctctgtttta

SEQ ID NO: 4090 - DNA, 121 bp, Artificial Sequence
  Synthesized
  misc_feature (61): n=a or c
gcagctgagtgctgtgagctgttgtttcacgtgcaaagtcctgctgcaattctggaagctncattcccatcactgttcctacacaaaaggagggttgcggctccctgctcatgcatggggt

SEQ ID NO: 4091 - DNA, 121 bp, Artificial Sequence
  Synthesized
  misc_feature (61): n=c or g
cgcagtaactgcattgtttactgaaatactcaatcctcctggaagagacctttcctcctcntcgtggcagtgaccagctgtttgaggagtgtccctggtgtagcctttccccaagaagcag

SEQ ID NO: 4092 - DNA, 121 bp, Artificial Sequence
  Synthesized
  misc_feature (61): n=a or g
tcttctcatagaggtgctgattgtggttgtgttttgtactgattgtagtgctgcttgcacntggtagctctgctagagcaaatgtatcctttcctgttccaagagacgtaggtgctgctgg

SEQ ID NO: 4093 - DNA, 121 bp, Artificial Sequence
  Synthesized
  misc_feature (61): n=a or g
tagctcctttgctgcacagttcctctgaagatcagggtggtgtattttctccaaagagttngtgtccctcacccccagctccagataatggcatctcactgtgtgggcttgaatcacagtg

SEQ ID NO: 4094 - DNA, 121 bp, Artificial Sequence
  Synthesized
  misc_feature (61): n=t or c
tcacagaacagctgttggagttcagtgctgatgtaattctgtgctatctggtaacatctcnggggagtggttactgttggcaggtttctgggatgagctttctctcacaaagtagtgcgtg

SEQ ID NO: 4095 - DNA, 121 bp, Artificial Sequence
  Synthesized
  misc_feature (61): n=a or g
gcttttggcagcagcatcgtgtctagtgtcaaaagaccacagccttgccctgcaagccagnctgcaggcagaggtggaaggagcagaaacaccagcaaagcccgtccagccctgatcagtg

SEQ ID NO: 4096 - DNA, 121 bp, Artificial Sequence
  Synthesized
  misc_feature (61): n=t or c
catgtgcttttctggtacagagctgtggttacacggtaatttaccagcagaccaaatacgngcatgcttaatttgtaccaaacgactacaagaaccagttcagtgatgaatgctaggaaaa

SEQ ID NO: 4097 - DNA, 121 bp, Artificial Sequence
  Synthesized
  misc_feature (61): n=t or c
cttgctggatgctttcttccggcgcagcttacgcaagcagcccagcaatccatagtccagngcagtctgcagcaaagacagaagtaaaacaggttttggggggtttcttggacagatccat

SEQ ID NO: 4098 - DNA, 121 bp, Artificial Sequence
  Synthesized
  misc_feature (61): n=t or c
ctcaaaaaaggaagaatagtcatacactgtgggactagagacactcccctcagtcctatcncattttttaaaagagaaggtgacccttaggtgaccttcctacaccccaacctgaatgatg

SEQ ID NO: 4099 - DNA, 121 bp, Artificial Sequence
  Synthesized
  misc_feature (61): n=t or c
agttcttgcttgctctcagcctccctcctgctctgccaggtatctgccgtgccattttgtncctgctgttttcatatgtaatgggtgaatggacttccaattactctggagacattttaac

SEQ ID NO: 4100 - DNA, 121 bp, Artificial Sequence
  Synthesized
  misc_feature (61): n=a or g
ccccttatccttagatactctctgaagaggtacaaattcccctttctccagagagttttgnctactcattgtgaagtggtgagtgagcagccttcattctcatagtttggacacagtttcc

SEQ ID NO: 4101 - DNA, 121 bp, Artificial Sequence
  Synthesized
  misc_feature (61): n=a or g
agttcatgctaggataacacctacaaaaacctggagtcagcaggtttgaatctgatttcanatgaaagtaaaactaaaaaagtgtgtcagtgcaactgaacgtgagcaatgaatgcatgaa

SEQ ID NO: 4102 - DNA, 121 bp, Artificial Sequence
  Synthesized
  misc_feature (61): n=t or c
gctgctcacctccatgagctcatcgatgaattggttccgtgtcgcagcattctccagcagngtcagagcatcggagccacgggcaactgcctcgggttctgggggatgagtggggtcagca

SEQ ID NO: 4103 - DNA, 121 bp, Artificial Sequence
  Synthesized
  misc_feature (61): n=a or c
ttgtttatcagatagctgaagaggggaaatatgacttatctctaacttatggttttgaatncgattaatgaacatgctgataagtgaaattaagcatgttacatgtagctcattcttcttt

SEQ ID NO: 4104 - DNA, 121 bp, Artificial Sequence
  Synthesized
  misc_feature (61): n=t or c
tgctcagagcacgcaaagactgagcaacgcgctgcagagcagcgacaaatcaccacccagngcccaacataaggtggccgttaatgcacattttgtccttcatcgttgccatcatctcagg

SEQ ID NO: 4105 - DNA, 121 bp, Artificial Sequence
  Synthesized
  misc_feature (61): n=a or g
ggctctgatgaaataactctagtttattccagacaatcagaattggaacctaatttttgtntatattcctaattcttacccttacccagaatgttgctgtgctctcccagtcccaactctt

SEQ ID NO: 4106 - DNA, 121 bp, Artificial Sequence
  Synthesized
  misc_feature (61): n=a or g
tcaagttactaaagcatgtgcaagagcaatgaagaaagagcaatgaaggcagtgaatggcntagaaagaaagacatatgaagaggagctgaaggaactggggttgattagtcaggaaaaaa

SEQ ID NO: 4107 - DNA, 121 bp, Artificial Sequence
  Synthesized
  misc_feature (61): n=a or g
ataggaaaaaaataacaaggctcagtgagtttcttcattcaaattcagcaaatagtagacntgttgaagaagcagtttccttccgaattcttctgaagcagaggttagtggcaccaaagaa

SEQ ID NO: 4108 - DNA, 121 bp, Artificial Sequence
  Synthesized
  misc_feature (61): n=t or c
ctcccataattgctgcaatgcttgagtggcttttgaggtcaggtggtggtgcttcagaatngggtttccacatgttaaaaaataataagaaatgtagaagtcagagacaggaatctatgaa

SEQ ID NO: 4109 - DNA, 121 bp, Artificial Sequence
  Synthesized
  misc_feature (61): n=t or c
ctcgtgcttgcattgcctttccctacatcaaacttctctactaaagtctgcagctgaatgntggagatcctttgtagcagctgccacctgttctcctcagagaacacagatgcagaaggat

SEQ ID NO: 4110 - DNA, 121 bp, Artificial Sequence
  Synthesized
  misc_feature (61): n=c or g
aaaaagcgaagtttctgtactggataaaaagaagtggggttagttgaagggagttctagtntagaggaacaaaacatgaggcaaaggaatcatgaatggagtgagtatcagcatgaagtac

SEQ ID NO: 4111 - DNA, 121 bp, Artificial Sequence
  Synthesized
  misc_feature (61): n=t or c
ctgaacaatgtggcctacactagtggttgctgtataccttaagtagttctgagcaacaaantacaaactaaatgacaacacgccgggcgatcaagaagaaaaatgggaacagagaagaagg

SEQ ID NO: 4112 - DNA, 121 bp, Artificial Sequence
  Synthesized
  misc_feature (61): n=a or g
tgacaccactgatgaaaaaaacagcacaagaaaacaaacaaacaaacaaaaagacctcacnaggcagcatgcagtttgatcacctcgacctcaatgtctagatttcaagtcttctcaagaa

SEQ ID NO: 4113 - DNA, 121 bp, Artificial Sequence
  Synthesized
  misc_feature (61): n=a or c
catctatgcagtgtttctctcattcctattaaataatctcttctaatcccactggaatccntctacccacctcaacagatagtgaaagctgttcatcaaccctaagcctgtctggcagatg

SEQ ID NO: 4114 - DNA, 121 bp, Artificial Sequence
  Synthesized
  misc_feature (61): n=t or c
ttttggtgttttaatgaactacagaagataatctgagagtctccactggatttcaaacggncagctatctatagtatatctttacagaaaacattattaaacctgtttgacactggtaacg

SEQ ID NO: 4115 - DNA, 121 bp, Artificial Sequence
  Synthesized
  misc_feature (61): n=a or g
ggaaacagatggtttgcagagaggagctgtcaccatctgggcttagagaggagacctgaantactcctttgcaagatgagcaccctgggtctgacatttgttcatgccaatttcccttcct

SEQ ID NO: 4116 - DNA, 121 bp, Artificial Sequence
  Synthesized
  misc_feature (61): n=c or g
cctcagcaaaatacctttggagctatgcagcttagatctgaaactctgagctaactcattntgctcctgtgaagaccttccatcttctcatctccacgtaggtaacagccaagtaggctgt

SEQ ID NO: 4117 - DNA, 121 bp, Artificial Sequence
  Synthesized
  misc_feature (61): n=t or c
ttagctgatcactgcttgtttttcatgcaatatgttaaatcttccaggtgaattttgttanctggataatgttatgacagctcttcatggaacaaaccaggacggacgaaataaacaatat

SEQ ID NO: 4118 - DNA, 121 bp, Artificial Sequence
  Synthesized
  misc_feature (61): n=a or g
ctcctggtgtgtaggaaagctaaaatgagggaacaaagaaaatacaaaatccttttccctntatatcagatcacgtgctcactctccctaaacatgcagggtccatgggcatggccagtgg

SEQ ID NO: 4119 - DNA, 121 bp, Artificial Sequence
  Synthesized
  misc_feature (61): n=a or c
ttagaaaaataaaaaggggagcctgaaatgcacacaacgaatccggtcagattccccattnattccctctacctacggcacccaacgctgagtgccgcgccggccgccagcagcgctccgc

SEQ ID NO: 4120 - DNA, 121 bp, Artificial Sequence
  Synthesized
  misc_feature (61): n=t or c
cggctgaagtcacattctgtagaaagtcccttttactcaactgctccatctcagtgactcntaagtcattaaaacagagtagggtatggaattacaggcattcttacgtccaaatctaaaa

SEQ ID NO: 4121 - DNA, 121 bp, Artificial Sequence
  Synthesized
  misc_feature (61): n=t or c
gagaagatatgaaaatgatgttgagggcaccaaatggagatttacatctaagattttcccnccttccctgtctcctccaaagcttaaggaaataaatatctgaataattttctttcaaata

SEQ ID NO: 4122 - DNA, 121 bp, Artificial Sequence
  Synthesized
  misc_feature (61): n=t or c
cttaaattgtacctaggagcaaaattaagcatgggttaaccaagtagtcacatatcatcantgaaagctattggaaaggcagaaagatacaggcccgaagggacttcgccattgtctgaca

SEQ ID NO: 4123 - DNA, 121 bp, Artificial Sequence
  Synthesized
  misc_feature (61): n=a or g
agctgggacaggcaataaataaataaataaataaataagagaaacttagaaatgtcgcctnacattataaggatggtgatagggaaggcaaaacacacctagaactgagactgcaaggggt

SEQ ID NO: 4124 - DNA, 121 bp, Artificial Sequence
  Synthesized
  misc_feature (61): n=t or c
aaatttgatcacgtctcttcaccaaactttcctgttttctcttaacagagagaaatacccntctctttacaaagacttaattcatgctgttgctttttggcagtttgtacatttgtgaaca

SEQ ID NO: 4125 - DNA, 121 bp, Artificial Sequence
  Synthesized
  misc_feature (61): n=t or c
aacaagtaacactgtaacgaaaaaaccttgaagtcttgcaaaataatgcacatttcatatngcgcttttaactgctactttctattaagggctttgccatatgatcagtgactttcctgtc

SEQ ID NO: 4126 - DNA, 121 bp, Artificial Sequence
  Synthesized
  misc_feature (61): n=t or c
atcactgctccataaagccctgtgcttcccatgaacctggatctgactgtgatagctgatnttagtcacaagcacccaaaaccttgccagcccaaggttactcccaaacatgtccaaggtc

SEQ ID NO: 4127 - DNA, 121 bp, Artificial Sequence
  Synthesized
  misc_feature (61): n=a or g
gcgtggataataaataagccgaggcaccacgcagcaacacaatctcatgtgctttttctanggctaagcttacagcagtttacttgtaactgcaggtctgtgccacgacctttgcactaac

SEQ ID NO: 4128 - DNA, 121 bp, Artificial Sequence
  Synthesized
  misc_feature (61): n=t or c
ttcacgttaaaacatcattcactagcctggttttgataaccataatccaaactactcattntgtactgcattctcattgctagggcttctatgtgtgaagttacttgtagttgactgtggg

SEQ ID NO: 4129 - DNA, 121 bp, Artificial Sequence
  Synthesized
  misc_feature (61): n=a or t
tcatcactgcaggtctgtgtgccagtaaaacctcttttctttcttacaacgttagataagnattggggaatcaacagtaagaagtccttccttcctgtaataactgtagtttagaaggaga

SEQ ID NO: 4130 - DNA, 121 bp, Artificial Sequence
  Synthesized
  misc_feature (61): n=t or c
tgatttatgataaatttctggatggcggcatttttagacagtcgtacaaaggctgagaagnacatcaatgcgttatagtcggtatgtactctgtcatcatgaagaatgaagatgacaaatt

SEQ ID NO: 4131 - DNA, 121 bp, Artificial Sequence
  Synthesized
  misc_feature (61): n=t or g
gtaccctgcctacattaactgtgaaagctatggtgccatatggcaaagacacctggcaaantcttatgtaactcaggagatttctggattttatgggtgacaatttcatgaaacacataat

SEQ ID NO: 4132 - DNA, 121 bp, Artificial Sequence
  Synthesized
  misc_feature (61): n=t or c
catgggagtaactactgccagagatccccagaacagcttctgtcatattttttttatgagnatatgtataagagacagagctataatgattgggagaactgcttattaagctaatgcattc

SEQ ID NO: 4133 - DNA, 121 bp, Artificial Sequence
  Synthesized
  misc_feature (61): n=a or g
gaaactggaactgcagttttgtgtgaaagatgtggtttgtctcaataaaactgataaatcnggagtaagctcacaaatttatctgcagctgaagacagacctccagagaagaaaagatctc

SEQ ID NO: 4134 - DNA, 121 bp, Artificial Sequence
  Synthesized
  misc_feature (61): n=t or c
acggtgacccaactgggaccggtacctgagcagcactggtaacaaagaagtgcagaaattncatctagaaatgcagaaatctggcctagaaatgcagaaatttggactagaaacgactaag

SEQ ID NO: 4135 - DNA, 121 bp, Artificial Sequence
  Synthesized
  misc_feature (61): n=a or g
caccaccaccgaaaaaaaacaaccacaaaagatgataggtgtgctgggtcggagagaagcnctcgttgctgcatgtatctagagcatggggcagaaaaatggagtaacagcctcaaatacc

SEQ ID NO: 4136 - DNA, 121 bp, Artificial Sequence
  Synthesized
  misc_feature (61): n=a or g
ggcttttggaataagtaagctttgtactgttgcgttatctgggaataaaattgcacgtagngttgaccgcggctgttattcctgacggtcattgcagagcagcaggttgcatgaacttttc

SEQ ID NO: 4137 - DNA, 121 bp, Artificial Sequence
  Synthesized
  misc_feature (61): n=a or g
tgtcagcactcagtagtgccaaagccctttccacacattacatcagtcagcggttatcccncacagaattcacgcaatgtgatgcatagcaggtgtgcactctggggcacacaggtggaag

SEQ ID NO: 4138 - DNA, 121 bp, Artificial Sequence
  Synthesized
  misc_feature (61): n=t or c
agcccattgaagcctgggaagggagagagttgggtgtgatgaggagcaatgctgcaccctnatgcaccggtgctgcactgtagagtgatgcttcattgtcatccaatgctgcatcacggac

SEQ ID NO: 4139 - DNA, 121 bp, Artificial Sequence
  Synthesized
  misc_feature (61): n=t or g
aaagaaaaagcaccataaagtagaacaaaacattttttgacttcttatgatagctgaaatntcatagttctttgtgttactgcttgcatagtaatatcatcctcctttctacagatctcaa

SEQ ID NO: 4140 - DNA, 121 bp, Artificial Sequence
  Synthesized
  misc_feature (61): n=t or c
caggttgccgtgctcccatgcacaccagcaccaaaccctttcctgcacaaactactgctangcaaaatgcaaagtgctcgctatctgtagaccttccagattgaaaagatccaacacggtg

SEQ ID NO: 4141 - DNA, 121 bp, Artificial Sequence
  Synthesized
  misc_feature (61): n=a or g
agactgtgagttaaaataaatgacatggagaaagaggaatataatgttttgttttgatctnaattcaagcatcagctaaacatgagccagttttgtggtcaggtagccaagaaggtcaatg

SEQ ID NO: 4142 - DNA, 121 bp, Artificial Sequence
  Synthesized
  misc_feature (61): n=a or g
aggtggcttgagatcaactatttgattttgttttagaaagagctggatgtaagaaaaactnatacgaatgggaactctcccactttctttccatcctttcaagacacaatggataaattaa

SEQ ID NO: 4143 - DNA, 121 bp, Artificial Sequence
  Synthesized
  misc_feature (61): n=a or g
ctggttcttactttccagccaagcaggaaggagcaaatagaacaactaatagacctttgangatataacagttatatttaagagcatcgttatgtatcacactgtggaaagacaagccaaa

SEQ ID NO: 4144 - DNA, 121 bp, Artificial Sequence
  Synthesized
  misc_feature (61): n=t or c
caattacttcctattgcacaaatgaatcagttatgtgactgaaacaatattccttatcaanaaatctgaataggcacagacagattgatgtaagaaatttttctgacgagcaggtagggga

SEQ ID NO: 4145 - DNA, 121 bp, Artificial Sequence
  Synthesized
  misc_feature (61): n=a or g
cagaaccaatggattcatgaatgttatgtattcttacaaggaggctaaaaaccatttaccnttccttaattacaaaagtagtgatgcagtgtaaacatgcatttgcatgagttgggtttct

SEQ ID NO: 4146 - DNA, 121 bp, Artificial Sequence
  Synthesized
  misc_feature (61): n=a or g
ctcttttcttttcatgatttctgaaaatttgaagaggaagctaaagaggtatttcattacnttgtttcattccattttctacctgctttctggaagtgtactgaaaaagctcaaacttgcc

SEQ ID NO: 4147 - DNA, 121 bp, Artificial Sequence
  Synthesized
  misc_feature (61): n=a or g
cctggggaggtgctgccctcagccccccgcggccctccacaaaagcatttactttctgccngcagcagcagagctgggccctgtgactatgaaaatacatccatgtagtgagggaaaagcg

SEQ ID NO: 4148 - DNA, 121 bp, Artificial Sequence
  Synthesized
  misc_feature (61): n=a or g
gtctaaatagatgcaaaaaaatctattttcattatgaatttggttaaagtggctgcctggnaagcttgtaaaatgtccatctgtaagtatagtcaaaacttgataaagacttaattttcat

SEQ ID NO: 4149 - DNA, 121 bp, Artificial Sequence
  Synthesized
  misc_feature (61): n=c or g
tttacaaacacattgtgaggatcagtgggacccacagccaaccacaggcacaactgtagangtgcttgagaccaaaaaacatgtattagagcacagattcaagagccaaacccaaatttca

SEQ ID NO: 4150 - DNA, 121 bp, Artificial Sequence
  Synthesized
  misc_feature (61): n=a or g
tagattctgacaacttcctagacaaaaatatcagattaagaagttaaacttggtggctgtntcacaactatgaattgagaaatgtttcccattagtaaatgtattggttattgtgaacaga

SEQ ID NO: 4151 - DNA, 121 bp, Artificial Sequence
  Synthesized
  misc_feature (61): n=t or c
aaatctctgctgttcaaggagagaattcaagaacagcagtcattgtacaccatgaagaagngcagccaatgaatcagagctggccagtgggttccaaagccatttacaaacatgagacact

SEQ ID NO: 4152 - DNA, 121 bp, Artificial Sequence
  Synthesized
  misc_feature (61): n=a or g
tcagaggcagctcttacctgtctgaggctgtgtagcctctagcaatgtttcctccattccncatttcttgctctgccccttagaaaacaatgcagagctgagtcatgctttctctgggaga

SEQ ID NO: 4153 - DNA, 121 bp, Artificial Sequence
  Synthesized
  misc_feature (61): n=a or g
agtcctgatattcctatcaagatgtccccacagcaaatgtttgctgatacaccattccaangagcaggttgccccagccacaaccctgcacacgggagcacatagcagccacagaccatgg

SEQ ID NO: 4154 - DNA, 121 bp, Artificial Sequence
  Synthesized
  misc_feature (61): n=t or c
ctgagcttctgtgtggaacctggcaaaacactatatgtgtgagcagctaacagtgttgctngtatatacaggatgtgtgaagatcgaatgagtgtcagaagaaaaaagagcaaatttagaa

SEQ ID NO: 4155 - DNA, 121 bp, Artificial Sequence
  Synthesized
  misc_feature (61): n=c or g
atacttttccttgctgtctttatttactaacaaaattttgtataagaatagaccttctaangctcatggaatagacctatccattctatgttacagtcttcttggagctgagaatacaaca

SEQ ID NO: 4156 - DNA, 121 bp, Artificial Sequence
  Synthesized
  misc_feature (61): n=a or t
gaggtggttagagtgagtgcatacctcccttggccattgcctgccatctatgaccacttgntactaccaaaatcctatttcttattcacacttttaagaaactatttaaaaaatagctcac

SEQ ID NO: 4157 - DNA, 121 bp, Artificial Sequence
  Synthesized
  misc_feature (61): n=t or g
agacaaaagcttttaaccttgctctgacaaatgcttttcaaaattgcttgaagagcaagcntagttacagatctctagcctggaacaatgtaacagctggacatttccagtctaaaacccc

SEQ ID NO: 4158 - DNA, 121 bp, Artificial Sequence
  Synthesized
  misc_feature (61): n=a or t
ataaagaactggctcaaactatttttgttaagagttgctgagtttttttgttctaagagtntgacagtgtccctttaacgctacttggattaaaaatttaaaacatacattttaagtttta

SEQ ID NO: 4159 - DNA, 121 bp, Artificial Sequence
  Synthesized
  misc_feature (61): n=a or g
aaaaattgcagaattttaaaaaaatcttattgtccatggccatatgtacccccaggagaanccaactgataataaagtgaagagcacctcaatataaaaattaatcttcactaactaatat

SEQ ID NO: 4160 - DNA, 121 bp, Artificial Sequence
  Synthesized
  misc_feature (61): n=a or g
taactgctaaaagttgactttccgaaagagaacatttggagaaatcagggcttgtaagganaggtagtaggtagcttgtgttgtatcacagaatgacctctgcatccagaactggatcatt

SEQ ID NO: 4161 - DNA, 121 bp, Artificial Sequence
  Synthesized
  misc_feature (61): n=t or c
tctgctgtccgtactgctatccatgaacacgtacagaaagatttcaagctgcagtgctaanatgcttacacttctgatgagagatagcagataatggtgcaaaactgaccctcattttttt

SEQ ID NO: 4162 - DNA, 121 bp, Artificial Sequence
  Synthesized
  misc_feature (61): n=a or g
gcgaggagccagactggggtacagctcagcaagcttggcttcagcctgttcttcctaagangatctgggacatggagtggctgttcaagaatcttgcttgctttatttttaatgtagtgaa

SEQ ID NO: 4163 - DNA, 121 bp, Artificial Sequence
  Synthesized
  misc_feature (61): n=a or g
tctcaaatcagatcttctgcattctgcccttgcatagaatgtcttttctattcgataagcntgcttagtcttgctcttaaattcacctatgaatcttgggccaccagattttagcactcac

SEQ ID NO: 4164 - DNA, 121 bp, Artificial Sequence
  Synthesized
  misc_feature (61): n=t or c
ttgttttttttccactactcagtgcaatatgcagcgctttggtgttcccaatttctaagtngcatacagagggatatgaccccaaaataaatgctgttgtaaggcagttttagagaattga

SEQ ID NO: 4165 - DNA, 121 bp, Artificial Sequence
  Synthesized
  misc_feature (61): n=a or g
gttaaaatagcatgacataggctgacaatgtctgacagaaaataaacatgacacctcccancttgcacagctaggagggcaacaaacctccagcagagtgaaccagcaaagagctctgacc

SEQ ID NO: 4166 - DNA, 121 bp, Artificial Sequence
  Synthesized
  misc_feature (61): n=a or c
aactgtatagggccccagtatatcaacatttaaaagatactgtgctgggatttccggggangtacattcctaataacatgtctcatgggtttatagcattcatggtttgattggcctactt

SEQ ID NO: 4167 - DNA, 121 bp, Artificial Sequence
  Synthesized
  misc_feature (61): n=a or g
acagtgatcagaggtcctgggagttatacttgcctttgtgatattttaaaagaaaaacttnatagagagtaggtgttatcgaacacatcctaagggttagcagtatacaaagaacatggga

SEQ ID NO: 4168 - DNA, 121 bp, Artificial Sequence
  Synthesized
  misc_feature (61): n=a or g
gtacctgtgtgcctgtatcactaggatggcaaaggatgtggttatgccaggtaccaggccnttctgtggagacaaaccacctgccccctgaaaccttgcaatcacacagtgtaatgattgc

SEQ ID NO: 4169 - DNA, 121 bp, Artificial Sequence
  Synthesized
  misc_feature (61): n=a or g
tcatagcagctattattagggaagaaatggagaaacactacttgtggaagttcacagaggnatctgtgacactatcacagagtttgaaaaggaactgtggtgacaattactaaagtttact

SEQ ID NO: 4170 - DNA, 121 bp, Artificial Sequence
  Synthesized
  misc_feature (61): n=t or c
tccagccaagattttaatgaatctagacaggaatcccagaacacaagtcagaaaaagaaancaaataaatgtatctgaaactcttaacactgtaacatgcttactcaatttttaagactag

SEQ ID NO: 4171 - DNA, 121 bp, Artificial Sequence
  Synthesized
  misc_feature (61): n=t or c
tcagttgtcctggttatcccacacgctcagaccatgcttaactggtttgtaggatcttctncatcagagaactctcctgggagagtgggggaaaggaggcagagaggggaaccgccaccac

SEQ ID NO: 4172 - DNA, 121 bp, Artificial Sequence
  Synthesized
  misc_feature (61): n=t or c
ggtttcaaggagccctgctccacactgctcctttggatgtctccataaacttcctgtttcntcaataattctgtattgtttgaataatactaagaatttattctagtgatttaaacagata

SEQ ID NO: 4173 - DNA, 121 bp, Artificial Sequence
  Synthesized
  misc_feature (61): n=a or g
ctttgtttttaacaggaagctcattctgtagctgccccacacctcaggccccctccctccngctgcctctgcggccgctgctttcttctcagtgctgacatctcccatcatgatccctgca

SEQ ID NO: 4174 - DNA, 121 bp, Artificial Sequence
  Synthesized
  misc_feature (61): n=t or c
tatgttgaagcccagatgaaaggaaaaaaacagtctgtggcttacgaactgcaaattgtantcatcttgcattctttgcccacctgggactccttttgatacctagccccagattaaagtc

SEQ ID NO: 4175 - DNA, 121 bp, Artificial Sequence
  Synthesized
  misc_feature (61): n=t or c
aaaaaaataaagtaaaaaaatcgaagattcagaagaaagaggcacatgcataaatcagcangagaaagaatacaaaaatgctgatggctaacaacaaaaaaatttgaattccacctcaaga

SEQ ID NO: 4176 - DNA, 121 bp, Artificial Sequence
  Synthesized
  misc_feature (61): n=t or c
tctccaagcatttgggtttaactgtcactgtctgctctgactcaggtaaggttctgtatgntggcatctgtctgggtcagcagaggctttatcaagttctacactagtgcactgagctacc

SEQ ID NO: 4177 - DNA, 121 bp, Artificial Sequence
  Synthesized
  misc_feature (61): n=t or c
tggataactcccaggtggaaaatatcagatgcctggctttgttcaaactcgctcctctctncatttaaccaccctccctcaccctagaggagcaaacagcaaggagcaaatgcagtagcag

SEQ ID NO: 4178 - DNA, 121 bp, Artificial Sequence
  Synthesized
  misc_feature (61): n=t or c
tagtctgtcctagaatttcttcttaccctttgagctcatcagagctgtaggaagggattgncaaacattttgtgttttggccatacacataaacttgtatcttgaaagttttcaatttcta

SEQ ID NO: 4179 - DNA, 121 bp, Artificial Sequence
  Synthesized
  misc_feature (61): n=t or c
tttaaaatattttcaggcacagtactaaaataattcatcattgtttctctcttgggacttnactatttgccatcaaactatccaagaaacctgtttactagatgaaactgaacagtgtttg

SEQ ID NO: 4180 - DNA, 121 bp, Artificial Sequence
  Synthesized
  misc_feature (61): n=t or c
gacctcatatactgaatactgcaggtactgtttgttctcccccagccccagacgtagttgntatttttcagtgagtttggtcttgcttctacttacatcttgctccctaggtcttgccata

SEQ ID NO: 4181 - DNA, 121 bp, Artificial Sequence
  Synthesized
  misc_feature (61): n=t or c
tttagataactgcttcatgtaaaccaaaatttcccacagtctttgtctgcttagtcctgcngagtcaagcctgtagatattgaccaagctaatgaatgacttttcaaagctgaactcagac

SEQ ID NO: 4182 - DNA, 121 bp, Artificial Sequence
  Synthesized
  misc_feature (61): n=a or g
taaatatgattatacatatgctaaacacataactctcaaccagtttgagcttaaaaagaanagagatcaggggccaaattacaaagcaatttagctgaaatctactgtaattattccactt

SEQ ID NO: 4183 - DNA, 121 bp, Artificial Sequence
  Synthesized
  misc_feature (61): n=a or g
aaggtcacagccatctcttgctgaaatcacagttccttggtcagcgacctcactaatcatngatgcatgtattaaggcaccagcctgggcctccatcaccctttattttcctttgtaatgg

SEQ ID NO: 4184 - DNA, 121 bp, Artificial Sequence
  Synthesized
  misc_feature (61): n=a or g
tctgcacaagtacaactgaaggggcagttctttcatttggtttccagtctctttgtgacanagtttaactctcagcacattaaaatatgttagccttggcagcctagacaatacatcagcc

SEQ ID NO: 4185 - DNA, 121 bp, Artificial Sequence
  Synthesized
  misc_feature (61): n=t or c
tgctagtcttattagctgttacactttatggattactgctgtaaccaaatgattatattangagtagtcagtctgaatgtacctaaaaatatgcagaatactatgacaaatgtaagaggat

SEQ ID NO: 4186 - DNA, 121 bp, Artificial Sequence
  Synthesized
  misc_feature (61): n=a or g
ctgttttatttgagggaacaccaagcccctacttgtaaggttcagtgacaattatatagcntgttaagaataccccacacaaagaaacacatgagctgcagattgctttcttggaaactcc

SEQ ID NO: 4187 - DNA, 121 bp, Artificial Sequence
  Synthesized
  misc_feature (61): n=t or c
tttagcagctttgttacttttctctgagtgagttccagcacctccacatcctatttgtagngaggggccgcaaactagttacagcacttctggtgtgttctgtcacaccaggctgagtaca

SEQ ID NO: 4188 - DNA, 121 bp, Artificial Sequence
  Synthesized
  misc_feature (61): n=t or c
agtaatttcctggttttacatgtttgttttttgcataaaccaaatactattaattatttgnttttgccgtctgaatctgactgctcagattgttagagtcttttgattgagccgttctcca

SEQ ID NO: 4189 - DNA, 121 bp, Artificial Sequence
  Synthesized
  misc_feature (61): n=t or c
ttatttgatgcaaatacacatacgtatgtcttatttacagtgcaaataaaacagtctgatnttcctaattttggccctggaaaacacctactgacattcacaaagtatgcaatatgaggca

SEQ ID NO: 4190 - DNA, 121 bp, Artificial Sequence
  Synthesized
  misc_feature (61): n=c or g
tattgtggtatgtgctgtgtaaatatatagtaagcaatcaagtaaagctgatcattttcangtggttcctccatttcttccatcttctttgtgttgcacagtagaagtgtttccacggatt

SEQ ID NO: 4191 - DNA, 121 bp, Artificial Sequence
  Synthesized
  misc_feature (61): n=t or c
gtttgcagtcaggttctgcaatgaggagagtttgtgctttgtttactaattaatttgacantatgatcagttacttggggaaataaatcttttcactcttctaaattttaaagcattatct

SEQ ID NO: 4192 - DNA, 121 bp, Artificial Sequence
  Synthesized
  misc_feature (61): n=a or g
atgttgatgttattttaaattaattccagcttttgtaaacagatgttaaaactgatgtctntgagatgcaaagaaagaaaaggaggtagatggtgattcttagttttgttcaatatcttca

SEQ ID NO: 4193 - DNA, 121 bp, Artificial Sequence
  Synthesized
  misc_feature (61): n=a or g
aatttgttgtttggtttggttttctgtgtgttgaggtaaactgagttctgcagctgttttncacaacagcattgggggtgcttaggccagacaagactctacttgctgatatcagttccgg

SEQ ID NO: 4194 - DNA, 121 bp, Artificial Sequence
  Synthesized
  misc_feature (61): n=t or c
gtgtgaaaaataaaatgacagtaaattaattacagagcatcatctggcaagctggattcantcaaatgaaaattgcacaaagacaccgaacacagctgatcttttgaaatctactgaaaaa

SEQ ID NO: 4195 - DNA, 121 bp, Artificial Sequence
  Synthesized
  misc_feature (61): n=t or c
agttagaatttggcctgtattgtttaagcctagactctcttcttaaaatgttcattcttangggagatgactcttcactgtttattgacttacattcagattttcctttgaatctttctaa

SEQ ID NO: 4196 - DNA, 121 bp, Artificial Sequence
  Synthesized
  misc_feature (61): n=a or g
taaactaaagctaggcccctagctgtttcattgaggcttacggattgtttttctgtctcanaagctagaaacttgttcttaaaagcacagtataatcttgacttagaggtttgtgtgacaa

SEQ ID NO: 4197 - DNA, 121 bp, Artificial Sequence
  Synthesized
  misc_feature (61): n=a or g
attttctatatattgaactctggaggcactttaagataaggtgacaaggattcagtatagnagaaagaatttgtaacccaaagcgcatctatgggagtggtgctacttcatcatgtcacag

SEQ ID NO: 4198 - DNA, 121 bp, Artificial Sequence
  Synthesized
  misc_feature (61): n=a or g
gaaactccaacagagagcagagcttatctcttcatggaaaatgctaatggatagttttggntgttcagtctcttggccggaatgcatctccaggtgctcagcggcaggtgcctcagctgca

SEQ ID NO: 4199 - DNA, 121 bp, Artificial Sequence
  Synthesized
  misc_feature (61): n=t or c
aaaaatttcttacgtctttgttgcgttactagaaaactatttaaataacaggtatatctcnccagaggaggtcctgagggtgggccctgtggtacagagctgtgtggagcagtgcctggag

SEQ ID NO: 4200 - DNA, 121 bp, Artificial Sequence
  Synthesized
  misc_feature (61): n=a or g
agttagtagaaaggcatgaggaatttgcctagataaatgatgacactggactattcagcantagttcttctgtcctcaagtacttcagagatcagctattatttttaggtaaggaattaga

SEQ ID NO: 4201 - DNA, 121 bp, Artificial Sequence
  Synthesized
  misc_feature (61): n=t or c
aaagattactgaaaactagatacattgggcatgattccagacacaaaacttgatggatctngcccattttctttttaacaagatacgaaattccacagctcccctgaagcactaaaacttc

SEQ ID NO: 4202 - DNA, 121 bp, Artificial Sequence
  Synthesized
  misc_feature (61): n=a or g
agttcacaatgatgcttttgagccaataatgcatgttttggttacagctgggatggaatcnttttcttcagtgtttgttatgatgcaattttggttttaggagaaaaaccatgttgataaa

SEQ ID NO: 4203 - DNA, 121 bp, Artificial Sequence
  Synthesized
  misc_feature (61): n=t or c
ctggattccggtctcgctgatgttagaagttcctggttctacattagtacaaggtcctgtntaacacagacatagtcatatagaacttcaaatagtcacatctgaaaatatgaagtcaatg

SEQ ID NO: 4204 - DNA, 121 bp, Artificial Sequence
  Synthesized
  misc_feature (61): n=a or g
gatgttcagttcttgctttgggagctgtaatgcaaggcattgctgacgctgtttctggganactttcacacgctatgaaagagagagatccacagtgacagtaatcccttaagggtcgtcc

SEQ ID NO: 4205 - DNA, 121 bp, Artificial Sequence
  Synthesized
  misc_feature (61): n=t or c
ggatctttcctacattctaaagactatgaaatggattatgactagcctattgggactgaanagacagccagatgctaggggctgcgaaaacgatgctgactggctgctctggattctgtgt

SEQ ID NO: 4206 - DNA, 121 bp, Artificial Sequence
  Synthesized
  misc_feature (61): n=t or g
actgtatcccttccagggctaattgggccctatgttagtagattccatatccaatccaatntaatagtttcccataatgacgtttttgaatttgcaataggatttctcaaataatgttgtc

SEQ ID NO: 4207 - DNA, 121 bp, Artificial Sequence
  Synthesized
  misc_feature (61): n=c or g
ggcatgagtttgctaatccaggttctatttaaccatgtatgtctcaccagcagccagcatncgatctggcccagctatcactgcagactgcccactgcccattgccatctgcctccgctgc

SEQ ID NO: 4208 - DNA, 121 bp, Artificial Sequence
  Synthesized
  misc_feature (61): n=a or g
ggctagaaagtctcccattacagaactagatgaaaggtgagagtattgcagaatgcctgtnaatcttagttacatcttttttttcctttagagaattttctaagtttaattcctaaatttc

SEQ ID NO: 4209 - DNA, 121 bp, Artificial Sequence
  Synthesized
  misc_feature (61): n=a or t
agcactgaacagtatttattcttatcacttgagtaagacattttttaatacttcttataangcttgaagttttgcctgcttctttgaggaatgatatattaaaaacatgtttttaatattg

SEQ ID NO: 4210 - DNA, 121 bp, Artificial Sequence
  Synthesized
  misc_feature (61): n=t or c
aaaacagaaaataatatgctgaaggttaaccttaaagattaatgtgggccatagtttaganctcagagcaggcagtcacaaagattgattcagttttcctctacagatgtgagtctgtgca

SEQ ID NO: 4211 - DNA, 121 bp, Artificial Sequence
  Synthesized
  misc_feature (61): n=t or c
aattttatatggtttagataattctttcattgttctctggacttcagaccattacctggangatgggaatttggattggttcaggcagaagagaatgactttctaagtagtagtttactta

SEQ ID NO: 4212 - DNA, 121 bp, Artificial Sequence
  Synthesized
  misc_feature (61): n=t or c
gatttcaaaagtatattatacatttatcctgctgctgacatttttcattactggaaactanagatggcctaaatgaccaaaactggtagtggaaagaggtgctaattaaaccctagcaatt

SEQ ID NO: 4213 - DNA, 121 bp, Artificial Sequence
  Synthesized
  misc_feature (61): n=a or g
aagattagatgtacaattctgagtcatgcatatcaaccatttaggtactgagtgccattangtatgaaggatgctgtaatgacatcaggagagaagactcagggggcactcatatgtgtgt

SEQ ID NO: 4214 - DNA, 121 bp, Artificial Sequence
  Synthesized
  misc_feature (61): n=a or t
ggctattgttcttttcctggtttttactttccccttcatctcacaaatgttcaaagtggcnattaagaacatgcataaatttcatgacttagaaaaaccgatcagttggcaggatgaggct

SEQ ID NO: 4215 - DNA, 121 bp, Artificial Sequence
  Synthesized
  misc_feature (61): n=a or g
ggacagactgagagagctgggcttgtttagcttgcagaatagaaggttctggacagacttntacgtgttcttccagtatgtgaggaaagcttaggaggagaggtgggagactaatttttac

SEQ ID NO: 4216 - DNA, 121 bp, Artificial Sequence
  Synthesized
  misc_feature (61): n=a or g
ggtggaagacacattacagaaagcttgcttaaagaacattcaaaatggagcacaaaagacntctccagttgcctacaatctccaaagtttgtcttctgtctgtcactgtgttccaatttac

SEQ ID NO: 4217 - DNA, 121 bp, Artificial Sequence
  Synthesized
  misc_feature (61): n=a or g
gtatattgttttattagcaatttgaaggatatgttcaaatgtaagggaatcactaagacantgcaactcatttgacctcctactaattaaactctagcttgactccctgcaaaagaaactt

SEQ ID NO: 4218 - DNA, 121 bp, Artificial Sequence
  Synthesized
  misc_feature (61): n=a or g
cttatgaagccaacaggtactcaggtttgagcaaaaaaggggtttgaagacctatactatntatcttaagcaacagggtggagccagcagactcaacctgcaccagcccattggtagaaca

SEQ ID NO: 4219 - DNA, 121 bp, Artificial Sequence
  Synthesized
  misc_feature (61): n=a or g
cctgaaattaaatttgtagtattctgaggaaaactagaagtgaaagatactccagcttgcncagtggctattgatttttctgctgctgactaaattgtctgttgtaaaccagatcagctgt

SEQ ID NO: 4220 - DNA, 121 bp, Artificial Sequence
  Synthesized
  misc_feature (61): n=a or g
ttggctaatttagaaaactaaaccagctcccagatggcagattttatcttgaggaggaaanaaaaggatgttaactcatctgagttcttttccactttgctcagcactaaatgcacatagt

SEQ ID NO: 4221 - DNA, 121 bp, Artificial Sequence
  Synthesized
  misc_feature (61): n=t or g
cacagattagtctcacaaatccttaagacatgagtcattcttaaaaaaacaaggtagcaantagaatgccacctttacagactatattattcttgtgcgtgcagaattttctatcaaggat

SEQ ID NO: 4222 - DNA, 121 bp, Artificial Sequence
  Synthesized
  misc_feature (61): n=c or g
ccgttgcaggggaatcggactagatggccctcagaggtcccttctaactctaaggattctntgattctatgacggtttatcctaacctgctgttttttaagtgttaaccaggtgtgtcaat

SEQ ID NO: 4223 - DNA, 121 bp, Artificial Sequence
  Synthesized
  misc_feature (61): n=a or g
cattcagaaatgaggagtattttgagatgagaaaattagtaacataagtacaaaaccctantactgcagagctgaaaacgttacttgagacacactaattgcagatgccatataatgacat

SEQ ID NO: 4224 - DNA, 121 bp, Artificial Sequence
  Synthesized
  misc_feature (61): n=c or g
agaagtgcaccacctgtagaaagtgtgtgatgggtctttccctatgtgagttttcattaancatcatatgcctaagagtaacagatactctttaaactttctacaaagactacaagagaat

SEQ ID NO: 4225 - DNA, 121 bp, Artificial Sequence
  Synthesized
  misc_feature (61): n=t or c
atttttctaggactccaggtggtgagctccttttcttgcctctcaagtcagcaccaaaggntgtcaatgtactgctaccttcctcccatgctttggggcccctgcttagatatataaaatt

SEQ ID NO: 4226 - DNA, 121 bp, Artificial Sequence
  Synthesized
  misc_feature (61): n=t or c
agttggaacactaaggtggcagggggtgggaaagagcatcaagtggattgtgtcctaagcntagctgttagattttcttggacatctaacaaaaaccttatggtaccttgtctcagcaaag

SEQ ID NO: 4227 - DNA, 121 bp, Artificial Sequence
  Synthesized
  misc_feature (61): n=a or g
aaaaaagttttaaatttaaatcctgcctaatagcaaactaatgttgtaactacagaccctntttcttcagtgagtgcaaattttgacaaaaaactgagagctcccagtccttgagattttt

SEQ ID NO: 4228 - DNA, 121 bp, Artificial Sequence
  Synthesized
  misc_feature (61): n=t or c
aacctatctgggattgctctgacccaggtacaataccttccacttagccctgttgaacctnattagctgggccaatttttcaaacctgtccagatctggttgatgtcttttccttctttgg

SEQ ID NO: 4229 - DNA, 121 bp, Artificial Sequence
  Synthesized
  misc_feature (61): n=t or c
ctgtgttcttttctgtggtgccatctgcaccctatccgtagctctgagcccacaaatgagngcgaaaccacaatggtttcaaatacacacttggtgtgcatgtgcaatcagagaaaactgt

SEQ ID NO: 4230 - DNA, 121 bp, Artificial Sequence
  Synthesized
  misc_feature (61): n=t or c
cgccatttgcgtttgattatacaggtacggcattcagctggctacaattccttcaccgtantattcctggtaagtgggattagctagcctggataaagggggcaaagagatctgctggccc

SEQ ID NO: 4231 - DNA, 121 bp, Artificial Sequence
  Synthesized
  misc_feature (61): n=a or t
accaacaacgtgcttaaaaacaaccagttgtaacatagtacaaaacgaaaaaaaaccaacnatgctatcctgtgattggaatatcagaaacaaatagagggggtgaaaaaagcaacatttt

SEQ ID NO: 4232 - DNA, 121 bp, Artificial Sequence
  Synthesized
  misc_feature (61): n=a or c
tgttttgtggattatgggagcaagttaatcactcacacagagaggatctttgtgaggctgntctctccgtgtatttgttttagtgtcagctgctagcaaagaacatggaaagagaatctgt

SEQ ID NO: 4233 - DNA, 121 bp, Artificial Sequence
  Synthesized
  misc_feature (61): n=t or c
tttcttaaacaaacaatgtaatatattattactgctgctaaagataacttgagctctgttnggttttaagcctgttcacagaatcacagaagtgaatgcagagtgcactgatatgatatgt

SEQ ID NO: 4234 - DNA, 121 bp, Artificial Sequence
  Synthesized
  misc_feature (61): n=t or c
attaaaagtaaagaaaatctgatttgaaaggatctgaattttttcatggtacatagaacancttagaagagcaggctactctaccgctcacagcttcttaacagcttctttctcaacagga

SEQ ID NO: 4235 - DNA, 121 bp, Artificial Sequence
  Synthesized
  misc_feature (61): n=t or c
agaactattgatggttttgaggaaggagatagttttgatttgttagtagaagaaacacacngcttgtgaaaaatagattgcaagtagactcaattctatttgtgtcagtggggaaaggtgt

SEQ ID NO: 4236 - DNA, 121 bp, Artificial Sequence
  Synthesized
  misc_feature (61): n=a or c
tttatctcttctactaacccacattcttttccagtgccagtgaaatttttttacatctagngaagctcactcagctcacaaatggataaaattttctgctggatttaacccaattaggttt

SEQ ID NO: 4237 - DNA, 121 bp, Artificial Sequence
  Synthesized
  misc_feature (61): n=a or c
ttcaagttaagaatgcagaattatcagaaagcacagctctaaggcagcagcaaaggaaaanacattcagaacaataaggaaagcatttttatctgggagaactactgtgctgcagagactc

SEQ ID NO: 4238 - DNA, 121 bp, Artificial Sequence
  Synthesized
  misc_feature (61): n=c or g
ttcaatccatgtaatccggctttaccttgtcaagtttttgcaaggatggaggttcctctangcacctgtgtttgactacctccattgtgagcagttgcttttttaaaaacagatgaacata

SEQ ID NO: 4239 - DNA, 121 bp, Artificial Sequence
  Synthesized
  misc_feature (61): n=a or g
cagtgtgtcaccaccctctgagtgaaaaacttcctcctgatatttaacctaaaccttcctntctcagtttaaaaccattccactatagtgtcctgtcactgtccacctttgtaaacagcca

SEQ ID NO: 4240 - DNA, 121 bp, Artificial Sequence
  Synthesized
  misc_feature (61): n=a or g
ataatgtctgatatatgcttaaagttgcgacacttctatttaactgacaaagcttatagcntattcttgtgcttcagaaggatgctttggttatttcatacacatgtgaaaatagcataat

SEQ ID NO: 4241 - DNA, 121 bp, Artificial Sequence
  Synthesized
  misc_feature (61): n=t or c
tccaagaagtttctttttcctcagtaaactttttccatataaattcatctcagaacaaggnaaatcccagaagaaagagcttcctaaaactccagagtaactatttagcaacaaatacaca

SEQ ID NO: 4242 - DNA, 121 bp, Artificial Sequence
  Synthesized
  misc_feature (61): n=a or g
ctcaagtcatgaactcagtacctccagtaagtcttctcattcaaaacagtaagggaatcanagctgaagcatctcagtttctcccaagatgcagaaaccaacctataaagtcattgcaatt

SEQ ID NO: 4243 - DNA, 121 bp, Artificial Sequence
  Synthesized
  misc_feature (61): n=a or g
ttgagcttcactaggcttctctaacatttgcactctaaacttctatgtgcaaacttctttnaaacaaaaaaattgaattacacttaacagaattgtatagttctgtctggatttttccata

SEQ ID NO: 4244 - DNA, 121 bp, Artificial Sequence
  Synthesized
  misc_feature (61): n=t or c
gctggctgggtacaactgaacctggcttcatttttgagctcagcctttattatctttatgngtgccttacagctgggggaagatgttattcaaagttcacagctgtagagatgcttaacaa

SEQ ID NO: 4245 - DNA, 121 bp, Artificial Sequence
  Synthesized
  misc_feature (61): n=t or c
ctttaaattgcagtagaaataaacaacaaatcctttcttgccaacttgatttagaaaatgncagaggagttgcaacaggtttaacttggcattctgctgtagaaggcagaaaatggcagtg

SEQ ID NO: 4246 - DNA, 121 bp, Artificial Sequence
  Synthesized
  misc_feature (61): n=a or g
aagcagttagctgggagtctcatactcagagaacacttaaagggaagggaacgctgacttntgtctatatcctttttagtcactgtaagaccatttgcaagttcacagcttagatcattaa

SEQ ID NO: 4247 - DNA, 121 bp, Artificial Sequence
  Synthesized
  misc_feature (61): n=a or t
tacaaactacttcagaagatttaggttcagcttaatattcaacatgaaggtatctttcagngtttgattccacttcagtcccctttccctatgacatttcattagatttaagaaccattct

SEQ ID NO: 4248 - DNA, 121 bp, Artificial Sequence
  Synthesized
  misc_feature (61): n=t or c
aatttcatttgaaaagctaacagaattttgtagacaaggttcaatgtccagcttcattacntacaaatgtaatcacgtatcaacatatcacattacaccttgtgcactcagttttacgggg

SEQ ID NO: 4249 - DNA, 121 bp, Artificial Sequence
  Synthesized
  misc_feature (61): n=a or g
agtaatattttcctaaacattaacagtcatttacaattcgctctctccttctgttcctttntgttttttcctctggtcatgttggtcagaggcacgagagatactttcagtaatatatctt

SEQ ID NO: 4250 - DNA, 121 bp, Artificial Sequence
  Synthesized
  misc_feature (61): n=t or c
ctgtgtgcagaataatgtgaaagaatgataggtaataccacagtaccactttagcacacanatttcaaatacagagagccttggtttaaaaccaatatgtttgtatatgctgctttttcag

SEQ ID NO: 4251 - DNA, 121 bp, Artificial Sequence
  Synthesized
  misc_feature (61): n=a or g
tccacagaatacattcaattcttacacggtaattcaagagaagaaggatgtaaagggtaanataccagtgagaaattttaaagtgacaagtttctaaggacaagagaaatactaggtgacc

SEQ ID NO: 4252 - DNA, 121 bp, Artificial Sequence
  Synthesized
  misc_feature (61): n=t or c
agcaaaacaaggaatagcccggacagcagcctgcattcaaaaaaaatgctcatatagggcnggatgcactgtgaattacactatggagtaaagggaaagtatcgtggtgtatgaaagaaat

SEQ ID NO: 4253 - DNA, 121 bp, Artificial Sequence
  Synthesized
  misc_feature (61): n=a or g
gaacagatggctgggaccttgttttcttggggtcaaacttattactgactgccacacagtnaaaatctacaattttcagtgtagtagtgttgcccatttcagacagtactatgtatgtctt

SEQ ID NO: 4254 - DNA, 121 bp, Artificial Sequence
  Synthesized
  misc_feature (61): n=c or g
gtcctctgccacctgcaactgctccttgtttcagttcccatatgcatagcaagcgctgatnagaattaggacagggatcaccaaaatggctgtctatgtgaaagcagcaaataaagattat

SEQ ID NO: 4255 - DNA, 121 bp, Artificial Sequence
  Synthesized
  misc_feature (61): n=t or c
tgtgaaatatcagtcagagtctgaggcctaacacagacttcacagttctcaattagtgaancattaaaagacttaaagagactctgctctgactgtatgcatctcttcacatttgctggac

SEQ ID NO: 4256 - DNA, 121 bp, Artificial Sequence
  Synthesized
  misc_feature (61): n=t or c
gaaggccgtgcttgtcagtcctgacctatattctgaagagtggagctgcatcagactgatntatcagatagcaaccacttcagtgacttcattggatcctgccacgctcaacctttacatg

SEQ ID NO: 4257 - DNA, 121 bp, Artificial Sequence
  Synthesized
  misc_feature (61): n=t or c
tcagcaatgtaacaatactcaacttttgagtagaattagttgatttctttcctccccctgnacccccagtaggaagtcctcttctgagatgcccattgcagatttcttctaatgtacatcc

SEQ ID NO: 4258 - DNA, 121 bp, Artificial Sequence
  Synthesized
  misc_feature (61): n=t or c
ctataggtacatggcataatggatgataagacttttactctcactaaatggtcatagtaanactgggagtgggaaatctggtcccattgcaaggaatgggtatttgaccacaaaactgaga

SEQ ID NO: 4259 - DNA, 121 bp, Artificial Sequence
  Synthesized
  misc_feature (61): n=t or g
aaacatgaagaacaaaaatcattaaatgtgtttcttaaacattagtgggatgagctgcctntaaagaaagcaagagatgattgataaaaatctaaaacccttagaatttttgctggatcat

SEQ ID NO: 4260 - DNA, 121 bp, Artificial Sequence
  Synthesized
  misc_feature (61): n=c or g
aatcctagtagttttagaaattactttagaaaccccaaggttttagaagagcctgagcttnaagtgaaatagcaaagaagtgaagagaaaaagaaagatcaaaagcaattactaccatctc

SEQ ID NO: 4261 - DNA, 121 bp, Artificial Sequence
  Synthesized
  misc_feature (61): n=a or g
tctatttttaccaataaaacatagtgagaactaataaaacagaagatctggagttgagaancagtgtaaaattgctgtgaatgacgaatacataatcaagcaaatatatattactgttatg

SEQ ID NO: 4262 - DNA, 121 bp, Artificial Sequence
  Synthesized
  misc_feature (61): n=t or c
aagagcagattgcattagactgctcacaaaggaacacgccttagaaacgaattcctgctcnttccctacaagttcacggcttggtctttctaaggcaaggcaaatggaagcacgaatgata

SEQ ID NO: 4263 - DNA, 121 bp, Artificial Sequence
  Synthesized
  misc_feature (61): n=t or g
ctaccagcatgaataatgctctgatgtgtgattctcacaatgactttaatgacacttcatnattacttactgatgaaaagaaaacaaaattgttttaaaaaaattaaaataaaaagaatta

SEQ ID NO: 4264 - DNA, 121 bp, Artificial Sequence
  Synthesized
  misc_feature (61): n=a or g
acaaaatttaaggagagaagagtaagattacaaagcattgcagaataactaacaaaaccanaattcacgcatttgcttaatgtaaacgtttcattatacatatatatgctagcactctaca

SEQ ID NO: 4265 - DNA, 121 bp, Artificial Sequence
  Synthesized
  misc_feature (61): n=t or c
ggcaaatggctggaaaatgaaggacgtttatctcactgctttgttgttgctgtgcaaatgncagtatttttttcctgcaacagctccttgaagaaaacgataatttaagtacctgagagta

SEQ ID NO: 4266 - DNA, 121 bp, Artificial Sequence
  Synthesized
  misc_feature (61): n=t or c
gctttctgtctgagctcttgtgggcctcccttcccatttgcctacatgcacaggcttgtgnacgcctatgtctatactgtggcctggcttcaggttaatgaaggcagtggctggtttaaga

SEQ ID NO: 4267 - DNA, 121 bp, Artificial Sequence
  Synthesized
  misc_feature (61): n=a or g
cagcaggaacttggtgagtagagaaggcaaagtaatgagccactgatgtaatgagacaganatagagaaggtaatggtgggagaagtgacctccaacaaatccaatttcatgtgttgcaaa

SEQ ID NO: 4268 - DNA, 121 bp, Artificial Sequence
  Synthesized
  misc_feature (61): n=a or g
gactccaagcactgatagcagtgtcttttatgtgtggctcaatagaggaactgtagcaaangcaaaaactactcctttgacttaagcagatgtaccaagtctttctttattaactagaaaa

SEQ ID NO: 4269 - DNA, 121 bp, Artificial Sequence
  Synthesized
  misc_feature (61): n=a or g
tgagcttttagtttgaaatatatgcttcttctagggaagcatcctgtagaaatcgagtaanagttaaagacctaatttcccttcaacacatacactccagagaccacatctgtcttatttt

SEQ ID NO: 4270 - DNA, 121 bp, Artificial Sequence
  Synthesized
  misc_feature (61): n=a or g
ggtcatttccctgcctgcactactcagaagttaagaatgtcaatctgttggttatgacaanctgttctgtaaacacatctcttcctttgctgtcctctcactttaatcacttatcttcagc

SEQ ID NO: 4271 - DNA, 121 bp, Artificial Sequence
  Synthesized
  misc_feature (61): n=a or g
atgcagtaagaactcaaaaaactctaatatatttattatgtgtgacagccttcgtataatnatttattcttcatagtaggaattccacaagtgccaccacttattacaaatgtaacagttc

SEQ ID NO: 4272 - DNA, 121 bp, Artificial Sequence
  Synthesized
  misc_feature (61): n=t or c
catactatgtcagataagctttaaaatcatgcagtttgtggttgtgattattagttctgangatatattttcatacagtctcagtaattcctttattgatgaagtcattaatttttactaa

SEQ ID NO: 4273 - DNA, 121 bp, Artificial Sequence
  Synthesized
  misc_feature (61): n=a or g
gagactgagattacctgtaagcagaaacatagttacagctggtcataatccttacttctcnacttttaagaccagagtgctaaaaacaaacgtccactatttgtgcacagtcacacacgtt

SEQ ID NO: 4274 - DNA, 121 bp, Artificial Sequence
  Synthesized
  misc_feature (61): n=a or g
tacagcctggtagaattgccactaaatatgatatgattgtatgcacagcaaaaatagtagntgttatccatttaccgatacaggaacctgaagatctcctgggaatggaagaagaaatgtt

SEQ ID NO: 4275 - DNA, 121 bp, Artificial Sequence
  Synthesized
  misc_feature (61): n=a or g
actaacagggaacagctaaccactgcccaattattttttgcgattagaataagtgggcaancagagaatggatttaaccattttctccccttcaaaagccatcagaagacataggaggaag

SEQ ID NO: 4276 - DNA, 121 bp, Artificial Sequence
  Synthesized
  misc_feature (61): n=a or g
aaatactgcaaagaaatgtgtgttcagagtgtttttgccgggctcaatgagtagttgtcanaaatggagactctgagatgcagagccaatttacgtggaaaggggttttcaaaatactgac

SEQ ID NO: 4277 - DNA, 121 bp, Artificial Sequence
  Synthesized
  misc_feature (61): n=t or c
aaaacgaagtccagttttaaagctatatacctatttcaatttaaggagtactgttgtaggnattcattcaaactgaaaaaaggttgcacacgtgagagtgaaaatcagatgtgtactgagt

SEQ ID NO: 4278 - DNA, 121 bp, Artificial Sequence
  Synthesized
  misc_feature (61): n=t or c
tacttaacagcaacactccttctttctcgtcccctcctcaccaagaggaaatgtactctanattacacacacattgttgtccaaaggagtgaacacagaatgtaaagctacactgacttgt

SEQ ID NO: 4279 - DNA, 121 bp, Artificial Sequence
  Synthesized
  misc_feature (61): n=a or g
acacctttctatacttttttcatgagaaaaatgctaaggtgccccacgtgttcccaacacngactacttagagaacagtgactactagagaacaggaagatgttgacagttaattaccagg

SEQ ID NO: 4280 - DNA, 121 bp, Artificial Sequence
  Synthesized
  misc_feature (61): n=t or c
gcactggtcatcctttttggagaaaaagaataaaactggaatattatcaagtcactgaagngccgaatctgaccactctcagaactccaggatgacaagcaggatttcagttctgatcagt

SEQ ID NO: 4281 - DNA, 121 bp, Artificial Sequence
  Synthesized
  misc_feature (61): n=a or g
tgtagaggagaaaacagcagtcagctcatatgtacttttagatggatggaaaacaacagcnagagtattcaactgattacataattccttcctttgcattctatttctgcgtttcatcaag

SEQ ID NO: 4282 - DNA, 121 bp, Artificial Sequence
  Synthesized
  misc_feature (61): n=t or c
tgagcaatgaaatcttaataaattgtccaaaactaatttcccttctctgttttaggaattngaaaaggtccttgatatttttaacatcacacttgcaaggcaacaagcagaagttgaggta

SEQ ID NO: 4283 - DNA, 121 bp, Artificial Sequence
  Synthesized
  misc_feature (61): n=a or g
gaaaataagttgaggtataaacagggtaaaccattgccatctgggtcaattcttgtggtanctataaagcagccacttcatacatccttggtttatccttcctgtttcctcccttatcaaa

SEQ ID NO: 4284 - DNA, 121 bp, Artificial Sequence
  Synthesized
  misc_feature (61): n=t or c
ggcccctttctcttcaatgcgtgataggatgccattggccttcttggccacaagggcacantgctggctcatagtccaccttttgtaaactagttccttctctgcagatctcctttccagc

SEQ ID NO: 4285 - DNA, 121 bp, Artificial Sequence
  Synthesized
  misc_feature (61): n=a or c
ttttccttcaaacagtgttccctaaggtatcccacacagtgccttagctatactgtaattnatttatctatttagtacagagaactactgcagtatctcactcagcttcttgcagcttttg

SEQ ID NO: 4286 - DNA, 121 bp, Artificial Sequence
  Synthesized
  misc_feature (61): n=a or g
cagcgttgctcctaagacccatctgtggcagacatttttctgaaggcattgtaataggtcnttttacacttctgaagttaactttttgcagtaggcctgtggattaacattactgtcccca

SEQ ID NO: 4287 - DNA, 121 bp, Artificial Sequence
  Synthesized
  misc_feature (61): n=t or c
tgaaatagggttgctgagtctatttttacactgtactcaggaattatatattagcactagnaggtgtgaagtgcgtgaacgaaaagatcttgtttcaaacatgatcacccttcagaaaagt

SEQ ID NO: 4288 - DNA, 121 bp, Artificial Sequence
  Synthesized
  misc_feature (61): n=t or g
atgtaactctagagaagttccttaacctctgtatacttctatcatctcccttcatgaaaanggggaacagattcatgaaagattaatataacaaagtcagaaaacttgcaaggaagaatat

SEQ ID NO: 4289 - DNA, 121 bp, Artificial Sequence
  Synthesized
  misc_feature (61): n=a or g
ttacagagcagtaggctgctcacctaaagtagggtaaagtagaaagaggctgttttaaagnacaggatttgcctgaccatctcctgcttttaattcatgagactgccaagctattttggta

SEQ ID NO: 4290 - DNA, 121 bp, Artificial Sequence
  Synthesized
  misc_feature (61): n=a or g
ttataccttactacggaggcatatataattgctcaagaggggataattattcttcacagcnttatggtagtttttatggtctgactacattaatttttttttaaagttttacaagaagtat

SEQ ID NO: 4291 - DNA, 121 bp, Artificial Sequence
  Synthesized
  misc_feature (61): n=a or g
tcgtggctggattttaaaaaatgtgtacagcctatgtggcagaaatctgatctcacgcaangagagtttgtgtaatttcattttcagaatagttttgtatttactatgcagtgtttcacat

SEQ ID NO: 4292 - DNA, 121 bp, Artificial Sequence
  Synthesized
  misc_feature (61): n=t or c
tatatcaaacattcaatgaatacaagccagtactgttctgttttacgctgatattggcaangttgagtagaaaatctgaaatatttctggagagctccagcagctactgctgacatgatgc

SEQ ID NO: 4293 - DNA, 121 bp, Artificial Sequence
  Synthesized
  misc_feature (61): n=t or c
ccttagtagtactttttctaaatgtcctctttcttcttcatagcaaagactccacaacaanagatatttagcatcttttttatttttttttcagccagaaatacagtttcagacggtattt

SEQ ID NO: 4294 - DNA, 121 bp, Artificial Sequence
  Synthesized
  misc_feature (61): n=t or c
aaaagaaagtgtgtatcagttatgtaagctcttaaatttaaactgaaaagagagatcattntctaaattctctcactattatctctagaatggttttgcatgcgctctgatcaagctttct

SEQ ID NO: 4295 - DNA, 121 bp, Artificial Sequence
  Synthesized
  misc_feature (61): n=t or c
gtggataatatttgatggaccatctatttgaagtaaacagatgtatgtccaggtgaaggcngcttataaatggtgtctcccaaggacaccctcagcaagtttgctgatgacaccaaactga

SEQ ID NO: 4296 - DNA, 121 bp, Artificial Sequence
  Synthesized
  misc_feature (61): n=t or c
ttttctgtgttacgctagtgtcataaattatcatagtggactaccatgagtcagacacacntactgaggggctttactgagcagactgcctgacaaaactcattaaatggcaaaaagcagg

SEQ ID NO: 4297 - DNA, 121 bp, Artificial Sequence
  Synthesized
  misc_feature (61): n=c or g
gagtcactaagggcttgtaactgtgggcaatttgcagactgtggctaatacaagcacttanagctgttaattccagcccaccttcacatcttgagctgctgtcaacaataccctgaggtga

SEQ ID NO: 4298 - DNA, 121 bp, Artificial Sequence
  Synthesized
  misc_feature (61): n=t or c
agacacccaactgtaaagcacttcaacccctatctctagagaaaactgtaggaaatagccnaaccagtcttctttccctacagcatattgggaatattgctgcccttctgggaagcaacag

SEQ ID NO: 4299 - DNA, 121 bp, Artificial Sequence
  Synthesized
  misc_feature (61): n=a or g
gacagcagttttgttatcaggccagagcaggaaccgcagttcaccacagcaaggctcccangcagcaggcagacaagtcccaggctgtagatatgaatgggagacatcttcagtctgaagg

SEQ ID NO: 4300 - DNA, 121 bp, Artificial Sequence
  Synthesized
  misc_feature (61): n=a or g
ctgaaagcatattgtttaaagaagaatcacagaaaattctatataaattcagactacagcntacacctgtcccaagatgtataaaaacaagtgcctggagtcttgtatgatatttgtgctc

SEQ ID NO: 4301 - DNA, 121 bp, Artificial Sequence
  Synthesized
  misc_feature (61): n=t or c
aaggagaaaagagtgtgtcttgacactttgctccagactccctgaagagccaccacagtcngggaagccccaaaatgtctgggtcaaagcttactcaaaggaggactcaatgacttctgtg

SEQ ID NO: 4302 - DNA, 121 bp, Artificial Sequence
  Synthesized
  misc_feature (61): n=a or g
tggcctgggctgtaacagccattccctaactgagtttctgatcttgaggaatgctgtcctngcaaaaaagctgtcaagaccctggatgagatctcctgggaagctgtctttagggacacag

SEQ ID NO: 4303 - DNA, 121 bp, Artificial Sequence
  Synthesized
  misc_feature (61): n=t or c
tgcttttaagctcacactacaaataatgatgaacattacctgactgacacgcttttcttgnaaaaactatcatccagttcactaaccacaaactatgaatcagtcacacttagagacagct

SEQ ID NO: 4304 - DNA, 121 bp, Artificial Sequence
  Synthesized
  misc_feature (61): n=t or c
ggaaagcagccagaatctcactttcaccaactctctcagcacctttgggcggatctcatcnagccccatggacttgtggcagtccaagtggagtagtaggtctctgtttccacctgaatca

SEQ ID NO: 4305 - DNA, 121 bp, Artificial Sequence
  Synthesized
  misc_feature (61): n=t or c
tactcttttgagaaaaaaaaatgctgcttgaagtgtaactgcagtgataatcactgaaagngtgcacagatacccagggaaatgccctttctctgatgtgcagtagtcagtatggaaacca

SEQ ID NO: 4306 - DNA, 121 bp, Artificial Sequence
  Synthesized
  misc_feature (61): n=t or g
caaaattgtagcaatttaggcaattgcaaaaagcattttgccacctggcctctccagacanaaacagatcctgtaagattatctaggcttgtataatttattcttgtgagatcctgttgtg

SEQ ID NO: 4307 - DNA, 121 bp, Artificial Sequence
  Synthesized
  misc_feature (61): n=a or g
caaacattttacctaataatttattaatttgttttactttattttgcaaggcttaaaactnatgtgttaaaggaagagctacgctttagagacatttcagcactgcaggacttgaagtatt

SEQ ID NO: 4308 - DNA, 121 bp, Artificial Sequence
  Synthesized
  misc_feature (61): n=t or c
cagaggaccagtgctaccagaatgtagctaccagtgctagttaaaatgtgttttccattcntgtccaattgtgtctcctttttaaactatgctgttcttgatccttgttcatttatgcttt

SEQ ID NO: 4309 - DNA, 121 bp, Artificial Sequence
  Synthesized
  misc_feature (61): n=t or c
acatcacatacagctgctgtaactcaaaaagtactaattttctctctaccaggacaagtangctagtaaatacattagctgaagcatgaagactcgcttcaacagttctaagagaaggtat

SEQ ID NO: 4310 - DNA, 121 bp, Artificial Sequence
  Synthesized
  misc_feature (61): n=t or c
atttcacaatccattagccttcagagaaatgtctcatgttttcatttcatacggtcaaatngtgtgtgtaaatgctagtacatcagaattacaagatttttaatggttagagtgttttgtg

SEQ ID NO: 4311 - DNA, 121 bp, Artificial Sequence
  Synthesized
  misc_feature (61): n=a or g
ttagaatagcaaatacacaatgtgaatacagtcaagcaattaccatgtgaccacaaaacancagatatccaaagacaaatcccactggcaaaggtttacatttgttttcctatttattgaa

SEQ ID NO: 4312 - DNA, 121 bp, Artificial Sequence
  Synthesized
  misc_feature (61): n=a or g
tttgctttcaacggcatgagatcctgctgctgtcagccaggcctgctgagaaagcctcacngtgcttacttggtagcattgcaccaagctacccagtacaggaagtactgggctaacaata

SEQ ID NO: 4313 - DNA, 121 bp, Artificial Sequence
  Synthesized
  misc_feature (61): n=t or c
tcttttcctaaaatactggtggccagagcaacatgtagctactctaagaaccttaattacngcggctgatggtttactgggatacattgcatgactgttattgtttctgttaagggcagct

SEQ ID NO: 4314 - DNA, 121 bp, Artificial Sequence
  Synthesized
  misc_feature (61): n=t or c
ttttcagcctcatttcagccttcctttgtaacgctgtgcttttgggatctatccaattcantcattctacatattacagttatacccaggcatcttctactctgattaactcctacctggc

SEQ ID NO: 4315 - DNA, 121 bp, Artificial Sequence
  Synthesized
  misc_feature (61): n=a or g
agaattaattgcttcatcaagaaatactataagcttctgataatagccaagaatttggctncagaagtcacacagatgttggtttataacacaacactggactttgagctgatacaatcct

SEQ ID NO: 4316 - DNA, 121 bp, Artificial Sequence
  Synthesized
  misc_feature (61): n=t or c
agagttctggatttgacctagaaaaagttaagcttcagcacagatgtcattacaatcagcncagtctcagcactccggtttgcaacaggaaactcagaagcaatttggcagaaaccttttt

SEQ ID NO: 4317 - DNA, 121 bp, Artificial Sequence
  Synthesized
  misc_feature (61): n=a or g
ataagtgtaaataaaagggcttcattctcagcggtctatcatgggattaacattgaaaacncagcgttcagaacactgcctacaagccacctcggaatgcaaacaaaaaagaccttcctca

SEQ ID NO: 4318 - DNA, 121 bp, Artificial Sequence
  Synthesized
  misc_feature (61): n=c or g
ggaaccacattcatacaaaaaagatatcccttttcactctgtgtcacctggctgtctatgnactctttggagagaaactactgcagctctgtgaacacagcagcatgagaacagtggtgac

SEQ ID NO: 4319 - DNA, 121 bp, Artificial Sequence
  Synthesized
  misc_feature (61): n=a or g
tcaagtgtgccacctctgccctcttgcttgatggaaatatgggcaggtaatgaccacttcngaaaggtctagtgtgattgtgaagccgaagactcctgaaatccagcaaaagctgagcact

SEQ ID NO: 4320 - DNA, 121 bp, Artificial Sequence
  Synthesized
  misc_feature (61): n=a or g
agaaaaggaagtcagtcagatttttggctgtcagtacgagatgactttgtggtgtgcttgngcattgctgttctgctctgtgagcctggcagagacatgcagcacctcaggagcacaggag

SEQ ID NO: 4321 - DNA, 121 bp, Artificial Sequence
  Synthesized
  misc_feature (61): n=t or c
tgatgaagaaattcacattgtgaattttgaagaagtccagctctgtagggaacttattgtnctgatggtcaattaatattgctcctctgcagggttgccatttgatgtctcctttctttat

SEQ ID NO: 4322 - DNA, 121 bp, Artificial Sequence
  Synthesized
  misc_feature (61): n=a or g
tgcagctgccttgtttccaaatgaactaagtatagaagcttccttggtaagctgaaaaatnttttcctttctctcttacttagtcgagtctaacagaagaggaacttcctatctctctatt

SEQ ID NO: 4323 - DNA, 121 bp, Artificial Sequence
  Synthesized
  misc_feature (61): n=t or c
ttgaatcaacagttatttgtcagaaagttgactgtagtgtttagtcagcaacttgtaagcnacctaggtaggacttcatatgaatccaaactgattgctcttgtagtgagtacagattgag

SEQ ID NO: 4324 - DNA, 121 bp, Artificial Sequence
  Synthesized
  misc_feature (61): n=a or g
tgttaaaaagtaaagcctcagagatgtttccctctatattgtaatcacgtacagcattcantggcctgttgatttgaggacaggagcaaaatttcagttctaaatttaggaacttctggtc

SEQ ID NO: 4325 - DNA, 121 bp, Artificial Sequence
  Synthesized
  misc_feature (61): n=c or g
gaataaattgaaagagtgggaaaggcaggtttacttcacaaaagtctggaggatttttggnaaaatgcagtacctccactgagttgttccctgtcacccacacgcagttaccaaaacaaag

SEQ ID NO: 4326 - DNA, 121 bp, Artificial Sequence
  Synthesized
  misc_feature (61): n=a or g
ttctttaagaggattaaaaagaagtgttttacaggggaagcataggagggtgagataatanaataggttcctcttccagacagttcatcctaagagcagcacagtcatctggttcattcag

SEQ ID NO: 4327 - DNA, 121 bp, Artificial Sequence
  Synthesized
  misc_feature (61): n=t or g
ttgttgtttacttcagaaaatctgagctcaagttttggcactaatgcaaacttcttagganatgaagctttcctaaagctatctcataactcaaattcaaagtctacttctaaagtataat

SEQ ID NO: 4328 - DNA, 121 bp, Artificial Sequence
  Synthesized
  misc_feature (61): n=a or c
aagtacacactgtaccaccaagcagcaatttcccatgaactccaactgccatgtacaaggnaatgtatataccaactgacagccactgacacgtaggcacattttgaaaccaagggacagt

SEQ ID NO: 4329 - DNA, 121 bp, Artificial Sequence
  Synthesized
  misc_feature (61): n=t or c
atgggggattactttttattaaagactagtgagctcctcttctgggcaaacagactaaatnaaccaaatattctgaataatgcacaggagctggtgagcactgtatgttgtggtaaacccc

SEQ ID NO: 4330 - DNA, 121 bp, Artificial Sequence
  Synthesized
  misc_feature (61): n=a or g
attttgttttatttttacttctgagtgaatagctaagccaggcaattaatgatgctgacanatcatatttggggacattatttaaccaagaggcttaagctggaaaattaaatttccagta

SEQ ID NO: 4331 - DNA, 121 bp, Artificial Sequence
  Synthesized
  misc_feature (61): n=a or g
tccatacgttccagaatattgtacactggtgattgagagcagcttgctgtgactctgaccncaggtttggccagttgtgacatctgccagcataccaaacttggaaacgtggttaagtgaa

SEQ ID NO: 4332 - DNA, 121 bp, Artificial Sequence
  Synthesized
  misc_feature (61): n=a or g
tgacacttatgcagcagggaaatggccaggagtgattcttcatgatggagtatgccatgcnttgcaagtgcttcatcacacaacctatcaaggagacttccgcagagagcaagtctggggt

SEQ ID NO: 4333 - DNA, 121 bp, Artificial Sequence
  Synthesized
  misc_feature (61): n=a or g
atgctaggaagcaagcagttcaacaactagctgaaacccacaactaccagttgaatgtacncacagagaatccattgctgtagcacagcatgaaaatgaaatgaaactttatttcttcttc

SEQ ID NO: 4334 - DNA, 121 bp, Artificial Sequence
  Synthesized
  misc_feature (61): n=t or c
acggggtctttgcggtaggtaagtttgtttctggcaaaatcagccctggttctgtactccnttcaatgtgttctctttgttcttccagataaaaaagcaaaggtttcaatgaggctaaaaa

SEQ ID NO: 4335 - DNA, 121 bp, Artificial Sequence
  Synthesized
  misc_feature (61): n=a or g
gtaacttgcatctcccttttaaagttctgctgatctctgtttccctgcataggttgacacngataaaataacactcgtgtgtacagttcactgcttgatgagtggcattaacatttaatat

SEQ ID NO: 4336 - DNA, 121 bp, Artificial Sequence
  Synthesized
  misc_feature (61): n=t or c
gtcattgcaagcctctgctataggatgttttttcagtggtacattaagatttgcatatccnggctactggtgcttgttatgttactcatcagcttgaagtagtttgatgtttttcctccaa

SEQ ID NO: 4337 - DNA, 121 bp, Artificial Sequence
  Synthesized
  misc_feature (61): n=a or g
gcttggattttttaaaaaagaagatatacagcctttcaggcctcatctaaactcagtgacngagacacaaatgcatactcttgatgctagatacttagcatgtcacctatttgttttgtat

SEQ ID NO: 4338 - DNA, 121 bp, Artificial Sequence
  Synthesized
  misc_feature (61): n=t or c
atttgtgtaaatcaggggtttaggaattcatgttagaacaggttgaatctaatatggcttnagagggctgcaactgaaagaggcaatgtgtcctgagatttctgccatcctaaacaatgca

SEQ ID NO: 4339 - DNA, 121 bp, Artificial Sequence
  Synthesized
  misc_feature (61): n=t or c
tgctgcctccctgtgacactgttcagggatatttctaggacaactcctggtctgattcacncctctgagtattatcccttattggtagttcaggttggcagtgatgaagtagctgagaaaa

SEQ ID NO: 4340 - DNA, 121 bp, Artificial Sequence
  Synthesized
  misc_feature (61): n=a or g
caaaattgaagaacttagtgctttcttgcatgagcagcagaaatatcctggcttgttgagnacaatgttcttgttaacttctattctggaagtcaaataaagccctcatggactttggaga

SEQ ID NO: 4341 - DNA, 121 bp, Artificial Sequence
  Synthesized
  misc_feature (61): n=a or g
gttttgttaaaccttttgttaagcttctcgttctccttaaaccggtagattttgccctccnagtttctttgcagcgggagacatgcatctcagcagggctgaccccgctggcctcggtcgt

SEQ ID NO: 4342 - DNA, 121 bp, Artificial Sequence
  Synthesized
  misc_feature (61): n=a or g
agcagaaatgctgtcatgcccagtccttcagcagggagaagagtagcattttccaaatggnctactttttattcaacctgctttccattttgcaactgacagcaccagctctctgcttttt

SEQ ID NO: 4343 - DNA, 121 bp, Artificial Sequence
  Synthesized
  misc_feature (61): n=a or g
gagactgagaatgaaaaataattatttctgtcccatttactcatttgaagctatggaagtngagaagcctctgtattttggcactattttctagggaatataatgaaaaataacctgtgat

SEQ ID NO: 4344 - DNA, 121 bp, Artificial Sequence
  Synthesized
  misc_feature (61): n=a or c
gtcttgaacttttgtctcaaggggatattgcagaagtgatgactaggctgtgcttttctcntcattgcaaggtggggggtgtgaggacagggcagacacaggtgcctcattgtcacagcag

SEQ ID NO: 4345 - DNA, 121 bp, Artificial Sequence
  Synthesized
  misc_feature (61): n=a or g
ttggtgtctctgtgcaccctttggttttgggaagtttgcttttttatttgtttaaaacagnccaagtgagttggaagtcgaaataagttgtctaaaccttgttggcagaacatcttatctg

SEQ ID NO: 4346 - DNA, 121 bp, Artificial Sequence
  Synthesized
  misc_feature (61): n=t or c
cttgcagttcttatccccttttgctgctatgtgttggagaagcactggcaaccttctcccntaaagctaacagttgcatctttcttttagaaaataaacaacagaaaaagccccacaactc

SEQ ID NO: 4347 - DNA, 121 bp, Artificial Sequence
  Synthesized
  misc_feature (61): n=t or c
actattaaatattgaaaaagggtattttctccctcctcccccctcttccatatttgtatgngagtagaagtatattttctaagaaagaaattgtgtcttctgcaactttttgtaatgtttt

SEQ ID NO: 4348 - DNA, 121 bp, Artificial Sequence
  Synthesized
  misc_feature (61): n=a or g
tggctgcagtctgctttttagccacagaaacaaagcaaaaaactggatggcaaaatgtcantcaaatcagatttaagttctctaaggtggcagtgaccctggtggcatgtgacccacaaca

SEQ ID NO: 4349 - DNA, 121 bp, Artificial Sequence
  Synthesized
  misc_feature (61): n=t or c
ggattctgggcacatttaaacttttcctcctgcacaagctgtcccaagtctttgatcacangtaccagcgcttctaggctccacatcttgagtcatgagccaccatttgaacaaaaggaca

SEQ ID NO: 4350 - DNA, 121 bp, Artificial Sequence
  Synthesized
  misc_feature (61): n=t or c
tctatgaaaatattttttgttgtcctgatatggtgtggtggagagatcccagatttcctangaatctgagagattagagtgatgcagctgactgtgtttggggacacgttccaggcctttg

SEQ ID NO: 4351 - DNA, 121 bp, Artificial Sequence
  Synthesized
  misc_feature (61): n=c or g
cttgtgggttactgcagaccccagtctgctgcagttttcaaaatacataaacttgtacagntctgttgtgattttggctctgtttctgcagtagatgtgtaactgaattgccttcccagag

SEQ ID NO: 4352 - DNA, 121 bp, Artificial Sequence
  Synthesized
  misc_feature (61): n=t or c
aacagtcatcagagcaaagagtgtacaaatccagggctgggattgtgcactgacatcattngtgtatgtagggttggactggggagaatgggaaatctgtgacatggcacaaaacagcagc

SEQ ID NO: 4353 - DNA, 121 bp, Artificial Sequence
  Synthesized
  misc_feature (61): n=a or g
acaatatccctaagtctgaaagtcattgctctgaagtgaagcagtaagtggtgtacacttncatgctattgtaattatgacactagttgtgctcttaacagcataacttgtacaggcctgg

SEQ ID NO: 4354 - DNA, 121 bp, Artificial Sequence
  Synthesized
  misc_feature (61): n=t or c
agaacaagtttactaatacatagatgcacaaacaatgcatattctggtacgtcataatggngtacagacatgattttagaagtaataacctcagcagaccaaacatacaaaagatcatcta

SEQ ID NO: 4355 - DNA, 121 bp, Artificial Sequence
  Synthesized
  misc_feature (61): n=a or c
agtcatgaaacacaaaaccttgtactcaaatagacacatctcctttaaaagtttgatgacnaaataatttttagaactatcatacaactgtgctatatgttgaacacttcaaactctgata

SEQ ID NO: 4356 - DNA, 121 bp, Artificial Sequence
  Synthesized
  misc_feature (61): n=t or c
caaacgggccgggatgtcacgctcggcaatgaaagcgtgtgtcaagcaggaggaatgggtnatggtgggatggatgctcttgccttcccaagagatggttacgtgcactgagcgcgctgtt

SEQ ID NO: 4357 - DNA, 121 bp, Artificial Sequence
  Synthesized
  misc_feature (61): n=t or c
gtgtaagctagggactaaaaactcaaacaaacagtgacagaagataaacacatttaggtangttctccaaatggattctagatcccaacacatttttctgcatagcagttagtcagttaag

SEQ ID NO: 4358 - DNA, 121 bp, Artificial Sequence
  Synthesized
  misc_feature (61): n=t or c
tcctataagaaggggcagtgtatgtgatggacatataaaccaagacactacacaagtatanaatatccccacactcttccaaattacacctactgctgcacacagtaaaaccagttttact

SEQ ID NO: 4359 - DNA, 121 bp, Artificial Sequence
  Synthesized
  misc_feature (61): n=a or g
gaaaagaaaacatgtattcagcttcagagacctcagaggctcaggctggagacaaggagangcctttttcccgtgaggatgatccagccatggaagtactgtccaagtcagtcaggttggc

SEQ ID NO: 4360 - DNA, 121 bp, Artificial Sequence
  Synthesized
  misc_feature (61): n=a or t
agacatgattttttatactcaagggagtcagctagagttggaaactgcttgacttcagggngctttaaaatcctagtgtgatgtgtctgagcatggcaaaaaaacaggatgtttttttcat

SEQ ID NO: 4361 - DNA, 121 bp, Artificial Sequence
  Synthesized
  misc_feature (61): n=t or c
tttaagatcagaaagagaaaacagtcaaatgtgtacttaaaaataatttctataataggtncatccatctgtttgtggtcttaatatctggttgctataagcttcatgttgctggaaaaaa

SEQ ID NO: 4362 - DNA, 121 bp, Artificial Sequence
  Synthesized
  misc_feature (61): n=a or g
aaagcactgcacttaaatttaggtgctgttttacttctagcaaaactgggggccttttttncacatatagtgtgtttgcttttatcattggtgatcatttgtgggctgcacgaggagagtt

SEQ ID NO: 4363 - DNA, 121 bp, Artificial Sequence
  Synthesized
  misc_feature (61): n=a or c
atgcaagattactcatttgtttcaatacccagggttttataacaaacacttcacatggccnaagtggctatttgcagtccacaataagcctctctaagccatttcagctgaacaactgttc

SEQ ID NO: 4364 - DNA, 121 bp, Artificial Sequence
  Synthesized
  misc_feature (61): n=t or c
taagcagggctttctcatattaatccagcattaagtagcatgcagtttatggtgggagtgnttatgctctgattttgtattttgtgctatcttacatttctagagtaaagaacaaataaag

SEQ ID NO: 4365 - DNA, 121 bp, Artificial Sequence
  Synthesized
  misc_feature (61): n=t or g
aggagacaagattcttttagaatagcagtaggagactgtcagtaccactggcagaaaactnaaatactgttctattcctttggatgttaatgagcactgaacatacagtagaaaataggtt

SEQ ID NO: 4366 - DNA, 121 bp, Artificial Sequence
  Synthesized
  misc_feature (61): n=t or g
ggaaaatactttaaaaaccacaatgctacagaacaaaaacttaaaagtgtgctacctaatnggcagtagtaaagtcaaacaaacaagacatgcacaacaagcctacaccttctgttgcatt

SEQ ID NO: 4367 - DNA, 121 bp, Artificial Sequence
  Synthesized
  misc_feature (61): n=a or g
agtttaactttgcaaatattcagaaagactgaaggcttattttaaagttactgctaaaccnagtggtcaaagaactccctgagaaatattgtgaaaatctgtacctttatagaaaaacaaa

SEQ ID NO: 4368 - DNA, 121 bp, Artificial Sequence
  Synthesized
  misc_feature (61): n=t or c
ttctgttcttaagctggtattgtttctttttttttccctcatattaggccacattgaaganggaaccaagtctttataggaattttgcagaccactgtcactttccaaatccacaaaggac

SEQ ID NO: 4369 - DNA, 121 bp, Artificial Sequence
  Synthesized
  misc_feature (61): n=a or c
ctcctcgggacaatacttgcaaggagagggcggtgagccacaaccttaagctagcttcccngtaccaggaacttgcatagtagcaagaggtcattgctgaggattctggatgaatataaag

SEQ ID NO: 4370 - DNA, 121 bp, Artificial Sequence
  Synthesized
  misc_feature (61): n=t or c
gtggattccagcctccttgtgagagcacagctaagcaggcatttcactggcaacagagtgngcaccgtgccagaaaggagaaggcccttgagtttgttgcagcagtggagcgtacagatct

SEQ ID NO: 4371 - DNA, 121 bp, Artificial Sequence
  Synthesized
  misc_feature (61): n=t or c
gcggtggcacagctgcttctgcttctctggggccagcctcctccatccttgcaccaagtgngggctcagcaaaggatctggtcgcagaacaggtcactagcacagctcatctgcccacagc

SEQ ID NO: 4372 - DNA, 121 bp, Artificial Sequence
  Synthesized
  misc_feature (61): n=a or g
tagaaccaaagtgtgacaagaccaacatgactgtggacacagacagcagatatatgtagcntagtacaggactaatgcatctgctctaggtccagaaagctatgaaagagctgctggatcc

SEQ ID NO: 4373 - DNA, 121 bp, Artificial Sequence
  Synthesized
  misc_feature (61): n=a or g
ctcatcccactgcttaactcagagtcaccgcagggcctcccttgaaaaacacacacttttncccacttccagaaataaaaaatgtgaaggaagcatttttagtttgagacgcaagctgtaa

SEQ ID NO: 4374 - DNA, 121 bp, Artificial Sequence
  Synthesized
  misc_feature (61): n=a or c
ttgtagacaagacagaaagaaaaactgtacacaaataacggccctcttattattgatctcnaaaatgattattactgttgatgaattttgctttgaattttggttggttcttgtcacagag

SEQ ID NO: 4375 - DNA, 121 bp, Artificial Sequence
  Synthesized
  misc_feature (61): n=a or g
catggataaagggcagaagttgcagcaacaccagaaactgcagtgatggaaaagagaaaangggctagttaaagaaaagggggagttctgtagaaatggaaggactagtatgatgcacaga

SEQ ID NO: 4376 - DNA, 121 bp, Artificial Sequence
  Synthesized
  misc_feature (61): n=a or g
aacagagagccaaataaagcatagtacttccaggtcttctaaacataagggaagattcatngtaacatctactattgggactgttttaaaacatatctaggtacttaaaaagtatgtttat

SEQ ID NO: 4377 - DNA, 121 bp, Artificial Sequence
  Synthesized
  misc_feature (61): n=t or c
aattacatattagatgtgggagatattcggtagtgtgatttccaagaaatatcacttgccncttccacccccttaaccttcctgctacagtgagtgatctgcagtgagctaattagccaat

SEQ ID NO: 4378 - DNA, 121 bp, Artificial Sequence
  Synthesized
  misc_feature (61): n=c or g
ccttttcaattggaaccagctgataaggagaacttaaacaatgatgaaaaaaagcatgagnttatgagaaagttgacttgacattggtttatttttttcattttgtcatttgatttttttt

SEQ ID NO: 4379 - DNA, 121 bp, Artificial Sequence
  Synthesized
  misc_feature (61): n=t or g
agaaattgctcttcctcagctcccactaccagttaacttgttataatgcaaaatagtgagngaatttgtgtgttcagaagacttgtctctctataaaaatacttcattttgttgtataagt

SEQ ID NO: 4380 - DNA, 121 bp, Artificial Sequence
  Synthesized
  misc_feature (61): n=a or t
taatcattatttattttttgtaaataaggtgactttcactgggttctttgcttcctttggngcattttctcttctacattctgtcttctcatttactctcacagcaaagtaaattggcacc

SEQ ID NO: 4381 - DNA, 121 bp, Artificial Sequence
  Synthesized
  misc_feature (61): n=a or g
catggatgatccatcttttgtcttttcatctcacagtcgttcaaaggcaggggattcatantagcccaggaaatcagatcaaatgaaatgctggagaaaataatccacaaaatcttaataa

SEQ ID NO: 4382 - DNA, 121 bp, Artificial Sequence
  Synthesized
  misc_feature (61): n=a or g
tcacctagaaacaagggattggactgaaaaatttaccccctgtacaccgaggtcacacacnggctttgctgtatggccagggcactcgttgctcatgaacgccttcacccatctcacaccg

SEQ ID NO: 4383 - DNA, 121 bp, Artificial Sequence
  Synthesized
  misc_feature (61): n=t or c
ggtctacatggccattcccgattcctacaaaacagatgaaaggccattgggcatcaccagncacccaggcagcactcaggtatgatgtcttcgctgcctttagcaccccacagcactagag

SEQ ID NO: 4384 - DNA, 121 bp, Artificial Sequence
  Synthesized
  misc_feature (61): n=t or c
tatgatctgcaatctgtttgttaaatattaaattcctttcagtgtgaaaaacttctcatgnccacacaacccaggataagaccaactgtagccataacactgatgaatcctgaaaactaag

SEQ ID NO: 4385 - DNA, 121 bp, Artificial Sequence
  Synthesized
  misc_feature (61): n=a or c
aggtccagcacttgcttggccatgatggggatgcggttcacaggcgtcccttccagtgagnacagagggaaagagaaaagaagcacgagatgagcctacatccatccccttggggacatga

SEQ ID NO: 4386 - DNA, 121 bp, Artificial Sequence
  Synthesized
  misc_feature (61): n=a or g
cgggtatgtttgtcctgcctgatctcctgactgagctcagagatgtgatcaatcaggccanccattcttgtgtaagcgtaatacagatagccctcctgtccaccagaatgctcaatttcag

SEQ ID NO: 4387 - DNA, 121 bp, Artificial Sequence
  Synthesized
  misc_feature (61): n=a or g
aattctactgccaccagcccttcctggggcaaccacatccctttgctccacacagataganactgcatggggttactaagacccagtggcagcatcacttgcagacatcccacatttccca

SEQ ID NO: 4388 - DNA, 121 bp, Artificial Sequence
  Synthesized
  misc_feature (61): n=a or g
ccactccttaattagttgctaggggatatgaaagcagagtattagctaaactacctcaccnttatcttctctgatttagccaggaagcagtgcagtttatatggtgtttctttaaaaaaat

SEQ ID NO: 4389 - DNA, 121 bp, Artificial Sequence
  Synthesized
  misc_feature (61): n=t or c
aagacccacagttattgatataatgcaggatttttacctattcttaagagaagcaggtagntctattcttgtacaggtagtctctactaatttagctaggcgcttcctgcctcttccttcc

SEQ ID NO: 4390 - DNA, 121 bp, Artificial Sequence
  Synthesized
  misc_feature (61): n=a or g
agcatttttcctggaatcatgcttggggaactcacctctgaactctggctgcggccctctnctgccaaacgagtagaggctgggtgagagaatgaggcagaaagaaaggaccaggacctgg

SEQ ID NO: 4391 - DNA, 121 bp, Artificial Sequence
  Synthesized
  misc_feature (61): n=a or g
ctagggttgctatggaggcaaatagcctagaattgatcaaaagcaatcagatacttccacngaagagcaactcagcaaggactgctagaggtaagggtactttggtcagtgtgtgactaac

SEQ ID NO: 4392 - DNA, 121 bp, Artificial Sequence
  Synthesized
  misc_feature (61): n=t or c
tcctgtgaatgtgtctcagcattcccggctttctgaagtttactgcaattacttactacangtttcttgtaaacaacccaaacaaagagtgagtcatgttggcagaactcacaggcgaatg

SEQ ID NO: 4393 - DNA, 121 bp, Artificial Sequence
  Synthesized
  misc_feature (61): n=a or g
gtgttggctgctcagctgaacatgaccaggaccagcagtgccctgcagagcaaaacttggncaccaaggtcagacctgcccacttcccagtaaccttcagcaaggggaaaaacaagaaaaa

SEQ ID NO: 4394 - DNA, 121 bp, Artificial Sequence
  Synthesized
  misc_feature (61): n=a or g
ctttcttcaagactcgcctattgtggtacaggaaaagtttagtttaactattaagatgttngctagttagctattaagatgtttacttttcttttttttttttttaagagaaaagatgttc

SEQ ID NO: 4395 - DNA, 121 bp, Artificial Sequence
  Synthesized
  misc_feature (61): n=a or g
agaaattattcaccaaccataccatgccatgctatatgtggtagcctacataaggcaactntaactattgctgcctctggagtattttacaaaccattgaagtagggaaattgctttcacc

SEQ ID NO: 4396 - DNA, 121 bp, Artificial Sequence
  Synthesized
  misc_feature (61): n=t or c
gaattctaggtttcaccttctcaaggataatgactaactagctgactgattgcatgcttgnccttgcttccaggtcctggctcagttaatgtttcagtgctgtacatgatgaggtggcttc

SEQ ID NO: 4397 - DNA, 121 bp, Artificial Sequence
  Synthesized
  misc_feature (61): n=c or g
ttaaaggtgcatatggattttcaccttttctacccagctttgacagcacacctgaaagtanagcaaatgaagcaaacacacaaattaaaagtgatgtttgtaagtcaagtttcactctttg

SEQ ID NO: 4398 - DNA, 121 bp, Artificial Sequence
  Synthesized
  misc_feature (61): n=t or g
tgaggtcctgggcagcctgagctggtgggggcaaccagcacatgacaagacatttgaactnggtgattttataggtccctgccaatccacgccatattgtgattctgtaatctaacatttg

SEQ ID NO: 4399 - DNA, 121 bp, Artificial Sequence
  Synthesized
  misc_feature (61): n=a or g
gcatcacattgcacacaatggacaccttaaatgtaacgacactgcacacatctgcaagatntggaactagccaactaaggcaaatgagatacagaaagagtgaatatccattcacgcttcc

SEQ ID NO: 4400 - DNA, 121 bp, Artificial Sequence
  Synthesized
  misc_feature (61): n=c or g
gttgtttagttttaaagactgaatcttcagaatgttttctgcaattacactctcactgtcnttctttcttgaagtgatcttcaggtgtgtgtacaacattctaagttattaaaggtctttt

SEQ ID NO: 4401 - DNA, 121 bp, Artificial Sequence
  Synthesized
  misc_feature (61): n=a or g
aaaatcatataatgcaaatttactagttaatttcaggaacaattttggagatgtgtaagtngagcacattctaacttcaaaagctcgtagttggaaatggtgattttggacatacttacaa

SEQ ID NO: 4402 - DNA, 121 bp, Artificial Sequence
  Synthesized
  misc_feature (61): n=t or c
tttgatgttttaatgcatgtcctaattatcacacttaatttgttgcaggatttattctganactgtggactatgaagatgcatgtttgattgttcgctacttggcctctatgaggccgttt

SEQ ID NO: 4403 - DNA, 121 bp, Artificial Sequence
  Synthesized
  misc_feature (61): n=t or c
tttacaaagtattttctaatttctgttatcctttcctttgtaatttgttctttttgaccgngttcacttccatcagagggagatagaataggtccagtacatttatcatttctttttcttc

SEQ ID NO: 4404 - DNA, 121 bp, Artificial Sequence
  Synthesized
  misc_feature (61): n=t or c
tatcagttgactgctttgaaaacagcagagagcagtcatatacaagtgccaagtccagtangaaagtgtttgtataaactttttcttagaatgtaggtttcagcactgcctttcttcacaa

SEQ ID NO: 4405 - DNA, 121 bp, Artificial Sequence
  Synthesized
  misc_feature (61): n=t or c
atacatcattctaaaacttgaattttattacatgtaaatgaaacacaaacttcagcatatntgagcttcattctaatctataaaccatgaattttggcagggttgaaatttggctgaagtc

SEQ ID NO: 4406 - DNA, 121 bp, Artificial Sequence
  Synthesized
  misc_feature (61): n=t or c
cgtaatcagtcaggtgttttaagtatcccagctgctgcagcaaagcttgtggaggttgganggcttacattgcagctgagctgaggctacagccatttcatgctaatttttaaaaatgaga

SEQ ID NO: 4407 - DNA, 121 bp, Artificial Sequence
  Synthesized
  misc_feature (61): n=a or t
gatcatatttttaccctaaaaacgaataaaaagattgacataaacatgctttttaagctantcatatatcttaatttcagctgggattgagcggttgtttttagagtgtctgatatgatgc

SEQ ID NO: 4408 - DNA, 121 bp, Artificial Sequence
  Synthesized
  misc_feature (61): n=a or g
ttactgggtgaacagtaaggttagaaaaactattttatggtcctcttgaatcaaagtagtncagtcatgtatgtgtccttttatttgcattcatattcagtagtctgacatttgaatttaa

SEQ ID NO: 4409 - DNA, 121 bp, Artificial Sequence
  Synthesized
  misc_feature (61): n=t or c
caattatgcttagctattcttgccgtcttctgcatactattactattttcatttttacaanatcttgaaccctagttgacaaacatctgttggtgagagtagggaatagcaaaaaaactga

SEQ ID NO: 4410 - DNA, 121 bp, Artificial Sequence
  Synthesized
  misc_feature (61): n=a or c
tgaggaataagcattttcccagctttctttttatgcaatttatactctcgaggagggcaangtctcagaagaagatggttacaagaactgtgtcaactctagatccaacttgtgtctaact

SEQ ID NO: 4411 - DNA, 121 bp, Artificial Sequence
  Synthesized
  misc_feature (61): n=t or c
gttgtgcaagaactgattatgtttaatgacatcctctactgcacatttggtagcagtcttnaccctctgtgcattttctgaacactaaaattgtgatatgaaaatcagctggcagctacac

SEQ ID NO: 4412 - DNA, 121 bp, Artificial Sequence
  Synthesized
  misc_feature (61): n=a or g
atagaccatgtgactccccatgatgccccaaattctgcaattctgattacgacctttggcnttatcgtatgtgacatattatcctaactttatggaaatcagctatttcaagagaaaagta

SEQ ID NO: 4413 - DNA, 121 bp, Artificial Sequence
  Synthesized
  misc_feature (61): n=a or c
catacaggattagggggaaaaggagtaaatcacaaaacaaaagaccatcagcattttttcnatctctctctgtctctcatacccaaatttcacagtagaattatagctgtgggatttgatg

SEQ ID NO: 4414 - DNA, 121 bp, Artificial Sequence
  Synthesized
  misc_feature (61): n=a or g
aaaactgaaaaacaaataaataaaaatgtaacaacgttaggtactgatctcctgatcacanacagtacttctgcattaggccctattgctaagagcatttaaaaagaagtaataaatagca

SEQ ID NO: 4415 - DNA, 121 bp, Artificial Sequence
  Synthesized
  misc_feature (61): n=t or c
gtgttcaaaacagaaaataaaacactatcttggtttagcatttgactttggctattatttntttaactgaaatgtgaaaacgcttctaaagatattactcagggaacagcagtatctgtaa

SEQ ID NO: 4416 - DNA, 121 bp, Artificial Sequence
  Synthesized
  misc_feature (61): n=a or g
atgaagtgagtggattatttgcccatccagaagacattaccctcttaagcgtagtttctcntcatctgctgagtcatgtttattttcatgcagatcactctcaatattgatgaattcatcc

SEQ ID NO: 4417 - DNA, 121 bp, Artificial Sequence
  Synthesized
  misc_feature (61): n=a or g
ggttaatgtcccatgcctgtcagtattcaagaggcattttgataattccctcagtagtatnctttaacattggttagtccagaagtgtttaggaggttggacttggaagatcttcataggt

SEQ ID NO: 4418 - DNA, 121 bp, Artificial Sequence
  Synthesized
  misc_feature (61): n=a or g
tgtatatagcatactgtgtgtcagatgtggattggaaaaccagtacctgtcgcaggaacanagcttcaaaaaagagaacagtcttattcacttacttgataatactctctcctagcagtta

SEQ ID NO: 4419 - DNA, 121 bp, Artificial Sequence
  Synthesized
  misc_feature (61): n=a or g
tacatgggcagcataacataacagagatgtacctcttttgtagaactgagatgactacaanccttgtctaatcttattacaccaggcagagtttctgatctgagtgtcatggttttatgat

SEQ ID NO: 4420 - DNA, 121 bp, Artificial Sequence
  Synthesized
  misc_feature (61): n=a or g
tatggaaccacaacaaaactgagttgacaaagccatgttcccactgctgttctacagatancaataaaactatacactaacttccgacatctgcagtaggaccagtaggtctgtgttgcaa

SEQ ID NO: 4421 - DNA, 121 bp, Artificial Sequence
  Synthesized
  misc_feature (61): n=t or c
attgcacaggcaaaggaatgcatgaaccacacatggaaacctgccagcaaaggttttacangtacgcagatggttttagctattgtaagcgcaaagccaggttgttgtacatttactgcag

SEQ ID NO: 4422 - DNA, 121 bp, Artificial Sequence
  Synthesized
  misc_feature (61): n=a or g
gatcaatcaaccaacaaaatccctctattttttcccctgaaaacctgaggaatggtatcantctggcagcaagttaatttagtgactaaaagcactcctgtctggtactgaagaaggcggt

SEQ ID NO: 4423 - DNA, 121 bp, Artificial Sequence
  Synthesized
  misc_feature (61): n=t or c
tctgctcccaatggtcttggaaggtcagagaaggtggactaggagaatgtggcatatggtnttctaaatgtcaagcacctgacgagtattgttctaaaaagcttccagatatctagggtgg

SEQ ID NO: 4424 - DNA, 121 bp, Artificial Sequence
  Synthesized
  misc_feature (61): n=t or c
ctggtcatgacagtgtcacggaagctacagaagtaaaacagtgggtcacttccactggtgnagatttgtatgaacatagcatagtgtgcgagctcttgtttatcactggcaaacaaacaaa

SEQ ID NO: 4425 - DNA, 121 bp, Artificial Sequence
  Synthesized
  misc_feature (61): n=a or g
ctcttgaataattaggttctattagttctgacagaggacttcttcaactgtcggtgaaagntagcctcttactcaactctgccagtcattctctcagctttgcatttggtgtctggggatc

SEQ ID NO: 4426 - DNA, 121 bp, Artificial Sequence
  Synthesized
  misc_feature (61): n=a or g
cttatgtagctgctgtctggtctgtgaaaaatcacacaatgtcaattccaactgtcatcgnttctcaatcaggtcagtggctttttctggctccatcacttaaacaaagtggattcatctt

SEQ ID NO: 4427 - DNA, 121 bp, Artificial Sequence
  Synthesized
  misc_feature (61): n=t or c
actgtatcaaattaaagggtttagaagttgattctttgcctacttatctgaaccttggcanaattccttttcctgaggtattcccaaattgccatggtgtatgggagatgaagtcaagcct

SEQ ID NO: 4428 - DNA, 121 bp, Artificial Sequence
  Synthesized
  misc_feature (61): n=t or c
ttatgagaaatctttagataatcattaattatcatttaggcaatattatcatataagcagngtgatcaactctgcatgcaactgagtcatcatgtggtggccacactgactttgaaggtta

SEQ ID NO: 4429 - DNA, 121 bp, Artificial Sequence
  Synthesized
  misc_feature (61): n=t or c
atgcttcaatgctcatacaaaaatttaatgggatatttaatagcagcaagtgctatggttnggaaggtgattaatattcaacatcctatttttttccttgttatgtttttagcgattgctc

SEQ ID NO: 4430 - DNA, 121 bp, Artificial Sequence
  Synthesized
  misc_feature (61): n=a or g
ccccctaatgtcattttggcatatgagcagcccacgtcctccgaggatacccaataaacancgcaaaagatcaatcaatccctcctccaggacctcctctcaaccctcttcagagccattt

SEQ ID NO: 4431 - DNA, 121 bp, Artificial Sequence
  Synthesized
  misc_feature (61): n=a or g
agtaagatttacctacaggaaaaatccagagacttaactcacgaggaatatctgaattacntgtacttattgtatgtacaggtaagtaaagtaactttgcatgggagataccctgctgcac

SEQ ID NO: 4432 - DNA, 121 bp, Artificial Sequence
  Synthesized
  misc_feature (61): n=t or c
cagaccagcagtaatgtgccctgataactgatgatcaaagcagtacccaacacattccccntgtccaacagctaaaaaacagtctatgcatttaaatataatgaagcacttaatcatagaa

SEQ ID NO: 4433 - DNA, 121 bp, Artificial Sequence
  Synthesized
  misc_feature (61): n=t or c
tgctgagaaaatggtgaccacttgcctcagcttcatgatatcccctgtataaatgacatcncccaagtgcccttcaaaaacctgtcagggcagagaccagagggaagccagaagccagtct

SEQ ID NO: 4434 - DNA, 121 bp, Artificial Sequence
  Synthesized
  misc_feature (61): n=a or g
tatttattttgccattgcactgaatattctggtgaggaacagcagagacctgacaggaacnctaatgctttgtgtcctgcagtcacattgctgcagattttctgctgcatatccagcattg

SEQ ID NO: 4435 - DNA, 121 bp, Artificial Sequence
  Synthesized
  misc_feature (61): n=t or c
caaagactaacctaagccttgtggtagatggcttgctatttcaatatgccatgcccttctntggtatataaattttagcagacatgcacagaaaagcatcaacatgtacattcaacaacta

SEQ ID NO: 4436 - DNA, 121 bp, Artificial Sequence
  Synthesized
  misc_feature (61): n=t or c
caccatatttccctgcagtgtacttgcacattttccaaaagtttgatgttgtctctcacantgtttatgcgaaatatctgacagtagctccccagattttctctgtcagaggaaatactca

SEQ ID NO: 4437 - DNA, 121 bp, Artificial Sequence
  Synthesized
  misc_feature (61): n=t or c
ctatatgattcattttcatgttaatcattgcatctgcaggaacagtgttcttaataacttngcagtgttcacgctacgggaaagccatgatgatatttggtatcactgtcttaaagagcaa

SEQ ID NO: 4438 - DNA, 121 bp, Artificial Sequence
  Synthesized
  misc_feature (61): n=t or g
ccgactttcagatcaagcaagcttccatgtctgtatctatccaagtaagcacagcaggatncatgtcagtacatccttgtctaagagcaaattggattccaaacatgcatccaaagatata

SEQ ID NO: 4439 - DNA, 121 bp, Artificial Sequence
  Synthesized
  misc_feature (61): n=a or c
acgtataaccagactggtttgtgaacgtgggcaatgcaagttctgtttcacagtaacttcngtgtcaaagaactaaggatttttccaagaaaagttgtagtttgatgggaggaattcttca

SEQ ID NO: 4440 - DNA, 121 bp, Artificial Sequence
  Synthesized
  misc_feature (61): n=c or g
tatagatggtgtaaatggcttactgcattgcaaacacaaagctaggttcctctgcagaaantgctgtatggacaactgaaggtaactgtgcacctgatcattaatgatcattaatcattaa

SEQ ID NO: 4441 - DNA, 121 bp, Artificial Sequence
  Synthesized
  misc_feature (61): n=t or g
ccgttcaggtccgtattctcatcaatctcagcagcaaaggagtgttcccattactttaccnagcccagcagaagccaggcagatcagcaggatttgcctccacactgatatctcatgaccc

SEQ ID NO: 4442 - DNA, 121 bp, Artificial Sequence
  Synthesized
  misc_feature (61): n=t or c
tgatgaaggcagaaagccaaagctcagaattttagtcttctacgtaagcaactacaaaaangattttttaagtacacgtgtacttcatctaacagattaattactggatatttctcgcgtt

SEQ ID NO: 4443 - DNA, 121 bp, Artificial Sequence
  Synthesized
  misc_feature (61): n=t or c
ctcgcactggttctgattatccccatgtaggtgggagaaagtaaaaaagacatttttgcanggtgaaaggcacaaacataggtgagtgactgaacttgtacaagtgaaaatactcccactt

SEQ ID NO: 4444 - DNA, 121 bp, Artificial Sequence
  Synthesized
  misc_feature (61): n=t or c
ttagctttccaactcattctcattatttcttctatgttcccagatagacaaacaagatatncaaaatgtatgtgtgacataatcatattttagcttgtacagtttgttgcatcacaatcac

SEQ ID NO: 4445 - DNA, 121 bp, Artificial Sequence
  Synthesized
  misc_feature (61): n=t or c
caggtaaaccatgaaccaggtgccacctccaagctaccacctggctaaaggaccgagtggngtgaagctgcatatgagaattgtgagcatgtttctagagagttattcaaaggtttattta

SEQ ID NO: 4446 - DNA, 121 bp, Artificial Sequence
  Synthesized
  misc_feature (61): n=t or c
gtttaatgaaatctcttctccgattggattctcctgtattaaactgccctgttgaagttangcatatagcagatgatgcaggcaatgctatcccagtcagcaactcaaaattgacaccctt

SEQ ID NO: 4447 - DNA, 121 bp, Artificial Sequence
  Synthesized
  misc_feature (61): n=a or g
cagctttcacaaaagtctgtctgggtaactgtaagtcaatattaaatatctgccaatctgngagttttcagaggcaatctgtaaatgttcccaattaaagtttcataaagaaattttgtaa

SEQ ID NO: 4448 - DNA, 121 bp, Artificial Sequence
  Synthesized
  misc_feature (61): n=t or c
tgtgttttgcctcttgctgtcttaactaaatattgatgagaatgctgttgattgttgctcnctcacttcatgttataaaattacttcagaacctttgtgacatcggaatggcagaagtctg

SEQ ID NO: 4449 - DNA, 121 bp, Artificial Sequence
  Synthesized
  misc_feature (61): n=a or g
gagttctggtccagaattatctgactaaagtcactgaggcactgactgagcttatcttgantgctgaaagcagtgggtttgccacgttccagggctgcctgtaaaaaccactctgtgttac

SEQ ID NO: 4450 - DNA, 121 bp, Artificial Sequence
  Synthesized
  misc_feature (61): n=t or c
gtgatttggaagagtatcgggagcagaagaggcaaaagaaagtattgtgctctctgggganaaaattcatgtaaggcttcaaagggaaggttcagtttttttataagaggaaagagtaatt

SEQ ID NO: 4451 - DNA, 121 bp, Artificial Sequence
  Synthesized
  misc_feature (61): n=t or c
atatttggactacattgctacactaatcaagagaggaatggcttgttcccattttttgagnaggaatctgggagaagatttatcttcgtgttttttggggcaatggatatgaatatgagac

SEQ ID NO: 4452 - DNA, 121 bp, Artificial Sequence
  Synthesized
  misc_feature (61): n=t or c
acagactaagcaagatattgctttcaatgaacattgagtagtaaattaaattcctcagtangaccctcttcagtgcagcaattcatcacagatcccactttctaaagcacaaataatcaca

SEQ ID NO: 4453 - DNA, 121 bp, Artificial Sequence
  Synthesized
  misc_feature (61): n=t or c
tctgtgctgaagaatggatttacttccttacttcagatccttttaaagctgtgagaatccngaggaagtctccaaacacattctcttcatggattttgaagaaagttatgatatattttta

SEQ ID NO: 4454 - DNA, 121 bp, Artificial Sequence
  Synthesized
  misc_feature (61): n=a or c
ttgatcctcactagtccagaaggagtagagtttgctgggttgggtgcctggtccattcctncactgtgtaaggagagaggaagcgctgagaagcacaagccagcctctccaagggctgcag

SEQ ID NO: 4455 - DNA, 121 bp, Artificial Sequence
  Synthesized
  misc_feature (61): n=a or g
acgtaaattgcagaaataagacaagcaggaatgtaaccctgatctagtaatgcctactacnccgtattcgccatctaattgtgccgtctaggaatatctctcattccacttgcgtattttc

SEQ ID NO: 4456 - DNA, 121 bp, Artificial Sequence
  Synthesized
  misc_feature (61): n=a or c
tccacagtgaaatgtgtgaaatctaagaggaataaatgaagtaatggcatctgtctgtctngaaatagaatcatcctgaagtgtactctatgtacagaaggaaaacacacactttggagaa

SEQ ID NO: 4457 - DNA, 121 bp, Artificial Sequence
  Synthesized
  misc_feature (61): n=a or g
tgcacttattcagccatatcaagtatgccaaagcaaaaatagttaaactgtttatgactangcagagcttttgggatatactgctggccaaaagcagtatgattttaatataattttgtaa

SEQ ID NO: 4458 - DNA, 121 bp, Artificial Sequence
  Synthesized
  misc_feature (61): n=t or g
aaacaggaaggaagattcagttgctaacagaaaaagccaaaatcacaggtcagtgctgtgntacttgatctgtgacagacagacacaatttctttcctaacctggatgtgaaagggattgt

SEQ ID NO: 4459 - DNA, 121 bp, Artificial Sequence
  Synthesized
  misc_feature (61): n=t or c
tttattcagtcatagacacagatacatcataccaaactctgtttttagctgtattaatagnaatccaaatccctaaagaagacagctcttccttgtgcagaaacatactggaaaagttata

SEQ ID NO: 4460 - DNA, 121 bp, Artificial Sequence
  Synthesized
  misc_feature (61): n=t or c
tttacctttcttaacccctccatacaagcacttttaagtcagagagcagagaaggtgaaanagctcatcaaggatgaaggagtatcccatctaataggtcacctaagagtcataggaacag

SEQ ID NO: 4461 - DNA, 121 bp, Artificial Sequence
  Synthesized
  misc_feature (61): n=t or c
aaaggattagggtctgtgatgttgatgacagtgatgatgataatgagtctgtgagcctcantgaatggaagattgcttccctggagtttctgatggtggtggagcaaggtggagcaagtcc

SEQ ID NO: 4462 - DNA, 121 bp, Artificial Sequence
  Synthesized
  misc_feature (61): n=a or g
tccaacctccccccaacaaaacaaaaatagaacaacagaagataagccacagttgataatntatctgaatgtgtatgaaagacttcttttacatctgttgtcactaggaattttagtattc

SEQ ID NO: 4463 - DNA, 121 bp, Artificial Sequence
  Synthesized
  misc_feature (61): n=t or c
ggaggcatgcttcctatatattttggcattacattgatcctacttgaagggtagagtttgntttaggagagtatttttctagcactgttgttttctcatttatctttttagtattcacaga

SEQ ID NO: 4464 - DNA, 121 bp, Artificial Sequence
  Synthesized
  misc_feature (61): n=a or g
tgaaaaagccccatcaccacttctgtgctactcagaggtggaacttctcttaaaatcactnagatattggggtgttcaagtgatggaagatacaaaattagctgtcttatgggtagtctat

SEQ ID NO: 4465 - DNA, 121 bp, Artificial Sequence
  Synthesized
  misc_feature (61): n=a or t
aaagctcatcccataattagagtgtatacttctgaatctttgttaaaatctgctgctcagngcttctgaatatgtgtggaatggagataactgcaccgtggcttcttaaaactgttcagtt

SEQ ID NO: 4466 - DNA, 121 bp, Artificial Sequence
  Synthesized
  misc_feature (61): n=t or g
attccaaataccaactgaacattgcttattgtacagtctgtacagtcagaaaaagatttgntttttggatctaaaaccagctttgaagacaggatttgcaaaaaaaatatcccaccgccac

SEQ ID NO: 4467 - DNA, 121 bp, Artificial Sequence
  Synthesized
  misc_feature (61): n=t or c
tgtcatctgcatagctgtagtactgataaataatcatttgtttgtgaaattcatgtaactngcagactaccaaatagttttagaagtacttgaaataacaactacagttccagcttctgtg

SEQ ID NO: 4468 - DNA, 121 bp, Artificial Sequence
  Synthesized
  misc_feature (61): n=a or g
aaggtattaaatgcactgactgagggtattcagcaagttttaacagagcagaaaccttccnctgctctccaaatacttgctattgctttaaatttgtgatgtaattttaggaagctatgtt

SEQ ID NO: 4469 - DNA, 121 bp, Artificial Sequence
  Synthesized
  misc_feature (61): n=a or g
acagaatccctcagcgggtgtttaaggtaatggtatgagcagaagtaattcagattaggtntgttgttgggctagggccatcattaagctgtacacggtgcagaaaagcacttcttgtcgt

SEQ ID NO: 4470 - DNA, 121 bp, Artificial Sequence
  Synthesized
  misc_feature (61): n=a or g
ctcagtgtatgtgtgacttcatagggaaaaaataaatttggttcaacctgctcgctccacngactctgtttcaacagttcaatttatttcccagaacttctgcaagaaagagaactggcta

SEQ ID NO: 4471 - DNA, 121 bp, Artificial Sequence
  Synthesized
  misc_feature (61): n=t or c
ggatagcaaagctagatttttgttgtctgtgagtcttacatggggaatatggccatttganactccagtattgcccatgtgtggtgtcaccacccacttttaagaataaaactcactttta

SEQ ID NO: 4472 - DNA, 121 bp, Artificial Sequence
  Synthesized
  misc_feature (61): n=a or c
atatctctattctgtattttaatatgctaattcatacaatcgatagtgatatgttataaantggaggttgtattgtggtgacttcagtgtcacaggttagcccaaggagttagaagtatta

SEQ ID NO: 4473 - DNA, 121 bp, Artificial Sequence
  Synthesized
  misc_feature (61): n=t or c
aggaaaaaaaaaaaaaaaaaaaaacggccagttattacagaattaaaccacatgctatatncctaaatgcctggaaacaatgcgcataattactttttaatttttttcaagcacctctcat

SEQ ID NO: 4474 - DNA, 121 bp, Artificial Sequence
  Synthesized
  misc_feature (61): n=a or g
tttgtggatttaacatggcttctctatggctaacatccatgaggagggtttgccctaacantaatcaggtcatcttcctgttaattcaaatacggtgacagaaaggaggctaaggaacacc

SEQ ID NO: 4475 - DNA, 121 bp, Artificial Sequence
  Synthesized
  misc_feature (61): n=t or c
tttctggctgcccaagcacatgattcacataaaatgccaacacacagagccaagactccanacacctctctgggagagacagaagttcactggtgcaagcacacacagcacactccaggtt

SEQ ID NO: 4476 - DNA, 121 bp, Artificial Sequence
  Synthesized
  misc_feature (61): n=a or t
ctaaaagatttaccttgaaaaccagcattctgtcagtgacagatggccaaagcagtcctgnacgtaatgccttaaccacagttagacaaagctgtgtttgttttgttgttttgttttttaa

SEQ ID NO: 4477 - DNA, 121 bp, Artificial Sequence
  Synthesized
  misc_feature (61): n=t or c
ttgaggtaacagtgatccagcgaattggaattttattcagcagttagctggaaactccatnttactgaatgcaaatgtatccatgcatctgtaaatgcaaaaatctcccttactgtgaaca

SEQ ID NO: 4478 - DNA, 121 bp, Artificial Sequence
  Synthesized
  misc_feature (61): n=t or c
tcatgtgggtaaaacagagctggatggagtcatctcagctgggctatgccaaacattccancaaaaaaagtgtatttcaccataactaatgacagaaagtgcaccctagtatttgacaaat

SEQ ID NO: 4479 - DNA, 121 bp, Artificial Sequence
  Synthesized
  misc_feature (61): n=a or g
gcttttgatttccttgctgggtaagtgaggatgcaattgttcaaggctacctttctgtcantagtaagagatcagaatcttcatgtacagtgtacccaggatgtgtttcaccatctcccgg

SEQ ID NO: 4480 - DNA, 121 bp, Artificial Sequence
  Synthesized
  misc_feature (61): n=t or c
aaaaaaaaagaaaaaaaaaaaaaaacagcacggctcgagtaattcatagacctgcacgacngtattgcggatttctgagctctcctgcgatgctgtgggtggctctgaaaagagcctttgg

SEQ ID NO: 4481 - DNA, 121 bp, Artificial Sequence
  Synthesized
  misc_feature (61): n=c or g
tctatatttatgtttagtggctctgagtgggagccaaattgctcttccagagcaatctatntagatgagctgctaactgacccaagaagcaagacccctcaaggaggcatgctggcaggga

SEQ ID NO: 4482 - DNA, 121 bp, Artificial Sequence
  Synthesized
  misc_feature (61): n=t or c
cagatgctaataattggttttttggagatcaaaagctaggcactgataattagaggagcancaggcaaacatttaatctgcagaggaggtgagggtttgtagagtcagaagatcaggcaga

SEQ ID NO: 4483 - DNA, 121 bp, Artificial Sequence
  Synthesized
  misc_feature (61): n=c or g
acatttggaaaggacctacaaagattatcaagtccaactgcttgaccactttgcagctaanctgatgtatgaacatacttgtagtgccttagtttgagcagcctaacaaaagaaaagccca

SEQ ID NO: 4484 - DNA, 121 bp, Artificial Sequence
  Synthesized
  misc_feature (61): n=t or c
tgccttgtgtttccccacaacacccatcggtgactcagagctttgcccttctcctctcatnttccccatggcaagaagaaatagccagcacatgtaaacagaatccttgcagcaggcacag

SEQ ID NO: 4485 - DNA, 121 bp, Artificial Sequence
  Synthesized
  misc_feature (61): n=a or g
tgcctgttttctgccatttctctgagcacagaagaggatttaggcattgaagaggataggngaagagcacgatggagagccattacctgctttgtttctgtggccagctgctgttggctga

SEQ ID NO: 4486 - DNA, 121 bp, Artificial Sequence
  Synthesized
  misc_feature (61): n=t or g
aaggctgaaatattaaggattggtgaatatttgaagtaaagtatgtttaagtcttagtggncttgactgaactgtgttgtttttcaatccagttggccagcccagggaagactattcccag

SEQ ID NO: 4487 - DNA, 121 bp, Artificial Sequence
  Synthesized
  misc_feature (61): n=t or c
gaacctgatacggcagtgccatttcctcaagtccctgtcttagaaagaacctcactgctcngcagcgtgtttcttctgcgagtggctgggaagcttatcccacatacctgggagccgggac

SEQ ID NO: 4488 - DNA, 121 bp, Artificial Sequence
  Synthesized
  misc_feature (61): n=a or g
tgccagaaggtcagtcagcagcacatgaatgatggaaacatagtgagtcttgtggaagaanacagtaaagtgagctgtgggtttactcaaacgtggtagagggaactcagtggtgtttaag

SEQ ID NO: 4489 - DNA, 121 bp, Artificial Sequence
  Synthesized
  misc_feature (61): n=a or g
aagtgtgggtctgctaaaaggtgttctcatcttgcagctcactcctgtgaatataaccacncttcaacagtttatgtagttttagctaataattgttctcacgccttcagggtgtaggatc

SEQ ID NO: 4490 - DNA, 121 bp, Artificial Sequence
  Synthesized
  misc_feature (61): n=t or c
aatgacttttttggttgcacaagctttggggatgaccaatattctgtcgctcttgagatcnttaaatagctttactcatttccaggtgatggagtcaaatcatctgcctaatactgtccag

SEQ ID NO: 4491 - DNA, 121 bp, Artificial Sequence
  Synthesized
  misc_feature (61): n=t or c
tggactggggaagggagaaatcagcaagtattttcatgctcctctgtaatttgaaaccacngagacgtatctcagggtataaatcatacagctccaaaaataacataaattatgtttttgt

SEQ ID NO: 4492 - DNA, 121 bp, Artificial Sequence
  Synthesized
  misc_feature (61): n=t or c
ctttcaccttaaaccacataagatgtgaaatcgcatgagagaaacaggcaggttcggctgngttaagaaccagcggtgcttctgctgcgcgttcgcatcgtatcgagtttagaattcaaac

SEQ ID NO: 4493 - DNA, 121 bp, Artificial Sequence
  Synthesized
  misc_feature (61): n=t or c
accttcatcttcaatgagtctgttaagcctgaaagactggagattttcagtacaatggtgnattttgcacttgaaattagagtaatgaaacaaaaaaaactcaacactttaacacgagaac

SEQ ID NO: 4494 - DNA, 121 bp, Artificial Sequence
  Synthesized
  misc_feature (61): n=t or c
tggatctatgcacgagaaatgaggtgtctgcaacaagcttacatacatcacccatgttttngaatcatgaattatttataactactcagcagtgcatacaaacctttggatggaaagaagg

SEQ ID NO: 4495 - DNA, 121 bp, Artificial Sequence
  Synthesized
  misc_feature (61): n=a or g
agtgctgggaactgtgaattaaaccagtttggtgaaagcacagctctctgcactttacggngtatcaaagtactgctgtgcaatcacgaaacaatcatgtaggtagaaaaaagcagacaaa

SEQ ID NO: 4496 - DNA, 121 bp, Artificial Sequence
  Synthesized
  misc_feature (61): n=a or g
tttacctattattgtcagaggacagtatgaaattgtttgagcgacttcttgtagcaaagcngtataaattcatttccagttcactgttcaatacatagtcctcatgggcactggttgaggt

SEQ ID NO: 4497 - DNA, 121 bp, Artificial Sequence
  Synthesized
  misc_feature (61): n=t or c
ctctgctgtctcctaaaaaccttgagccagcacccacaggctcaatacattaccttcccangaggagagcttgtgctgctttgggttttgtagtcatacaataattaaggttggaaaagac

SEQ ID NO: 4498 - DNA, 121 bp, Artificial Sequence
  Synthesized
  misc_feature (61): n=t or c
cagcaaatgaaagtgtgcagctgctgcccatgcaagttaaccaagaaacatattaaccacngcagagccttgtgttcccatttttgctcttccagcgtcatacatggatccggtgtacttc

SEQ ID NO: 4499 - DNA, 121 bp, Artificial Sequence
  Synthesized
  misc_feature (61): n=t or c
tttcacccaggaagcgctcccactaaatcatgagtgaatgccttggcttattaaattcctngaattaaaaatgtaatgagcctagtctcagacctggttaatagtttatgtctaaaggatt

SEQ ID NO: 4500 - DNA, 121 bp, Artificial Sequence
  Synthesized
  misc_feature (61): n=c or g
aaaaccttggagatgccggtttacataaattatcacctctctgtgttgtggcttatattanagatctatattgccaacattttcagaggtgttccaccctattcccagtgtccattatcac

SEQ ID NO: 4501 - DNA, 121 bp, Artificial Sequence
  Synthesized
  misc_feature (61): n=c or g
actagtttaggaagtccttgttttcagagacccaaattatatttggtctcagagctcccanatgaagtccatatccatgggaaattttgcctcccagcagactcacctcctgatggcctaa

SEQ ID NO: 4502 - DNA, 121 bp, Artificial Sequence
  Synthesized
  misc_feature (61): n=a or t
tggtaccattcagcacttctatcaaaacagaacacccacacctaatcaagaatggatttcnattcataatatatactggacacaactgtactgacacaattccttgatctgagaagttcat

SEQ ID NO: 4503 - DNA, 121 bp, Artificial Sequence
  Synthesized
  misc_feature (61): n=a or c
tgtgcaccccttcataccccttctttccttatatcagaagagagcagcctcagccattctnagaggcaaaaacaaaccatgttttgggaactcagagcaggaatctaaggacacgactgtc

SEQ ID NO: 4504 - DNA, 121 bp, Artificial Sequence
  Synthesized
  misc_feature (61): n=a or t
ttgtcttacattgtgttattgtgtcaacctgcattgtgatgggctgaaagtgaggaaacgnttttccctgcctagtcttagtactgatgaacagacaccaaggacagcaagagagaaagaa

SEQ ID NO: 4505 - DNA, 121 bp, Artificial Sequence
  Synthesized
  misc_feature (61): n=t or c
gatattcttcagagaattcgacaggctcatgtgggtatagagcaatgcaaatggaaagcanagggtatgtacacgcagcagcctcctaaaagactcaaatattagaaaaatagtctaagaa

SEQ ID NO: 4506 - DNA, 121 bp, Artificial Sequence
  Synthesized
  misc_feature (61): n=t or c
cattttcagccagctgacatttgcctgaattacacaagatgccaccaccacagctggcacngtcccatatgctttgctggaagcgaggctgcagaagcccagaaccagcctacgcttcccc

SEQ ID NO: 4507 - DNA, 121 bp, Artificial Sequence
  Synthesized
  misc_feature (61): n=t or g
tggagttggaagggttcctgtatgagtgaatccagcagtacttaccaacacatttcctttnaacttgggtcagaaggtgattgtggtttgtggtaggtgtttagtgtttccaattcaaccc

SEQ ID NO: 4508 - DNA, 121 bp, Artificial Sequence
  Synthesized
  misc_feature (61): n=t or c
aacttcttgggcacctgtgtggtagtatttatcttttagcttggagagacagcagaataanagggggtgtgtgctggattcatacttttccagaaataaccaaattagtaaaacaggaaga

SEQ ID NO: 4509 - DNA, 121 bp, Artificial Sequence
  Synthesized
  misc_feature (61): n=t or c
acttaaagaagtattaagggaaaatgatctgcttcgcaaggatgtggaagtgaaagaaagnaagctgagctcttccatgaacagcatcaagaccttctggagtcctgagctgaaaaaagaa

SEQ ID NO: 4510 - DNA, 121 bp, Artificial Sequence
  Synthesized
  misc_feature (61): n=a or g
aaggtgaatgtaaccagtaaatttacaaaaatataagtatgaattaggcttgtttcagagnctgatcatggtatttaaggtgaagggtgagtggagcacagtttgcagatgattagtagct

SEQ ID NO: 4511 - DNA, 121 bp, Artificial Sequence
  Synthesized
  misc_feature (61): n=t or c
gggaatctctgggagggacctgctggtgcctgtgaggcaatggcctgtagctgcccaccantgaagagcctgtcccagcagagacctctcaggtcctttagatccctgctctgagggactg

SEQ ID NO: 4512 - DNA, 121 bp, Artificial Sequence
  Synthesized
  misc_feature (61): n=t or c
tttttattactttatttttattctatttattaaaaaaagtgtcaaaaactggatcccatgntgcttcaatagtgactgtagctgtgtcagcacagctactcctaggcagcttcaatctttc

SEQ ID NO: 4513 - DNA, 121 bp, Artificial Sequence
  Synthesized
  misc_feature (61): n=t or c
atctagaaaaatgttatcagttgtttaggtttctgacaaacataaggtggcatgttaaacnggacaactgaaatcattacgaggcagctttaagtaagcacatctgggctgcccatgtagc

SEQ ID NO: 4514 - DNA, 121 bp, Artificial Sequence
  Synthesized
  misc_feature (61): n=t or c
attaccttctaaagtgttccttctgccatcccctccaatgattacttcaaattcatactcngatactggatgggtttttggatggaccaatgcacgccaacctattcctgtcaataaactc

SEQ ID NO: 4515 - DNA, 121 bp, Artificial Sequence
  Synthesized
  misc_feature (61): n=t or c
cctctggcagaggcaggacccagcacctaaaacaggctctgtcacacagagcatttcctcnccacatacacactttgtgttactcccctcacggagctctatggtgcctgtcagtctcatt

SEQ ID NO: 4516 - DNA, 121 bp, Artificial Sequence
  Synthesized
  misc_feature (61): n=t or c
ctacggacattactgtgcctatattcgaagtctcacagaatgcaaatggtattgcttcaangattcttttgttgagcaggtaaggagacaaatccacatttcttttgtagctttccagaca

SEQ ID NO: 4517 - DNA, 121 bp, Artificial Sequence
  Synthesized
  misc_feature (61): n=t or c
ggggttttctgtgttgctctctcttgctacaacatcttgatcttgtttaggtgtctctagnaatctagttttcactgctagcacttctccaactgctagcacagcagctgcaatgctttgg

SEQ ID NO: 4518 - DNA, 121 bp, Artificial Sequence
  Synthesized
  misc_feature (61): n=a or g
tgacctgaaaaagttaatgctctattctggagaccaatataatagttggtatcttacttgncttatcaggttttcttttgtaaatatgttgaagaaagctctctgtgatggcagtggtatg

SEQ ID NO: 4519 - DNA, 121 bp, Artificial Sequence
  Synthesized
  misc_feature (61): n=t or c
ttagaaaaacttttctactggcagaaatttctgtactggaaatcaaggatactgtgagtcnttatcaacacctgtcagacacatctatttgtcactgcattgctaaatgtctacagcagcc

SEQ ID NO: 4520 - DNA, 121 bp, Artificial Sequence
  Synthesized
  misc_feature (61): n=t or c
aaggaaatgtctcctgtctgaagagttcagccgacggtgagcctgctcacccaaccttccngcatccccacatgaatttggtgaagtgtcttacacatgaggaaacagagaaatgactgtt

SEQ ID NO: 4521 - DNA, 121 bp, Artificial Sequence
  Synthesized
  misc_feature (61): n=t or c
tctagtttgggaaaacatcatgcaatgctttaaattcaatgtgaatttgttgcagagtgangtaccttatttagctcctaccctttggctttagcaaagaactaaatttgcaatcttttaa

SEQ ID NO: 4522 - DNA, 121 bp, Artificial Sequence
  Synthesized
  misc_feature (61): n=t or c
ttttcaagctctcaattttagttggttgttttgggtagcactaggtaaaaactattcattnggttttatggaaagtttatggaagctttaaacagagctgaagccctgcatattgaaattc

SEQ ID NO: 4523 - DNA, 121 bp, Artificial Sequence
  Synthesized
  misc_feature (61): n=a or g
aaccaggaaaatctgatctgcagcattcctctgtgaggaacacatggctaaaaagtcacgntgagggtatagctgccaccagtgtgtgtgtgagagtctctttcctgtagtgcaaagtgga

SEQ ID NO: 4524 - DNA, 121 bp, Artificial Sequence
  Synthesized
  misc_feature (61): n=a or g
aaccacagctgctaggattcagggaaataatcgagaagggacctcgctgtgaagcttgctncatgttcataagctcagcttgccctggagtcttccagttaaaagacctctggatgatagg

SEQ ID NO: 4525 - DNA, 121 bp, Artificial Sequence
  Synthesized
  misc_feature (61): n=a or g
cacttattattcttaattgccttgcctataatgggcatgtttgaaccctgcacaaaaagancagcttatacaagcataccttcacccacaagaaagctcagagcattcatcagtgtaagtt

SEQ ID NO: 4526 - DNA, 121 bp, Artificial Sequence
  Synthesized
  misc_feature (61): n=a or g
ctggagatggtcagtcagtaaccactaagaatctacacagagtggtggagagtatgacaanctgtaggcatgtaagcaaacattaatggccaagagaaataaaagcagattttccttttct

SEQ ID NO: 4527 - DNA, 121 bp, Artificial Sequence
  Synthesized
  misc_feature (61): n=a or g
aaagaaatcaaatgatcagcacttttatagcactacattaacaagtgtatcacaaacaggnatggaacatttctgtagaccaattagtcatctgaatcttctttgccacccttcttcccct

SEQ ID NO: 4528 - DNA, 121 bp, Artificial Sequence
  Synthesized
  misc_feature (61): n=t or c
cgtgctcgtgagctggggagcctgggtgccaaaatcaatagtgctgcctgcaacagcctcngctcttcttgctttcagggttagtgtcatggtggggcccggagggagggcgggtgatgtt

SEQ ID NO: 4529 - DNA, 121 bp, Artificial Sequence
  Synthesized
  misc_feature (61): n=a or g
ataatttggattgttccaaagatactgagcacctttctcaacaactgtggtttttggaggnggaggaagatggttttatttccattagacaaagtggtctggggacctttcacccattctg

SEQ ID NO: 4530 - DNA, 121 bp, Artificial Sequence
  Synthesized
  misc_feature (61): n=a or g
tctatcccacccatgtgctttgtttctgtctgacttcttgtttctgaaggagccctggccntagcccggttaacttaacttgctgcatcatactgaccgcatacaccctcaagtggtccaa

SEQ ID NO: 4531 - DNA, 121 bp, Artificial Sequence
  Synthesized
  misc_feature (61): n=a or g
tgacttaaatttgagttcctaggcttaccttgtacatcagccattcctctcaaccttccantccaactgcagtaggtaggatctcagaaggcacctgtaaaccaccagaggtcacaggagg

SEQ ID NO: 4532 - DNA, 121 bp, Artificial Sequence
  Synthesized
  misc_feature (61): n=t or c
tcatttggccatttagagggcaaggcagccttcctgagtagaaataatctcaacctcacantagtaagctgcacactagtaaactggtctgcagttgagaaaactgtgatctctgcaataa

SEQ ID NO: 4533 - DNA, 121 bp, Artificial Sequence
  Synthesized
  misc_feature (61): n=a or g
tgtctccttggttcttctccacagagcctgggcaggaacaaacccacagcctcactacaanctggacagcatttgggcagcagagcctggctttaaaaggcaaacaccagataggcacgtt

SEQ ID NO: 4534 - DNA, 121 bp, Artificial Sequence
  Synthesized
  misc_feature (61): n=a or g
agaagcaataacctgagcaggaagtctttctaataaggataacaaacaactagcaaatgtntaggctaccaatcttttaaatcactttttaggcaacataccaatgatacagagtgaatgt

SEQ ID NO: 4535 - DNA, 121 bp, Artificial Sequence
  Synthesized
  misc_feature (61): n=a or g
tcaaagaaaggtcaatgagcagagcagacactcaagttagactgagaaaatcagtatcagnaaatatttcaaccaagtgaacgggagaaatgttccctacaccagcacaaacctgctagtt

SEQ ID NO: 4536 - DNA, 121 bp, Artificial Sequence
  Synthesized
  misc_feature (61): n=t or c
ctaatgcacactttcttctgagtttgtatcaagccctagacagtgggaatgcctactccangctactccattacagtggtagctggatttttctatagtggttaccttgtcttataccagg

SEQ ID NO: 4537 - DNA, 121 bp, Artificial Sequence
  Synthesized
  misc_feature (61): n=t or c
ctacataacctctaattgttcctctacaccactcttgtacagcaggactgcaaacagtacnatcagatgttgttatactctgcttgaaggaaaattagaaggtttttgctaataaatgatt

SEQ ID NO: 4538 - DNA, 121 bp, Artificial Sequence
  Synthesized
  misc_feature (61): n=a or g
tttgttctcctaccttttctacccaatcctataatagtgtttaattgcaccccatattgtnttgtacctaatataatactttcgtcatctggcaagtgcaaatacaggaaaagcatatatt

SEQ ID NO: 4539 - DNA, 121 bp, Artificial Sequence
  Synthesized
  misc_feature (61): n=t or c
tactacattcctgtatcgcccttctaccacattaacctctctgattatgatgctgaacctnatcccactggccctagcctacctagattcctctacaggcccttcctacccccaggaagat

SEQ ID NO: 4540 - DNA, 121 bp, Artificial Sequence
  Synthesized
  misc_feature (61): n=a or g
tttccttctaccagttttgatgagattgcactgcaactaagaaatacattaatggctaatngaatgattgtagggagctacaaaagcgtatgtttcctctgcaatctttacactcccgtcc

SEQ ID NO: 4541 - DNA, 121 bp, Artificial Sequence
  Synthesized
  misc_feature (61): n=t or c
gtggaaacatctacaaatacctgatcttaaactttgttttgctcagattcttaaggcattncgcatcctggtcctgtttttggcttatacattacaagactgaaaatggtacagtcattac

SEQ ID NO: 4542 - DNA, 121 bp, Artificial Sequence
  Synthesized
  misc_feature (61): n=a or t
catagtgtgattcaagcagtgaattgcagcagtgttggcatcgataatattaatagctaantacaatttggtcagttattgcagtagacctgggacttgcacagatcctaggcctagcacc

SEQ ID NO: 4543 - DNA, 121 bp, Artificial Sequence
  Synthesized
  misc_feature (61): n=a or t
aaatactgctttgactgcccacatctgactcactgtttcaggagatgtaagctctttaaangtaatactgcctttggcctttcaaggagtttgtatgatattacgtagaatcagatcatta

SEQ ID NO: 4544 - DNA, 121 bp, Artificial Sequence
  Synthesized
  misc_feature (61): n=t or c
agatgctgcaacaccacttgtgccctgagcatcccacatctgtgtttttctcggtggctgngagcatcctggagcttgtggtccaagatgcagagctgcagtcgttgttttggtagcagca

SEQ ID NO: 4545 - DNA, 121 bp, Artificial Sequence
  Synthesized
  misc_feature (61): n=a or g
acgttactggcgcttcatgtattcaagctcctaaaaccagtaaaggctataagatcaagtngtcaatttcctgagctctgtgattgtggtcaatttcctgagctctgtgattgtgtctccc

SEQ ID NO: 4546 - DNA, 121 bp, Artificial Sequence
  Synthesized
  misc_feature (61): n=t or g
ctcagatgtgcagttacaggactcatgaagttaaaagtctagtttactaatcaacatgctnctttcatcatcatcatctaaactgccctccacaccagaaagaaagtttgcaagagtgctg

SEQ ID NO: 4547 - DNA, 121 bp, Artificial Sequence
  Synthesized
  misc_feature (61): n=a or g
cagtcttaactctctgactaatgtagttctaaattaaagaataaaaaagtgaaacgtctanagattcatgagtttgttacaactacagaagaaatacagccattttccccaagtagtatgc

SEQ ID NO: 4548 - DNA, 121 bp, Artificial Sequence
  Synthesized
  misc_feature (61): n=c or g
gagatacttgtttaagaaaactttatattctctattgttcaagcatgctctgagagatcanacagcatatttctttagttaagatggcagaatttgttcttcagtcattctaccagtatct

SEQ ID NO: 4549 - DNA, 121 bp, Artificial Sequence
  Synthesized
  misc_feature (61): n=a or g
ttatagcaggaagagatttcttggataaaaatgtggaaaaaatctctggaatgtctacagnggtaacactgtgctgaccacacataagtgaattaaagcaatgagaacttctttgaaaaga

SEQ ID NO: 4550 - DNA, 121 bp, Artificial Sequence
  Synthesized
  misc_feature (61): n=t or c
cctctgagaagtaacaaaaagttaccagactgaagcaaaatagaattttcagatttggaanatgaaaaaactttaaacataatgttaggatttacatgagacaggacatttgacatccatg

SEQ ID NO: 4551 - DNA, 121 bp, Artificial Sequence
  Synthesized
  misc_feature (61): n=a or g
acacggtttcagtttcttctattaatgaaccccactggaagataaaaatcccaacagaccntttctaagaaatcaggatataaggtgccactctgaagtgcttgatcaataatatatgcag

SEQ ID NO: 4552 - DNA, 121 bp, Artificial Sequence
  Synthesized
  misc_feature (61): n=a or t
gctgtaagacacatggaaagaggttaagctatctttctgtaaaatacttgacagaataggnttgggtggattttgcctgagttgcaaagaaagccacagagagaggggatgtaatgttgga

SEQ ID NO: 4553 - DNA, 121 bp, Artificial Sequence
  Synthesized
  misc_feature (61): n=a or t
tttcataaagctctgatctgtatctctgcctgctgtacaataggagatgaggtatcagagncactctgacttctcatatgaaactttcattccagtatatcctatcagagattttatttga

SEQ ID NO: 4554 - DNA, 121 bp, Artificial Sequence
  Synthesized
  misc_feature (61): n=t or c
agaactcctctgtgggagggttactttataattatccacggcagtgtttcttctctgaagngtttaagtcttgaccagtgggggtaaagataatgggccgtgcagatctgtggtgttcttt

SEQ ID NO: 4555 - DNA, 121 bp, Artificial Sequence
  Synthesized
  misc_feature (61): n=t or c
tgttatattgggatttgctcttgctctactggtgtgaagcattactaagtatgggagggcngtgagtgcaggtgttgaccactgtaccacactacttgagggtggtaggctgcctataata

SEQ ID NO: 4556 - DNA, 121 bp, Artificial Sequence
  Synthesized
  misc_feature (61): n=t or c
ttttaaaaaaccaaaacggctcatcttcagaaatgatctcattttccagcatcaaggttantgaaagccacacaagcaaggaaagcaacaccagaaggaatggaagacaatcggcagacaa

SEQ ID NO: 4557 - DNA, 121 bp, Artificial Sequence
  Synthesized
  misc_feature (61): n=t or c
tgattgaattactgaactccgggctctgtatgccgtgtctgtccttttccatctttatttnctttttcttaatgtgagagagacccagttaagatccccgagactcgccttctgcgcgctg

SEQ ID NO: 4558 - DNA, 121 bp, Artificial Sequence
  Synthesized
  misc_feature (61): n=c or g
gagagctgtcagcgtttattgcaacaaaaggaattagtcatcacagggctttgtcatgaanttctgtttgtctgtctcctatcccagaaaaagcagagaagctgctttttattaccgcttc

SEQ ID NO: 4559 - DNA, 121 bp, Artificial Sequence
  Synthesized
  misc_feature (61): n=t or c
ctatttagatcagacagatgtagccattcagttcaaggggcatggatttcacctgaagaangatcacctgtgtgtctcctttgatgatgtaaagtgacacattgtgaaagacaagagagaa

SEQ ID NO: 4560 - DNA, 121 bp, Artificial Sequence
  Synthesized
  misc_feature (61): n=c or g
gagcccacttggtgggaagggatggccatttctggctactgtaggaaggaagccatgtatncctgctttcttggaagccttgggagagggaggagggagaaaagtacaaaaagcccagcga

SEQ ID NO: 4561 - DNA, 121 bp, Artificial Sequence
  Synthesized
  misc_feature (61): n=a or g
gggcaagtgctttctttcaggtcacccaagaagcctgtggctgaggaggacctgacacacnattttccctggagcgtgcctacattcaagtaattgccgtagccagtctaaatacctgtcc

SEQ ID NO: 4562 - DNA, 121 bp, Artificial Sequence
  Synthesized
  misc_feature (61): n=a or g
gttaatctggtattagcaagactgatgggaggaatccaggctggagaagagtgaagcagancgctggcgacagcaagtgctttgccttctctggcacaaacccaagaaagaggagcagctc

SEQ ID NO: 4563 - DNA, 121 bp, Artificial Sequence
  Synthesized
  misc_feature (61): n=a or g
taattctgttcttaacagccactggacagacctgcagctgacctaccagcagcagtcaacnacagctgagattggcaagagaccgaaaagggaacgtggaggctgccccttcctgtggcat

SEQ ID NO: 4564 - DNA, 121 bp, Artificial Sequence
  Synthesized
  misc_feature (61): n=a or c
ttccatctttttgacttctttccctcaggtatttctacacatagataatatcacacctttnctttgcttgagaccctcctgtttcttttttattccctcattaggttatcatagcaaatgt

SEQ ID NO: 4565 - DNA, 121 bp, Artificial Sequence
  Synthesized
  misc_feature (61): n=t or c
gaatatgttgtccttctgtactttttattaagattatagaagtaagttgtgccttgttagnagggtctactggtcagaattaaatatagtcctttatgtctttatttgatattagttgggt

SEQ ID NO: 4566 - DNA, 121 bp, Artificial Sequence
  Synthesized
  misc_feature (61): n=a or g
attactgtagtggcaatagctttaatgtgcttgccagtcataccacattacaccatcatgngatttctattagaatactaccacagggactttttgtggagtatttttttttttttttttt

SEQ ID NO: 4567 - DNA, 121 bp, Artificial Sequence
  Synthesized
  misc_feature (61): n=t or c
catgcaggattgccttggtagcactgagaatttgtagtgctgttagcatcttcttttcctngcccagacagaacgtaattagatcccgatcactggtcctcatcctgttttaatcaaagca

SEQ ID NO: 4568 - DNA, 121 bp, Artificial Sequence
  Synthesized
  misc_feature (61): n=t or c
aaaaaaacaaacacaaaagaaggttttgttcttgttttacaacacagtaagcaacagaaantctgaaatgagcattttcaaatctctctttggcagcctctcttgtaaactgagaaaaatg

SEQ ID NO: 4569 - DNA, 121 bp, Artificial Sequence
  Synthesized
  misc_feature (61): n=t or c
atgaacgtttttggtgaaagacaaaagctgctggtaagccccagtctccttcatgccctcntgcaattcttctgttgtgacagtgttgtgttggcagtatcttccctcttttccttcagtc

SEQ ID NO: 4570 - DNA, 121 bp, Artificial Sequence
  Synthesized
  misc_feature (61): n=c or g
atcattggagactcctggttttgtttttcttttagacaagaataatgctagtaatcagcanctttatttgtttagctggtatgagtatggtggccacatacaagtcatagaaatccagaag

SEQ ID NO: 4571 - DNA, 121 bp, Artificial Sequence
  Synthesized
  misc_feature (61): n=a or c
taattaactgagaatacaataatgaatgagaaggcaaaactgtgatgcaggtgtttccccnaactgtcaattattctattaatatttcattatgttttcctatttgtgtacatgtttgtaa

SEQ ID NO: 4572 - DNA, 121 bp, Artificial Sequence
  Synthesized
  misc_feature (61): n=t or c
tgtgtgtgttgttataacagggttatacagtctacttgcataaaagaccataggttctgtncatcagtgtcaagagttaaactgcaacactgggaaatccaggtttctttcttatgttagc

SEQ ID NO: 4573 - DNA, 121 bp, Artificial Sequence
  Synthesized
  misc_feature (61): n=c or g
tcagtattcaccacaggttaaaaagcaagagctgtagggtatccagggcagcctactgtcnacatacatatcaactgctgccctacagcccacacaaggccatagtcagctgtgcctcagc

SEQ ID NO: 4574 - DNA, 121 bp, Artificial Sequence
  Synthesized
  misc_feature (61): n=a or g
attcacatagtattgacacaggtatgtgggtatgggaggtgggactggtataaagctatcngcctccaccccagaaagttcaccttttaggaaaccacaattattcactgttctcactggt

SEQ ID NO: 4575 - DNA, 121 bp, Artificial Sequence
  Synthesized
  misc_feature (61): n=a or t
agttttttcaggagatagcagtctccggttttagcatgtctctaccttactttaagcagcntttcattgctttgaagatgcaaatgtctcttcataaaacattggtggcacctgatggtgt

SEQ ID NO: 4576 - DNA, 121 bp, Artificial Sequence
  Synthesized
  misc_feature (61): n=a or g
aggaattaggcagtatttttacccttacaggcatgaaagctgtgaatatatatttcctgcngcacagcaccatgcagctagcaatccatacctaaatctgaacaggatgaaaaggaatttg

SEQ ID NO: 4577 - DNA, 121 bp, Artificial Sequence
  Synthesized
  misc_feature (61): n=a or g
gccataagataaataatcagccctgaaggccatgtttgcactttctgaaaaagttactccngattttcaggatacgcaggaattatctagtcttaaaaggccgtatttattttgctgtctt

SEQ ID NO: 4578 - DNA, 121 bp, Artificial Sequence
  Synthesized
  misc_feature (61): n=t or c
gagccatgcagtgtgtttaggagtttcaggttaaagctggagagggagctgctctagcaanaacaggttgaggctgtgctgcagaaagtagtcctcctaatcacaaaacttacctgcacat

SEQ ID NO: 4579 - DNA, 121 bp, Artificial Sequence
  Synthesized
  misc_feature (61): n=t or c
tgattgcttttgacttatttgtgagttttgcgtttttttattagattgtaaggagatatcnatggcctgtatgaaaatcagtcaaaatcctaaactatcttgcaaaatggaggtttttctc

SEQ ID NO: 4580 - DNA, 121 bp, Artificial Sequence
  Synthesized
  misc_feature (61): n=t or c
actatgtggaggtcctttaccatcagcccagtagagagaaatctctgtaaatgagagagangattgctttttgaagcattcattgggaaagaagtgacactgcacactgacctctctagga

SEQ ID NO: 4581 - DNA, 121 bp, Artificial Sequence
  Synthesized
  misc_feature (61): n=a or g
cacaacacatttatttggcagcctgatcaaagagggatgggtgcactagggcagacaagtntatcaaagtagtgcattttgaaatggctgagttagtttccctagaactgtgtccctgtga

SEQ ID NO: 4582 - DNA, 121 bp, Artificial Sequence
  Synthesized
  misc_feature (61): n=a or g
tccaacatctgtattcacagctactaaaagattgtcttactgtcagcaacagaacaacgtnataaaatttaaaactgctgtattgcttaagtgaagctttcaaattaattgaagtagctac

SEQ ID NO: 4583 - DNA, 121 bp, Artificial Sequence
  Synthesized
  misc_feature (61): n=t or c
aactattacatttcccaattttgtagtatgctggtggactctgccaacgtttttcttgccngcacattcttcttgtgctgtggcttctctgagcatcataatgaaaagcgcctgacagtgg

SEQ ID NO: 4584 - DNA, 121 bp, Artificial Sequence
  Synthesized
  misc_feature (61): n=t or c
tcatttctgtagtggaactttaccaataaattgtcagttgtccaacgcaactgataatccntgcttagtaatcagttctagctgctttcactttcactatctgtacatacaatgtcaaaac

SEQ ID NO: 4585 - DNA, 121 bp, Artificial Sequence
  Synthesized
  misc_feature (61): n=a or g
agaagtgtcacttctatccttccagtggatagtaaaactgacatttaaacaagctactccnagttgagagagattcttaccattaggtttgcagaatcatgctaatctctgcatacaaatg

SEQ ID NO: 4586 - DNA, 121 bp, Artificial Sequence
  Synthesized
  misc_feature (61): n=t or c
aattatttttaagtgaaatttgacttatcctttcctgaaaaaataaatatacttcaactangaaagagataggaagacggatcagtaggtgcctcctcagctggtgtgaatagatactggt

SEQ ID NO: 4587 - DNA, 121 bp, Artificial Sequence
  Synthesized
  misc_feature (61): n=c or g
agaactttatgctgttacttcctatggatttttggcaggcttggagaatccaggaaagcanatttttacatcaacatagtacattagtgaaaacagaattgctattaaaaaaacaaacaaa

SEQ ID NO: 4588 - DNA, 121 bp, Artificial Sequence
  Synthesized
  misc_feature (61): n=a or g
attaagcaatctcactgtagaccaaaatggacagaagcattttagacaggttattaaaatncaaagcaaaaccacccgcaccaaaaaaacaactcagtatacacagatttattactgccag

SEQ ID NO: 4589 - DNA, 121 bp, Artificial Sequence
  Synthesized
  misc_feature (61): n=a or g
aatcaattatgtgttcacctgtacaaactgtagaatctgctttgcttttaatattcctatnacatacgaagatgctttaccatgcaaaggtcaaggatataatttgtcaagcagtatatat

SEQ ID NO: 4590 - DNA, 121 bp, Artificial Sequence
  Synthesized
  misc_feature (61): n=t or g
gtatgctagttttacagcattgctcactgcagtgccatgttctgcactctctgagcatganggcaatggatgccattactcctggccctacccatgtctcaccagcagctctatcagagct

SEQ ID NO: 4591 - DNA, 121 bp, Artificial Sequence
  Synthesized
  misc_feature (61): n=t or c
tggacttcgaggcatggagtactttgtcagccaaaccatgaagtctaagagggaatataantgacacaaagtcagagttgctttaatggtcaaagtgacattatctaaaaccagctacaga

SEQ ID NO: 4592 - DNA, 121 bp, Artificial Sequence
  Synthesized
  misc_feature (61): n=t or c
catagagaaataagtaaaacctttgcagaatgtctctctgtaaatcaatactgatgatgtntgtaagtgtacattagcttccttgtcttatgaactacaagaatcagtcaaatagttgcac

SEQ ID NO: 4593 - DNA, 121 bp, Artificial Sequence
  Synthesized
  misc_feature (61): n=t or c
gatgagattccaaaactgagtatacattacttgaaaaagagataaacacttaatgctgaantgctttaagtcaagcactagaaatggagctccaggtatgtgtctcacagatgcacaaaag

SEQ ID NO: 4594 - DNA, 121 bp, Artificial Sequence
  Synthesized
  misc_feature (61): n=t or c
tacatagaattagtgtgaaaatccacctgagattctctgaatttctattgcttgtcatttnggagcaaataatttgtaattaacccagtgataagagcaatttcaattttccactaaaaag

SEQ ID NO: 4595 - DNA, 121 bp, Artificial Sequence
  Synthesized
  misc_feature (61): n=t or c
tcttggttggtccagcaaacagttacctaaaagaacaatccaacctattattactcactanctactttttctgcagtgctgcaaatctgtcattcaaatcagggagaccgataatgacagt

SEQ ID NO: 4596 - DNA, 121 bp, Artificial Sequence
  Synthesized
  misc_feature (61): n=t or c
agattaataattacggacatacgcagcgaatccctttaaaagatagtaacatttgaggagncacctcatgttaaaaataagagtcacgttactccgagaaccatccggaatcccacggtgt

SEQ ID NO: 4597 - DNA, 121 bp, Artificial Sequence
  Synthesized
  misc_feature (61): n=t or c
agcggttgagtgccaggtgtaagtactagtctgtttacactgaatgcctctgtccttgccngaaagtcctctgtcagtggaagctgacactgcattcttcctggaaagtagttaaatggcc

SEQ ID NO: 4598 - DNA, 121 bp, Artificial Sequence
  Synthesized
  misc_feature (61): n=t or c
cagagcagaaaaagggatgaaaacccatttgtccagcaaaagtcactcttacagtgtactnagtttcacagtttgtctttcaacacagctgacagaaagaaagaaagaggagagaagagat

SEQ ID NO: 4599 - DNA, 121 bp, Artificial Sequence
  Synthesized
  misc_feature (61): n=t or c
ctggggcatccactgcaattgtcaacatcaggttgatggatgtctcaatttttcctgtttntaggaagtaaggagtttgttcttttgtagagtcctgagcaattttctgacttggagcaga

SEQ ID NO: 4600 - DNA, 121 bp, Artificial Sequence
  Synthesized
  misc_feature (61): n=a or t
tgttggggcttaaaaaaagtggggctacatacgccttccaaagtaaaggattatcttgagnttcagacactccaagggaggatttcaagatgctatctaaagttttcacttaagtcaggtg

SEQ ID NO: 4601 - DNA, 121 bp, Artificial Sequence
  Synthesized
  misc_feature (61): n=t or c
acactattcagtgagggcaactcagagatcacagctacactaagcagttgcctccaaactnagtgagtgttgtacctcatgttccagggaggacacaaagtgtggtggcaagggcagggtg

SEQ ID NO: 4602 - DNA, 121 bp, Artificial Sequence
  Synthesized
  misc_feature (61): n=t or c
ctgtttcaccagtcttcctcatgcttcccttcctcctaaactcccagtgctattcacaganctcttaaaaatcaattgaacttccttcttctagcagctctctgccaagtggcaagaagca

SEQ ID NO: 4603 - DNA, 121 bp, Artificial Sequence
  Synthesized
  misc_feature (61): n=a or g
tggctcctgtagttgtaggaaacatactcaattgaaatttaatggtgtacaaaccgtatcntgagcaactattttaaaccatattattttccactgttcccaagcttccatataagaggtt

SEQ ID NO: 4604 - DNA, 121 bp, Artificial Sequence
  Synthesized
  misc_feature (61): n=a or g
aaaataaagaatgataaatttgatttattatcttggatatggacttgcagtgcctcccctntaaaacccatgaatgatacctcaaacttagtgcctattaaactatctgatagtagacaga

SEQ ID NO: 4605 - DNA, 121 bp, Artificial Sequence
  Synthesized
  misc_feature (61): n=t or g
gcaaggctgggagccataaaatacatctaaacaagaaagaggtcacttatttctaacaggntgggaagctgttccacaggttactctcacacaggaggtaaggtgactccacattgcctgc

SEQ ID NO: 4606 - DNA, 121 bp, Artificial Sequence
  Synthesized
  misc_feature (61): n=t or g
acttcaatatcacaaaaattgtcatcaatatcctatgtgcaagaagataaacagtctcatnatatgttccaaggcataagcctaaccaggtaatataaatggcaagaaaggtatggctgtt

SEQ ID NO: 4607 - DNA, 121 bp, Artificial Sequence
  Synthesized
  misc_feature (61): n=c or g
ccttgagagctcccaactcataaggccaggcagggctcctgcattatttgcagcacagttnaatggaccctctacaggacaagaagcccagctccagaaatcatataatcacagacagaac

SEQ ID NO: 4608 - DNA, 121 bp, Artificial Sequence
  Synthesized
  misc_feature (61): n=t or c
ggagctgttgctccctctccttgtttcaagtccttcagggcacacctgttaccctgtagcntcctttgggcgatctcttctcttttccaagtgttgaagttcttaatgtcgctctagagca

SEQ ID NO: 4609 - DNA, 121 bp, Artificial Sequence
  Synthesized
  misc_feature (61): n=a or g
gcagggcagcaccgtgtgccatgcatcctcctgcactacccagcctccgttgtaacagcantcagaagcttcatgcagaagcttgagagcatctttgagccaaagaacaggatgagctgag

SEQ ID NO: 4610 - DNA, 121 bp, Artificial Sequence
  Synthesized
  misc_feature (61): n=a or t
ccagtgctgaaatattgatgggagttgggagggcatgttaactctgttctttatatacttntggtctcttacagttttgaaaggtgggtgtgaagtggttctgtcctttttcatctgcttt

SEQ ID NO: 4611 - DNA, 121 bp, Artificial Sequence
  Synthesized
  misc_feature (61): n=t or c
cacagaagaagttaatagcagcctcccaaaagttgattttggtagtgttttgtacttctgngttttagttcacttattgctcctgtaaaattgtgtttacaattgggtacaattacaaccc

SEQ ID NO: 4612 - DNA, 121 bp, Artificial Sequence
  Synthesized
  misc_feature (61): n=a or g
atccctacttcctcattcatttgccctttaaaggagaaatcagaagtcagtcccaaaggantgactcaggtacctaaaatttgaggtggtggacttgtgttttcacacagaattagacaca

SEQ ID NO: 4613 - DNA, 121 bp, Artificial Sequence
  Synthesized
  misc_feature (61): n=t or c
gctctcgctcctggcaatgataggagacgtggacagcaaaccagacagttccttcatgatngacaacgatcccagccgctgcatgaggcatcactatgtggactccatcagccaccccctg

SEQ ID NO: 4614 - DNA, 121 bp, Artificial Sequence
  Synthesized
  misc_feature (61): n=c or g
caactggccgtagcacggtggtgcttagctagtttcaggcaaaaacatgcactcgttctgntaatactctaggaaaatacactcagagagcttgtttctccttgagaagagtgtatattcc

SEQ ID NO: 4615 - DNA, 121 bp, Artificial Sequence
  Synthesized
  misc_feature (61): n=a or g
tgttttgtggatgtagaggatgtggctcggcatcttttctaagctcctggtgcgtctcctnatggaaagtccttcccgacccctaaggccgcctttggccgcctctgcggggctgaccttg

SEQ ID NO: 4616 - DNA, 121 bp, Artificial Sequence
  Synthesized
  misc_feature (61): n=t or g
tccttactttcctcctccctccatccagaggcaggggatgaaccaggcctgcgggtgctgngctgtgcttagtgcttggtacacagtgaggcctttccttgcagggcagccttcacatttg

SEQ ID NO: 4617 - DNA, 121 bp, Artificial Sequence
  Synthesized
  misc_feature (61): n=a or g
tttgtagtggaatgatgtaagatgtgttcaaaagaaaacagtttcagatatgaaaaggtantaatctctggcaaagggtcagtgacaagataagagaataaccttgtcagacagccaaact

SEQ ID NO: 4618 - DNA, 121 bp, Artificial Sequence
  Synthesized
  misc_feature (61): n=a or g
ttccccatgctctcccagaacagcttcactcctttctcgagttcatggtgaaagacagacntgttgcaaagaagtagggaaaagatgaactagtactcacctgtccatatttctctgttgg

SEQ ID NO: 4619 - DNA, 121 bp, Artificial Sequence
  Synthesized
  misc_feature (61): n=t or c
tgttcctgaggtttgcagcaagtgatatattggtacaggacttactataacactgtggttngtgctattaagcacatctgcaaatcagaggatgtctagttctccccacaaaatgaataca

SEQ ID NO: 4620 - DNA, 121 bp, Artificial Sequence
  Synthesized
  misc_feature (61): n=a or t
tttagatattgatacacacatgtattaaccacaaacttctgagattactcagaagcaaggngcctgtttaatgggttttatatctgagttgcactcagcacaaaacttgctctcatctcct

SEQ ID NO: 4621 - DNA, 121 bp, Artificial Sequence
  Synthesized
  misc_feature (61): n=a or g
aatgctctgacagacagcactttcctttggaaagagtttgtagagtgcaaacaagtttaantcaacctgcagagaaagggaaaatgcagaaatgaaaacatgcattacttcaaaaatatat

SEQ ID NO: 4622 - DNA, 121 bp, Artificial Sequence
  Synthesized
  misc_feature (61): n=t or c
agcagataatttccatacatttgtagctgaaatagtgtttgagagattaatattggagttngtgagtgattatttgacagttacgaatagtgtgcttcccatatgaattttagcactatgt

SEQ ID NO: 4623 - DNA, 121 bp, Artificial Sequence
  Synthesized
  misc_feature (61): n=a or t
gtatgattatttgtatttttaagttttatatatttatacttgtatgctcttacatgtatangaaattcaggtttccccttccatctatcttccctccatatcttcctatcttcccttccat

SEQ ID NO: 4624 - DNA, 121 bp, Artificial Sequence
  Synthesized
  misc_feature (61): n=t or c
taaaaaagtaagcattgatgtaagtattgatacaaatgcctgttctgtatgcagcatttcngatgctaattgtttcaacaagaatttccaattacattattagtacaatattatgaggtac

SEQ ID NO: 4625 - DNA, 121 bp, Artificial Sequence
  Synthesized
  misc_feature (61): n=a or t
gtgcgtttggaacaaggagaggaatgtaaagggcctgtgttgggtctacttgtgctgtgtnctgcaagactgcaaggtggctgtagagaagtgtcaggagagcatctgtacatctgcattc

SEQ ID NO: 4626 - DNA, 121 bp, Artificial Sequence
  Synthesized
  misc_feature (61): n=c or g
agggtgaaagatgttttgtaccatcaacaaacaaaaatctgcaaagtgcgctgaatatctntcttcatggtttatgtttcagtatgtgtttctctgaccaagactaatgtttgaatcttgg

SEQ ID NO: 4627 - DNA, 121 bp, Artificial Sequence
  Synthesized
  misc_feature (61): n=t or c
ctttaggcatacatttggcttgtttctaatgctatcctagctagcttgatttctaaaccanaatcttcatcatcaatatttttaagcatttatatctacttttctgtctcattttattgca

SEQ ID NO: 4628 - DNA, 121 bp, Artificial Sequence
  Synthesized
  misc_feature (61): n=t or g
caaacttttgaagtaagtgctgtagtttttggaaaaaaactcctacttcccatctatagancagatcagttaaactgtaactgtgtttgtaatctctttgctttccttcacctctacccaa

SEQ ID NO: 4629 - DNA, 121 bp, Artificial Sequence
  Synthesized
  misc_feature (61): n=c or g
cagtgttgcaggtggtacctttgtgctgacatatttacaaatggctagaaatgttttgcanacacagagatctacaaagaagtaagaggagagcatgctccatgttctagagcagagcttc

SEQ ID NO: 4630 - DNA, 121 bp, Artificial Sequence
  Synthesized
  misc_feature (61): n=t or c
cttgtaccttgctctgcatagctaacctagctgtctcttcctctccacctacttggactanagagcttttcttctcccactgcagactgacagctgaatatggggcatttgtggtaggtgc

SEQ ID NO: 4631 - DNA, 121 bp, Artificial Sequence
  Synthesized
  misc_feature (61): n=t or c
atacctaaagacagtcaaatactgagctatgactggcacaggaaggacaagcatccaccancaaaagtactggccacctttcacctctgctgcattctctcccttccagttcaactgcatt

SEQ ID NO: 4632 - DNA, 121 bp, Artificial Sequence
  Synthesized
  misc_feature (61): n=t or c
aattaaaatcagctaaaaaaacattgcctgtacctgatggcaggacatccacaggagctcngtattgaatgtggtaggcaagcacagagtagttctgcaaatctgcttgcagatgaagggt

SEQ ID NO: 4633 - DNA, 121 bp, Artificial Sequence
  Synthesized
  misc_feature (61): n=a or g
cacatttgcatctagcaccacaacaaaaatgatcttctaaggtcagctcatcaaaacagcngagtaaggtcttggaactggtgctctttaagtctgtgacttgcaggtatgcaagctgtat

SEQ ID NO: 4634 - DNA, 121 bp, Artificial Sequence
  Synthesized
  misc_feature (61): n=t or c
actaagcactcttagactaagcctttgtttaggctttctctgttcatccatcatgcacttncttcttcagcaagaatttttggagatgtaggcagaaagaggcagagcttttttgttgcct

SEQ ID NO: 4635 - DNA, 121 bp, Artificial Sequence
  Synthesized
  misc_feature (61): n=a or g
ctgattttgaagccctcggtgtgagacagaattaaagttgcactttcgaacgcggcgtgcnctaacagtggtaagggcagactgtaaaagggctgtggtttgcagagctatttaaacggca

SEQ ID NO: 4636 - DNA, 121 bp, Artificial Sequence
  Synthesized
  misc_feature (61): n=a or g
tacctaatttataattcacagtgacaactttttcctctgtctttactatgcataaactacnctgggacaaagacttttctctactgttctgttaaaattcctttgagtaacctataaagaa

SEQ ID NO: 4637 - DNA, 121 bp, Artificial Sequence
  Synthesized
  misc_feature (61): n=t or c
cattctttattttttaaaaataattcaatgtattttccaatcaaagagcaatattcccttntgtaatgaagtttaggccttgggtctttagaattttagagtttccttcttgcctcatcta

SEQ ID NO: 4638 - DNA, 121 bp, Artificial Sequence
  Synthesized
  misc_feature (61): n=t or c
actgaagtaattcaaataacatgcagaacagtgcatcactgtgtaattacttgcatctcangtgtctcaaactacactggagaaagtatagatataacagtggctgtgaagagagaaaatg

SEQ ID NO: 4639 - DNA, 121 bp, Artificial Sequence
  Synthesized
  misc_feature (61): n=t or c
ttgcccctttgcaagcagtggatgtcactaaataaattccagtggtctcacagaaatcagnaaaactgaatgtgtactgagggaaaaagaaggaacttgagtaatatttgtagatatctag

SEQ ID NO: 4640 - DNA, 121 bp, Artificial Sequence
  Synthesized
  misc_feature (61): n=t or c
tgtaaataggtactgtacataaaatgcttggaataaaaccatagggcatgacaaattaganacacaaagttaaaggtaaaagccatcatttttctgatagcagatgtacacaaggtgacca

SEQ ID NO: 4641 - DNA, 121 bp, Artificial Sequence
  Synthesized
  misc_feature (61): n=t or c
aattctgaacatattcttcctttattccagtgtcctgctacctaattgtaaagtgtgaaanacatacccttaatttctctaatttggcaaggtgcagaaagagtccttcaattgtttcaga

SEQ ID NO: 4642 - DNA, 121 bp, Artificial Sequence
  Synthesized
  misc_feature (61): n=c or g
aactgtatactttgcacttgtttaatttatatcagtgtgtggaatatgtacttagaaagtnagttggttatgctctgttgtgtcttgccagaaaatttaagagcttgacagaatgctggag

SEQ ID NO: 4643 - DNA, 121 bp, Artificial Sequence
  Synthesized
  misc_feature (61): n=t or c
ccctagactcaatagtcttcctacactgtatgggtatatgcatcacagatgatcccagtcngcaaatagacctgtggaaaaaaatacgtcttctctttggatagggaccactgtgcataca

SEQ ID NO: 4644 - DNA, 121 bp, Artificial Sequence
  Synthesized
  misc_feature (61): n=a or g
cagattgtgaaatggattcccatagcttattaggctattcttgttgagtttgctggatacnaacttggtaaaacttttaatcaatttgtaaattgcctcttctgtcaatgtttcattgatt

SEQ ID NO: 4645 - DNA, 121 bp, Artificial Sequence
  Synthesized
  misc_feature (61): n=t or c
taaataaaatgggatggaatgagctggcaacaaaacagctgatgtgtttgtatgtaagtcnacaaaattaaaatttaataaagaatcttatagggaattctctttttcatttacttacagt

SEQ ID NO: 4646 - DNA, 121 bp, Artificial Sequence
  Synthesized
  misc_feature (61): n=a or c
atcctgactggaaattatacaaagttttgtgcaaatttttgatgaatgaaacacactctgntgacttgcattagcagtgttggttagcttcaccagtgagactcgtttccagtgtgagtcc

SEQ ID NO: 4647 - DNA, 121 bp, Artificial Sequence
  Synthesized
  misc_feature (61): n=a or g
agaaagattaatggtgaaattattcttccagttttgagtattgctgatctttgattgccantgtctgtgttggagtagcagtgcctgtccatatgagagccagggcacattaccgacacac

SEQ ID NO: 4648 - DNA, 121 bp, Artificial Sequence
  Synthesized
  misc_feature (61): n=c or g
tgcaactcaaatatcgctttcttgacagtgtgctgcacttctatacttttgttgtccaatnagaagatctctgtatgaccccagccccaagaacatgacatttgtaatgatgcttacagtt

SEQ ID NO: 4649 - DNA, 121 bp, Artificial Sequence
  Synthesized
  misc_feature (61): n=a or g
tgatgcacacattgttatttttcagtttttacagtggatgggttttttatgcatctgcccngttaggaatgctgcctttttgaaacaatgcaataccaatatttaagaaggataaccatgt

SEQ ID NO: 4650 - DNA, 121 bp, Artificial Sequence
  Synthesized
  misc_feature (61): n=t or g
tggggtgggaggaactggggtcagatatgactccaatgagggaaaagggaccagcgacacngaaacgagtgtggtagattgctctttggaactcgcagggagcgtatgaatcttttctgta

SEQ ID NO: 4651 - DNA, 121 bp, Artificial Sequence
  Synthesized
  misc_feature (61): n=a or g
taataaagtgtggctttagataacttactttaggttgaggttttcttgtgaggacaggtgnttggaaagactatgggaaagcaagccaggcataactgctgccctccagttttttccctct

SEQ ID NO: 4652 - DNA, 121 bp, Artificial Sequence
  Synthesized
  misc_feature (61): n=t or g
ccaaatactgacaagataaaagcaagtcactgaatattttaagtcactgaatcaccttgantctacccacaatgtaaacaaatgtagacggtcatttaagattatcctttttcaagaactc

SEQ ID NO: 4653 - DNA, 121 bp, Artificial Sequence
  Synthesized
  misc_feature (61): n=a or g
aaaaaaaaaaaaaaaaaaaagattccagactttctgaagtaaattggagattcagtctgcngcatcccttcctgtggatttctctttctgttcttgtctctttggcacaaatcaggagttg

SEQ ID NO: 4654 - DNA, 121 bp, Artificial Sequence
  Synthesized
  misc_feature (61): n=t or c
tctaccagagaccccacagccatggggaatccttgccctagtttctcactcagtaacttcnatgcgatcaccaaggaagaccaaatcttgacactcttgtttgttgggttttttttttttt

SEQ ID NO: 4655 - DNA, 121 bp, Artificial Sequence
  Synthesized
  misc_feature (61): n=a or g
cattccctgtttggaaagcaaagaagcactcctggcaggagatagaggtgctgcaaggcancacaggcatggatgtggagttgctgccttgtacttcagcaccctgagagcatctccctgc

SEQ ID NO: 4656 - DNA, 121 bp, Artificial Sequence
  Synthesized
  misc_feature (61): n=t or c
cattttactgggtggcaggctctactcatttcagtgggccatgtggttaagtgaaggccantgtcaaaagtgaaaaatgatggcaaaaatagagcccataggaatttaaacatacaaacat

SEQ ID NO: 4657 - DNA, 121 bp, Artificial Sequence
  Synthesized
  misc_feature (61): n=t or c
ttctaaggtgggggtcatgtgggaagagatacagtccaggaatatcaccactacatgttcnagttttcaggtgaagtcttgcacatgtttacaggtatcttgagtctggaagaaaatatgg

SEQ ID NO: 4658 - DNA, 121 bp, Artificial Sequence
  Synthesized
  misc_feature (61): n=a or g
tttttgctctaagctagatgtgagacttctggaatcactgagcaataaagatggagcacanttaactgtacagggctaagaaaactcacatttgtaattggaaaagagctttttaggaagt

SEQ ID NO: 4659 - DNA, 121 bp, Artificial Sequence
  Synthesized
  misc_feature (61): n=a or g
cacagtcattgtcctaaatgtggaactgctaattgtagctgaaagcagaagatattctcanttctctgagttttaccttgggttcagattaggttttggctcccgatttgcataggggtca

SEQ ID NO: 4660 - DNA, 121 bp, Artificial Sequence
  Synthesized
  misc_feature (61): n=t or c
tcttgaagacagaagccacttaaaactttgtagatcacaggttttacagtggtataccttngttacacctgcattggctaaagtctgtcttagcctccttgttttcttcagtacatcgcat

SEQ ID NO: 4661 - DNA, 121 bp, Artificial Sequence
  Synthesized
  misc_feature (61): n=t or c
aaattcttgacttagttgttggcttctcagtaacgtttgccatacgctagttcacttaggntggtatccccttacataaagccataccccttaaattttttcctttgttcaaatgcagaag

SEQ ID NO: 4662 - DNA, 121 bp, Artificial Sequence
  Synthesized
  misc_feature (61): n=t or g
tgtaaatactgattgctgtcaaggaaataccccgtgtcttaaacatttgcacaagttcttnctgcagttacatcaatgtgggagtttcttaaatgggatttttcttgttcctctttttctc

SEQ ID NO: 4663 - DNA, 121 bp, Artificial Sequence
  Synthesized
  misc_feature (61): n=a or t
agaagagctcaccattagcttttgatagttaggagagtgtgtcaaagatgtgatggtgacncttcttattctaacaccacaaaactgaccagaaaataatttggaacagagatagaggtta

SEQ ID NO: 4664 - DNA, 121 bp, Artificial Sequence
  Synthesized
  misc_feature (61): n=a or g
cccctcccactggatggagagaaaatagaaggaaggcaagaaggcttatggattgagatantgccaatttgacagggaaaacaaaagctgtgcctacaaatcaaacacaataagaaattca

SEQ ID NO: 4665 - DNA, 121 bp, Artificial Sequence
  Synthesized
  misc_feature (61): n=a or g
attcccagaaaggtgtctacattcttccagattattttaatgaatagcagtggcaaatatnttactggattgttcttagccattagctctctatgctgtcacagagattactctcaaatat

SEQ ID NO: 4666 - DNA, 121 bp, Artificial Sequence
  Synthesized
  misc_feature (61): n=t or c
agcaaattgtgcttcgatggagaggaaaccaaaccataagtaaagattgctgtcctgtccnaacctcctgtcagttaccaggatccaaatcagctctatctgacaatgcagtcatctcaaa

SEQ ID NO: 4667 - DNA, 121 bp, Artificial Sequence
  Synthesized
  misc_feature (61): n=a or g
cgagaggtggcgttggaaatcccagctgggtgaagtaactttaccataggaagtattaccnggctcacgagcactattactgattcattaccccataggtaccaacactttaagcaacaca

SEQ ID NO: 4668 - DNA, 121 bp, Artificial Sequence
  Synthesized
  misc_feature (61): n=a or g
acagaaatgccctatcaggttcatgccccagtgaaaaggcaacatcctcatacagaagaanatgtacaagatataccttggctagaaagctgggttatttttctggtgaaaccacaaagct

SEQ ID NO: 4669 - DNA, 121 bp, Artificial Sequence
  Synthesized
  misc_feature (61): n=a or c
gttttagctgagacttttttcaagtagaaggaaatccagaaaatcaggtatgtgtcattcntcagttggcctatttccacaagtgtaactttaccctgatgatattaatttcatcatctta

SEQ ID NO: 4670 - DNA, 121 bp, Artificial Sequence
  Synthesized
  misc_feature (61): n=a or g
agagcatcttttacgatgaatgtgtgatgtctaatagaggtagggatggtggtgaaattcngaaaaaatactactactcatgacaaggacttgatatagtgacaagctactccatatgttt

SEQ ID NO: 4671 - DNA, 121 bp, Artificial Sequence
  Synthesized
  misc_feature (61): n=t or c
taacacttccttcctccctccctcttttcctccctccgtacattccattgttccttctttnccacagttgatctcagctataggtattgagagcatttgcctggagggtcaatgggtagac

SEQ ID NO: 4672 - DNA, 121 bp, Artificial Sequence
  Synthesized
  misc_feature (61): n=a or t
atttctggtataatttcagtgtaagcatatgcagtgcttggtttcatgctttaggtttgtntagattttgttggagcgtttttgccctccatcctatacagattactcatgacacgctcat

SEQ ID NO: 4673 - DNA, 121 bp, Artificial Sequence
  Synthesized
  misc_feature (61): n=t or c
cagactactggtataggtctggcaaataattcagcttccatgatggtactctgaagtcccncatctgaaaaacatgatgttttgtccgcaaaagcaccactttgccagtttcaggaactga

SEQ ID NO: 4674 - DNA, 121 bp, Artificial Sequence
  Synthesized
  misc_feature (61): n=a or c
gagtttcaaagctatggtaacatagccttaggaaacggtgagacaaccttaagcttgcttntaactttttggatgactttagacacgttattgtgttctcagtgcagatctttatttctag

SEQ ID NO: 4675 - DNA, 121 bp, Artificial Sequence
  Synthesized
  misc_feature (61): n=a or g
attttgacctggaaatgtcttctttgcacactaagtcagtataaaagcctgaattactttntttattttggatcactggaatggcaagtaatcacttatggtttatatagcatcaatgttt

SEQ ID NO: 4676 - DNA, 121 bp, Artificial Sequence
  Synthesized
  misc_feature (61): n=t or c
agatttcaggcatgttctaacaaatcaaaagataatttctgtgggtagcaatgtacttctngtgaagaaatctcattttagatggtattaaagtataaatgcccagagattactttgagtg

SEQ ID NO: 4677 - DNA, 121 bp, Artificial Sequence
  Synthesized
  misc_feature (61): n=t or c
catcaatctatattgtggagtaaatagatactgttgaaacagtaaaagtacaactctttancctcgttaaaatgctagtgttgacccatagttcagtggttttactacatccatgttctgt

SEQ ID NO: 4678 - DNA, 121 bp, Artificial Sequence
  Synthesized
  misc_feature (61): n=t or c
aagcaattaatgaaataactcccaattctacataatttcagaattccctagtttctctatntgaaatgtgaaaatcaattagatttttttttttaattgaaaagcaggaaacacgattttt

SEQ ID NO: 4679 - DNA, 121 bp, Artificial Sequence
  Synthesized
  misc_feature (61): n=t or c
cagcccatccacgcaaatcaggcagattataaccaaagaactgtgtaaagagctggatatnggcttcagtatgttggaaatggtagcaacgttgaaatatcacaaagtttatgccaggtgg

SEQ ID NO: 4680 - DNA, 121 bp, Artificial Sequence
  Synthesized
  misc_feature (61): n=a or c
ccaaaattatttgcaaatctgatcatatgagccttgattcagcaaaccaaaacactgctcnaagtgtgtgatgaaatgtgctgctgaactggggctgaagattgatcatcctacagtctgt

SEQ ID NO: 4681 - DNA, 121 bp, Artificial Sequence
  Synthesized
  misc_feature (61): n=t or c
agaaaattgaagttagcttttggaagaattatttttacacataaaactataccaggattcnacctcacccttccctccgccaccaacaaaaatatggtttgcgtgtggatgcccagtcttc

SEQ ID NO: 4682 - DNA, 121 bp, Artificial Sequence
  Synthesized
  misc_feature (61): n=a or g
cattcagtgtagcttagtgtctactgcatacttttttgaaaaggaagaaccaaacccccanatttcatgtggactctgcagaacagtcccaaacacttcttcagctacaacatgaagaggt

SEQ ID NO: 4683 - DNA, 121 bp, Artificial Sequence
  Synthesized
  misc_feature (61): n=a or t
aagtaatggttgcattcattgttatcacactgctttttcaactctgtatttttccctcttngtgtgaaactgcatgatgactctgcgtcccataaaattaactcaagcaaaaccttctata

SEQ ID NO: 4684 - DNA, 121 bp, Artificial Sequence
  Synthesized
  misc_feature (61): n=t or c
aagattgctgaaattgtccacaggggttcagtcttcatatgagaagtaaatgtccaggatnatgtatgcaaccggtgccaaaatgagagatgagattgaactgtgagtttcgtttagatgt

SEQ ID NO: 4685 - DNA, 121 bp, Artificial Sequence
  Synthesized
  misc_feature (61): n=a or g
gaagtggttcaggtgacccctaatttcggaggaactcttgccttcagtctgtttctcttangacttattgaggctgcttagattaatttcaaccatcagatttaggcagctctgagagagt

SEQ ID NO: 4686 - DNA, 121 bp, Artificial Sequence
  Synthesized
  misc_feature (61): n=a or g
agtgttttgttacttcttctccccatgctcctcttccatcaggtaaatctatttctcctcntctacattaccacaagctcttagttcactgttgaattatccttgcaggcaccctaataac

SEQ ID NO: 4687 - DNA, 121 bp, Artificial Sequence
  Synthesized
  misc_feature (61): n=a or g
cagccatgtctctattatctgctgttagatatatccaagtccaagtccaagtccaacaaanatttcatctacttcaagcagtccatcaggctttgagctcaaattctttgtctggcttatc

SEQ ID NO: 4688 - DNA, 121 bp, Artificial Sequence
  Synthesized
  misc_feature (61): n=a or g
ctcagcaaaactatgctaatctttcccacaggagctgatctgcccttggttctcatgtgcntctgacactgacagtaacctccattccaaacagtaaacatattatcaacacatgcaggaa

SEQ ID NO: 4689 - DNA, 121 bp, Artificial Sequence
  Synthesized
  misc_feature (61): n=c or g
tgaaaataagtgagaaatgtgcatccacatcaggtactccactatctctaattagtaaatntgtaaggtaaaagccattcatgcatgcaataatatactttcagcatcttgatttagcagc

SEQ ID NO: 4690 - DNA, 121 bp, Artificial Sequence
  Synthesized
  misc_feature (61): n=t or c
tcaaatacactagaatttcagaaaggcacaaaatatttcacatcttcgctgtaatgacaanatggtaaaattgtacctagggactgtagaggcagaacacagaagcaggatttttctaaca

SEQ ID NO: 4691 - DNA, 121 bp, Artificial Sequence
  Synthesized
  misc_feature (61): n=a or g
tcccatggcctcagcaagcagaatggaaattatctgtcttggctatcagcaatgatacccngcttttgctggactgcaaaggtgtcttgctgctgatgggcattattgcccaacgttctcc

SEQ ID NO: 4692 - DNA, 121 bp, Artificial Sequence
  Synthesized
  misc_feature (61): n=t or g
ttctctttctcagttttctttttatcagatatgatgagattgcatgtgtgtggtaaacctnttttttttctcaatgaagttattgtctatttaagatgcaaatgatgcaatgcagaatatt

SEQ ID NO: 4693 - DNA, 121 bp, Artificial Sequence
  Synthesized
  misc_feature (61): n=c or g
taagcagaaagggatattagtaagaatggtttacttatgtatatcgtggggagtaagacanagatctccaagtgatgctacaagatccttgagtcattcaaacaaatggcaggtggtaatt

SEQ ID NO: 4694 - DNA, 121 bp, Artificial Sequence
  Synthesized
  misc_feature (61): n=t or c
tgtcctggctaatgtcctttgaactctgtaccagatataccttccagcctttaaggtttgngttctggccttttcctatcttttccctgcaaaataaacatcctgctcatggtgaaaatgg

SEQ ID NO: 4695 - DNA, 121 bp, Artificial Sequence
  Synthesized
  misc_feature (61): n=t or c
ccttccaacccaggccgttctgtgattctgtgattctgtgataattttggcaacactgtcncaagggagagtcaaccaatggtcgttgcggtcctgccggaagcctcttctttggaactaa

SEQ ID NO: 4696 - DNA, 121 bp, Artificial Sequence
  Synthesized
  misc_feature (61): n=t or c
cacaaatctgtttagtgtcttcacttggattgcatgcatgaaagctctttagaatggttgntatttttacatttctaagtgacatctttgtgttgtgaaatatctttgtactatgatgttt

SEQ ID NO: 4697 - DNA, 121 bp, Artificial Sequence
  Synthesized
  misc_feature (61): n=t or g
ggcagcaaagaagtaacactacaacaatgatgatgaaccagggacccactcaggcaccctnttatgtctgctcagtcagaaagtgtgtttttgttggtcctttaccttctgataagaataa

SEQ ID NO: 4698 - DNA, 121 bp, Artificial Sequence
  Synthesized
  misc_feature (61): n=t or g
ggaatatattacttggtttagggagaagattaagaggaagctagttagactatctgctatntggttcttcatcttgcatttgcaagatgacccctttttaaagggctctattatcaatgga

SEQ ID NO: 4699 - DNA, 121 bp, Artificial Sequence
  Synthesized
  misc_feature (61): n=a or g
aacatactgtttgtttacaagatacaatttaatcaaatttatgtgaggtttgccgtgcgtnatattttaacatagcaaagtcccagaaataaagaatattcaaatatacacatgaactctg

SEQ ID NO: 4700 - DNA, 121 bp, Artificial Sequence
  Synthesized
  misc_feature (61): n=a or c
tcgggtttcaggctgaaatttggtgctttctgagacataaaaggtcaaaattttagttatnatttctttcaatagcatcaacataacaagaggctttaaagtgcaacagtgattctggtct

SEQ ID NO: 4701 - DNA, 121 bp, Artificial Sequence
  Synthesized
  misc_feature (61): n=a or g
tctcataaaaacaacattttcagccttcaaacttgtaattgtgtctgctgaatgtcacatntagcatataacatatatcagcaaaagcagggtagctgtgggtgataacatggctggcagg

SEQ ID NO: 4702 - DNA, 121 bp, Artificial Sequence
  Synthesized
  misc_feature (61): n=a or c
gaaaaggttgcaggccagtctgacctagttagacatgcactgaacagggtcacttctcatntgaattattctgagttcatcaaacctatcacctggacacttccagtggcctaagttgaat

SEQ ID NO: 4703 - DNA, 121 bp, Artificial Sequence
  Synthesized
  misc_feature (61): n=a or g
tgtgtgaaacttaggaaaataatagtttgataacactgtatttctgtaagccaaaagttancattataaaagcattcacattttctctggcttgctctcaaaaacagatttttttttcact

SEQ ID NO: 4704 - DNA, 121 bp, Artificial Sequence
  Synthesized
  misc_feature (61): n=t or c
aaagcacacatattccgagtgagatcataactgttattgtttactgtgctttacttctacnattacaggtttgtcttcacctttaagagaataacagttttgctacaacagctcagtaaga

SEQ ID NO: 4705 - DNA, 121 bp, Artificial Sequence
  Synthesized
  misc_feature (61): n=t or c
aaccttttgagtagtcctgctcttgggataacacagagtgttctgccattaatgaggcaantgttgtatgcagtattagcatacgataaaatcttgcatactatcactttcccagaggtga

SEQ ID NO: 4706 - DNA, 121 bp, Artificial Sequence
  Synthesized
  misc_feature (61): n=a or g
catctacatacagcattacaggttttcttttttctcaggtcttgcagcttgtttaatctgntgggaaactgccagcgtaggccttgaatccaatctctgataggtgtgcccatgtatatat

SEQ ID NO: 4707 - DNA, 121 bp, Artificial Sequence
  Synthesized
  misc_feature (61): n=a or g
actcaggtactgatttactgctgaaaggtcatattctcctccctcagtaaacaattacgtngtttgtccattccttatcacaagacatgatcaaatctgcttaacagtttcccaccctcca

SEQ ID NO: 4708 - DNA, 121 bp, Artificial Sequence
  Synthesized
  misc_feature (61): n=t or g
taatttgcaaggatattttgagataaaacatagaaaatggaagattcttaatgaggatatngccatactgtttggagagtaggagaatttcatattatgaatgccagctgttccatgccag

SEQ ID NO: 4709 - DNA, 121 bp, Artificial Sequence
  Synthesized
  misc_feature (61): n=a or g
tatgcatagatagatagatagataaacagtaaattctaattggtagagataatagccccantttctttctctaatacagggagatgttcatgactctcatttctgctgtatagtcagtatt

SEQ ID NO: 4710 - DNA, 121 bp, Artificial Sequence
  Synthesized
  misc_feature (61): n=a or g
gtatgaaacagagaataaagatcagctaaaaggcaaattatgtgtaagcacccttccactngtggcaatctacatagaccaacaggtgcatattgttctttggcacctagctgagtctgga

SEQ ID NO: 4711 - DNA, 121 bp, Artificial Sequence
  Synthesized
  misc_feature (61): n=t or c
gtgaagctgagatgtctctgtgcctgaggggctgcacttgcagtgctggctatggaagtgngaaatgctgagcttgttagaaaatctgtctagagaaatgtaagtcctaaaacaagggcaa

SEQ ID NO: 4712 - DNA, 121 bp, Artificial Sequence
  Synthesized
  misc_feature (61): n=a or g
atttctttttttcccaagaattggaaaattgggttgccagtgactgaattctatgcttccnagaattttcatttattgtgtcttttattgtattttatatgattttaagtaattgcttact

SEQ ID NO: 4713 - DNA, 121 bp, Artificial Sequence
  Synthesized
  misc_feature (61): n=a or g
aaacttcatagatgtgaggttctgaaagaacaaaataaaacaaatggattgagtgcttgantaaaaaagggatgaagaagattcaagtctgtctggaatatatagtctggaatatatattt

SEQ ID NO: 4714 - DNA, 121 bp, Artificial Sequence
  Synthesized
  misc_feature (61): n=a or g
aatcagtagatgttagaagaaaacatcttccttgtttatatttaaaataaatgtggcatcnactaggctttgaaagtgcttaaaatcacttgatagttttacaacagcattagcaggtaca

SEQ ID NO: 4715 - DNA, 121 bp, Artificial Sequence
  Synthesized
  misc_feature (61): n=t or g
atcttctggtactgcaaatatctaatacgtctcacagagcttcagacagtcagtgtagatngtacaggacttttcagcataggatagaaatacatgaaacacgggaaaatgttaataatta

SEQ ID NO: 4716 - DNA, 121 bp, Artificial Sequence
  Synthesized
  misc_feature (61): n=a or t
ctgttttgaaggtccctaggattccccttatttcttatcagtccgcaaacatgatattatncaaggaaaatatttgaacaaggtattccttgtgcaggctgcggctctgtgttaccacatc

SEQ ID NO: 4717 - DNA, 121 bp, Artificial Sequence
  Synthesized
  misc_feature (61): n=a or g
gcggctgcctggaccgggggtatgcacctaatgccgcaagggttggcactatgcaaatcantgccactccagatttaacataggggcctctgtggtacagcatacattaccactcatatgg

SEQ ID NO: 4718 - DNA, 121 bp, Artificial Sequence
  Synthesized
  misc_feature (61): n=t or c
acagccattcacataacacttcctataatgctgtcctatcctacagaccacagcattccancatggtctcatcagtgactccgttagacaaaatacaacagacaaaatgtcaaagagaggg

SEQ ID NO: 4719 - DNA, 121 bp, Artificial Sequence
  Synthesized
  misc_feature (61): n=t or c
taatgcattagaacaaagaaatctgtcctagatcaacaccagtccaagagagcctactaantcacatctcacaacaaaggaacataatctttactgcttgcagtaaaatgtgagacatttt

SEQ ID NO: 4720 - DNA, 121 bp, Artificial Sequence
  Synthesized
  misc_feature (61): n=t or g
ttcacactctgccttttttagtgtcttctattttgaagaagggaggttaaatttaatatcnctcagtgaccataaatgtttcctgtctgagtgcctgggtttgtagtagaatagccaatta

SEQ ID NO: 4721 - DNA, 121 bp, Artificial Sequence
  Synthesized
  misc_feature (61): n=a or g
tttttgaccctttcttttgacagtgaaatgtcatcaggattttgttcttgcctttttatanaagtctgttcccatcctaaaggcttctgtagtttttcccaaccagggagtagccaccctc

SEQ ID NO: 4722 - DNA, 121 bp, Artificial Sequence
  Synthesized
  misc_feature (61): n=a or g
taataaaatggttacgttgttttggttagattgcccatgtctcataagtagtgaatgtgtnctatgtgctttttgcaaagaaaattaatcacagtttctaggcaagtacaacatttcatgc

SEQ ID NO: 4723 - DNA, 121 bp, Artificial Sequence
  Synthesized
  misc_feature (61): n=a or g
ccttgattgaattccattagaataagaactagatgaagtttaggccatccaagcaggccantgtaataaaatgtaatttggactaatcttcccaaagaatgccttgtgtttgaagctgaca

SEQ ID NO: 4724 - DNA, 121 bp, Artificial Sequence
  Synthesized
  misc_feature (61): n=a or g
caggaaataccagctcaatgtgcctttattatttttcagatgttgaaaaggtgtagagcantactgggattattaataggacttgggtgcctaatagccttggggttctttataaaactct

SEQ ID NO: 4725 - DNA, 121 bp, Artificial Sequence
  Synthesized
  misc_feature (61): n=t or c
tccacagatggtgactcagccacctccctgaaacagaaaataattctcatgagatgtaaantattttccaacaaatcttgaaattatgagggagatttcccgtctttgcatgtttattaac

SEQ ID NO: 4726 - DNA, 121 bp, Artificial Sequence
  Synthesized
  misc_feature (61): n=a or g
aagtaccaggatgtatttaaaaacatgctgtttttttcttcctttcaacgcgtacaaatanaagggtagatcagttcccattaaagagaagcattttatatccatctataatttctataca

SEQ ID NO: 4727 - DNA, 121 bp, Artificial Sequence
  Synthesized
  misc_feature (61): n=a or t
agctttaggagaggaatatgcagaagattaagtctgtgcatgcaaaagtggttggttattngaagtctgtagattcaagttttgtcagaatgatcctggaatggggatggcaaagaataaa

SEQ ID NO: 4728 - DNA, 121 bp, Artificial Sequence
  Synthesized
  misc_feature (61): n=t or c
gatgtgtatctattttcaggagatgatagaaagagatggaagtcagcagatgcttaaatcntgaaaagacatcacaaatggtacttttttttcagcagtgctccagtggtatatatcagtt

SEQ ID NO: 4729 - DNA, 121 bp, Artificial Sequence
  Synthesized
  misc_feature (61): n=a or g
gtgctgagggagatttctgaggaataattcatgcagagaaactcttgtatttactgaactntgtaactactgttatatttttactagaaatagcattcagatttctgaagaactgggcgga

SEQ ID NO: 4730 - DNA, 121 bp, Artificial Sequence
  Synthesized
  misc_feature (61): n=t or c
ggcttcatcccatttctgtatagatggtaaacttcctgtgaatgccttctgtccagtcatncacgttcttaacaaagatgttaaacagtatccatcccagtatcgagtcttggaacatatc

SEQ ID NO: 4731 - DNA, 121 bp, Artificial Sequence
  Synthesized
  misc_feature (61): n=c or g
gtccacgatgcccatggcaccgggacccccatcaccctcagggctctcaatggcctcacangcaaggtggggaagtgactgcatcatcaaatgctgctcaaggatgtggatgcttttgttg

SEQ ID NO: 4732 - DNA, 121 bp, Artificial Sequence
  Synthesized
  misc_feature (61): n=c or g
ctcactcagctgatgttcccttttgtgagtgctggatgttagaaaggcacttcaatgactnaatatgtggaatgtctgaattttgttgtggtggggaaatagccaaagggaaggttggatt

SEQ ID NO: 4733 - DNA, 121 bp, Artificial Sequence
  Synthesized
  misc_feature (61): n=a or g
atctcttgttcactactaagaatagagggataccatggaggtcaactttcctgcccccagnatagggatatattcaccaaggctatgtaactgtatttgcatgttatgctgaactcagcag

SEQ ID NO: 4734 - DNA, 121 bp, Artificial Sequence
  Synthesized
  misc_feature (61): n=a or g
atacggaaatcaagagagtaaaggagttataaaagtccaaagcattaaacagtgacagaanatgagcacatacattttttaaaagcttccttactaccttgcttagatcattaaaggtaaa

SEQ ID NO: 4735 - DNA, 121 bp, Artificial Sequence
  Synthesized
  misc_feature (61): n=a or t
cagaagctgtgccacctaccagaaaagtttcccctcaataggcctagtggttaggaagggnggtgaagtaagcattttggctaaatctttggaaaaaagaatctttgcttcattatgtgtc

SEQ ID NO: 4736 - DNA, 121 bp, Artificial Sequence
  Synthesized
  misc_feature (61): n=a or g
ttaccatgtagtgccatgacatacatcagggcagtgtggataactgggtaggatcaatatntaatgaaataatgagaagatagtggctttcagcaggatctttatcccaagggagctttga

SEQ ID NO: 4737 - DNA, 121 bp, Artificial Sequence
  Synthesized
  misc_feature (61): n=t or c
gattctgacagctggcagaatgatatccaagggacacgtagctaccactttactcagctantcttcataggactaccacacttcaaagaagttttataaaccttctaattttctaatttaa

SEQ ID NO: 4738 - DNA, 121 bp, Artificial Sequence
  Synthesized
  misc_feature (61): n=c or g
aaaggtgaaggggtggaaggaaggctaaattgtggccaacaaagtctgtgaatgccttcantgccccaacaaggtacgtttggtcacttaagagtcacagggaggaaagatttttcataac

SEQ ID NO: 4739 - DNA, 121 bp, Artificial Sequence
  Synthesized
  misc_feature (61): n=a or g
gagatgaaagtttatctgtttcagcctgttcacgtttgacttttgttcatctctaagacantgatctgaatgtttccagatccagctctgaactcatttcctaaatctctgataatgctct

SEQ ID NO: 4740 - DNA, 121 bp, Artificial Sequence
  Synthesized
  misc_feature (61): n=a or c
gtgcctctactggcagaatctttcagaagtgagaaaagctttgtgtaccatttgcagtgtntgtcattgcatctacaaagcctggattgagtctacaaaggctagattgagagattagttc

SEQ ID NO: 4741 - DNA, 121 bp, Artificial Sequence
  Synthesized
  misc_feature (61): n=t or c
atccagccttcagcaggagcccaaagggagagcccgctctgggatgatgcctttattcctnccagtctctcatttgcacacctcttgccagcctgagggatgtgggatgcaggatgaaggg

SEQ ID NO: 4742 - DNA, 121 bp, Artificial Sequence
  Synthesized
  misc_feature (61): n=c or g
gaaagtcagaaagattgtcctcaaccaggatatgtgaaaagtgagggcacaggtggaattnttcctgcagattaagctgctcttattggctctgcttggagcaaaggggttagactaggtg

SEQ ID NO: 4743 - DNA, 121 bp, Artificial Sequence
  Synthesized
  misc_feature (61): n=a or g
gtaaaatggtaatctgcaccaggttgtttttaattagatccagacagtgaataacataaanagaaccctaaactcctaagcatttggtttatcagtgtttatcagttgaaggaaacattaa

SEQ ID NO: 4744 - DNA, 121 bp, Artificial Sequence
  Synthesized
  misc_feature (61): n=a or g
ggatcctgcagttcccctctcccctttaatagctgaggtgcttcagtgaaaactgagcagntatttccacagctggaacaagggaacattagaagtcactcttttcttccacaggatctgc

SEQ ID NO: 4745 - DNA, 121 bp, Artificial Sequence
  Synthesized
  misc_feature (61): n=a or g
ttaagctcgtataattgtttgtcaagtgactgagtggaagtctcttgtctaattatcattntcttaggtagagactggagctatagattaccagtgcacatgctaatttgactgcctttct

SEQ ID NO: 4746 - DNA, 121 bp, Artificial Sequence
  Synthesized
  misc_feature (61): n=t or c
tgtctctgcaggactctttatgctggaagacatcactgcattgaattacagccatgttttngaaaagtatttgccaggattcatttcacctaactttggacatcgtggacatctgtatcct

SEQ ID NO: 4747 - DNA, 121 bp, Artificial Sequence
  Synthesized
  misc_feature (61): n=a or g
catagagccagatagagagaacagaactggacccaggcaagagcaaataggagtgcggatnactgagacccaaggctcaaactcaatctctgtccctcaaactcacccagctgtatgttga

SEQ ID NO: 4748 - DNA, 121 bp, Artificial Sequence
  Synthesized
  misc_feature (61): n=t or g
aataaattgagctcattcacagataggcatagggacagcattttatcaagaagatattttnagggaatagaaatcatctgccagtctgtatcaaatctagctagaatggtcagttaaaaaa

SEQ ID NO: 4749 - DNA, 121 bp, Artificial Sequence
  Synthesized
  misc_feature (61): n=t or c
tttccaagtcaggaacagttcttagcatgtgtttatctgaaacctcaactgtcaagagatnctgcaacttctctgtgggatctattccagtaccttactgttcttgttgtcaagtgatttt

SEQ ID NO: 4750 - DNA, 121 bp, Artificial Sequence
  Synthesized
  misc_feature (61): n=t or c
tttgtgctgtgttacaagggcaggtagagtttagaggccccctgaactgactaaactattnaaaagaacaacttcactgatgacgtaaaattcctgcccacatctccagcattacagtgga

SEQ ID NO: 4751 - DNA, 121 bp, Artificial Sequence
  Synthesized
  misc_feature (61): n=a or g
acctacctgctatgtacatgtggtttgggtttgtgtatagatatagagttgtactggatcnctacagcgagaccagaactgcgtgatctctaaaattcataaggatctgagtggggttttt

SEQ ID NO: 4752 - DNA, 121 bp, Artificial Sequence
  Synthesized
  misc_feature (61): n=a or g
gttttcctgaggtttaaatttaaaaatcaagcactaggcttagagttaatgcgtatttagnaacagctgatgaatctgaattcctttaggtggggttaatcaaactgaaaacattccgtcc

SEQ ID NO: 4753 - DNA, 121 bp, Artificial Sequence
  Synthesized
  misc_feature (61): n=a or g
atagccaaagcacagacatagctttacatatgatgaaagaaaatgcttcctttggtacagnatttcatctgggttactattttgatgatgaaaaagactattatttgcacaagtcgacaac

SEQ ID NO: 4754 - DNA, 121 bp, Artificial Sequence
  Synthesized
  misc_feature (61): n=a or g
caggacccagggtcacgacacaacactcaaaataaggcccatccctacttttcagaaacancgctgtttttgctaacatgtccagtgtcctccaaacagctttctacttctttaggacacg

SEQ ID NO: 4755 - DNA, 121 bp, Artificial Sequence
  Synthesized
  misc_feature (61): n=t or c
gtaaaaatcacctcccgtcagcaatgccaaagagcttttatcctagcttcaaataaggaantgctgccatatatgaaacggaaacctcaataatagaagaaaactcgatccactcctcttc

SEQ ID NO: 4756 - DNA, 121 bp, Artificial Sequence
  Synthesized
  misc_feature (61): n=t or c
gtttggagcctgaggtggctcagcatgactgaacactttgcactgacactgtgaaagaggnagttcatcaaagcctcagcttagagccacaaggttggaaaaataactcagtaatgtctaa

SEQ ID NO: 4757 - DNA, 121 bp, Artificial Sequence
  Synthesized
  misc_feature (61): n=a or g
gcaagaagagccagaggagctttacttggccaacctctccaaatctactgcaggcttgatncttctagcaaagtgagtgcagtagagactcaggaaacagcattcgttcaagtaggtgagc

SEQ ID NO: 4758 - DNA, 121 bp, Artificial Sequence
  Synthesized
  misc_feature (61): n=t or c
gaaaacaacagtaatttccaaaaggtggaggaagagctggtgtaataatcaagccagttcngaatgttacagtaatatcagaggtctagagacaaatccccagtgtctaattccacaccaa

SEQ ID NO: 4759 - DNA, 121 bp, Artificial Sequence
  Synthesized
  misc_feature (61): n=a or g
aaagagtctaaacttcagagttactgaaatggtggcagcaaatcacctgcaaggacaggtnagcatcctgcagctacctgaaggacagggacaacgagactcaagccaagatcagagcaga

SEQ ID NO: 4760 - DNA, 121 bp, Artificial Sequence
  Synthesized
  misc_feature (61): n=a or g
atacagttctaataaaacgcttgcctcactctaagaatgattatgggatctaccaaggtcntttaaggctgtagaatacaaatgacaccacaggttcaagcactgtagtcctcttcattaa

SEQ ID NO: 4761 - DNA, 121 bp, Artificial Sequence
  Synthesized
  misc_feature (61): n=c or g
gtgacgacgtatttgttgcttagttctccaccccctcttcctgcttagactggaattgctnggaagggctgtaacttggattggaagttttttacagtgaggatggtgaggcactggcata

SEQ ID NO: 4762 - DNA, 121 bp, Artificial Sequence
  Synthesized
  misc_feature (61): n=t or c
tattcatttaaggtacttttctaaacaaattccaactagtgctgtagattttagggtaatntgggacattagcagatctttatgcagctgttgaagtattgtttcttatacgatatatcag

SEQ ID NO: 4763 - DNA, 121 bp, Artificial Sequence
  Synthesized
  misc_feature (61): n=a or g
gctagaaaataaatttcatgcaggtaaagcatacttcactttgagacactacataagaaangcgcgatcccccaacaactacttactactggatatcggttctgctgagatgtgattctca

SEQ ID NO: 4764 - DNA, 121 bp, Artificial Sequence
  Synthesized
  misc_feature (61): n=t or g
ccaaaaactaaacgcttcttacaaagtggcctcttgatcttaagaaggtaattcagatctnttatcccctttatttagcagaagtctaagaggcttctagaaagcagaacagagagcctaa

SEQ ID NO: 4765 - DNA, 121 bp, Artificial Sequence
  Synthesized
  misc_feature (61): n=t or g
tacactgctttatatgtcaggtacccttggattatatagagggcattttcataaaatgtgntggcagccatttcggacagacctacctttgggcagtttagagtttattaatgttcaaaga

SEQ ID NO: 4766 - DNA, 121 bp, Artificial Sequence
  Synthesized
  misc_feature (61): n=t or c
ttgattgctgttctatacatagaagtgttccaaatgtttttgcagagtagttgcttataangtgtgtgacactgccttctttgatgcttcaggttttgtatgtataaaggagaagtgtttc

SEQ ID NO: 4767 - DNA, 121 bp, Artificial Sequence
  Synthesized
  misc_feature (61): n=t or c
tgctggataggacctctgagagaaagaaggtaacatgcgttaggggttagtgtctgtcctnaaatgggaaacagataataacctgactttagcttttctttctttttttttttttttttgt

SEQ ID NO: 4768 - DNA, 121 bp, Artificial Sequence
  Synthesized
  misc_feature (61): n=t or c
tgataacagcaacaaatagaattaaaattagctatcaacacaacccactaggttaattaanaatcaccataatcctaattaataatcccgtatacacaggaattttcttacatcttcacat

SEQ ID NO: 4769 - DNA, 121 bp, Artificial Sequence
  Synthesized
  misc_feature (61): n=a or g
attctccagggtcaataccaggcagtttaaaagtccctttgtctcagctacagtggggaanagtatgcaagaaagttgtgctactgttctccttcctgtgtactcagagccaaggtcttac

SEQ ID NO: 4770 - DNA, 121 bp, Artificial Sequence
  Synthesized
  misc_feature (61): n=c or g
aagtagaggatagtatatggaaaatcccttacctgtgcacagtacaaacattatcctgcanttcaaatcttactgttcttcagatttcacttaatgtgacaaggtataagtaaatgatctc

SEQ ID NO: 4771 - DNA, 121 bp, Artificial Sequence
  Synthesized
  misc_feature (61): n=a or g
acaaatatcctaggtttgcaagatatattgtagtaagtctttaaaagtggcattcctgacncaaatagcatgaactctgcagcttctattttaaacatttggagaaatcattcagatgctg

SEQ ID NO: 4772 - DNA, 121 bp, Artificial Sequence
  Synthesized
  misc_feature (61): n=c or g
gaccctactcataaagtagctgaattcagctctgcttcactctctgtcagttcagctccancaataacactagagggcatgtattagagcttgctgaaaccatacatataaaaaaagtacc

SEQ ID NO: 4773 - DNA, 121 bp, Artificial Sequence
  Synthesized
  misc_feature (61): n=t or c
ggaaaagctgtcagtgttatttcatgtactacaaaaatgtctgattgtgcaagtcacttcnaggactctgtagctccactcattagggatgagatccaaacctatttttaaggctttgtgc

SEQ ID NO: 4774 - DNA, 121 bp, Artificial Sequence
  Synthesized
  misc_feature (61): n=t or g
acagatgagaattcagaataagataacaaagcagagataaggctgggattcttcttttttncatgttgtctataatgcagcagtctccagtgcatctgcagcagtctctccagagcactga

SEQ ID NO: 4775 - DNA, 121 bp, Artificial Sequence
  Synthesized
  misc_feature (61): n=t or g
aaatgctccttctcattttgtattctctgcaaacttgctggggaagaactctgtctcattntccaagtcactacagaaaaggttaaacagtcaactcttggttttctcagccagtgactcc

SEQ ID NO: 4776 - DNA, 121 bp, Artificial Sequence
  Synthesized
  misc_feature (61): n=a or g
agcacctaaggatgtcttcttgctgctcaggtcaccctgggaagtagcttaaaagacagcngtgtgctcatctgccatcagaagtgtggatgtgacccctttgtgactctttaaccacgta

SEQ ID NO: 4777 - DNA, 121 bp, Artificial Sequence
  Synthesized
  misc_feature (61): n=t or c
aacttcgaagcacagtgcactcccttcttctcaaatattcaactacttaccattttccatncacaaaactcacttgattctgatctttactataagcaggaggtgaactcctgcttcaaag

SEQ ID NO: 4778 - DNA, 121 bp, Artificial Sequence
  Synthesized
  misc_feature (61): n=a or c
tcaacacagtttttgtatgtatccttaccctgtctgatactgataataatttgcaaaaaantggttctggttttcagtccttcttcttgatctctttcaaatggccatctatcttccatat

SEQ ID NO: 4779 - DNA, 121 bp, Artificial Sequence
  Synthesized
  misc_feature (61): n=a or g
ccatagcctggggtatctggacgaagaagtatttcctgctgaggatccctgctgaagtgcncttgggaccatcaatgcttgtttctcttggggtagaatccctgcttgagcacagagctgg

SEQ ID NO: 4780 - DNA, 121 bp, Artificial Sequence
  Synthesized
  misc_feature (61): n=t or c
aaaaaaaaaaaaaaaaaaaaggagaagaaccaaccctccagatcagcttctggttgaccanatgtctcaaatatgatgtttcttgttttttcagaaactagctcattcttctgactacaca

SEQ ID NO: 4781 - DNA, 121 bp, Artificial Sequence
  Synthesized
  misc_feature (61): n=a or g
caccatgatggaaatgtgattaatacgaccaaagtcagactagatagctgtgatgctatantatggttagcagttgtgtttcacagaacagggaagggctgcagttacagattaaatgaat

SEQ ID NO: 4782 - DNA, 121 bp, Artificial Sequence
  Synthesized
  misc_feature (61): n=a or g
acaagagccagaaccaatgttattgtgggggagagccaacaaaaaacaatgcaggcctgcnttcagatctggatatcgttgcatggataaaatgcgttatatttattcagattgcacctgc

SEQ ID NO: 4783 - DNA, 121 bp, Artificial Sequence
  Synthesized
  misc_feature (61): n=t or c
tccatacagtattcaagaattggatgcatcacagattcatgcagaaaagcaatatgcttantactcgtttcctttcctatcagatattctaactacctttgttgttattgactgttcttga

SEQ ID NO: 4784 - DNA, 121 bp, Artificial Sequence
  Synthesized
  misc_feature (61): n=a or g
cactattcatacacgtatctaccgggggaagaaatgtgtagctgattagattatattcaantagaataagcctacatactattccagaaatctgataagcctatatctgataagtaaaaat

SEQ ID NO: 4785 - DNA, 121 bp, Artificial Sequence
  Synthesized
  misc_feature (61): n=t or g
attaattaggctcttttttaatctggaaaaattcctattgcttcatcagaaagtgaagttntatagtgtatctttgaaagaataacaaagtcctttcttacctcctttacaatgcctattt

SEQ ID NO: 4786 - DNA, 121 bp, Artificial Sequence
  Synthesized
  misc_feature (61): n=a or g
catttctttctttctgctcttggtgcacagctaaaacagctattcattcaggctggctttnaagtttgtacccatgctccgtgctcgtaccttcatttctgagcacgttgcacagctgcca

SEQ ID NO: 4787 - DNA, 121 bp, Artificial Sequence
  Synthesized
  misc_feature (61): n=a or t
tctataggataaatacgagctccattgtacttgtagactccatcgtcaggaacagagtatnttgagcaacagagggaaagacgagaggatattattcactcatagatgtatccacgagcac

SEQ ID NO: 4788 - DNA, 121 bp, Artificial Sequence
  Synthesized
  misc_feature (61): n=a or g
atatttaagagattgacttgaatttgtagttgatctgttttgaagtactgagggtaagggngattggtgagaattaactggaatttggggatcagagggaaaggaggcttggggccataaa

SEQ ID NO: 4789 - DNA, 121 bp, Artificial Sequence
  Synthesized
  misc_feature (61): n=t or g
tcagcatggccaaagcattgtcacagagccaacataaagctaggtagaagcaggatgcgtnagcacttgggtattccaaatgtagtgtgtggcaagctagacatgaccaagcaataagccc

SEQ ID NO: 4790 - DNA, 121 bp, Artificial Sequence
  Synthesized
  misc_feature (61): n=t or g
ttctctacaatgattctcctccttctcctcttcctgttttgagtacgttccataggaaccnttcaaaagtaaacctgtgagtagttgggagggctagtctgtcacattttcctatgatccc

SEQ ID NO: 4791 - DNA, 121 bp, Artificial Sequence
  Synthesized
  misc_feature (61): n=a or g
catgaatatcttttggtgtgcagtatgaatgtgaaggtcttgttacttagaatattgtgcncgttgtcactgtgtaagaccctttggcctatgctttgagacacaggagctgcccctcttc

SEQ ID NO: 4792 - DNA, 121 bp, Artificial Sequence
  Synthesized
  misc_feature (61): n=a or g
agcttggacattgctggcgttaccctccagctctttgctggccagggggaagcctccatcntatcagaccttcgtagccaagccatttaacagccccttaacctctgccagaataatctcc

SEQ ID NO: 4793 - DNA, 121 bp, Artificial Sequence
  Synthesized
  misc_feature (61): n=a or c
acactcctggttttcctgtccttcactcccctgtgccagagacatgagggaggaaacaagntatatcccgtgcaaatcaatagaaagtcccttgatgcagctttggcctggagcagcgagc

SEQ ID NO: 4794 - DNA, 121 bp, Artificial Sequence
  Synthesized
  misc_feature (61): n=t or c
gcagtttggcgcctctaaacggagctgagagccttgaggttggattgtcatcccaagacangggtaggagcttcagggttaaggatcagcaccccaaaatgaggagttgggtacgcacccc

SEQ ID NO: 4795 - DNA, 121 bp, Artificial Sequence
  Synthesized
  misc_feature (61): n=t or g
aaggcatagttaatagctcaaaatgtactgagagtttgaggagacaaagccagagtgagcntaaggatggtaaatgttatcaagctgaaatctttagctgaacgcaggggcaattccagat

SEQ ID NO: 4796 - DNA, 121 bp, Artificial Sequence
  Synthesized
  misc_feature (61): n=a or g
ccaccagccatgctcataacctcgagcatgtcccttctgcaccctacaggggactttttgnaggatggtgtcactcatctcatgattgcagtgtttgtgtctcaccttctttttttcttgg

SEQ ID NO: 4797 - DNA, 121 bp, Artificial Sequence
  Synthesized
  misc_feature (61): n=a or t
tgatatatatatatatatatatatatatagtcattgtttcaagtaaccaaagcctctctgnctcactggcactcttttcagtcagttccataccagagtgttttggcagcattatactgag

SEQ ID NO: 4798 - DNA, 121 bp, Artificial Sequence
  Synthesized
  misc_feature (61): n=t or c
caagtcctttctctgttgttagtaaagagcttaattgtgcagcaggctccagtttccctcnggtcaatgcacttccgtggtgccccgtttcacaccgtcgtgttgctgcagttcccatcac

SEQ ID NO: 4799 - DNA, 121 bp, Artificial Sequence
  Synthesized
  misc_feature (61): n=t or c
gtagaggtgagatccgagcgtgttgacgctggaagaaaagggtgtttgctccccagtgccnggacccacggtgtgccattcttccccagcatcaccgcatctgcagctgcccctcgcttca

SEQ ID NO: 4800 - DNA, 121 bp, Artificial Sequence
  Synthesized
  misc_feature (61): n=t or c
gtgaatagttgtcaccatggagtgtcagggagggctaagctaaccccagccttacattggnagcaggttaagggcacacaaagggctcttcccacaaagcagatgaatggttggatctctg

SEQ ID NO: 4801 - DNA, 121 bp, Artificial Sequence
  Synthesized
  misc_feature (61): n=a or g
agcacagattgttgtctgtctgcaatgttcagaaagaaaagggataggatgcgttacagcngtttcccaagaggaagaagataatggcagatcagtggtagagagaggagcggtgagtagt

SEQ ID NO: 4802 - DNA, 121 bp, Artificial Sequence
  Synthesized
  misc_feature (61): n=t or c
ctttctacatgtgtataatagaacaggagaccagccgtactgcccttgtgagccacatatngagttttcatggggtgagagtcacaagacacttcgcgtgtaccagagagccgatgggctc

SEQ ID NO: 4803 - DNA, 121 bp, Artificial Sequence
  Synthesized
  misc_feature (61): n=a or t
acaggaagagttggtagattttaaaatagagttagaacttcacctctacagttattctgcntttcttcttcctgattatatgaagtaatttgtataagcagtccttttcttgacacggttt

SEQ ID NO: 4804 - DNA, 121 bp, Artificial Sequence
  Synthesized
  misc_feature (61): n=t or g
gacggccacctcactgctgccccacatgcagaagaagaactatgagcggctgcagaaggcnctggacagtgtgatgtccatccgggagatgacccaggtacatggcaagccctagctctgc

SEQ ID NO: 4805 - DNA, 121 bp, Artificial Sequence
  Synthesized
  misc_feature (61): n=c or g
gctgggaaacaacacaacccaaaacatgggtttgctttttgcttagcagcagtgagagatngttacgtacttcctacctcgctcatcttctacccaagacaaaaccatttgccttgagttc

SEQ ID NO: 4806 - DNA, 121 bp, Artificial Sequence
  Synthesized
  misc_feature (61): n=a or g
acttcccctcctcatctgtcagcagcactcgcatggatcacagccaacagctccttcccgntgttatttaggagtgtgtccctgcagaagaaggggatggctgagcagaaagcctctggag

SEQ ID NO: 4807 - DNA, 121 bp, Artificial Sequence
  Synthesized
  misc_feature (61): n=a or g
aaaggcaagagaaagattgcatcaggaacgatggacatcgtgcaaaacatttctctcatcnacaggtgtgggtctgagggaaatttctgaacatcctctatgtaaactcgttgatgttgtt

SEQ ID NO: 4808 - DNA, 121 bp, Artificial Sequence
  Synthesized
  misc_feature (61): n=a or t
tgtgccctgaaagtactgcctgacaggcaggacctgtgctgttgttttacttaaggtgttnaggcagagaatagatacctcgtaccgataagagccaataaggccagagcatggcagtgtc

SEQ ID NO: 4809 - DNA, 121 bp, Artificial Sequence
  Synthesized
  misc_feature (61): n=t or c
tttgtgcatttgtgggtctgattgctgctagtaaactttcccactcatatatatcctatgngattgctgcttgcatttgatagatttctactgcattttatcattactgcttctcaagatg

SEQ ID NO: 4810 - DNA, 121 bp, Artificial Sequence
  Synthesized
  misc_feature (61): n=t or c
cagctacttaattttgttggcaaatgttctgctggcagctgctagctgctggcatgtttgnccccttcactttaaccaagcagaaagccagtgcctgtttaactccactatgatgagagca

SEQ ID NO: 4811 - DNA, 121 bp, Artificial Sequence
  Synthesized
  misc_feature (61): n=a or g
ggaggtttatttccttttattttcataaacaaagactgcatcagcaagaggaagagcaaantaacatgacaaattgctaatatctttaattggctttttttttccaggtcattgaagactg

SEQ ID NO: 4812 - DNA, 121 bp, Artificial Sequence
  Synthesized
  misc_feature (61): n=a or g
atatggtgagctctggtgccttccatataccagagccacctgacacctttttaatcacgantaaggcaatatacttttccctagttatgctttggaaaaacacaattgtatttttgtagat

SEQ ID NO: 4813 - DNA, 121 bp, Artificial Sequence
  Synthesized
  misc_feature (61): n=c or g
aggatatctgaaacacaatcctcatacgcaagcatgctgaaacagagcttacttcatggtnacatgtttaatggaaaggaaataagaaagagtggaacaattcagtccaaaggtattagaa

SEQ ID NO: 4814 - DNA, 121 bp, Artificial Sequence
  Synthesized
  misc_feature (61): n=t or c
tagttaccttaccttctgctgctgctacctgtgagttggcaatggcagttccttgtcaganctcagttcagatggcagttttgtaaggctgaggctttgtacatctctaagacgtgaatgc

SEQ ID NO: 4815 - DNA, 121 bp, Artificial Sequence
  Synthesized
  misc_feature (61): n=t or c
tataggaaaagctattcgtaatatagaagaaagcccacgtttctgtggctatttctgtagngttgcttggatttatgagtgtctggtgagcagtaggagagaagcaattgtacttcctatc

SEQ ID NO: 4816 - DNA, 121 bp, Artificial Sequence
  Synthesized
  misc_feature (61): n=t or c
ttgaatcctgtcttgtgtttcaaagatttcaattgattgtactgtatattcacagatgtanttgaatcattttttagacccagtaaattgttctttatgcagatggcaattcttccttgat

SEQ ID NO: 4817 - DNA, 121 bp, Artificial Sequence
  Synthesized
  misc_feature (61): n=t or c
ttgataccaaagcatttgagtttcacatatgggttttgtaccaaaagtcttgactgtaaangtagaactcagttcctcctgcgtcattcaagggaatacaaaagaaaatagggatctttct

SEQ ID NO: 4818 - DNA, 121 bp, Artificial Sequence
  Synthesized
  misc_feature (61): n=a or c
gaatcagtaaacattgctgtggtactggaattctgagagacctggtgattagtttctgtanctctggccaaactaggccagatcaagaaggcagcaaatgatactgtttgactgttgagag

SEQ ID NO: 4819 - DNA, 121 bp, Artificial Sequence
  Synthesized
  misc_feature (61): n=a or g
cacctgatttttctacacatggtaagtaactgccagtcaagggtcatggagggggagaagngcagctagtcaccaccttaggtacttaaaagagctaatatactttcccatcattagatct

SEQ ID NO: 4820 - DNA, 121 bp, Artificial Sequence
  Synthesized
  misc_feature (61): n=a or g
gagctgacacaatgcgggtttgtcatcaggcactccacggcaagcatgtatcacctttctnctcccccttttctaggattaggagtgttctggtgatgaaccatttgctgcaaaatacaga

SEQ ID NO: 4821 - DNA, 121 bp, Artificial Sequence
  Synthesized
  misc_feature (61): n=c or g
caaacgttactgcaaagcaagtacttccttattttgatgccattttcctgatcattaaatnagaaacaaacctgtgcagattgcactctgcagtgtaaaatgcagttcctataactgtgct

SEQ ID NO: 4822 - DNA, 121 bp, Artificial Sequence
  Synthesized
  misc_feature (61): n=t or c
taatctgataaaaatgctctggttttggtgaccttggtctctgtcaatcgagagaatgttntactgggaaaaatccccctgaagatagcattcagatcagtagaagatgctgtgtttaagt

SEQ ID NO: 4823 - DNA, 121 bp, Artificial Sequence
  Synthesized
  misc_feature (61): n=a or g
ctgtaagtatttgctgtctagctgaccaaatactggcaacaaatgtaagaggttgggattngatgaggcctcgtctcttagttcttactcaattgccaaataaacttaatggaaaaaaaaa

SEQ ID NO: 4824 - DNA, 121 bp, Artificial Sequence
  Synthesized
  misc_feature (61): n=a or t
gctactctgaaaagcaggccatttcatgagaacctcaaacagaacattttgagcaggaaantttttactctacctgttcctgcacctcagtttggatatatctaagcataagtggttatat

SEQ ID NO: 4825 - DNA, 121 bp, Artificial Sequence
  Synthesized
  misc_feature (61): n=t or c
acaatttcagaattagtacacatatggccttgacattttgctgaattgtgatcttctgttnaccagcattatctaacagctcttattctaatctacaaccaaatcagttaagtgaggcttt

SEQ ID NO: 4826 - DNA, 121 bp, Artificial Sequence
  Synthesized
  misc_feature (61): n=a or g
aattattttaactgttaaagctctgatttgtggcttacaaacccaagcattggaaataggntggcaaaaatacggcaacgcatgttgctatggaatgatacagctcaggaagaaggtgggg

SEQ ID NO: 4827 - DNA, 121 bp, Artificial Sequence
  Synthesized
  misc_feature (61): n=a or g
ggatctaatagatccccaggggaaggcatctatgccttatcttcaactcagttgaaccatnaaataggatgaaagcagacctgaacaaaaaacaaattctgtacctaagctgcttactaca

SEQ ID NO: 4828 - DNA, 121 bp, Artificial Sequence
  Synthesized
  misc_feature (61): n=t or c
ctgaagaaacttaagacaattcaccaagtgcttcctagcagaaacaaacatacactaaatngtaatgcagatcattggactcactcacaactgcatgaacgaagtcaaaattctggtgaac

SEQ ID NO: 4829 - DNA, 121 bp, Artificial Sequence
  Synthesized
  misc_feature (61): n=c or g
agaaaccccataatgccatgtttttctaaatactgtttttcacaaccgaactgcagtgtgnagcaatggtttcactgccatctggctgcatttaggaactgaaacagcaagaacaatcaca

SEQ ID NO: 4830 - DNA, 121 bp, Artificial Sequence
  Synthesized
  misc_feature (61): n=a or g
aactatgttttaaccaatttattccagagatcagtatattcttattttgctgtcacatacnaggacatctgaagtcaaattgagatctgctgtgactggatgcagctccaccaagctcagc

SEQ ID NO: 4831 - DNA, 121 bp, Artificial Sequence
  Synthesized
  misc_feature (61): n=a or g
gtcttctcttttgtaggtctagcaaatagaaatgtatctctgtaggtcctaatgagtttgntttaccatgcatttgaatataaattgctggcagtttgctattttgaaatatgtgttacat

SEQ ID NO: 4832 - DNA, 121 bp, Artificial Sequence
  Synthesized
  misc_feature (61): n=a or t
agcaggagtagaattcttatttttaagtctcattttggtttttctaagcctgaagtcaganatttgggtccagacgctcatttcttattaatgggtatatagtaattgtgggggagatgca

SEQ ID NO: 4833 - DNA, 121 bp, Artificial Sequence
  Synthesized
  misc_feature (61): n=a or g
tggctgctgataaatataaggctgttggtctgtgcaaggctcagttttctgtttgtctgcnttgttcttaactctccactgccaccctactcatacctgtcatggggaacagctcaaatat

SEQ ID NO: 4834 - DNA, 121 bp, Artificial Sequence
  Synthesized
  misc_feature (61): n=a or g
cacaaaaataagccctaaactgagaccttctattgggatttatgtcagcacagcgactgtnactattatgaacattattacaaactaaatgcagctacacatagggctgctgtctcaaatt

SEQ ID NO: 4835 - DNA, 121 bp, Artificial Sequence
  Synthesized
  misc_feature (61): n=t or c
tgcctccgtcaccaccctgctcctggcactgcaattcccacaagccctaacaaggatgggntgcaagttgctccaacttccgtgagtttttgctgctcaaaccctttcttgcaataacatc

SEQ ID NO: 4836 - DNA, 121 bp, Artificial Sequence
  Synthesized
  misc_feature (61): n=t or c
ctcagaaatgacctttttaagagttgtctgaagaatgggaacaggttggtactcacattcnagcaagtagaaagaaaaatctaacccaaaatgctcctagcatcctactttgggtcttgat

SEQ ID NO: 4837 - DNA, 121 bp, Artificial Sequence
  Synthesized
  misc_feature (61): n=a or c
ttttaggctaaaaaacaacaagcacttctattacatgctcctaacaggagctttacaaganaaaaaatgaatgagttacaggaagtcttccctccacttctacatctaagtaggcagagag

SEQ ID NO: 4838 - DNA, 121 bp, Artificial Sequence
  Synthesized
  misc_feature (61): n=a or g
tctcttacctcctcacgtacaaactgggcagccataattgctctctatcacccagcagctnccatgctgctattattaagtttttttttaatatatatatcttttaagatcagaagaagga

SEQ ID NO: 4839 - DNA, 121 bp, Artificial Sequence
  Synthesized
  misc_feature (61): n=t or g
atatgaagtacaccaatgcctgtccccccattccctcctgaagatgctccatagcagaganatttgatttcataaccttggtcagacaaaaacaatggaaaagaaccttcacagtcaccaa

SEQ ID NO: 4840 - DNA, 121 bp, Artificial Sequence
  Synthesized
  misc_feature (61): n=a or g
cagagacaacaacagtggaggactgttagcagagacgtaccaatacataacagccagtcangtctgagcaactcttatagattaacccacaaggttatgctgggagaatttgtgctccccc

SEQ ID NO: 4841 - DNA, 121 bp, Artificial Sequence
  Synthesized
  misc_feature (61): n=t or c
agttaaaaaaagagattaaatctcccatataatgcacaaaggccgcccttttccctccaanatgtgctccatgggaagaaggagcatgcaaggcgcggacccgggcagcgcatgtcgggag

SEQ ID NO: 4842 - DNA, 121 bp, Artificial Sequence
  Synthesized
  misc_feature (61): n=t or c
gcgttgtgccccgggggctgtgcagacagcgtgttctgttctgtattcctcacaccacatncctcagttcccaggtggttgtgtggctgaagaagggggagctgccccgtgcggtgaccag

SEQ ID NO: 4843 - DNA, 121 bp, Artificial Sequence
  Synthesized
  misc_feature (61): n=t or g
aaataaaggaacctaacaccagtctactcatctcacaattgaatcctgccataaggtaccnatgggtgtttgcagtacagaggacatgagggctcaaaagaactcaggaacatacagatca

SEQ ID NO: 4844 - DNA, 121 bp, Artificial Sequence
  Synthesized
  misc_feature (61): n=a or g
caagggacgcctaatctcttgaacgccaggatgcacaagatgagaatggtgtgaatcatcntgtggaaagccacatctgaacaatagtcaaattcctgagagttaatatctttggagcttt

SEQ ID NO: 4845 - DNA, 121 bp, Artificial Sequence
  Synthesized
  misc_feature (61): n=a or g
agatcaaacactattttgttatttgaaactgggagtttgcttgctatttgaatacgttggncttttatcttttaatgagatgctgatactttatagaaggtattgtggaatggcatcttca

SEQ ID NO: 4846 - DNA, 121 bp, Artificial Sequence
  Synthesized
  misc_feature (61): n=t or c
agagttctggacagtatctaccagtaatgacacgtgatgcttcagaacttccatatttctnggtccataggaattctacataatctcagtggattagcaaaacaaaaaatgaataaaaaag

SEQ ID NO: 4847 - DNA, 121 bp, Artificial Sequence
  Synthesized
  misc_feature (61): n=c or g
gcttggcttgttgagacagtgaatacagatgagatggggagaagcccaacaattcaactanagcaacttctgggaagtcacaattagcactacaagacaattaaggcggtgatttatttct

SEQ ID NO: 4848 - DNA, 121 bp, Artificial Sequence
  Synthesized
  misc_feature (61): n=a or c
tgcttcccagggactcatcagctttagagcagaagactttgagttccttctggtgtgtctntctgaacctctgcttgtcccttgggcacatcgtatgatctagcttgccttgggtttacca

SEQ ID NO: 4849 - DNA, 121 bp, Artificial Sequence
  Synthesized
  misc_feature (61): n=t or c
atatgcacaagcccataagtgctatgagctccattattttctagcaattgcttcagttccnttaaccttctactaatagcttttttgttatgagctgagcaaataaagcttgggtccaaca

SEQ ID NO: 4850 - DNA, 121 bp, Artificial Sequence
  Synthesized
  misc_feature (61): n=a or g
agaaatagcgtttccttttgccaagagtgcataggagctgctgtgcaccggtgttttgtgnaaaagcagtcttgggttcatggtgcaccttcttttttttgccaacgggcagcgtcaacat

SEQ ID NO: 4851 - DNA, 121 bp, Artificial Sequence
  Synthesized
  misc_feature (61): n=t or c
ttttttagtagtcccaggtactaactatctcagcatgggaagagattggtggcggtctggngttcgcagcttacttgtgattctgtaagattttcttattatattcaatagttctgtcaga

SEQ ID NO: 4852 - DNA, 121 bp, Artificial Sequence
  Synthesized
  misc_feature (61): n=a or t
tccattgctttacctatcttattgtgagaaagcttttctggtgtaaattaaatcaacagcngtatatcatagtataattcttctatgttctttccctttacaattgtcctgaatgtgtttg

SEQ ID NO: 4853 - DNA, 121 bp, Artificial Sequence
  Synthesized
  misc_feature (61): n=t or c
tctgatctctgagttgtaattaaaacctctcattgggttctaagggctgacaggctgtccnactcctaaagagtgccatgaagcatcttgcctttctttctgtgtctggatttgtccacac

SEQ ID NO: 4854 - DNA, 121 bp, Artificial Sequence
  Synthesized
  misc_feature (61): n=a or c
ctgtacttttcccatcttacacacatccctgtaagcagaggaggcagcacaccgggcaggntgcatgctcacacgtagtgagatacataaaccctgcctttatttatctatatacatgcag

SEQ ID NO: 4855 - DNA, 121 bp, Artificial Sequence
  Synthesized
  misc_feature (61): n=a or g
aggagcatctcttttcttctttccacaactgttaaataggccttgaagttttactgtggcngttatcacttcactatctgaacaactcccaggttaattgagtgaccagagttcttagcga

SEQ ID NO: 4856 - DNA, 121 bp, Artificial Sequence
  Synthesized
  misc_feature (61): n=a or g
caaaacattttctctaccttatagacctggagataacaagtagctgaagaaacaaatgtgnccactgttaatgtagatggtattacttaaaaatgagtccaatgaatgcaatctggtttat

SEQ ID NO: 4857 - DNA, 121 bp, Artificial Sequence
  Synthesized
  misc_feature (61): n=a or g
gaagaggagagagtaaaggaagaaagctgttgtaagactaaatgactaatcattcatcctngagtttgttaccctttcggattcatcaaactgtgtaatgagagcagctagcttaagaact

SEQ ID NO: 4858 - DNA, 121 bp, Artificial Sequence
  Synthesized
  misc_feature (61): n=t or c
tggattttgtattaaaccactttaacacttttgtagacctgaggaactctgcaaatactgngagtgaaatgccctgagcttcatcttgcatgctttgaactgagcacagtgaactttgcct

SEQ ID NO: 4859 - DNA, 121 bp, Artificial Sequence
  Synthesized
  misc_feature (61): n=t or c
cagaataatcctgttagaaaaggaaggaagaaatagaaatatttcaggccttctgtctttnccagtgtacagtatttgcttccctccttccatgagcccctttcttaagccacctgttcta

SEQ ID NO: 4860 - DNA, 121 bp, Artificial Sequence
  Synthesized
  misc_feature (61): n=t or c
acagtgtgaacaacagggttggcattccttgcaggccatgattatcacttatcaaattacncacaagcacagcaaaccaagtgaagcagcacatcacactgacacacaccaaaccgaggcc

SEQ ID NO: 4861 - DNA, 121 bp, Artificial Sequence
  Synthesized
  misc_feature (61): n=t or c
tatcactcatttaaactcatttattgattgactcaggaacttacacagttacagaaaagantttcctttttccttagcactgtggaaataaccatagagctcagatgaaagagaaaccaca

SEQ ID NO: 4862 - DNA, 121 bp, Artificial Sequence
  Synthesized
  misc_feature (61): n=c or g
ttgaaggcaagaacacaaaaggcaaggaatcactggtcagttccacagacagatcaaaggnaacaaatatggaagctcccaaacccaccatctctcagccaggatcgcctcctcttggacc

SEQ ID NO: 4863 - DNA, 121 bp, Artificial Sequence
  Synthesized
  misc_feature (61): n=t or c
tgcccccagctgtgtggggtagtgcttcacccacgagtgctacaggaaagggatccagatntcctccttagccagcattcccaggacttcctggaagcatttcctaggtgagggactgctg

SEQ ID NO: 4864 - DNA, 121 bp, Artificial Sequence
  Synthesized
  misc_feature (61): n=a or g
ccttagaacgacagataatgatattaaagagccataacaaaagctgagaatgcagcatgcngtgtcttaggcggtgtcctggtgcaatgaatcggtgatttactttacctttcactcaaag

SEQ ID NO: 4865 - DNA, 121 bp, Artificial Sequence
  Synthesized
  misc_feature (61): n=a or g
gcaagagctaacatctcaccgagagacccatgggacaccagagctcaccaaagtcagtggnagatagtctgatggcatcagtggcttttgggtcaggctctcagtggaggcaatggtgttc

SEQ ID NO: 4866 - DNA, 121 bp, Artificial Sequence
  Synthesized
  misc_feature (61): n=a or t
acccatcatccaacatagcaatcactatggaacactttctagagtttccaggcctgactgnagctaccacagactagctacatgcatttggagagcactaatgcaagtaaaggaccctgtt

SEQ ID NO: 4867 - DNA, 121 bp, Artificial Sequence
  Synthesized
  misc_feature (61): n=t or g
tttctcagccctactgaaggtcatctggttgagacagtgatggaaactccaaagagaactntcagttggagtcagttggagcagaggaagaaagctttccttttgtcttgttatactatag

SEQ ID NO: 4868 - DNA, 121 bp, Artificial Sequence
  Synthesized
  misc_feature (61): n=a or g
tggaacaggaatacttgtataactgtactcatattttttctgtgttacaaaacgactttcnttacattatattagctggtttgggaaagttttgtccatcactcaactgtaccagtggcct

SEQ ID NO: 4869 - DNA, 121 bp, Artificial Sequence
  Synthesized
  misc_feature (61): n=a or c
gaaagctgcgcagtctcctttccatgggcactcatgccatggcttctacaggtgtgtcaantgaaaggcagctctaggatttaaagcagcagactgagcgagcaaagcagagaatcacagc

SEQ ID NO: 4870 - DNA, 121 bp, Artificial Sequence
  Synthesized
  misc_feature (61): n=a or g
catggggatgtgcagcgagggtttgcaagaggcacccttcaaataacctgaaatttctcanccccaggtacaagtgggagatccaggcaaactgttccaggatagtaaatgaactaaaaaa

SEQ ID NO: 4871 - DNA, 121 bp, Artificial Sequence
  Synthesized
  misc_feature (61): n=t or c
gtttgctggctcccagttgtaggtagttttactggcacacaactctgctaacctctgtacngagctagctttatgggcaggttgttgtggccctgcccttacccttgtgctgtcactgccg

SEQ ID NO: 4872 - DNA, 121 bp, Artificial Sequence
  Synthesized
  misc_feature (61): n=t or c
ggaaactgtaaggttgtctcagctctgctcagggtcccttagcccgaggaaagagctcacncagggtgtaacacagcacaatgaggaagagctcaggcattttctggagctcggggtttcc

SEQ ID NO: 4873 - DNA, 121 bp, Artificial Sequence
  Synthesized
  misc_feature (61): n=t or c
atgagcaataaggaaagcaaatctgagtaatttacactactacaggaccgtttactacttnggggctattgatagatccacagttagacaatggtctgatttgccctcttgatttaggaag

SEQ ID NO: 4874 - DNA, 121 bp, Artificial Sequence
  Synthesized
  misc_feature (61): n=a or g
gcttgggcgatggttccatcccagtggggttgggatgcacagcacacaatggggccttacnggtggtgatggcaaaagggcagtttggcacccactgagtgctgtgtgtggagtgatgctg

SEQ ID NO: 4875 - DNA, 121 bp, Artificial Sequence
  Synthesized
  misc_feature (61): n=t or c
gagtctcgagaggcagaattcatgcctgtgaggttttgcttctcagcccatccctttgtgngatacttagtttaagcagtatctgaaggaatcagtctctcttattatcaaagccacaagc

SEQ ID NO: 4876 - DNA, 121 bp, Artificial Sequence
  Synthesized
  misc_feature (61): n=t or c
cggtaatgacatccttcctcaacccagggagaagaaagcactttgagggtgattgagcagngctcctgagacacagctttaaataaactaattagcaagctgccttcatttctggatttag

SEQ ID NO: 4877 - DNA, 121 bp, Artificial Sequence
  Synthesized
  misc_feature (61): n=t or c
ctccctgtcctgctgctggtatccaggcaggtgctgtgcctgttgctgactccgatgaaangtacagtctgcagtttccatgccaaaatcatcagctgtgcaaaatgaacctcctgtcggt

SEQ ID NO: 4878 - DNA, 121 bp, Artificial Sequence
  Synthesized
  misc_feature (61): n=a or g
aaatgagagtggctggctgacaggttggtgagtggctgcatggtatgaaatactggggaantgaaaaagggatcaaatgtagagtcccatggagactggtcaggtcaaggacatggctttt

SEQ ID NO: 4879 - DNA, 121 bp, Artificial Sequence
  Synthesized
  misc_feature (61): n=c or g
cctgaatttctgaaacaagatgatttcataaagatcccatctggaattttcagtagaagtntcagctgatatggtgataccgactctggtatctcatgtggttgtaatacatctctgcaat

SEQ ID NO: 4880 - DNA, 121 bp, Artificial Sequence
  Synthesized
  misc_feature (61): n=t or c
actaagacagtggggataatgattgaattggatgagtcaaatttgtccagttttaagaagngatggcattttgaatcctaaaattcaatttgcacaagatacagcatcataaagttgaaca

SEQ ID NO: 4881 - DNA, 121 bp, Artificial Sequence
  Synthesized
  misc_feature (61): n=a or g
tgagtggaatattcagaaattgagggtggttgggagtaggaacttgagtacaatatgtcanttctgcattgttatgtaggacacactaaaagatctaaggaggccatgtttaaaaatagaa

SEQ ID NO: 4882 - DNA, 121 bp, Artificial Sequence
  Synthesized
  misc_feature (61): n=t or c
tataacggggagattctggggatgggaccaccagactgggaagatgttgctgcatgcctanttgagccatctgggcttatgcagcactgccttatgtaggacgtagttttctgtgcatgtt

SEQ ID NO: 4883 - DNA, 121 bp, Artificial Sequence
  Synthesized
  misc_feature (61): n=c or g
atttcctgcccttggatctaatctcccccagtcctaagattatttctcccatctttagcanttacggcttctccagctttcaccttccccaacaagctttggcctcattccccccgaacag

SEQ ID NO: 4884 - DNA, 121 bp, Artificial Sequence
  Synthesized
  misc_feature (61): n=t or c
ctgggcatgcagcctcttccctggctaatcccagtggtgcttagggctttatgagctaacntgaacaagggaggagaggatgtgttcattgtatttgcaggtgccattgaattggaggagc

SEQ ID NO: 4885 - DNA, 121 bp, Artificial Sequence
  Synthesized
  misc_feature (61): n=t or c
tggtctttcatagagaggaaacaggcatccaagcagaaagctgccttggtctcctgagtcnggagctcagatcctggttgatgctccatacttttaatgagggcagttctttcattctttc

SEQ ID NO: 4886 - DNA, 121 bp, Artificial Sequence
  Synthesized
  misc_feature (61): n=a or g
ttgtgcatgcacacttggatgccccaagatgttcaacttggagcccgcaccagtaagcctncatcttgtgctgtttctctgcagttaagaaagagacaacccaacatatgagaagcccttg

SEQ ID NO: 4887 - DNA, 121 bp, Artificial Sequence
  Synthesized
  misc_feature (61): n=a or g
gatttccctaatgatctcattcctttcccaagatgtctgtgtggctcttgtcccacaagtnacatttgaaaggcactttcaaggagaggtggtacctagatttgttcactctttgggttgt

SEQ ID NO: 4888 - DNA, 121 bp, Artificial Sequence
  Synthesized
  misc_feature (61): n=a or g
ttccttcatttgcctctttctccccagatcaagtttgaattcatctcccgacatctggacntcactgagtccttctgggtctttacaatccctgagaagagcctttcagtcctgttcctgc

SEQ ID NO: 4889 - DNA, 121 bp, Artificial Sequence
  Synthesized
  misc_feature (61): n=t or c
ttgtgctgctgcacagtatgatgacacggctacctgagcaatctgtctttccaacacaagntcaccaaggcacacctgttggaactaggcagacacctctcacctgcagtccaatgttcag

SEQ ID NO: 4890 - DNA, 121 bp, Artificial Sequence
  Synthesized
  misc_feature (61): n=t or c
gaatccaaagtatacataagagaaatacagagccatcttcaaacctcagctttatctacgnagttttgcatatttccacagataaaccgttactcatgacttggctcatcaattaatttat

SEQ ID NO: 4891 - DNA, 121 bp, Artificial Sequence
  Synthesized
  misc_feature (61): n=a or g
aggagggactcagagctcctgcaaatcagaggagtgtttcacagaatacacagcaacaacnaaggcatctcaggtacagctcaagcaaaggccaacttgagacgtgctctaataggagcac

SEQ ID NO: 4892 - DNA, 121 bp, Artificial Sequence
  Synthesized
  misc_feature (61): n=t or c
acacgtttgttacagaattatgttctcttcattgtctcacacgtgacatgacacattctgnctcagtccatactgacagacacagtgctacaactcagtaagacaaagtggccaacaaagt

SEQ ID NO: 4893 - DNA, 121 bp, Artificial Sequence
  Synthesized
  misc_feature (61): n=a or g
gccctcccctctctcagcccattcactgtcagaggaagtgagttgcaggtgaggatggcantgcccgacccttacccggaaggcaggaaactttgcaggccaattttcggaagtatggggt

SEQ ID NO: 4894 - DNA, 121 bp, Artificial Sequence
  Synthesized
  misc_feature (61): n=a or g
gttttgggacacacccaaaggaaagattctcttttaaagacagtcagaggcaaaacatgcntagggaatgaagggtttcctgttggtcaaacaaagtcccttggcaagataaaggctggtg

SEQ ID NO: 4895 - DNA, 121 bp, Artificial Sequence
  Synthesized
  misc_feature (61): n=t or c
ttaagcaaagaaaaaagggatggacataacttcagccagtttaggtttgtgatgaagacantgcatgcaacgtaagcccctccatcctgcagaatacagacttctctgcataatgcttgtg

SEQ ID NO: 4896 - DNA, 121 bp, Artificial Sequence
  Synthesized
  misc_feature (61): n=t or c
tggaacaagggtggcagaaatatgaaagaactgtgcttcatattctggctcccagaatccnaggccacagaacagcattaaggttgtgcagatccatggagagcactgggttgtatttgcc

SEQ ID NO: 4897 - DNA, 121 bp, Artificial Sequence
  Synthesized
  misc_feature (61): n=a or g
caaaactgaggtttgtttgtagtcatttacgtgtgaattcagcagatttcatggtattgtngtgaaggggagattagcaagtgcatctggcttcgatgattggcagagggatcccggtgag

SEQ ID NO: 4898 - DNA, 121 bp, Artificial Sequence
  Synthesized
  misc_feature (61): n=t or c
gtaagaagactgaagtctctcttcttgccagttgaaaaataattttatttacttctgtgangtttctaactttttgtcttctctgaatgatttcttcaagtactgagaagtatttcatcca

SEQ ID NO: 4899 - DNA, 121 bp, Artificial Sequence
  Synthesized
  misc_feature (61): n=a or g
aagcggaagacaaagacaccacctattcccaatgcagtctgtctgccccatttaatcttgngagaaccacattttccatgcagtgaacaaaaacttctgcctccacttggccacagacagc

SEQ ID NO: 4900 - DNA, 121 bp, Artificial Sequence
  Synthesized
  misc_feature (61): n=t or c
gccctgaaggcatctctctgttgatgaacaaaacactgttttgctcctcaggccatctganatcccttggggcagaatgcagggtatttccgaagtacctgccacaaaaacccctttgcag

SEQ ID NO: 4901 - DNA, 121 bp, Artificial Sequence
  Synthesized
  misc_feature (61): n=t or c
gtcccagttcttaaaacagtagagatttaaagtaagtgatttatgcattttaaattagggnatcatattggccaggccaagagtgagtaaactacaaccagtaacaggattgaactaatgt

SEQ ID NO: 4902 - DNA, 121 bp, Artificial Sequence
  Synthesized
  misc_feature (61): n=t or c
taaaataaacataatgccccttgtgattccctgttcttacagatgggaaagcagttgccanagattgcgttacatgagttttttcatttttgcaatacaatctagttgctaaagaatacag

SEQ ID NO: 4903 - DNA, 121 bp, Artificial Sequence
  Synthesized
  misc_feature (61): n=a or g
aaagtcaaagcacaaagactttgaatgatttgtctgcatgaattggtagcagagctaagantcgaattgtggcttggctcaacctgccatggtattattcatcatcccaactactcagtca

SEQ ID NO: 4904 - DNA, 121 bp, Artificial Sequence
  Synthesized
  misc_feature (61): n=a or g
cgttgtgcactactcttttcagcactttcctttgaaggatgtagttaaggaaatgtggatntatcaaagacttatccagtgaaaagaaaaagcttcatcaaattaatattacttctttgta

SEQ ID NO: 4905 - DNA, 121 bp, Artificial Sequence
  Synthesized
  misc_feature (61): n=t or g
agctgcatgaaagctaggatgatttttatctcccccatcaatatggcaatggaatgatttnctaagtaataaatacatgatccaaatacttgtgaaatgcccaagggctacctctggaaac

SEQ ID NO: 4906 - DNA, 121 bp, Artificial Sequence
  Synthesized
  misc_feature (61): n=t or g
tttttgaagtctcatctaaagccaaacaaataaaaacacccaaactctgccaaatatgatntgttggtctcatcctgccaatgtgacatagcagatatccccatgattttgagcactgtaa

SEQ ID NO: 4907 - DNA, 121 bp, Artificial Sequence
  Synthesized
  misc_feature (61): n=t or c
tcaggtaggagagggctatacagaactttaattctgcttattcagtaataatttattttgnaagttccaatcgttaggattattactaattgccatgctgttcagctgcactgacacaaaa

SEQ ID NO: 4908 - DNA, 121 bp, Artificial Sequence
  Synthesized
  misc_feature (61): n=a or c
gttatagtactgcttaaactcctcttaggaaatagaaccaatatctctcccccttcttacntaggatgcttcacgcacccagtctcatcactgttaatgtttttcttttttactgtctttt

SEQ ID NO: 4909 - DNA, 121 bp, Artificial Sequence
  Synthesized
  misc_feature (61): n=t or g
ctgcacgatgttgcagtttttccatgcagtgtttgtacctgtcttctgtttctgggcacantgtggccctctgtccttggactgaagcggtgcggtgtctgtcccaggacaggctgtccag

SEQ ID NO: 4910 - DNA, 121 bp, Artificial Sequence
  Synthesized
  misc_feature (61): n=t or g
tgtgcctgcaagctagaaaaatatgattttacccactggtttattttgcagccatgaggancttgtgtctgctgctgacaggctcagctacttggtcatgtctccctgttgtgtgataagt

SEQ ID NO: 4911 - DNA, 121 bp, Artificial Sequence
  Synthesized
  misc_feature (61): n=a or g
ctgttcattgtaattaataatgacatgaaggtacttcactgaaccttgaaggtacctcatnaaggtatccagctactcgtagtcttttccagtaccagttttgaactggaatctgtctata

SEQ ID NO: 4912 - DNA, 121 bp, Artificial Sequence
  Synthesized
  misc_feature (61): n=a or g
tgaggtgcaaaagaactgcatattggatatttaagtctacatctaagaattgaagtatctnttagtgttgacttcagtgttctggagcccctgcttggcttccattctagcaaaccttttc

SEQ ID NO: 4913 - DNA, 121 bp, Artificial Sequence
  Synthesized
  misc_feature (61): n=t or c
cctgtaaatgcttcccattctgtttgccataatacaaggttatgtatcattttctttgtgnacattttctctactaagatgctgagatcactgcataaagtaaagctggtaggtttttgac

SEQ ID NO: 4914 - DNA, 121 bp, Artificial Sequence
  Synthesized
  misc_feature (61): n=a or g
gggtgattgggatgtgaaatgaaaatccactggaaaaggcctgtgttctatttcagatacntagctactgatttttgctactgccatagactacagagagaaacaatagcatctaaatgtt

SEQ ID NO: 4915 - DNA, 121 bp, Artificial Sequence
  Synthesized
  misc_feature (61): n=t or c
gttttcatcagaagactgatatttcagtgaactcaactttgaagacattttcctatcacanacttgagaaaaatcagagtttcaacaattcttagggaaaataaaacctgtaccattttcc

SEQ ID NO: 4916 - DNA, 121 bp, Artificial Sequence
  Synthesized
  misc_feature (61): n=t or c
taggtgccttgaacctatctgtgtgtttctttgtttcaatacaaacattagctttccagantgtatacaaatgtgcaaatactggatcaggtctctgggaccttggttggagactgtgtat

SEQ ID NO: 4917 - DNA, 121 bp, Artificial Sequence
  Synthesized
  misc_feature (61): n=t or c
taaggagagattgtaaattctgttttttgttttctgtcattttgtagcatcttatttctancagtttaaagcacaagtcacgaagaagtgtatttccagttggctactacaagtaaagaac

SEQ ID NO: 4918 - DNA, 121 bp, Artificial Sequence
  Synthesized
  misc_feature (61): n=a or g
caacctttttatgggaattgataataggtaaaaaaaaattcctttgcatagtttaactaantgaatgagctgagctggacgggtttgaggttcatgcaactttggtatgtttttgtaagct

SEQ ID NO: 4919 - DNA, 121 bp, Artificial Sequence
  Synthesized
  misc_feature (61): n=a or g
ttgtattctgcccggaaaaataggaatgcagtgtgtagtgtttaattccattctcccacantgttttgagtaaacagaagtagtaagtaaggtaataagagccagtgagtttttgtatcag

SEQ ID NO: 4920 - DNA, 121 bp, Artificial Sequence
  Synthesized
  misc_feature (61): n=t or c
aatcctaacagctgaggacattagtttggcctaatctataaactcataaatctgttatctncttgtaagactgtaaaagtatgtggaaaagcatgaaaagccaagtccctgcccttggtgc

SEQ ID NO: 4921 - DNA, 121 bp, Artificial Sequence
  Synthesized
  misc_feature (61): n=a or g
ttttaatttctgttttgtcgtgccacttgtctttttgtttagtctgatttttaagtccatntgtactcagaagtcaaattctagcggagacataatggtgttttggcaccttgtgagagtt

SEQ ID NO: 4922 - DNA, 121 bp, Artificial Sequence
  Synthesized
  misc_feature (61): n=a or g
gttcttttagcaactgcttcaaattccttgttgctttattttaccctgaaaatcatttcanccacctgtggatgataaacagatgatgaataattgagttaatccaagaaagctttggggc

SEQ ID NO: 4923 - DNA, 121 bp, Artificial Sequence
  Synthesized
  misc_feature (61): n=a or c
gaaggctttaaggtgtttatttgcatccaaaaaattcagccataatggtcattcccaaccncaaaagcattctagttgttagataccaaacactgtttcttcatttcctgaacggtctcct

SEQ ID NO: 4924 - DNA, 121 bp, Artificial Sequence
  Synthesized
  misc_feature (61): n=t or c
ggaaatgaaacagcagaaataaaatctactaaatatatttgggcatttatgtatttaagtngtcagctggagaattttggtaattacttgttcagttctgcaatcctgagaaggatgtcca

SEQ ID NO: 4925 - DNA, 121 bp, Artificial Sequence
  Synthesized
  misc_feature (61): n=t or c
tctcacaaatagttcactgtcttgccttggtttatgtagtacattttgtagacatgacagngatggagtcttgctgcaattggcctcgcttcccaagacaaagtttaaatacactggcaac

SEQ ID NO: 4926 - DNA, 121 bp, Artificial Sequence
  Synthesized
  misc_feature (61): n=a or g
cagtttaaaaaagttaagaagctgtggatacagtctgatcccactggtgggagtcatggcngtttcttcctgtcttcaaggaagtcacaatgtaagctttggtgctgtgggtttttgtgga

SEQ ID NO: 4927 - DNA, 121 bp, Artificial Sequence
  Synthesized
  misc_feature (61): n=t or g
gcaatagtttcgtgtctgcatgatgagttatggatctacttttacaaaggcatatttctgngagtatgtgcttttggaaccacatacaataagcatttgaaggcgctcagctgtagaccat

SEQ ID NO: 4928 - DNA, 121 bp, Artificial Sequence
  Synthesized
  misc_feature (61): n=t or c
cagagtgaaaaaaaaaaatctctcagcctcccacgtgaatgcaatcgtccagcaaatctantgaaaatagcaaatattttacaacgtctgcaaacacacaaggattgtgttgcacacggga

SEQ ID NO: 4929 - DNA, 121 bp, Artificial Sequence
  Synthesized
  misc_feature (61): n=a or c
tttattattttctggactctgccatcttattttggatgaaattgaggtactattctctgangctgctgaacaggtaaatgggttatgcgttctgatggtaaaatgcctttcagttctagtg

SEQ ID NO: 4930 - DNA, 121 bp, Artificial Sequence
  Synthesized
  misc_feature (61): n=t or c
attcagtaaaaattgccatgatgcaaatgtttcctagacgtcactactgtctgttaaaacncagtgcatgtgtgtgagactcttttttgttcttaatgctttctgtcatggttcagagtgg

SEQ ID NO: 4931 - DNA, 121 bp, Artificial Sequence
  Synthesized
  misc_feature (61): n=t or c
agatgttgagtgaagggagaaaatgcaggcagataaggatgttattttgcagatcccctcngatctccaactttttgtgacttctaccattttctccttcagagtgttcctgcagagttaa

SEQ ID NO: 4932 - DNA, 121 bp, Artificial Sequence
  Synthesized
  misc_feature (61): n=a or g
ggagcaaattggctcagtgcactctaaagagaaatggaaattacttttcgtccctacactngaagtgataaaatttacctgtaatacaaatcatttgactgtttccaaatcttctagccag

SEQ ID NO: 4933 - DNA, 121 bp, Artificial Sequence
  Synthesized
  misc_feature (61): n=a or c
taaaatatgccccatatcagacttgcttaataaaagcttcagttatgtaagttttgggagnatatacataaattcacatattttatataaagagaacagagtagtgatttaaaatcctttt

SEQ ID NO: 4934 - DNA, 121 bp, Artificial Sequence
  Synthesized
  misc_feature (61): n=t or c
ttcttcttcgagttctgcagaagtgctgcagttatttcgttatgcaattttggtgcccatntcctgataacttattgtctcttccttctttccagtctaaatgactccagtagtttcattc

SEQ ID NO: 4935 - DNA, 121 bp, Artificial Sequence
  Synthesized
  misc_feature (61): n=a or g
attgttactgcacaatcaaacacaacagctaatgcacttcagtgggaaggactccaaagcntatggaagaaaaccaaagcaacacaacactgtgttattgctgctactccttccttccaag

SEQ ID NO: 4936 - DNA, 121 bp, Artificial Sequence
  Synthesized
  misc_feature (61): n=t or g
acatttttttggctgaacaaaattttatagaaacgtgtcactgagacagaccacctctggnacaagtgaggctagggaggaagcactggaaggaaaaaaagattacttgcacttggattat

SEQ ID NO: 4937 - DNA, 121 bp, Artificial Sequence
  Synthesized
  misc_feature (61): n=a or g
aagcctagatattacatttcaacagcctcacagaaccagaagatctattactgctctactnagtcttctaagtattgcttttggagagacagacagttaatcatttccatagcagcttttt

SEQ ID NO: 4938 - DNA, 121 bp, Artificial Sequence
  Synthesized
  misc_feature (61): n=a or g
tgtaaagctctctgtggtcagtgtgacactgcatgagcatacgttctatttcagacaacantcaatacttttttctttctaaaagctcaggtggcaatgaatttggttaacgtgactggtt

SEQ ID NO: 4939 - DNA, 121 bp, Artificial Sequence
  Synthesized
  misc_feature (61): n=t or c
gtgcaggtgggtatgtacatctaaggcagtattaaaagatttcctgttaaaaagggccaanaataattagtagagaatgctgtttgttagtgtaactattgctcttccctaaaggataaga

SEQ ID NO: 4940 - DNA, 121 bp, Artificial Sequence
  Synthesized
  misc_feature (61): n=a or c
ggaagaaaaccctcttaaattctgatcatagctgttgctgtttcctctacagaagttaaantttgtctcgctgtggtctttccctcttctgccaactcagaaactccaatctcccgtgttt

SEQ ID NO: 4941 - DNA, 121 bp, Artificial Sequence
  Synthesized
  misc_feature (61): n=t or c
cacacacacaaaaaaaaattggaacttcaaaatccatcttggttgacagtggaactgaatnggtggtattttgatcaaagaacagccctactaggttgtactgccaagacattgtgttcta

SEQ ID NO: 4942 - DNA, 121 bp, Artificial Sequence
  Synthesized
  misc_feature (61): n=t or g
aggatcccatcaaaactatgcacacaaaacaattcaaaattcagcagcagaagagaaatanttgcctatgtatcctggtttttagagcatttctttagaaaggcagaaattcccattaggt

SEQ ID NO: 4943 - DNA, 121 bp, Artificial Sequence
  Synthesized
  misc_feature (61): n=a or t
ttggctagagcggacttttcctggagtccaaaaaggcacttttgactattcatacagacangggggttgatatgctgtatacagacttggtagttttcatctcaccagccttgtaaagtac

SEQ ID NO: 4944 - DNA, 121 bp, Artificial Sequence
  Synthesized
  misc_feature (61): n=a or g
ttagcagaacttctgattttgaggaaagaaaattccacgttactgtggctattctaagttngttaactccttgaaggtccatgcatggactgatttctaaagaagaaaattacaaatatca

SEQ ID NO: 4945 - DNA, 121 bp, Artificial Sequence
  Synthesized
  misc_feature (61): n=t or c
atgatgtgatgtacatttatttggggcaaatgctatcttaagcagtctcagactcttgctntcatgagcggacttcttcattattgaagtcagcactttctgatggtttatatttcagcca

SEQ ID NO: 4946 - DNA, 121 bp, Artificial Sequence
  Synthesized
  misc_feature (61): n=a or g
acttccactttttatctgctctgtattgcattccggcttgtacccagtatgcagagcagcnatataacaaggagcatcttacaggctgtcccccttggttacacattgattcttccttgcc

SEQ ID NO: 4947 - DNA, 121 bp, Artificial Sequence
  Synthesized
  misc_feature (61): n=a or g
gccaggtagctccgccacaggagggaaaacactgcccaagaggggatttgaggacgtttcntgtagacctggaagttagccaagacaccagatgctcttctgcacgttctgaaaaggctca

SEQ ID NO: 4948 - DNA, 121 bp, Artificial Sequence
  Synthesized
  misc_feature (61): n=c or g
tcagtgagcagatgtgactggaaggaagcagagaaatgattggcttccatgcaggtcaganactggggggaaatcatcacagctaaacttcaaatgggggtgctgtggaaatgctctcata

SEQ ID NO: 4949 - DNA, 121 bp, Artificial Sequence
  Synthesized
  misc_feature (61): n=t or c
aagatttaaatggttgtttgcacagctgggatttaggtaggatgtcaaacttctgggaatntctcttcattttttccgagatttttctatggatttttctgacagaaaatcaagttaaaat

SEQ ID NO: 4950 - DNA, 121 bp, Artificial Sequence
  Synthesized
  misc_feature (61): n=t or c
gtatgaaggccaaatgtgctcactagtttgggtctggcagaaaggttttatcttcaagttnctacgggtagatgtgtttggagtgtgggccttggtctgggtttatggagattgcatatca

SEQ ID NO: 4951 - DNA, 121 bp, Artificial Sequence
  Synthesized
  misc_feature (61): n=a or c
ttaaaacgaggttgaatctttggctgggattatagtgacaaaggtgagaggcagagtaganagtgatgagtttgaagttacagagcaatttaaaggagctcagaagctactgctaagaaga

SEQ ID NO: 4952 - DNA, 121 bp, Artificial Sequence
  Synthesized
  misc_feature (61): n=a or g
ggtggagagaagtaacatcaaaaaccatattgtttcagcaagcatggaaaatttggatttntttgtttcagaagagactgtagaagtgactatggctctaacaccaatattgaaagaaatt

SEQ ID NO: 4953 - DNA, 121 bp, Artificial Sequence
  Synthesized
  misc_feature (61): n=a or c
cctgttcttttccctcctctcttcctgtagacctgggatgatgagctggaaagatcagccnacgcatgggctcagcagtgcatctgggaccatgggcccagtgccctcatcagatccattg

SEQ ID NO: 4954 - DNA, 121 bp, Artificial Sequence
  Synthesized
  misc_feature (61): n=a or g
tttgtgtttttccaagtcttgcccacaatgaaatcattggcaaaattatccagtaggaganggaacggtcatccaacagagcacaggcagagagacaacattgattctgaaagaacagaca

SEQ ID NO: 4955 - DNA, 121 bp, Artificial Sequence
  Synthesized
  misc_feature (61): n=a or g
actctgttaattacacacaggcagcaaaaaggatggcaggggaatagggaaagcatgctcncagcccccccttcccaccttgctcttggcaaggatccgaaatatgcccagataatgatgg

SEQ ID NO: 4956 - DNA, 121 bp, Artificial Sequence
  Synthesized
  misc_feature (61): n=t or c
cctgcacactagcaagcagctccagaactcggaaatggaaaggaccttttcagcaacaggntgagaaatcccaaagtcagcttctatttcaggaattaaagatctggattcacataagtgg

SEQ ID NO: 4957 - DNA, 121 bp, Artificial Sequence
  Synthesized
  misc_feature (61): n=a or c
aacatccccagattttttttggaggcagtcaggccctggactatggcagcacatgcagcanttccttggctctgatgcgcattggacaaagccctgcactgctccatcacagagctgtgca

SEQ ID NO: 4958 - DNA, 121 bp, Artificial Sequence
  Synthesized
  misc_feature (61): n=a or g
ctctgggttgaagctgcagtaactttcagctaagaaagcacgcgtagctttctcagtggcnttaggctgatccttattttttttaaccctgtgacagacacagggctgaggactggcttag

SEQ ID NO: 4959 - DNA, 121 bp, Artificial Sequence
  Synthesized
  misc_feature (61): n=t or g
agcttaggtttgtgtggcatttgtctcactctttgggcaaagagaagaaggggggaatctnttcacttttagcaggaactgctgtggttgaaggtgaaaagaccaggaagaggtgaagcag

SEQ ID NO: 4960 - DNA, 121 bp, Artificial Sequence
  Synthesized
  misc_feature (61): n=a or t
tatctttttccttctttttttttaaagggtttgagtttatgctacatcaaatagttaaatnattggtctatggaatatgctgcaaaagggcaaaagttttcatctgaaagattattattat

SEQ ID NO: 4961 - DNA, 121 bp, Artificial Sequence
  Synthesized
  misc_feature (61): n=t or c
acgagacaaagctgcttcaccagggctctgaggcaaccacagatggtggcacaggccatcngcaatatctcttcccatcatgagctgaatgtcatgagcaaatagatgccaagggccttcc

SEQ ID NO: 4962 - DNA, 121 bp, Artificial Sequence
  Synthesized
  misc_feature (61): n=a or g
gcatgggaagagcagtgctacacctcagcctgcaccttggtggagtgttctgtggaggacngtggcaaggttgagtgcattaaggaagtagcagagcatggtgagatctgtgggcattttt

SEQ ID NO: 4963 - DNA, 121 bp, Artificial Sequence
  Synthesized
  misc_feature (61): n=a or g
taacaaaatgcaagacgcaatgcaaactctgcacaaaagtttgtgacttctgcagtgagcncttctgcggtaaggctacaaaggtgagaagcagtataactaaaggaaagaggaaaccctc

SEQ ID NO: 4964 - DNA, 121 bp, Artificial Sequence
  Synthesized
  misc_feature (61): n=a or g
tacctggcattttcatacttaggaagcaaaagatcccagtcctgtggtgtatgagctgacntgatggcaacaccgtagggctggacataaataaacctaattagacatgcacattggtgtc

SEQ ID NO: 4965 - DNA, 121 bp, Artificial Sequence
  Synthesized
  misc_feature (61): n=t or c
agttgttctgccaacttctggcagtggcccataaaagtcaatcacctcaatacaagtattntggcaggtatttaggtttaatttaccattcaaatgtctgttttactaagaatccacaaga

SEQ ID NO: 4966 - DNA, 121 bp, Artificial Sequence
  Synthesized
  misc_feature (61): n=a or g
catcacatttggtgcatttggcagaagccaaccgtacctccttgccagctacctgctgacnctgccagacttgaacctcccgcgtccagcccagaaagcccaccgcagcagttagcaatct

SEQ ID NO: 4967 - DNA, 121 bp, Artificial Sequence
  Synthesized
  misc_feature (61): n=t or c
tgtgctctgtgagttcacagcacaatgaaaagtgcaaggagtggatctcagattaaatggngtttgtagtaaatgagaagtgcacaccaaagagcagttacctcaggtgctctaagcttcc

SEQ ID NO: 4968 - DNA, 121 bp, Artificial Sequence
  Synthesized
  misc_feature (61): n=a or g
catcctgagctccattcaccacgtgggtccagctgtgttggattcagagcgtattctcatngctacgtgcaccagtctgcctgcgggatctttaaatacataacaaaatgctctgaattgt

SEQ ID NO: 4969 - DNA, 121 bp, Artificial Sequence
  Synthesized
  misc_feature (61): n=a or g
aaaagtgctcatctaaacaggcaaagaaaacactcctgtctgttccagatactactacacncagataagaaacaactctgccactccgatgaactctaatctttattaaggattttgcctt

SEQ ID NO: 4970 - DNA, 121 bp, Artificial Sequence
  Synthesized
  misc_feature (61): n=t or c
tttgatttcatttcaaaagcagctcacttcttaaacccagatgttccccattccatgcaanagttaccttgcaattcatgaaggaaattgctttaccctctttagagcttgtaacacactt

SEQ ID NO: 4971 - DNA, 121 bp, Artificial Sequence
  Synthesized
  misc_feature (61): n=c or g
ccggaggggagagctgggcgccctgcaggtacacggctgtcatcgggcctctgttcctctnttatctcaggccttcacagtgtgctgcaagaccccagtggatccatctctttgcagtccc

SEQ ID NO: 4972 - DNA, 121 bp, Artificial Sequence
  Synthesized
  misc_feature (61): n=c or g
cagccttcacccagcaggagtttgcattgcgctggttcattgctctgctcgtcccactgtntgttcagaaccttagctcacccagaggctgttctctcgctagtgtgccagctgaacccat

SEQ ID NO: 4973 - DNA, 121 bp, Artificial Sequence
  Synthesized
  misc_feature (61): n=a or g
gttctcctgtagtgtttttgtaactgcaatccagagatttacaatggttaactgccaggcntagtgcatcttaaagacataatgatatcttacttaaaatcataggatggcttgggttgaa

SEQ ID NO: 4974 - DNA, 121 bp, Artificial Sequence
  Synthesized
  misc_feature (61): n=t or c
ttgtacctatgtaatttggtaatcagcaggacacagctgagattgctgtagaataaactangagaaagcttcaaaacagagagcagggcacaaacatctctgctgttctccttcccacata

SEQ ID NO: 4975 - DNA, 121 bp, Artificial Sequence
  Synthesized
  misc_feature (61): n=a or c
tgtctgaatggggcccttgtttggttgctggatttacagtctctcagtcagtgtgaactanatcctcaaaacacctttgacaaagtgttggttcacataagaagttagtaaaggtgaatag

SEQ ID NO: 4976 - DNA, 121 bp, Artificial Sequence
  Synthesized
  misc_feature (61): n=a or g
catggaaggtcacttctctaacttaagtgctgggacagaatttgtctctgatgtacctcantaacctctcatctaacccctaaaaatcggaagctacacttgatagtttctgcttgtgttt

SEQ ID NO: 4977 - DNA, 121 bp, Artificial Sequence
  Synthesized
  misc_feature (61): n=t or c
agatggttagtactccagactagactctcagtgcctggctaaataacctcaggtattttgngtctgaagttatctttatgggaaaaatgagcccctgtggagcacagtactctgagcagca

SEQ ID NO: 4978 - DNA, 121 bp, Artificial Sequence
  Synthesized
  misc_feature (61): n=t or c
gacagaaaaatcaggttttcatctttcacattcagcatacactaaggatgtagcatacagnagggtacagatctggcaggagactgagcaacatgaggtaacgcagtggagtaagggaaac

SEQ ID NO: 4979 - DNA, 121 bp, Artificial Sequence
  Synthesized
  misc_feature (61): n=t or c
gtaaaggaattcaagagtggtacgatgcggagtgtttccttaccgtgtcctcttgggttanacgctgaggagcaaggtggtgtgatttagttccttcaggggcttgaagtctgtctgcaga

SEQ ID NO: 4980 - DNA, 121 bp, Artificial Sequence
  Synthesized
  misc_feature (61): n=t or c
acagaaacaggcactgtcacttcatagctcctttcaccacactcctaaggctatttcaccnctctattgatatgctgcagcagtgggatggcactcatggtgacacacggccatgtcgcat

SEQ ID NO: 4981 - DNA, 121 bp, Artificial Sequence
  Synthesized
  misc_feature (61): n=a or g
agtctttcattgcgctcgttaaaataaataaataaggactaaatcaaaagcttgaatacanctaagaagcacaaacttacctcaccatttagctaaaacttacatagactccacagagtct

SEQ ID NO: 4982 - DNA, 121 bp, Artificial Sequence
  Synthesized
  misc_feature (61): n=a or c
aaccgttttgctctttaggagtgctgaatgaatcccaggcttttaatgtcttccaacttgnagtatattctttcttctctaatgctgtgtccacaggtaccttcttgcaatttcacagtaa

SEQ ID NO: 4983 - DNA, 121 bp, Artificial Sequence
  Synthesized
  misc_feature (61): n=t or c
atctgtatttgcacaaaagaggcagactgagtgcctggaaaatggttttgaatatgtgacntatatcttacgtaaatagcccttccctgacaacacaggctagcatagaagtggacttcca

SEQ ID NO: 4984 - DNA, 121 bp, Artificial Sequence
  Synthesized
  misc_feature (61): n=a or g
ttttgaggagtattggaatgactacaaggttactacaaacttcaaatggaaaaagttctantatctaatctaaaatagggttctagtctatccccgacatacttttcattccttctagacg

SEQ ID NO: 4985 - DNA, 121 bp, Artificial Sequence
  Synthesized
  misc_feature (61): n=t or c
agtgggaaaaccggagcttaatataataaaaacatcacacagttggaaatctaatattaanagcaaaattaatgtatcgatgcactggtaaagatggcattaaaaatcatcctttacttat

SEQ ID NO: 4986 - DNA, 121 bp, Artificial Sequence
  Synthesized
  misc_feature (61): n=t or c
tgtgtgtgtgtgtgtgtgtatataataatacatatatatatgacactagtcacaaatctgnccacattttgcaatgctagcattccttggaggttcctccttttgttcagtaaaaaccaag

SEQ ID NO: 4987 - DNA, 121 bp, Artificial Sequence
  Synthesized
  misc_feature (61): n=t or c
agattttgtaactgaatgtttggaatgatccatgaataggagattgattttatgagtgctnaaaagacactttcatcatgtatcacatagtgcttttgtacacttgtcaaccagctcttat

SEQ ID NO: 4988 - DNA, 121 bp, Artificial Sequence
  Synthesized
  misc_feature (61): n=t or c
gctacagcagcaaatgcagcaacatattttagcaattagcggcaagctggctggctgctgnacaccgggtccttctgaatattcataccacgactatcatcttcactctgcacaactacaa

SEQ ID NO: 4989 - DNA, 121 bp, Artificial Sequence
  Synthesized
  misc_feature (61): n=t or c
accagtccaaaacaaacacccaaacttttccaaaatggcatcacacacaaatgcctgcctnatacatcctctcccaatgtcacaacaaattattatcactgattctgaacattcagtgcct

SEQ ID NO: 4990 - DNA, 121 bp, Artificial Sequence
  Synthesized
  misc_feature (61): n=a or g
agaccaaatgcttaccagagccttttcattggttatggttcagcctaaggacttgggaganatgtgatgatttaaggcatcgatacagcaaatatcacttaaatgttagctctattttcct

SEQ ID NO: 4991 - DNA, 121 bp, Artificial Sequence
  Synthesized
  misc_feature (61): n=t or c
cctgacaacagaactcaagatggcaagttctgcaagtatgttttgaaggggttttttgaanggtcagtggaaagaatcaatcaccttcctgggaggatgcaaggaagggttgtacctatgc

SEQ ID NO: 4992 - DNA, 121 bp, Artificial Sequence
  Synthesized
  misc_feature (61): n=t or c
tgttacttttctttgtgaaacacttcaacctttccctgtgtgcaatctcagtacttcagangttaaggtttggtattttgttttgctctgctttttgcttgtttgttttataatatgaaaa

SEQ ID NO: 4993 - DNA, 121 bp, Artificial Sequence
  Synthesized
  misc_feature (61): n=a or g
accgcccttagcaaaagtgaaaccttgaatggatcaaaattaaactaccagattgtcctcntcagcattagaaccatctcattgattgtgtataaggaattgttttttacagtaagggcag

SEQ ID NO: 4994 - DNA, 121 bp, Artificial Sequence
  Synthesized
  misc_feature (61): n=a or g
tctcttcagaggttcagcggtcagtgcagacagtagaattactctgtttgaaaggcctacngctcatctgtcagacctgcagagcacatcctgaaggaacttcctgctctcatgcagtgtg

SEQ ID NO: 4995 - DNA, 121 bp, Artificial Sequence
  Synthesized
  misc_feature (61): n=a or c
gaatgaaaatcaggattatgtacacatagaaagtgaagtttctggccaaataatatatcantttcagaggacttctaaatcatattatattaaagataaattctacagtcacaggcaggtt

SEQ ID NO: 4996 - DNA, 121 bp, Artificial Sequence
  Synthesized
  misc_feature (61): n=a or g
caaatggcatcagattttttttctttcatttgtgaataaccacattaaaatgagcataccnttcagtctgagagaatttcttaaggtaggctgatacttaagggatggagatgcaagtaaa

SEQ ID NO: 4997 - DNA, 121 bp, Artificial Sequence
  Synthesized
  misc_feature (61): n=t or c
aactttgcagtatcagctcagtgcagagtctgactcctacccatggagacaaggcttttcntgtggcccttttggctagaagcagttcagggaagaactgtggcagtttcatgcaggcagt

SEQ ID NO: 4998 - DNA, 121 bp, Artificial Sequence
  Synthesized
  misc_feature (61): n=a or g
agtgaaggagctattgcttgtgttcagataggcagctgatgttataggctaggtggctacntagcagtgtgagttttggaatccttttgtttttgctctggctgtttgatctgtgctttgt

SEQ ID NO: 4999 - DNA, 121 bp, Artificial Sequence
  Synthesized
  misc_feature (61): n=t or c
tatggggctgagtgttcacacctgccttcagcaatgctcacagctgacgtagctcaggcanggctcaccaggcttcactgtcaggtggctggaaggaaatctcagcaccaaacagaggaat

SEQ ID NO: 5000 - DNA, 121 bp, Artificial Sequence
  Synthesized
  misc_feature (61): n=a or g
taacagcagctgaaatggaatcttttcatctccttgtaatcttctgtccatcacttgtggngcctcaaagaaagggagagagcacaagagtatggtgccctcacacccctaccactccccc

SEQ ID NO: 5001 - DNA, 121 bp, Artificial Sequence
  Synthesized
  misc_feature (61): n=a or g
ttcaaaggagatggtacagctgagatctgagcaggctgccgtagtacaaggaaacctgtcncggataattattcttccatgaactggggattgtcttacaaaaattctgctgcaccaaaaa

SEQ ID NO: 5002 - DNA, 121 bp, Artificial Sequence
  Synthesized
  misc_feature (61): n=t or g
taaagctgtatatgcaagcccttttccagcagcaactgcctccctctccagaccacacatncatgctctcaaggcattgggtaccactgcaacaccccctgccaacagtgtggtggaactt

SEQ ID NO: 5003 - DNA, 121 bp, Artificial Sequence
  Synthesized
  misc_feature (61): n=t or c
caaggcatcaagagaagacaggatgtactccagcaaaaggctgtttgcagacaggcagttnatgctcacgacactgatctttggcagcagagtaagggaatggaaagccatgtagagaaaa

SEQ ID NO: 5004 - DNA, 121 bp, Artificial Sequence
  Synthesized
  misc_feature (61): n=a or g
gaattggtttgtcttaagaaaaagcattctcagaaaggtcagaccacctgctatggagaanatgattttatgtggaggcttttggtaaggtgtttgctcaaccccttgatgtgaaggtggg

SEQ ID NO: 5005 - DNA, 121 bp, Artificial Sequence
  Synthesized
  misc_feature (61): n=t or g
tgcttaaatatgtaactttggaaatgtttttatttcaaatggatgaaagaaagaagcactnctcacatagattcctgaggcctgtgctcctgttccatgttgccatttctttctacatcca

SEQ ID NO: 5006 - DNA, 121 bp, Artificial Sequence
  Synthesized
  misc_feature (61): n=t or c
tgaaaacaaacaaaaaaggaaagctgtcatcatctcgctgacatgccctttctgcagtcangggtgtatccaaatatcagtggttaatttttgcaaaatgataagccccctttttgtcttt

SEQ ID NO: 5007 - DNA, 121 bp, Artificial Sequence
  Synthesized
  misc_feature (61): n=a or g
ggaagcataataatatgcagagcacacttcaattaggtgccagcatattgaggtctgcaantgaatgtcttccctcatgtgagtctaccctgtccataaatccccatttctgcaatgtccc

SEQ ID NO: 5008 - DNA, 121 bp, Artificial Sequence
  Synthesized
  misc_feature (61): n=t or c
gctgtaatgattaaaaaaggatggaacggtagtaaaggcaaggattgtcaggtttaacaangttcgtaaacagatgatggcaaaaatgggacctacactgttcttccacatgtcagtgtgt

SEQ ID NO: 5009 - DNA, 121 bp, Artificial Sequence
  Synthesized
  misc_feature (61): n=t or c
aagtaggaactcaggacccgaaagcactgcaaattgcaagaacaggtgagtgctcaggcanatatctggtttggcattttcattcaaactggttcctagccactgttgcatattttttttt

SEQ ID NO: 5010 - DNA, 121 bp, Artificial Sequence
  Synthesized
  misc_feature (61): n=a or g
gaaatccaaacacatcgcagcccttcacaagatgtaacctgctgattaacacgtcttgcanggagggacacgccgctcaggttaaaaggaatttaacgaggcatttcttaaaggcatcggg

SEQ ID NO: 5011 - DNA, 121 bp, Artificial Sequence
  Synthesized
  misc_feature (61): n=t or c
ataggcttcatgccctcagcgccagtttgaccaacccatctccctgaaatggaacttatgngaaaagaagagaagcatctgcagatactctgtattaaacagagggaaatcgttaactgtg

SEQ ID NO: 5012 - DNA, 121 bp, Artificial Sequence
  Synthesized
  misc_feature (61): n=t or c
tcctgagctgaaccatggcagagaacccaaggcacccagctgcatgacaagtgatgaatangacacaaccgagaccagagggtaagagctaaaaaaaacttaacagagaaacacctacaca

SEQ ID NO: 5013 - DNA, 121 bp, Artificial Sequence
  Synthesized
  misc_feature (61): n=t or c
gtgtttatgttccacgtttgtacatgtttaagggccatttagcagtgaacctgggatggtntgaggatttctgggatgtgctggagatacaaccctcacttgaagcctaagcagaaagaaa

SEQ ID NO: 5014 - DNA, 121 bp, Artificial Sequence
  Synthesized
  misc_feature (61): n=a or g
actatcaggtcaataatccacactgttatttaaatccctgagtattcctttgtaacagatnggaatggctcccaaggagaagtttggagtcaataatccatgttatttgaaagtccatcaa

SEQ ID NO: 5015 - DNA, 121 bp, Artificial Sequence
  Synthesized
  misc_feature (61): n=t or g
ttgttgtgggtatgcttttctcagttatttatgaggagatggtaactgtgatgcataatanatttgcctttctgagaaaaagaggttccgtggaatgcttttgagggtgcctaggtgcaga

SEQ ID NO: 5016 - DNA, 121 bp, Artificial Sequence
  Synthesized
  misc_feature (61): n=a or g
tttatactgtggcttaaaggttaagtcgggcagaaggtgcctctccctccagtgcaagganaaaaaacattactcctctccgactattcgtgaaataagcccgctgaagccaatacgagcc

SEQ ID NO: 5017 - DNA, 121 bp, Artificial Sequence
  Synthesized
  misc_feature (61): n=t or c
aagtgtgacttgatctttctcagcaaatttcctctcatcattgcgcttgtgtaaaggaggngctacaaagcagtcaaggcagagaaacttcataaggaggtactgggctcagtcttacact

SEQ ID NO: 5018 - DNA, 121 bp, Artificial Sequence
  Synthesized
  misc_feature (61): n=a or g
aattgggaatctctcctctgaatccccaagcaagattatcaactgatttcattcaacagangagtgacattaaccaagcaagaattagacccttcccagtaactgctgtttgctctttcac

SEQ ID NO: 5019 - DNA, 121 bp, Artificial Sequence
  Synthesized
  misc_feature (61): n=a or g
tgttcccaacagctgctttagtcaggctgtagaagccttccagcagaaaacaaatttcagnttgcgataaaaagaagtaaagcatacaggaaaatgtaaatacactctgttcttaaccagt

SEQ ID NO: 5020 - DNA, 121 bp, Artificial Sequence
  Synthesized
  misc_feature (61): n=a or c
gctctgtggtacagagccttctggctctcagcaccaagagaaagcaagcagtgaatctctnatgtgctgcacagcacaagtggaaatccaggctcccagctgggcttttcttcagcttcca

SEQ ID NO: 5021 - DNA, 121 bp, Artificial Sequence
  Synthesized
  misc_feature (61): n=a or c
caatattctatattgcatcaggacacaaggactttgtggaacaaagttggtaagcagctgngagctagggagaactgggccaggtgacctcttcaagtcagttctgctgcaactcctgaac

SEQ ID NO: 5022 - DNA, 121 bp, Artificial Sequence
  Synthesized
  misc_feature (61): n=t or c
tgctcacaggtgagggctcttctttcctctggagaagcagtctgctgaaatcagtacaagnctttctactgactgaactcagcttcagttcaggcctggtgtacaaaggagatatccaaaa

SEQ ID NO: 5023 - DNA, 121 bp, Artificial Sequence
  Synthesized
  misc_feature (61): n=t or c
ctctcccagcaaatatttagtttggtgtgcagaggaatttaggcaccatttggtaaatcgnaatcaggagagcagagagactttgcctccatcgcactggacaatccatgcccgtcagggc

SEQ ID NO: 5024 - DNA, 121 bp, Artificial Sequence
  Synthesized
  misc_feature (61): n=a or g
aggcagacttttacatcttgacaattaattctgctatttttccagatagcaagaccgtttnaagacattcagtgataatcagattaagacagagttagtgttaattactgtaacattcatt

SEQ ID NO: 5025 - DNA, 121 bp, Artificial Sequence
  Synthesized
  misc_feature (61): n=t or c
caattttgaggctttaacactgatagaatccagaggatctattttcacacatttcactctntcatgtcagaatgttgatggatgcagcttgcatgtgctgaggaacatcagacatgagctg

SEQ ID NO: 5026 - DNA, 121 bp, Artificial Sequence
  Synthesized
  misc_feature (61): n=a or g
gttaattttggttgaaatgttagcgtttctgttttctcagtgctgccagtggcttgcagcngggggagttttaatgcctggaacagtttgaaaccattgggtcactttgccaatgtggcac

SEQ ID NO: 5027 - DNA, 121 bp, Artificial Sequence
  Synthesized
  misc_feature (61): n=a or c
tctgccccaccgctgggagaaagaagatgaacatagggggaaaacggtgtgctttaggaangctttaaaccaatctggtggaaggtgctgagatgggctgtgctgggtcacggtcagcagc

SEQ ID NO: 5028 - DNA, 121 bp, Artificial Sequence
  Synthesized
  misc_feature (61): n=t or c
taccattttagttgttaagatctacatcagcaatccacatgaacagaacgttcccttctgncctgccctgcacactgactctccctgcacgtggcagtaaccacctctgtgtccgcaggaa

SEQ ID NO: 5029 - DNA, 121 bp, Artificial Sequence
  Synthesized
  misc_feature (61): n=t or c
caattctttttaatatgtagacttcatacgccttacaatatcagatctacagtgcttcccntgcacagtaagctctgtgttttatgcaggcactggttttacctgagacttttaagaaaag

SEQ ID NO: 5030 - DNA, 121 bp, Artificial Sequence
  Synthesized
  misc_feature (61): n=t or g
gttatccttagcagacgctattagtagtgcacttcttaagcagacccacaattccagcacntctttctgttcttctattctctttctagtagtaattctttctgtaagtaatatggaatag

SEQ ID NO: 5031 - DNA, 121 bp, Artificial Sequence
  Synthesized
  misc_feature (61): n=a or g
gaggttttggaacatttacacactgtatgcttgaataacatctggcatatactactttgancttaagtgaaaatatttaatgggagtggctgagaaaaagaaaaaaagtattttatgtcat

SEQ ID NO: 5032 - DNA, 121 bp, Artificial Sequence
  Synthesized
  misc_feature (61): n=c or g
aatatgaagtcagcagcaccagcaaatctgtatcagtattttcagtctgaaaagtggcctnattagtatttttcccctaatgcctacttttaccattacaactgtaaaaattaatcacttg

SEQ ID NO: 5033 - DNA, 121 bp, Artificial Sequence
  Synthesized
  misc_feature (61): n=t or c
gttttacagaaagtaaagcagaaaaattgtacaggaaactatcagggatcagctagcaggnttgataagtcatcttgtacagtcccccggtgttagatctttacataggtgaattattctt

SEQ ID NO: 5034 - DNA, 121 bp, Artificial Sequence
  Synthesized
  misc_feature (61): n=t or c
actcaatgttcccattagacaaacagttaaaagctgccaggctggtgggtagatcaaattntgcaggattttgagaccaaagctcatgaatcgagggaaggcattgagaattcagctgctg

SEQ ID NO: 5035 - DNA, 121 bp, Artificial Sequence
  Synthesized
  misc_feature (61): n=t or c
caagcttttctttttgatagatcagtcaattagtgcagataaaagggcatgaagcatctanatcagagatgcaagcatcttttaactgaagagttttaaaacattaaaaaagtttaagaaa

SEQ ID NO: 5036 - DNA, 121 bp, Artificial Sequence
  Synthesized
  misc_feature (61): n=a or g
ttttcaggccagtgaactgggagacagaaaagtaactgaaataacagatatctaacttcantcaggaaatttataaaaagcaagtgcaacacgcagcagtagcagtgagtagcacagtata

SEQ ID NO: 5037 - DNA, 121 bp, Artificial Sequence
  Synthesized
  misc_feature (61): n=a or g
agccaaaataaaagctttcagagaggcggattccaacacaacagctatcagaccattgacnattttagcactggtgtgcatcaccataattactggcacactgggagaacagcacaggaaa

SEQ ID NO: 5038 - DNA, 121 bp, Artificial Sequence
  Synthesized
  misc_feature (61): n=t or c
ccggtggaagaccagtaatgtgaaaattgaaatttccacagaaagcactgtctacactccngagttaggctgtctgatcaaaaaataacaaataatcactctcttcaaatggaggaaacgg

SEQ ID NO: 5039 - DNA, 121 bp, Artificial Sequence
  Synthesized
  misc_feature (61): n=a or g
cacattagcagtgaacactcaccctccaaagtgctttatgctatactcagcacataccacnaatgtgggtaagcacccctgggacagactgcaacacatgcttacaaggagacatccatgc

SEQ ID NO: 5040 - DNA, 121 bp, Artificial Sequence
  Synthesized
  misc_feature (61): n=a or g
agagaagaaaccaactcttctacatgttttccacttgaaatgtgactggagaacattaacntgcattctacttattgaagttccaattgaagaaatgaaatagttaacatttcagataatt

SEQ ID NO: 5041 - DNA, 121 bp, Artificial Sequence
  Synthesized
  misc_feature (61): n=a or g
tattttgtgtgaagacagttgcttgtgaagaagtacattcaggctgacttaaaagctcagntgatgctaaataggagatatgaaacataactgtataaatctaaccttccatgaaaatggt

SEQ ID NO: 5042 - DNA, 121 bp, Artificial Sequence
  Synthesized
  misc_feature (61): n=t or c
tcttggtaaattatgcacttgttgctttgaggtttgttcagtgatgtcaagtattactgtnttctgaactaaaaagcaatgtaataaaaaccaaagatttgaagcattattatttccagac

SEQ ID NO: 5043 - DNA, 121 bp, Artificial Sequence
  Synthesized
  misc_feature (61): n=a or t
gatgtttttttttttttcctagttatcagctccttattattcatacattctaaaaaatatnatcctggaaaacctctgggtaataaagcttgctatgtagaacatctgaacatattgagga

SEQ ID NO: 5044 - DNA, 121 bp, Artificial Sequence
  Synthesized
  misc_feature (61): n=t or c
ttaataccaaatcaccaagtaaaatccaaacaagaagtcagacatgtaaacagtacacaanaatagggcaatactgaccattacaaaaaagaggtataatgcatacatgaaaaaacatttg

SEQ ID NO: 5045 - DNA, 121 bp, Artificial Sequence
  Synthesized
  misc_feature (61): n=t or c
ctgcccatctctggagccccgatgacacatgtgccaccaatatggggttgcatccactccngcgatgtcagcagggagatgctgccaggtgcatttcatgcatgcttagcagtcaggatgc

SEQ ID NO: 5046 - DNA, 121 bp, Artificial Sequence
  Synthesized
  misc_feature (61): n=t or c
cagtccagtcctataaaccttgaagagaggggttattttttcaatgagatagctatgttanccaggtgtcagagctcccctgacacaggctgagtgcagacatcagccaacaataatcgca

SEQ ID NO: 5047 - DNA, 121 bp, Artificial Sequence
  Synthesized
  misc_feature (61): n=c or g
aaaactgcaagctcaccaggatgctctcctgttgaaaactgccaaccactgcacacacctncagccactctacccttctccatttggactttggaccatttggctgtttgcagccaagctg

SEQ ID NO: 5048 - DNA, 121 bp, Artificial Sequence
  Synthesized
  misc_feature (61): n=c or g
gcctgcacgtgggcttagcagctcctggggctcctgcagaacatgcagaaaggtcctaccngtgttctgtgcacaagagaagcctgcagccatgagttataaaggaaagagctttgccttg

SEQ ID NO: 5049 - DNA, 121 bp, Artificial Sequence
  Synthesized
  misc_feature (61): n=a or g
ggttggaagcaaaagcccttccagattccaaaccaggacatgaaaaccagagctccagagngcgctctctttttgttcagaagtatgcagcagttttcctgctgaagtgatgtgaaactca

SEQ ID NO: 5050 - DNA, 121 bp, Artificial Sequence
  Synthesized
  misc_feature (61): n=a or g
caacgtcattgtttttcgaaccaggaagaaaacagggatcaaaagtccaaccctgtgagcnaagttaatcgaaagaaaggaagatctattattgtagagatgccgtttattcagatgacac

SEQ ID NO: 5051 - DNA, 121 bp, Artificial Sequence
  Synthesized
  misc_feature (61): n=t or c
acggtgtgttaaaactttacctgccatccttgacatcagaaccatgagctctgggaattcncataaaacagggaaaaatgactacaagtgcttcactcacaaagttccatatttacttcta

SEQ ID NO: 5052 - DNA, 121 bp, Artificial Sequence
  Synthesized
  misc_feature (61): n=t or c
tgtctcccactcattcacactctgcccagataactgctctgcgagtggtggctgtgttacnaacaccagcatcatcataagattacaggtcccaaacacatttaggctctgtctgaggaca

SEQ ID NO: 5053 - DNA, 121 bp, Artificial Sequence
  Synthesized
  misc_feature (61): n=a or g
ttgagggtcttcttggtgatcatctggaaggctgatagtcttcattgctcctaaacttttngccccagtcttcaggaacatgctcagtaaggtgtttgcctcctctttaaatgtggttact

SEQ ID NO: 5054 - DNA, 121 bp, Artificial Sequence
  Synthesized
  misc_feature (61): n=t or c
cagtgagctggaagtaaatataaaatcaccgctgataaaatgtgcgtctgacacggagctnggtggagtgggagatcacgatgaggacagagcagtcatgcagagcaatccagattgcttg

SEQ ID NO: 5055 - DNA, 121 bp, Artificial Sequence
  Synthesized
  misc_feature (61): n=t or c
gcgtgcagcacagacgcatcccccggagccaggatgcacagtgcaaagccagcacaaacangccccatgcacgtgggtacttacaaaaaacatggacaaagtccttcgtgtgtgcagacgg

SEQ ID NO: 5056 - DNA, 121 bp, Artificial Sequence
  Synthesized
  misc_feature (61): n=t or c
cagagctgcagtgtgcatgagttgtgttcagagccactgctcccagccatgaaacgatagngagctttgagcagctctgcagacttgggcctttttttgaatggaaacaacccgagatcag

SEQ ID NO: 5057 - DNA, 121 bp, Artificial Sequence
  Synthesized
  misc_feature (61): n=t or c
actcctcgctggccaaaactgccgggacatttctttaaattctttcctctcattgtgtggntgtcacacagaacgtgagcttaaagctctgagtttgccaggactcgatgatccttaaggg

SEQ ID NO: 5058 - DNA, 121 bp, Artificial Sequence
  Synthesized
  misc_feature (61): n=a or g
aaaggcaggaatctaacacctgttggctggaaccatgggcttataaacaatcttctctacncacaactcctctgaaaaccagccagatgcatatacagctctcctggcttcctcacatgct

SEQ ID NO: 5059 - DNA, 121 bp, Artificial Sequence
  Synthesized
  misc_feature (61): n=t or c
ctcctcttctgcaaatgctgatgtatccctaatcttggcaagcacctaagattttcaaacngaggaagcagaatgctcatctgtaggtaaacaccttccaggtgcaagtatggcacaagtt

SEQ ID NO: 5060 - DNA, 121 bp, Artificial Sequence
  Synthesized
  misc_feature (61): n=a or g
ttccctccagggtgaaacacacacagcgcagtgggagaacgaggagaagagaaaactggcntgcaaacccaacctgacatcatttcttgtgtttcggagagagcaggaagcagagaacggc

SEQ ID NO: 5061 - DNA, 121 bp, Artificial Sequence
  Synthesized
  misc_feature (61): n=t or c
tcacataaggatctgaaccagagaacaaacacataactgtatcaagataaaaaccttggcntcttgaatttcttgactcaccctggaaatggattttatgtatatgcgtgtggtttctctt

SEQ ID NO: 5062 - DNA, 121 bp, Artificial Sequence
  Synthesized
  misc_feature (61): n=a or t
tcacatgttcccagtgccaaatgttgcttgggtggacatgggacttgtataggtatttcanggaagaaacaagtcttttctagccatttaagtgttgtttgggaggttttgcctctttgct

SEQ ID NO: 5063 - DNA, 121 bp, Artificial Sequence
  Synthesized
  misc_feature (61): n=t or c
ttgattggcattttgtctataaagcaatgaacgtgcagttcagtggctatcttacaaagancctacagcctgttgataaaggagatgcataggcaaagtctttgaagatgtggaatttggg

SEQ ID NO: 5064 - DNA, 121 bp, Artificial Sequence
  Synthesized
  misc_feature (61): n=t or c
gagcctcattatgtattctcaataacttggagacaaaaagacatagtaaaatatctacttntgtctttcaaatgttgtgtatctaaacaaacatgagccttatactttgtgaatcaaacca

SEQ ID NO: 5065 - DNA, 121 bp, Artificial Sequence
  Synthesized
  misc_feature (61): n=t or c
aaagattatcttcaataatgttttgtaataatacaaccttattataaattacctcataaanaaagcaaaaattaaatgaaagtcaggttaatttatatgcagtcatccctgcagcgaaatg

SEQ ID NO: 5066 - DNA, 121 bp, Artificial Sequence
  Synthesized
  misc_feature (61): n=a or g
agatctaaccttttgcaggaaattttttgctgcatgctcatgcattaccagaatgtgcctnacatacagagaaatactcacatgcaaaagttctttgataatgattgctaaaggtgcatca

SEQ ID NO: 5067 - DNA, 121 bp, Artificial Sequence
  Synthesized
  misc_feature (61): n=t or c
aaatctgcagacgtatgtttgtgttggagtgggaaactgtgtcgctccatgcaggagccangacaagctctagaaagcaagcctcaaggtgaatccttggtaaaacattcacttctcagca

SEQ ID NO: 5068 - DNA, 121 bp, Artificial Sequence
  Synthesized
  misc_feature (61): n=a or g
aatgagcagctagatcttaactgttgggtggtgggattgagatcactgtagctaaagatgnacagaagcaaacgggtgactcacagcagtaactcatctgctattccaagtccgtgtgatg

SEQ ID NO: 5069 - DNA, 121 bp, Artificial Sequence
  Synthesized
  misc_feature (61): n=a or g
cataaagctatctgtggtaaagcccattattatgatcattttaattgtgcattgtttattnaacaacttatcactttcagagatttagtgaatgttggaatgcaaataatcagaacatata

SEQ ID NO: 5070 - DNA, 121 bp, Artificial Sequence
  Synthesized
  misc_feature (61): n=t or c
ttttatagacttcacaagagactgtaacgatcatacatagaattagtaataataaatgtanagcaaaatatcttgtactttcacagagcctgtttgaaagaataataatgcagtatgaaaa

SEQ ID NO: 5071 - DNA, 121 bp, Artificial Sequence
  Synthesized
  misc_feature (61): n=t or c
caagcacagcttcttccaaaacagtctgcagaacagtgacaccacttctgtttgcagcagnaggtagataacaggtgataccatacctcagctaacatcttttacttttcctatttaataa

SEQ ID NO: 5072 - DNA, 121 bp, Artificial Sequence
  Synthesized
  misc_feature (61): n=t or c
gagctgagccctgtcctagctccaggtttacctgtgctcagcaaaaccctccagagggatnggggccttaaatcccacactccctgtaaaaaaaatcccaccaaaccaagtgccactcctg

SEQ ID NO: 5073 - DNA, 121 bp, Artificial Sequence
  Synthesized
  misc_feature (61): n=t or c
tcaaagcatggatgcttgcagaagtttagagggctttgtggcttgtggactgctgtatganctgtggtggaactcacccaaagatcctcctgccatacaaaaggcttgtttggatcctgca

SEQ ID NO: 5074 - DNA, 121 bp, Artificial Sequence
  Synthesized
  misc_feature (61): n=a or g
gactgtcactctcatcaccatttctatgatggcatatactgagttgaaggtggcactgctntggtgcttaaactcccacagctataggcatgtactgcccactgaaatgcttctgtggcca

SEQ ID NO: 5075 - DNA, 121 bp, Artificial Sequence
  Synthesized
  misc_feature (61): n=a or g
ctaacccagaaattcctatttggatggactgagactgccagcatttatggttaggacctcngttagaaagtttgtttctaattcaaattttccttaattctttttcatccccacagtatgc

SEQ ID NO: 5076 - DNA, 121 bp, Artificial Sequence
  Synthesized
  misc_feature (61): n=t or c
cacccctgaaatgcacctcacacatctgggaaatcttccttccttcacagaggaaagacanggaacattctaaagtcttttgatctgagagttgctacaacgagacatctgctattactcc

SEQ ID NO: 5077 - DNA, 121 bp, Artificial Sequence
  Synthesized
  misc_feature (61): n=a or g
actcagaacaactctgaaagtgttttaatcacacccattcctgacagcttctgcatttttntttaaaattaccagtacagaagagcttgttttttaatttatcatttcagcacaaaattaa

SEQ ID NO: 5078 - DNA, 121 bp, Artificial Sequence
  Synthesized
  misc_feature (61): n=t or c
accagaaagcaaattctgccaaggcgataatcaatgcaagtttaggccagggcaactgcangtgtggttttgtgtgtcctaacagaaaagtcaaatgctcccgaggaggaaagcggatttt

SEQ ID NO: 5079 - DNA, 121 bp, Artificial Sequence
  Synthesized
  misc_feature (61): n=a or g
acacaactgaatagcttgacagtgcaacttgcatcctctgaatgtgaggacaggccatgcngaggtgatcaggagcaagcagcaatagcaacaacagatggtccaagaacatgggttggca

SEQ ID NO: 5080 - DNA, 121 bp, Artificial Sequence
  Synthesized
  misc_feature (61): n=t or c
tgagttcaatagggtttttttgttaggctttttgttctttgactacctctaggggggtggnttagaatgtaattttaaagacatgcagatggctgaactagaacccaaaacttacagacta

SEQ ID NO: 5081 - DNA, 121 bp, Artificial Sequence
  Synthesized
  misc_feature (61): n=t or c
attacctaactataaggaatggtagaaagttcaattaaaaaatacagagctcttgttaacnattcactttcatttagataaaactttaggactgtgtctgtttcagttcaccctttaattg

SEQ ID NO: 5082 - DNA, 121 bp, Artificial Sequence
  Synthesized
  misc_feature (61): n=a or g
caaaagtgtattttttcaaagctactcgttgtgcatagaaagattaggcattgacattacntgcatttacaaaagcaaatttctgcagtatctgtggtaactttaagttaaattaaaacac

SEQ ID NO: 5083 - DNA, 121 bp, Artificial Sequence
  Synthesized
  misc_feature (61): n=a or g
catgtgcatgagcaagctccatttctaacagcagcctgctggaaatcccagtgtacaggantgtctgttctagccattaactgattttttttgaaaatagcaactgcgtttaattgacgga

SEQ ID NO: 5084 - DNA, 121 bp, Artificial Sequence
  Synthesized
  misc_feature (61): n=t or c
ctatgtagtgttttatacagcctaggcaggcaacttaaggagatctcaaatacatgtcctntgttaagatgtgcttctaattttctcagaactgctgcaccccagtttttggatcatgtgg

SEQ ID NO: 5085 - DNA, 121 bp, Artificial Sequence
  Synthesized
  misc_feature (61): n=a or g
tccagttcccagtgccagcaaatggtggtctttaggcatggtggtctgtagaggatgtccntctgtgtagcaccactgcagtggagctgtaccaacttgcagaaactctgaatttgttgtc

SEQ ID NO: 5086 - DNA, 121 bp, Artificial Sequence
  Synthesized
  misc_feature (61): n=t or c
taccattaatttgacactcaggacacccatatggttccctgcattgtgcctgccagctctnggccagggaacgatgcttgctgtgaccagtttcaggacagaaagtccctttcttttaaac

SEQ ID NO: 5087 - DNA, 121 bp, Artificial Sequence
  Synthesized
  misc_feature (61): n=a or g
tcttccctccagtgcctttttaaaacttgggttatttcagatgaaataccaggcgatctcnaagtcagtatcttgtatgcatttgctgctggggccggcgctgtgatcctgtctgtgcatg

SEQ ID NO: 5088 - DNA, 121 bp, Artificial Sequence
  Synthesized
  misc_feature (61): n=a or c
aaaaaatgttaatccttcttcagtcagttcaccattaggtaatgagaaacacatttaaggnaatcgaattagcagtagttgtgattattttcattttatccctcagagccttttctacaaa

SEQ ID NO: 5089 - DNA, 121 bp, Artificial Sequence
  Synthesized
  misc_feature (61): n=t or c
ggatttattttatgccacatctatacaatgagcaaaattgggagttttcagcaaccactgngaactgtttccagagattatgttttccccatggaataattttcactagtgtagaaaaacc

SEQ ID NO: 5090 - DNA, 121 bp, Artificial Sequence
  Synthesized
  misc_feature (61): n=t or g
aaattcaacatgtggttagaaaaataatattattcaaggttgaagtgttttgcattccagnctgagaacgcctgggccctttttcagtctaatccattataatgcactacaaaacagagaa

SEQ ID NO: 5091 - DNA, 121 bp, Artificial Sequence
  Synthesized
  misc_feature (61): n=a or t
gctgtagaacaacacaggcagaaatggttggttcttgttactcgttttgggacaaacaacnttatagtcactgtagatcccattagcaaactgctgcagccaataggtataaacttaatca

SEQ ID NO: 5092 - DNA, 121 bp, Artificial Sequence
  Synthesized
  misc_feature (61): n=a or g
gttatttctttcccattactttccagtacctaaggaaaagaaataaatggacaactgcagnttgtccgaaggtctcagagcaaatcacccccttgagtccaaaacctttacagacccatca

SEQ ID NO: 5093 - DNA, 121 bp, Artificial Sequence
  Synthesized
  misc_feature (61): n=c or g
aggataagttcctggaagatgatgtggctactgctgtttgtctgggatgaccaaagggatntatttaactggggtttgagcaggaaggaattacagctcagaaaaggagagggaagccagt

SEQ ID NO: 5094 - DNA, 121 bp, Artificial Sequence
  Synthesized
  misc_feature (61): n=a or g
tagaactgaaaacaggcaagcaaacaaaaaagtcgggcttttaaagcaatgagatttcttntaggaccccactgagcacacaggctgtttctggtgctccctcttttctgcagggtacccc

SEQ ID NO: 5095 - DNA, 121 bp, Artificial Sequence
  Synthesized
  misc_feature (61): n=a or g
cacatttgcgaacttcttgcttgaatttgaagaggatggcagaatttaaaggatctagtgnccttcaggaaatcagccctggtgttgatggatcactgcatataggacccagacagcaagt

SEQ ID NO: 5096 - DNA, 121 bp, Artificial Sequence
  Synthesized
  misc_feature (61): n=t or c
ctgtttctggagccagaattttttgtcttttggaggtttatctttgctacaagtgatgccncttggtgtggaatgagcagacattgtgatgaaaccacagacgctgtgaagaaggggcagg

SEQ ID NO: 5097 - DNA, 121 bp, Artificial Sequence
  Synthesized
  misc_feature (61): n=a or t
actgcagcacctctgctgcttgttcacagcacccaaaaccaccagggaggaacccagccanccttgggcttgaaaccttttccagatacacagctccaggatgaatcccattggatgcacc

SEQ ID NO: 5098 - DNA, 121 bp, Artificial Sequence
  Synthesized
  misc_feature (61): n=a or g
ggagcagtctcctgttcaaggccccttggcatcaccatggcagcaatgaaaggagaacacnaactcacagatgaccctcagcctcaagaccatcctgctgccttacacagctgccccacac

SEQ ID NO: 5099 - DNA, 121 bp, Artificial Sequence
  Synthesized
  misc_feature (61): n=a or g
taaatggattgctgagcagagcacgagaacagcaacacttctctgtgaggaagaacagcanagcagctcctgaaaggttagaggcagatacaggacttccatcagtgccttctccatactg

SEQ ID NO: 5100 - DNA, 121 bp, Artificial Sequence
  Synthesized
  misc_feature (61): n=c or g
acggtacacagaaagcatgggttcattgtggagaggaaacccactgggctctccatcccanatttccacactacagcccggtctgagaactgagcttcctctctgctccttccaaagcaac

SEQ ID NO: 5101 - DNA, 121 bp, Artificial Sequence
  Synthesized
  misc_feature (61): n=t or c
aagcttcagcctctctcctatattccgttgaagaacagctgcattaatttaaggaagcagngagttatcttaagacaaaggaaaaaaattccaaattaaaatcttgcaagaaccaagagat

SEQ ID NO: 5102 - DNA, 121 bp, Artificial Sequence
  Synthesized
  misc_feature (61): n=a or g
tccatttgtatttcataaagggaattgtaggatcacagatgctgagtatggtagaatacantcagatgaggaactccgcaacagaggagaagggggtggttggtgatgaagagctgacctc

SEQ ID NO: 5103 - DNA, 121 bp, Artificial Sequence
  Synthesized
  misc_feature (61): n=t or c
caatagtagccgaaagggcacatgcaatgagggattctatgtgaagagcaaaagccatcanagaacgactgctagacaggcaagttgtattgcaaaccgtgtcattcaactggagttcctg

SEQ ID NO: 5104 - DNA, 121 bp, Artificial Sequence
  Synthesized
  misc_feature (61): n=a or c
cttgcttagcatgggatgccctctgctttttgggttcatttcccttgatttcataaacacncctgagccactctatgtgaggtgagtatgagatggggggaaagcctcagcgcctctgagc

SEQ ID NO: 5105 - DNA, 121 bp, Artificial Sequence
  Synthesized
  misc_feature (61): n=t or g
taaagcctggaagtgttgagtgtagttaaatgggtctaagaatacctctgccatgagggtnctgtgtgcattatcctccagggttttgagaccatggcttcaaagcatcatcttctttgtg

SEQ ID NO: 5106 - DNA, 121 bp, Artificial Sequence
  Synthesized
  misc_feature (61): n=a or g
ggtgtttccacaaaggaaacatgtgtttggtctgtgtgtaatagtaaaagggagggatggnctgaggaccccccaggtctgggtaggttagcacagagacctgaggagctgatgagcagaa

SEQ ID NO: 5107 - DNA, 121 bp, Artificial Sequence
  Synthesized
  misc_feature (61): n=a or g
ggagggacagcagagctttgtgcagcattggccctagcaacgaggaggccaggtgagaatngcaaacacccatacggggcccaccatacggtttgcactgcgctctgtaacagcacagtgc

SEQ ID NO: 5108 - DNA, 121 bp, Artificial Sequence
  Synthesized
  misc_feature (61): n=t or c
accttcgctttgctttagttctcaaattgcaacgtggaaatccttctcttcctctagtgcngcacgcctggctggctttagggaggctgaggttctctgatgcgaggaagagaccccgttt

SEQ ID NO: 5109 - DNA, 121 bp, Artificial Sequence
  Synthesized
  misc_feature (61): n=t or g
cggccatgggtgcagacagtgcctgtaaagggctactagcacttattttcatcttttgcangaaatcctccccccctcagcactgccatacagccacagccgctgcgttcccgcgctgctg

SEQ ID NO: 5110 - DNA, 121 bp, Artificial Sequence
  Synthesized
  misc_feature (61): n=a or g
tcccctagccagggaggtcttgtcttctaatcttgtgcaccttctaatgaacagatgtcanccccagccctgagcactccttttagggtctgacttttctttcctaacaactaactgaaat

SEQ ID NO: 5111 - DNA, 121 bp, Artificial Sequence
  Synthesized
  misc_feature (61): n=t or c
accgccttcaaatgtaattaccttctttcaacaccaactggagcctagaaaacatcctgcngtgagtatttttatggcttatgaaatagtttgttgcccagggcgcaattcatttcccact

SEQ ID NO: 5112 - DNA, 121 bp, Artificial Sequence
  Synthesized
  misc_feature (61): n=t or c
gtgtttgaagcttccagtcctcagctcagactaggatttctgggatgtaataatcctctanttccatgctctgccccttctaccttggcacacgtatcagctggtacctgccaggcatacc

SEQ ID NO: 5113 - DNA, 121 bp, Artificial Sequence
  Synthesized
  misc_feature (61): n=t or c
attttacacttggaagtcaaatgcagtcggggggattctcattttatggtgcgtataacangtgtacgtgaatcctccggtggaatatttaaatggcaatccatccctgagcactctaagg

SEQ ID NO: 5114 - DNA, 121 bp, Artificial Sequence
  Synthesized
  misc_feature (61): n=t or g
acctgcactgacagcattgtgctacaaacagagctcttattcctccaccatgtgtaacgtntggttatgtgttttaaagcagccaagctacagtccatgagatcccacagaaaatctttat

SEQ ID NO: 5115 - DNA, 121 bp, Artificial Sequence
  Synthesized
  misc_feature (61): n=a or g
accaaactggaagacgccaagtaagctggactatactgtgagtactttatcttctgcttcntgaataaatgggaagcgtggctttttgataacagtaatgacagagcccttgcagtggagc

SEQ ID NO: 5116 - DNA, 121 bp, Artificial Sequence
  Synthesized
  misc_feature (61): n=t or c
ttttgtgtttgactgagcagagtaagggcactcggtgcattttagtgtcacagatgtgttngcaaactcagcccccgagtagtgatgcctttgcacagagctggggtgctgctgacctcag

SEQ ID NO: 5117 - DNA, 121 bp, Artificial Sequence
  Synthesized
  misc_feature (61): n=a or g
ccccaccggggccaggaggctattcactcagagcagggagaagaaaggctgagcacgagcntggcaaatgcctcccgttcctctatccatcaaaggcatctgcggaacgcagcctcattag

SEQ ID NO: 5118 - DNA, 121 bp, Artificial Sequence
  Synthesized
  misc_feature (61): n=t or c
gtcccatatccatgtcccctatcccacgtctggtgtcctatgtcccctgtcccatatccangttcatatccatatcccctgcctatcgctgtggtccagctgccctggccaggtgccctcc

SEQ ID NO: 5119 - DNA, 121 bp, Artificial Sequence
  Synthesized
  misc_feature (61): n=a or g
gaggagccactgttagtaaggaagtgggcaggcgtttcttaccttttgggttttggaaccntagtggtcagagaaaaattgtgcatttgttttttcctatatgagaaaaaaaagaggatgt

SEQ ID NO: 5120 - DNA, 121 bp, Artificial Sequence
  Synthesized
  misc_feature (61): n=a or c
tgtcccatccctcaaaaaaagtaagtatgttggggtggtggcagatatgatattcttatgnttgattggaaattgattctacttatcttatatttgatcctcttatgtacctttcatagtt

SEQ ID NO: 5121 - DNA, 121 bp, Artificial Sequence
  Synthesized
  misc_feature (61): n=t or c
aatactgcctaagaaggagagttcaaagacttcagcaaaaaaatttaaactaagtgaaaanactgcacgaacacaaccatttgcctggcaagacgttacctgaagttttcaagagcataat

SEQ ID NO: 5122 - DNA, 121 bp, Artificial Sequence
  Synthesized
  misc_feature (61): n=t or g
acctagcaaaataaagtttgtcttgcaaaaatttgttttgcaatgcatagtctaggttttngggtttttttcctcctggatcgaacaactacagccttttacttgctgatttgattcacaa

SEQ ID NO: 5123 - DNA, 121 bp, Artificial Sequence
  Synthesized
  misc_feature (61): n=t or c
gggtggtgcagggctcagctttctgagcaatgcagcatcaccatttgtacaccaaatcctngatctctttcaggtcagtgtgaaggcaggcacctcttgagagcagctcagagaaaaaata

SEQ ID NO: 5124 - DNA, 121 bp, Artificial Sequence
  Synthesized
  misc_feature (61): n=c or g
ccatgccagcctaggaaaactgaacttttctaaatttactccataatattcatcagtgaantaggtctgcaattaaatctagcatattatctatcaactgtagcttaggcattcaaatctc

SEQ ID NO: 5125 - DNA, 121 bp, Artificial Sequence
  Synthesized
  misc_feature (61): n=c or g
cttcagggagcaaagctctccctgacagcccctccatgcaccctatcagcacacatccctntcctgtaccaaaagccctcctgtctctgtgctggcagagctggggagtgctgcacaggca

SEQ ID NO: 5126 - DNA, 121 bp, Artificial Sequence
  Synthesized
  misc_feature (61): n=a or g
ccgcttcccagcagcgagagggcaaagacagcgcgggagggaatgtgttcactgtgccaantatccaagtgtccgcgtcctcctcaggttagaaggggctttttcaggcagcatctcccag

SEQ ID NO: 5127 - DNA, 121 bp, Artificial Sequence
  Synthesized
  misc_feature (61): n=a or t
aaaaacagcatcacagcttcacagattttggaggtcacccttcattttggattaagctacntaaaaactgcattctttttacttgagttcaaaacaggacgtgtttgttcaggcttacact

SEQ ID NO: 5128 - DNA, 121 bp, Artificial Sequence
  Synthesized
  misc_feature (61): n=t or c
tcttagatgcaataagataaactcccatggtggtggtgttcccttcccctctttatgtagngtcagaggagttaccctacacataagagatgctatcttgctcctctctccctgtcgttgc

SEQ ID NO: 5129 - DNA, 121 bp, Artificial Sequence
  Synthesized
  misc_feature (61): n=a or g
tccataatccacaagctttttttgtgtttacaacggttttcaatagaatccaggcctaatntgtccaaaacttgcctcttgcagcgatcacagtcctgcaaggagcccttttaacccttac

SEQ ID NO: 5130 - DNA, 121 bp, Artificial Sequence
  Synthesized
  misc_feature (61): n=a or t
ttcatcttcatttttgatttattgatttgtgaaagagcacaacaaaataataaaataaccnggtaggagatggctattttcccagtcgacttgcttcatgaaatgaaatgaagcacacgga

SEQ ID NO: 5131 - DNA, 121 bp, Artificial Sequence
  Synthesized
  misc_feature (61): n=t or c
tacacggggatgggattgaaaaaagaaagggttaaagttgcatcgctccaaacacagcgtnctcacacagtgttctctcaggctgcctgcaggaagcactgtgcagaccagccagcacagc

SEQ ID NO: 5132 - DNA, 121 bp, Artificial Sequence
  Synthesized
  misc_feature (61): n=a or g
ggtctcccacagcctttttgccttgaagatgtcgtgctgaccagagccctgtcccttctgnccactctgctccatctccctcagagctgcagggattatttttctttccttaagctgttcc

SEQ ID NO: 5133 - DNA, 121 bp, Artificial Sequence
  Synthesized
  misc_feature (61): n=a or c
ctattgaaaatcaggctaaaagcagtgaataattgcttacagaaaatacacctattccccntacaaggaggaatgttttctccaacagaaaaaatgagaacagcagtacatatcagtcaat

SEQ ID NO: 5134 - DNA, 121 bp, Artificial Sequence
  Synthesized
  misc_feature (61): n=a or g
cttccaactcaggatattctatcattttcttagcatccagcccaaaatttcacagtttttntgcgctgaaccctcgtttcctcccttttccaggtattaagttcctgccgctgtagccacg

SEQ ID NO: 5135 - DNA, 121 bp, Artificial Sequence
  Synthesized
  misc_feature (61): n=t or c
ttactaagttggatggcctcaaaatctgttaatgcagaattgagtttgtcctaccacatcncattttgcttgcagagtagcaggtctgcttacccacaaacatgtgcaaggtcagccatac

SEQ ID NO: 5136 - DNA, 121 bp, Artificial Sequence
  Synthesized
  misc_feature (61): n=t or c
gagtatattttaaacaagcatttggtgcactctccagctggatttctgtgcaactgagganctggacacagtgctcaaaatgcttctgcttgtttttctctcctgaagcttggctgacctt

SEQ ID NO: 5137 - DNA, 121 bp, Artificial Sequence
  Synthesized
  misc_feature (61): n=t or c
tcaaacatcactgccttttgtagtgcaggtattgttcaatgctgactgaaaaaacactttnttcctgttacctacatcttgtaaaagttcacactagactcaaatagaacctacccagact

SEQ ID NO: 5138 - DNA, 121 bp, Artificial Sequence
  Synthesized
  misc_feature (61): n=t or c
ttagaagcatcacaagggcagctcctatgggcacaaccaacatgcttcacaccaggcaggntagcttaaatctgctcctctcttacagacacgcagcagcactgcatgcagttggccagcc

SEQ ID NO: 5139 - DNA, 121 bp, Artificial Sequence
  Synthesized
  misc_feature (61): n=a or g
gctggaaggaatctatactagcagcgtctcacagttgagaagttttgcattaaaatgagcntgtccaagaggccagagaggacagctggagcctaccaaagctcagttccacacttgtccc

SEQ ID NO: 5140 - DNA, 121 bp, Artificial Sequence
  Synthesized
  misc_feature (61): n=t or c
gcaggactttggcaagcaaattcaggcgaatcttaaagccttaaggggctttaaggacagnaacacatatctaaaggagatactgaagagtgaaaagtgacaggcagtgaatctgacatgt

SEQ ID NO: 5141 - DNA, 121 bp, Artificial Sequence
  Synthesized
  misc_feature (61): n=a or g
actcataaaagatgcataacagttatcgagtacccatattgatccagcttcctaccaggcngtactcctgagaaagccaccagtgcattgccctatttgcgggctttctccccctttctca

SEQ ID NO: 5142 - DNA, 121 bp, Artificial Sequence
  Synthesized
  misc_feature (61): n=t or c
aaagaggcagccttcatctctttcacaataccaaagagctaagggccagctttgctggtgnaagcaacgggggataatctgcaaagcctgggctttaccactactcagacaccgcacacat

SEQ ID NO: 5143 - DNA, 121 bp, Artificial Sequence
  Synthesized
  misc_feature (61): n=a or g
aagttcaaaggaggccaattattgccagcagacttgcttgcctgctcttctaggaatgacnaatgatgggcttaggtcatcacccagcctgagccgggtatctcaggagctggctttaggg

SEQ ID NO: 5144 - DNA, 121 bp, Artificial Sequence
  Synthesized
  misc_feature (61): n=a or g
ccttcaactgtaatgtaggtacatcaatatttaatccttctctaatcctttgtcttttcanctcctgttctataaagtaggacacacaaaacagaagaattaatgggaggataaaaactcc

SEQ ID NO: 5145 - DNA, 121 bp, Artificial Sequence
  Synthesized
  misc_feature (61): n=t or c
ctggtttcactgtacacaaggttctactgtaacagtgaagggatgatgacatatctctaantttaggtcctatgggggcattgcttgatgtgacaatgagattttaatttctttctccttt

SEQ ID NO: 5146 - DNA, 121 bp, Artificial Sequence
  Synthesized
  misc_feature (61): n=a or g
aaaagtaacacatttatcacaacagacccatctcaaattatgaagaggcttcaaagcaccnctctgagctttttcctgttactggcacgttgctaatgaagggactggttcccttctctca

SEQ ID NO: 5147 - DNA, 121 bp, Artificial Sequence
  Synthesized
  misc_feature (61): n=a or g
aactgcctcagcctcgtactttggtccatgctaagaaccttcacgctgcttaccgctaccntacatccttatttcttccccatttctgccctttgtctcattgcaccactcccacagaaag

SEQ ID NO: 5148 - DNA, 121 bp, Artificial Sequence
  Synthesized
  misc_feature (61): n=a or g
cataaacaccaaccctccatgataagcaagcaataaagcctgtcctttattaccaccaagntaattcatactttaatatatctattgtttcagcccgaagattattttactgcagcaaatg

SEQ ID NO: 5149 - DNA, 121 bp, Artificial Sequence
  Synthesized
  misc_feature (61): n=a or g
aaagttttctgcaaggtggatacatctgcctctgctggcttttctccacccaggtctgccntgctgaaccactcttacagctctaaaaccccaagcagccccagggtagaatatgtttaga

SEQ ID NO: 5150 - DNA, 121 bp, Artificial Sequence
  Synthesized
  misc_feature (61): n=a or t
ccacaagtcttgcagccagaacctggttctgttccagtgatgttctgctgagccatggtanggtgcacagaaaagctttgccaaaatctctgttacatgaacgcaatgaagtaactcaact

SEQ ID NO: 5151 - DNA, 121 bp, Artificial Sequence
  Synthesized
  misc_feature (61): n=t or c
gtgtcctaattgacaccatgcagtaaaagccaagttcttagagcagtgacatgttgtcatngaagctgaagagagacaagcagtggttaataaatcataaacctgttttccaagtcctatt

SEQ ID NO: 5152 - DNA, 121 bp, Artificial Sequence
  Synthesized
  misc_feature (61): n=t or g
tgatcaggggactcttagtcactgctaaactgaacaaaggtagcttttttatcccaggggnaggaaaaataccatgccaaaaaactaattctatttcatagactttgtttccatcaattta

SEQ ID NO: 5153 - DNA, 121 bp, Artificial Sequence
  Synthesized
  misc_feature (61): n=a or g
aagccatcactgcatgcaaggctgctctgaggatgtagtcaatgatgaggaacttaaacanggggaactagattgaatttaaaaattgtgagagaggctgggagagaactctgcctcgttg

SEQ ID NO: 5154 - DNA, 121 bp, Artificial Sequence
  Synthesized
  misc_feature (61): n=a or g
agaataatctgttctgatttcctcttaagtgttagcaaagtagaggggctgcatgcacagnagcattcaggacacactgacagaccaaacagagagaacagctctgttaagtcctacctgc

SEQ ID NO: 5155 - DNA, 121 bp, Artificial Sequence
  Synthesized
  misc_feature (61): n=a or c
tgaggatagattgtacagtttagattactttttactattaagaatgtgtgaaactaaacanacgtgactgttcagatgagtgcagaaatctaatagagttagggctcagccctgaagggta

SEQ ID NO: 5156 - DNA, 121 bp, Artificial Sequence
  Synthesized
  misc_feature (61): n=t or c
tcacttagaaatgtttctagtgggttttttgttctcatggtagttattctgtctttgtacntactgatcatgtgctaattggaggtgatctttctgaaacatcaagaatctttttaaaaaa

SEQ ID NO: 5157 - DNA, 121 bp, Artificial Sequence
  Synthesized
  misc_feature (61): n=a or g
ttgtaagtagcagctgctgtggtcactttgactccagcccggctaacgttctctgtgcccntactgatctccactgcatgtctttcttatcttgaaactgaggttagttcgtgtgggaaaa

SEQ ID NO: 5158 - DNA, 121 bp, Artificial Sequence
  Synthesized
  misc_feature (61): n=a or g
tactttttctgttctgctctgcctttacatatcacttgtgctgtgtttcctctgcatcaangatatgtggctataaggcacgtgctctgaacctgtgtaagcaggagctttcatttgctgt

SEQ ID NO: 5159 - DNA, 121 bp, Artificial Sequence
  Synthesized
  misc_feature (61): n=t or g
tcttcaaaggggaggcatatattgaagattaggacttccaggaaatggtactcatcttatnatctcctgcaaaccatagaatattactcaaagactgccagaatttcagcatgaaggttat

SEQ ID NO: 5160 - DNA, 121 bp, Artificial Sequence
  Synthesized
  misc_feature (61): n=a or g
ctgctttctccattcttttgctggttgctaggaacctgaaggttcagcggtaattgcagcngttaagacttcagtgttactggaaattaaccacagtctctgaagtgcagtgggaggtgca

SEQ ID NO: 5161 - DNA, 121 bp, Artificial Sequence
  Synthesized
  misc_feature (61): n=c or g
tgctgaaatagtacagcatgtacctgaatgaataatagaatacattccatatattattatncttatgatttggcatcaccttgctagccctgttgacccctatgctttttatgacatattt

SEQ ID NO: 5162 - DNA, 121 bp, Artificial Sequence
  Synthesized
  misc_feature (61): n=a or g
aggtacacttaccaggtaggctgactcagagaatataaacctgaacttgggggcatgccancatttcatgatgtactatcagcataactctgaagcagaaattagtttattggcagactcc

SEQ ID NO: 5163 - DNA, 121 bp, Artificial Sequence
  Synthesized
  misc_feature (61): n=t or g
tagcagttggctgcttactcaccacacagttagttaaaggagttgttcttagcacaggcancagaagccagtgatttaggtgtgctaaggctttgagatttaatctttgccaattaatagt

SEQ ID NO: 5164 - DNA, 121 bp, Artificial Sequence
  Synthesized
  misc_feature (61): n=a or c
cgctgggtctacacaatctttcaggactctaatgagaattacacagttaaagcctcatgcnccggtgtgaaaatactgtcactgagcacgtaattgtgtgcctgaggctctcaggtccctt

SEQ ID NO: 5165 - DNA, 121 bp, Artificial Sequence
  Synthesized
  misc_feature (61): n=a or g
aggcagaaatccagagcaggatcaaaactctccccagggtgggagtagtccttcagtggtncagactataactagggaataacttagaaggaaacttctaagttaagagatggatggattg

SEQ ID NO: 5166 - DNA, 121 bp, Artificial Sequence
  Synthesized
  misc_feature (61): n=t or g
ttatctgtattgtaatgcaaaaacacgacatgggaatcaaggaactcagacaatgccaaantacagagctgccaaattcaaactggcaggcagcagtggcacacttttcaagttgcttttc

SEQ ID NO: 5167 - DNA, 121 bp, Artificial Sequence
  Synthesized
  misc_feature (61): n=a or g
catgggaagaagagagtctcagcgtgagctcagatgttacatacatgtcagtgtttatacnggaatgtcacttcccatctgcaatactcgttgcgttttacaagaaaaatgattactcatt

SEQ ID NO: 5168 - DNA, 121 bp, Artificial Sequence
  Synthesized
  misc_feature (61): n=a or g
gcagtttgcagagctttctgctcagtccctttagcaacctttcctccatgcactgacctgncctgacactgataaagtctatgaggagagcacaggcaaaaggtgatagggctctaatcat

SEQ ID NO: 5169 - DNA, 121 bp, Artificial Sequence
  Synthesized
  misc_feature (61): n=t or g
gcacaggacagtacatgtcagtggcatttggcctctggaaacttcagataagttcagtacntgttgctgtgtggctgctcttggtgatagcagcctactgcatggctgccttccctgagag

SEQ ID NO: 5170 - DNA, 121 bp, Artificial Sequence
  Synthesized
  misc_feature (61): n=t or c
tgtgcctttcatcactcaccccactatcaggcagctatcgcaccatggtgtaaggacatcnctctaaatacctcctggttttcactaacttcaaggagggaatctccattcctttagtaac

SEQ ID NO: 5171 - DNA, 121 bp, Artificial Sequence
  Synthesized
  misc_feature (61): n=a or g
tgtgtttcacatttcaaggcacggcactgagcatgccactcacctgcaagcttccaacagnacccttctaaagggctgcaggtggcaatcttgaggcatctcaagaagctcttagacctag

SEQ ID NO: 5172 - DNA, 121 bp, Artificial Sequence
  Synthesized
  misc_feature (61): n=c or g
ttgtgctgaaatccaaggaattctggtcttgtgtcatgttggtgagatgtttctgagcacntggcaccaatatatgtgtatttgttgataagctgtatggatgacatgatgaaattgggtt

SEQ ID NO: 5173 - DNA, 121 bp, Artificial Sequence
  Synthesized
  misc_feature (61): n=t or c
agttcagacccactgatgagctgcgggcacgggggctgggggaacatagagtgtctctgtnatcccgttgctcctgcagttgcttcccttcccctgccatggagtttgtcttcagtcccat

SEQ ID NO: 5174 - DNA, 121 bp, Artificial Sequence
  Synthesized
  misc_feature (61): n=t or g
gtaactcctgcgtcttgagtaaggattcggcggtcagaatggcacagtctgttgtcagaantgctgatcccatggccaggaccacatccctgtaattcaggggaggccttttctgacttag

SEQ ID NO: 5175 - DNA, 121 bp, Artificial Sequence
  Synthesized
  misc_feature (61): n=a or c
aaggtagtccccaaatgctctcagaggatggctgcaggaaaggagctccaatggataacgngcaaaaactttcttcttctctgggtaaagctctgtaccatcccctcttaacagaactgca

SEQ ID NO: 5176 - DNA, 121 bp, Artificial Sequence
  Synthesized
  misc_feature (61): n=a or g
acgcgttggaggccagcacataccaatggcctggacaaaaaggaagcacataagcagtgcncaagacagcaatgcaagacatagcaatacaagacatagcaatgcttgacacagccagcag

SEQ ID NO: 5177 - DNA, 121 bp, Artificial Sequence
  Synthesized
  misc_feature (61): n=t or c
gtgtctgaaaataaaagtaggaaatagcaatggcacaggaacacctgagagtgctcctttncttttccaaggaagatcatttttggctctaggcaggacaaatcctgagcatttccatttt

SEQ ID NO: 5178 - DNA, 121 bp, Artificial Sequence
  Synthesized
  misc_feature (61): n=c or g
aaggggtgcagactttaaccacagccctggctgcacatggcagtgcctgtgcccacattangtactgcttttgctgttcaatgtcctagacaagcaaacccctcaaaccagtgatctgcaa

SEQ ID NO: 5179 - DNA, 121 bp, Artificial Sequence
  Synthesized
  misc_feature (61): n=a or g
ggtgggtattaaggggtaaaagtagcatttacaatagtgttgccacactgctgagtctggnatgaaccttctgtgcaagcggtgtctttgtaagctgcctgtggttttgtgagtgttgtgg

SEQ ID NO: 5180 - DNA, 121 bp, Artificial Sequence
  Synthesized
  misc_feature (61): n=a or g
tgagtgttactgttaatgcagattaaaacatctcgtgtctcctgggaatttaaaagccttnactctgtatttaccactggtattttcagctgtccctgacgggctcacagctgccttgtgg

SEQ ID NO: 5181 - DNA, 121 bp, Artificial Sequence
  Synthesized
  misc_feature (61): n=t or c
aaaatctgagctgactaaccatcattaaattgcattttctacccatctccagccttgcccnccaaacgttccctcatgctagaaatggaattagaatttgaatctgcttctggaaagtaga

SEQ ID NO: 5182 - DNA, 121 bp, Artificial Sequence
  Synthesized
  misc_feature (61): n=a or g
acatcagacggcgaagcagagttgctagggctatttaaaataagccattttttaagctctngatttccatctttctcttcacagtggaataaagatcagtgggaagttgctggaaaagcag

SEQ ID NO: 5183 - DNA, 121 bp, Artificial Sequence
  Synthesized
  misc_feature (61): n=t or c
gctggcctctgctcctgggagtttccgtggggagaggtcagggctggtcacattgactatntgcttttggggcatttttctgactcatctggctgcatgaactgaggaggcttctcggagc

SEQ ID NO: 5184 - DNA, 121 bp, Artificial Sequence
  Synthesized
  misc_feature (61): n=a or g
tgctgccggtgagctcaggtgctgctccctgcaggcagaacaccagacctgagcaaccacnttaggctgcatctatacagcctgctttgctccagctgcctttgaatctacacagccgttc

SEQ ID NO: 5185 - DNA, 121 bp, Artificial Sequence
  Synthesized
  misc_feature (61): n=t or c
tagtgctctttttccttttcatttgatatctgtttgaaaatctacctaaaaattcctttcnttctctattattctgtatttttttccccacaaaagtatccctcagggcaggaagaatctg

SEQ ID NO: 5186 - DNA, 121 bp, Artificial Sequence
  Synthesized
  misc_feature (61): n=t or c
tggagctcttgttatcaaattagaagacaaaaccaaaactgtatctcggtgctccaagagngtaggagctctcatgtgcctctggtatcctcctgtctccctgcagctgtgggactgtttt

SEQ ID NO: 5187 - DNA, 121 bp, Artificial Sequence
  Synthesized
  misc_feature (61): n=a or g
gaagtacagagagagtgggcaaagacagtagaagagtggaggagcagaggagaattagctntgcttgagagtaagaaagggaagcaggttagggacacagggaatggtcagggccaggcag

SEQ ID NO: 5188 - DNA, 121 bp, Artificial Sequence
  Synthesized
  misc_feature (61): n=a or g
ggcatctccttcccaagggatggcactgccagaccctagggtggaatcacaggtctcatcntgggtgatgttctcgttaaggtgccagcagctggagccctgctaggaagtgtggttctca

SEQ ID NO: 5189 - DNA, 121 bp, Artificial Sequence
  Synthesized
  misc_feature (61): n=c or g
ccagggttatgctggcagcaaagctttcatagacaatgtgtagtaaggctaaaactctttnctttcctacaatctgcgccaagcttgtctcttgggaaagtcccctctttaaatagcaggc

SEQ ID NO: 5190 - DNA, 121 bp, Artificial Sequence
  Synthesized
  misc_feature (61): n=a or g
tgacatttccttcccagaacaagtcctttaactcatctcttaagctggtatttacatatcnctcaaagcatcaagtacattcttcagttgtggagtttacggttcaaacacagtcagaaga

SEQ ID NO: 5191 - DNA, 121 bp, Artificial Sequence
  Synthesized
  misc_feature (61): n=t or c
cccaaagctctccctcaacaaatcagggctccccttgcatgggataagagaccaaatttgnccctcagtgcaggaggaaaatgttctttggtggtggtggcggccctgtgttggagatgcc

SEQ ID NO: 5192 - DNA, 121 bp, Artificial Sequence
  Synthesized
  misc_feature (61): n=a or g
cggtggcagatgacaggtgagctaagcctcttttgaggtttccagagggaaagagggtccnaggtggacacaccaatgtgcaccaggggcttggggcatcctaacggcgagcaaaaattca

SEQ ID NO: 5193 - DNA, 121 bp, Artificial Sequence
  Synthesized
  misc_feature (61): n=t or c
tgttgtgcagacaggagcagcagcactggggacgtccccgtccctagacttacagatgtangctgtgtaggcgtgctgcctgtttgtttgcacagatccacccaggtgcagccgctcgcac

SEQ ID NO: 5194 - DNA, 121 bp, Artificial Sequence
  Synthesized
  misc_feature (61): n=t or c
gactcccaccacaacactccatttctgtatctgcaggcagggcatagaagggacaatgccngcaagcagcactaagggcaccagaatggacaaaacagcagattccctgtcccagaaagca

SEQ ID NO: 5195 - DNA, 121 bp, Artificial Sequence
  Synthesized
  misc_feature (61): n=a or g
ttcgccttaagaaaccttaaaagccaggaagggaatgagttcccagcatccacgcttcagnaaagggcagaaagtaatgctgcagaaaatgatttctgaggagagactgaaagatgtagat

SEQ ID NO: 5196 - DNA, 121 bp, Artificial Sequence
  Synthesized
  misc_feature (61): n=a or g
aagttttgaagaatgctctttctcggaacacgtggtgtgaatctttttggtttgtctgtancaactgcaagagaaatgaatgggtggaaaactgtgaagaatggagaagtatccttcttcc

SEQ ID NO: 5197 - DNA, 121 bp, Artificial Sequence
  Synthesized
  misc_feature (61): n=a or g
ccctacacataaatggggtctgcaatacctccacgcaggtccagtatttcctacctacacntctaacctggatatttctacagtgcagacactaagaggaggacatgagctcctggatagg

SEQ ID NO: 5198 - DNA, 121 bp, Artificial Sequence
  Synthesized
  misc_feature (61): n=t or c
ggatccatctcaaatttcccccttttcagcaataggtggagcagaggctgtgaagaaaagnctatgagctgcagaggggctgaacatccccacatggaaccagctgcaaaaagaaagcgaa

SEQ ID NO: 5199 - DNA, 121 bp, Artificial Sequence
  Synthesized
  misc_feature (61): n=a or t
gattaggcaacagccttctgtaccagagtgggatgggagcccaagtcctaggggtagcagngtagatcaaaccaatctttaaagttggatctggatccagtaaatatacatgctgcagttt

SEQ ID NO: 5200 - DNA, 121 bp, Artificial Sequence
  Synthesized
  misc_feature (61): n=t or c
aagaactttaatctcttaaatttctactgtaaatcctaagacagcttagactgtcacattnggactggcacaagaatttctgtatattttctaatttgttaattagtgggctatacgtacc

SEQ ID NO: 5201 - DNA, 121 bp, Artificial Sequence
  Synthesized
  misc_feature (61): n=t or c
gtcctctggaaagagaactgggtgaaaacagccttaagaatgtgtatgttacatattaccnaaataactcagttaattcctcagtcaattaaaatataattaacattttctctccctgtta

SEQ ID NO: 5202 - DNA, 121 bp, Artificial Sequence
  Synthesized
  misc_feature (61): n=a or g
tagctcttttggaaagctccccttcccctgtattttatttcctttcttggtgccagaatcngagccaaaggcaagcttaacaaagcaacaggcatggccatttttcccagccttcaattct

SEQ ID NO: 5203 - DNA, 121 bp, Artificial Sequence
  Synthesized
  misc_feature (61): n=a or c
accaaacagaggagcacttttccagtgctgattactacttggcgttcaactacaagacaantacagcgctgtaagcgttccgtacccctcattggagttttgcatattagccttggacaga

SEQ ID NO: 5204 - DNA, 121 bp, Artificial Sequence
  Synthesized
  misc_feature (61): n=t or c
ggcttctatgggtgacttgcgtggttcagcacatcatcccttaccactcacctgcagctgncagcaaaagccaggcactgagctgtgcagcagcactgaaaagcgacccctgggtgaggca

SEQ ID NO: 5205 - DNA, 121 bp, Artificial Sequence
  Synthesized
  misc_feature (61): n=t or g
atcagcctcagcagcaggggtggcactctatgatagtctgtgatagccccagcaagttctnatatcttctgacagaaccataaagactggcaaaatgacagccccaagcatctgagcagaa

SEQ ID NO: 5206 - DNA, 121 bp, Artificial Sequence
  Synthesized
  misc_feature (61): n=t or c
cgccaacacaaagtctagaaagcttaccgcatttaaggccatttccatccaacagcttgtngaagacaccaacagaagtaggctctgaaaatagtcctgatctgggaagtggtactcaaga

SEQ ID NO: 5207 - DNA, 121 bp, Artificial Sequence
  Synthesized
  misc_feature (61): n=t or c
acattcagaaaatgagtgtgtgtgtaacatctgcatgcaccagctgattgcagggctctgnggggtcgcagctggagatccctctttacatgcaggcactcgtgttcaatgatgtgcttga

SEQ ID NO: 5208 - DNA, 121 bp, Artificial Sequence
  Synthesized
  misc_feature (61): n=a or g
ggctaagcctcaggttctccctgggaaatgcttccgagagctttgttgtaaaactcaatcnctgcagactgtgtttggagctcttttgtataaacatatagatctgaccttccctctctgt

SEQ ID NO: 5209 - DNA, 121 bp, Artificial Sequence
  Synthesized
  misc_feature (61): n=c or g
gttattgcatgagaggctgtaattactcagactcaccctctctgtctgcacatggctgctntgctggatgccgccgcagagcaaaagctcctcaactctttggggctgagcagggtgatgt

SEQ ID NO: 5210 - DNA, 121 bp, Artificial Sequence
  Synthesized
  misc_feature (61): n=t or c
tctgtgattcctgagctcagggaggcttgagcactcttgctaatgcagcagggagcaccangagatgagcctgagtacagcacagccaagcttctggagcctgcctgtggctgcgctgctc

SEQ ID NO: 5211 - DNA, 121 bp, Artificial Sequence
  Synthesized
  misc_feature (61): n=t or c
caccgagggccgggcgtcacctctgccaaagggctgggacggctctgccgaaatctgtccncacaatgggcacggagcagctgaagtgcatcatccccaggggtgaaactgcccaaagcca

SEQ ID NO: 5212 - DNA, 121 bp, Artificial Sequence
  Synthesized
  misc_feature (61): n=a or g
catctgtacttttcccacttgtacagcactcccatgccatggtactgctgactgccatgangaaaacattcctggaagattcagaaataccctctgacatatttaccgatgattctttagt

SEQ ID NO: 5213 - DNA, 121 bp, Artificial Sequence
  Synthesized
  misc_feature (61): n=t or c
caagttcttagtgtcaaaaaaagccattacaaatttgcagcagtcaggtattagccaaagnactccactgcaggctttgcatcaaggatgtttaatcaaacccacggagctgtcaacacat

SEQ ID NO: 5214 - DNA, 121 bp, Artificial Sequence
  Synthesized
  misc_feature (61): n=a or g
cagcacaatgcactaaaacagacctgcagtcggtggtggctggaaatgcaaaatggagaancagcagtgagtgagagctgggctttgggaggaggcagccgtgtgccaagggaagggaatt

SEQ ID NO: 5215 - DNA, 121 bp, Artificial Sequence
  Synthesized
  misc_feature (61): n=a or g
ccggtttgctgcaggcaaagtcctgtaggaagcccagcagggcatgtgttcccactttgcntgagttggtctaatgatattttccccattaacgtttggaagaaagatctaatctgcgggg

SEQ ID NO: 5216 - DNA, 121 bp, Artificial Sequence
  Synthesized
  misc_feature (61): n=a or g
actggcatatattcctgcctgttcctacaagcctttaaatttcaagtttaacttaaattgntgaatatctggcacacacacaagacttgctttcctgctttgcctaagaagcgatagctct

SEQ ID NO: 5217 - DNA, 121 bp, Artificial Sequence
  Synthesized
  misc_feature (61): n=t or c
agctgctccatactgatatgagctgaagccaagactgatggtgaactgccacaaagccaangtgtcagcgtgcattcttgcccatcagggtgtttgcttttccatcctttttaatgcattt

SEQ ID NO: 5218 - DNA, 121 bp, Artificial Sequence
  Synthesized
  misc_feature (61): n=a or t
agacctctgaatttgatgacagcctcagctgtacttaggtatgaggggcaaggctgagcanggctccatggtgattgccattagggaacaaaccaacccttctatgtgttctcattgaaaa

SEQ ID NO: 5219 - DNA, 121 bp, Artificial Sequence
  Synthesized
  misc_feature (61): n=a or g
aatgaatgcttttggtcatctcagctttggctatgcttgtgttttacagagtggagaaggnctggcagctgcagattagatctgcagctttactgggaccggtagcaggtttaaaatacca

SEQ ID NO: 5220 - DNA, 121 bp, Artificial Sequence
  Synthesized
  misc_feature (61): n=t or c
catgctagcctgacttgtttgtactaaatgggctctgccttccttcctgaggttgcctgantagcagtatgtagtgagatgccagcttgggtctgggtaaatctgcaggccctgaagggat

SEQ ID NO: 5221 - DNA, 121 bp, Artificial Sequence
  Synthesized
  misc_feature (61): n=a or g
atgaacactgatgtcttgactgaatgtataaaccttctgtctcagaagggcctaatttcantcaatggaagagtgttttatgtaggaaatgtgtaaaaggctctggatatataaaccactg

SEQ ID NO: 5222 - DNA, 121 bp, Artificial Sequence
  Synthesized
  misc_feature (61): n=a or g
gccgcagcatcacccatccttcagtgaccgtttgatttccatggggttgcacgaagctgtngagcagcaatcagcaacaccttcccaggtgatgcatcccaacagcactcagtggttctgc

SEQ ID NO: 5223 - DNA, 121 bp, Artificial Sequence
  Synthesized
  misc_feature (61): n=a or g
cagacaccgttaggaacagtcatggctgatgtgaacacatcagacccagcagcctcagcantgggtgctttccacagcacggccaagcaaaaagccttcctgtttcctcgttgacttttcc

SEQ ID NO: 5224 - DNA, 121 bp, Artificial Sequence
  Synthesized
  misc_feature (61): n=a or g
cccctgtcctgtctcacagctctacattagtgggaaggtctgggtctctcacagagggcancccgtccctccaaagcaatgcctcacaagcaatgaagctcatttttgggttcctgaaatg

SEQ ID NO: 5225 - DNA, 121 bp, Artificial Sequence
  Synthesized
  misc_feature (61): n=a or g
ccagagcaggagttagtctctctctctttctttccttgatcactttgtgcatgttttcgtngacctgaacttctattctgaattacttttgaagccgaacctcttacaagtcttcagatca

SEQ ID NO: 5226 - DNA, 121 bp, Artificial Sequence
  Synthesized
  misc_feature (61): n=a or c
gcctctttctgccactgagatacagatgattgttgtaggatgtagttcataacttcaacanagtaaatccaaatatgttccaggctggaatggcagagatggacctaccacaaaaggctca

SEQ ID NO: 5227 - DNA, 121 bp, Artificial Sequence
  Synthesized
  misc_feature (61): n=a or g
aatacattttcatttggaaatgctcgctggctctcatgtgatttcagacttagtgcttgcngacacgctttactgtgagcccgtgtttggaaaagatgttttcaaaagcacaagtaagatc

SEQ ID NO: 5228 - DNA, 121 bp, Artificial Sequence
  Synthesized
  misc_feature (61): n=a or g
gccaaagcttttcctccgcctagggatctgttttgatccctggtggaggtgtggaagaagngaagccaaagcagtgacttagcttctaccttcagccatcgctagaaaaacatcctgttac

SEQ ID NO: 5229 - DNA, 121 bp, Artificial Sequence
  Synthesized
  misc_feature (61): n=t or c
tcagaatctacttacaccatcccaaatgaaatggctgttaggcagtccccaggtgacacgngtgcttctcctggaaggctcccagggctgctggtgagatggagtttcctgctgggagcag

SEQ ID NO: 5230 - DNA, 121 bp, Artificial Sequence
  Synthesized
  misc_feature (61): n=t or c
atgtaagtgacagctgaggaaaatctgtactcgagtgccaagagctgagaaacagaccagngtgggagatgatgtgaatccagtctcagtaagcaacatgtaatgctatgtaggttgtttc

SEQ ID NO: 5231 - DNA, 121 bp, Artificial Sequence
  Synthesized
  misc_feature (61): n=t or g
agggcagggaaggtctgcaaaggtcaaccctaattctagatggcagcaccttaatggacancctgtcatctcgaggggacatctagcaaaggccacatatttgggttggtgcagagtttct

SEQ ID NO: 5232 - DNA, 121 bp, Artificial Sequence
  Synthesized
  misc_feature (61): n=t or c
gcactaggaggggattcagaacgtgtggtgtcatgtgctgaatgcaagacttagagactanagacatcggtccccttacagactttcacttacaggcttttgcataaaaacaaaaccaggg

SEQ ID NO: 5233 - DNA, 121 bp, Artificial Sequence
  Synthesized
  misc_feature (61): n=t or c
ctttaagtaattagctaaaagaagtagtgaactagctagtgaactaaatgctcaacgtctnatctgcttgcaatggacttaaactagaagtcatgagcgcagtgccaaaaccaggtcatta

SEQ ID NO: 5234 - DNA, 121 bp, Artificial Sequence
  Synthesized
  misc_feature (61): n=t or c
cattttcagcctctgcattggcaggagtgaccatagaggggtccctagttttctatttctntttttgtagatttcaatagagtcatgagaaagccttcgtttcatcttattttcacaaaat

SEQ ID NO: 5235 - DNA, 121 bp, Artificial Sequence
  Synthesized
  misc_feature (61): n=a or c
gcaatctggactcctttgacattcattatgcatagaattgaagaactgagtgaacattacnctgaactgatgagtctggttatctttttggccaatgagctgcagcagtggcctcttttgg

SEQ ID NO: 5236 - DNA, 121 bp, Artificial Sequence
  Synthesized
  misc_feature (61): n=a or g
aacggggagatggggctgcgaccccggggagatgctggcatggtgcggatccaaggattgnttgttggactgcctgcaccagcctgatctgcgtggttgtttaacacatcttaatacgttc

SEQ ID NO: 5237 - DNA, 121 bp, Artificial Sequence
  Synthesized
  misc_feature (61): n=a or g
gttgtatttccatcatgtgcaggtgtctgggggatgattatttttattcctaaaatcttcnggagtgagttgtcactttcttttcccctaacagccccatcaggtctttggctgtgctgtg

SEQ ID NO: 5238 - DNA, 121 bp, Artificial Sequence
  Synthesized
  misc_feature (61): n=t or c
tcatgatcctggccgagactagtccaggagaaaaataaatctttgagacctgatgtcgaantaatgactgctctttctggatataacattatttctgctgaacacaagaaccactccaaat

SEQ ID NO: 5239 - DNA, 121 bp, Artificial Sequence
  Synthesized
  misc_feature (61): n=a or g
caaaagaaaataaaaaaccgaagtccctacactgcatgatttaagaagcacaatctgtttngattgtagaaaggatgagcgagaggtgacttgattagtgtgtaagtaccttcatggggag

SEQ ID NO: 5240 - DNA, 121 bp, Artificial Sequence
  Synthesized
  misc_feature (61): n=a or g
ctgaagagataacagatcggatggtttcttttattgccttctggctgagctggactgcagnggctctcaaggagcctatgacaccagtcctaagtgaaccagaaaggtcatggctttcctt

SEQ ID NO: 5241 - DNA, 121 bp, Artificial Sequence
  Synthesized
  misc_feature (61): n=a or t
aatattcagctcagaaagacacagagtaggtttcacaatcaccacgaagggatgccggccntcttatcaaccatctgtctaaagaaacacttcctcatgaattggcactgtcccttttcct

SEQ ID NO: 5242 - DNA, 121 bp, Artificial Sequence
  Synthesized
  misc_feature (61): n=a or c
gcagagccagaaaatgcatgtgatagcacacatctgactggatcccacagcagatacatgntggaggaaagagcacaattccttctcttcccctgaaagaaatcatgaagttcagcatcgg

SEQ ID NO: 5243 - DNA, 121 bp, Artificial Sequence
  Synthesized
  misc_feature (61): n=a or g
cactcttctgaagcactagtgaggctgttttagaaacacaccaggtcaaacctgccatgtntctgttttttctcgtattccatacattccggccactgtgattcttgttcaattttttttt

SEQ ID NO: 5244 - DNA, 121 bp, Artificial Sequence
  Synthesized
  misc_feature (61): n=t or c
aattggaactatataagggcagagttatggtagtttttataactatgagatccaaagtaangaggtttctccttggagacgcttattttgagctgtaaatcataagaactacaaataaatg

SEQ ID NO: 5245 - DNA, 121 bp, Artificial Sequence
  Synthesized
  misc_feature (61): n=a or g
caggttgcacacaaaacaatcctatatgctctactctcatgcacttcacatcgatgactcnataaacttgaaactagcagcagcctggagccaatatcgcccactgggcacagcaggagca

SEQ ID NO: 5246 - DNA, 121 bp, Artificial Sequence
  Synthesized
  misc_feature (61): n=t or c
gaggaaacattctccttccatcaagcagaggggaagcctagatgacagctaatactaaatnctaactttcagaaaatggatgtgccagaagaaccccatcagaagtggctgagactaatgg

SEQ ID NO: 5247 - DNA, 121 bp, Artificial Sequence
  Synthesized
  misc_feature (61): n=t or c
aggaaagctggccttgcctttgagcaggagagtgttttcaggtttattccagatgtatttngcgtgcccgtatggttgtatggattcgtggggtgtagtgctcagttccaggcctatgaca

SEQ ID NO: 5248 - DNA, 121 bp, Artificial Sequence
  Synthesized
  misc_feature (61): n=a or g
gatgatgctgggagagaacctccttcttgtcctgtgctctaaaataaatgcaggacagacntagccaaagggcttgtactgcagtggcctggctgctcttctgtctcctctacacagtctc

SEQ ID NO: 5249 - DNA, 121 bp, Artificial Sequence
  Synthesized
  misc_feature (61): n=a or c
tctcatactgcctgctgtatctgtgcacaaacacccaagctggggacaccgaagagggacngttcctagctgacaacaaagcatgcaaagtcaggggctatcacagacccatgcccagcac

SEQ ID NO: 5250 - DNA, 121 bp, Artificial Sequence
  Synthesized
  misc_feature (61): n=a or g
accagaaacatcagcttgggcacaaacgtagcagctacgtggagtgagtggatgatctgcnctcctgggttagagcacatcagagttaacataccctccgtaaaaacactgctttattccc

SEQ ID NO: 5251 - DNA, 121 bp, Artificial Sequence
  Synthesized
  misc_feature (61): n=a or g
ctgcgtggtttgaggaccatggagtgaccacctctgtttgtcctttgtatcctgcaacgtnctgctcagagctcgctgcagaaccatggcacggggtttgtcccttggcagatctggctct

SEQ ID NO: 5252 - DNA, 121 bp, Artificial Sequence
  Synthesized
  misc_feature (61): n=a or c
aacttttcttaattcatttttaaacccaccagacagtatcatctgatttatgaatgattanttcaggtctatgcaaagaggtacacgtaggtttgtaataactccagccccacaaaataag

SEQ ID NO: 5253 - DNA, 121 bp, Artificial Sequence
  Synthesized
  misc_feature (61): n=a or g
ctactatttcacataaccacacagaggtgtttgtactcccatagataactccaagcacatnagtatgtataagatcgataaaactgtaaaagatgtccttactccatcccatacatcagtc

SEQ ID NO: 5254 - DNA, 121 bp, Artificial Sequence
  Synthesized
  misc_feature (61): n=t or c
gtgggtgcttctattcacaagttaggggttgttcagttgtaagaaactgtgggcgttgtangtatgaagtcaaaacctctgttataaatctttccctgctctcttaagctgctggggaggg

SEQ ID NO: 5255 - DNA, 121 bp, Artificial Sequence
  Synthesized
  misc_feature (61): n=a or g
ggttctgttagggtgtatatgcccggaacaatagaagacttaacaacatgttaacaacagngttcactgattaccgttggtattaatggaattgcatgtagggaagcctgttgctggaacc

SEQ ID NO: 5256 - DNA, 121 bp, Artificial Sequence
  Synthesized
  misc_feature (61): n=t or g
cctggagaagctggcaggctggctccgcatctccatcatcttcatcctcagtggcatcacnggcaatctggccagtgccatcttcctgccgtaccgggcggaggtgagggcagcttgtgga

SEQ ID NO: 5257 - DNA, 121 bp, Artificial Sequence
  Synthesized
  misc_feature (61): n=t or c
tgcccgctacaggataagaaatttaactaagaaaaaactgcagggaccatagtctagatancaagagcagcacagcagcttagaaataagccacccatgggaatcaactggtatattcctc

SEQ ID NO: 5258 - DNA, 121 bp, Artificial Sequence
  Synthesized
  misc_feature (61): n=a or g
tgaaaacagtgaaagtgcagtagaccaagagtttcataggagaaggcaatttgaactgtcntaagtgaagtgcttcccttaaacccactttctagccatctatgcccagaattaccagcaa

SEQ ID NO: 5259 - DNA, 121 bp, Artificial Sequence
  Synthesized
  misc_feature (61): n=t or c
atactatagaatcactaagggttaatttgggatattgaaggtttgtattatgctttgagtnaactttgaatgtttaaaatttgcacatttttgcccttgtcattgtaataatgcttgtaaa

SEQ ID NO: 5260 - DNA, 121 bp, Artificial Sequence
  Synthesized
  misc_feature (61): n=a or g
ctactttgggtacagactcaattgcagaactgtttaaaggaaatgggaatttgaacccatngaaaggagtaaacaggactgaactctttcacatttggatcttttagttgtacccttcctc

SEQ ID NO: 5261 - DNA, 121 bp, Artificial Sequence
  Synthesized
  misc_feature (61): n=a or c
ttaattgctaccagagatggtaagaacagaacttgaagcacagagatatggcaaataagcncagaaggtacattgctctgttgaatttttggcagctttactgtcctcatcatttgttctg

SEQ ID NO: 5262 - DNA, 121 bp, Artificial Sequence
  Synthesized
  misc_feature (61): n=t or c
atgaagtcagagtggtaagaaaagggaaagctgctgaactggtggttctccactcttttantggatccagctctaataaacatacctgctaaatgttccacagttaggtttgcatgattgc

SEQ ID NO: 5263 - DNA, 121 bp, Artificial Sequence
  Synthesized
  misc_feature (61): n=a or g
cagaggagagcattctcctctcagcgtttctgctcggtgcagatgaggaaacgccgcgctncacacactgctgtgcgtaacttctgcagccctacaactaccggcagccaacgcaggaagc

SEQ ID NO: 5264 - DNA, 121 bp, Artificial Sequence
  Synthesized
  misc_feature (61): n=t or c
gctgttgataaacataagggtgcaaactgacttgttccagagagaacctgtctacagatgnaatgattcctctttaaaatatctgcggataagcctctgtgcaacagtccatttctgcctc

SEQ ID NO: 5265 - DNA, 121 bp, Artificial Sequence
  Synthesized
  misc_feature (61): n=t or c
ttatcagcatccaagagcctaaagctgggattatccaaaggattatgggagaattaggcanccaaagccaattgatttttttcaccgggatttagccaagggctgaaggctgaggtctgca

SEQ ID NO: 5266 - DNA, 121 bp, Artificial Sequence
  Synthesized
  misc_feature (61): n=a or g
ttgcatttcagcgcagtgtattttcatctatcatcatccagaggtttccctggtacagagnctactggcggagctcctcctctgtccctgtttgcctctcagctgcggtgatgtacaagga

SEQ ID NO: 5267 - DNA, 121 bp, Artificial Sequence
  Synthesized
  misc_feature (61): n=t or c
acaatgcctgggtttttctgtaggtatgcatatgatcccatgtagcccctaggagggttcntttaactaaacagttcaagccatctaggagagcgaaaacattaaaacaagaatatctctg

SEQ ID NO: 5268 - DNA, 121 bp, Artificial Sequence
  Synthesized
  misc_feature (61): n=t or g
tgaggttttaattgtgagcaataagcctgtaagccacccacgggattaaccgaagctttcnctcctcatgcttagcgaagcctaacggagcagctctgcatcctgccccaatctttgcctc

SEQ ID NO: 5269 - DNA, 121 bp, Artificial Sequence
  Synthesized
  misc_feature (61): n=a or g
tccctcaccctctggagcatctcccaagtctggagggtgttttgcttggagcaagcacgcncccagctcccacgcaagctcttccagcgtgacctcacgtgcatattgaggagcgagaaga

SEQ ID NO: 5270 - DNA, 121 bp, Artificial Sequence
  Synthesized
  misc_feature (61): n=a or t
gttactgagtgaatcaaaaaaagagatgttttcccacctacatcttgttctcttacatcangtttcaaaatcactttctgtcatgactcacttctgcacagatgagatggttgaacagtat

SEQ ID NO: 5271 - DNA, 121 bp, Artificial Sequence
  Synthesized
  misc_feature (61): n=a or g
cagcagagctcagtatccaggacatacgcacagccttcccagggtgctggcgaaggcatgncagtctcctctcttgaagctcggagctgaaaatcactgagcttgactaacgggaaaaaaa

SEQ ID NO: 5272 - DNA, 121 bp, Artificial Sequence
  Synthesized
  misc_feature (61): n=t or c
aagccggtgctgagccagctggaccaggagccagctctgagttcttcttgactcatgtctnctgttgctcagggaatgcagcttgcagacatacgtaagagcatggtttgcctctgagctg

SEQ ID NO: 5273 - DNA, 121 bp, Artificial Sequence
  Synthesized
  misc_feature (61): n=t or c
ggatgtgtaaaacagtgcaatccttcaagcagagcagtgatgtttggtcatcccttgctcnaagactggtcagggttttacaagactctgttaggtgctctatgtttttatgaatgttaaa

SEQ ID NO: 5274 - DNA, 121 bp, Artificial Sequence
  Synthesized
  misc_feature (61): n=c or g
ctgcctgcagatttcgatgtgccacggggtgagtaaaagtgacaagtgctgtgtgcatggntgagctgggtaagtgctaacactccaagccaggctgcgttgtcttcctgggacctcccac

SEQ ID NO: 5275 - DNA, 121 bp, Artificial Sequence
  Synthesized
  misc_feature (61): n=a or g
tgatggcagggatgctgcgcgaagagcgtgaactctcagaaatccccagtgctgtgcaacnttcaggttacaaactgctgtgttcaaggcttattttgtagaactaatgcagtctgagtga

SEQ ID NO: 5276 - DNA, 121 bp, Artificial Sequence
  Synthesized
  misc_feature (61): n=a or g
ctccttctccctgcttgtgcagtgacttctcccatctgtctgcattattgagagcttccancattgggttttatccagtcttcatggcatccttctttaacctctgtgcagatcacctcga

SEQ ID NO: 5277 - DNA, 121 bp, Artificial Sequence
  Synthesized
  misc_feature (61): n=t or c
gaactagggacagctacatgagccctgccagggattacaagtgccttttgttgattcgtgnacaggaagccagaactgtcagtgctgaggctgctatcagttggagagtggtctgggtgcc

SEQ ID NO: 5278 - DNA, 121 bp, Artificial Sequence
  Synthesized
  misc_feature (61): n=t or c
gttactattattgtctttccagcacaaataggagaaactgcaataaaatctagcagaatanggtttttatgctccaacctatttaaagcattcagtgctccgacatccttcactggagagg

SEQ ID NO: 5279 - DNA, 121 bp, Artificial Sequence
  Synthesized
  misc_feature (61): n=a or g
ggttgcctgtgttccccgtggtgcctatggtatgcgacattctatgctccaaagtacatcntatattgatcaataatttccacggggaaaagctttattattatctattaagctaaaaact

SEQ ID NO: 5280 - DNA, 121 bp, Artificial Sequence
  Synthesized
  misc_feature (61): n=a or t
gcttgttgagcccagcaagtctttactacctggaaggctttaaatcaacaatggagccttnctctctgagaggctttatttcaaatgcaaattaatggaggtaaatctctaaggctaacaa

SEQ ID NO: 5281 - DNA, 121 bp, Artificial Sequence
  Synthesized
  misc_feature (61): n=a or g
ggagcaatcgcctccaaatccagcactcttggaggcagttggctgcccaagcacctcaganaggagagaccgcaggggaagggacatacattccttctgtgggcagcaaacactgactcct

SEQ ID NO: 5282 - DNA, 121 bp, Artificial Sequence
  Synthesized
  misc_feature (61): n=a or g
agtagaattcagattaagaagaagcaagagaggatcgatcctcaggattggccctcgggtnttccagaagaatatttctattaatctgcagccgtcctttctggccataatgtatttcccc

SEQ ID NO: 5283 - DNA, 121 bp, Artificial Sequence
  Synthesized
  misc_feature (61): n=a or g
cactcatgtacggtcactcttcctcaggccctggcagccctctcagagggaaaaagaatcntttggtaccttgtctgttcagatcccgcgttggaatagcagccttcaggagggtgattag

SEQ ID NO: 5284 - DNA, 121 bp, Artificial Sequence
  Synthesized
  misc_feature (61): n=t or c
aatgatattcttgccctatctgacaggagacctaatgcatgctggagaccgtgcttgaccnaaccctgtgtcccagcacgctgctaacagccttgaggccttctcaggcacctgtaagggc

SEQ ID NO: 5285 - DNA, 121 bp, Artificial Sequence
  Synthesized
  misc_feature (61): n=a or g
gatactttcattcttaattgctttggatactcttgatgaccaagcctagataggaactgcnttgctctgagatgctttaaccaaaagatgctgtgcattctcctgctgctttacacaaact

SEQ ID NO: 5286 - DNA, 121 bp, Artificial Sequence
  Synthesized
  misc_feature (61): n=t or c
ctaatcgattaattagcaggggacaaagtgcaccaaccaatctgttatgccagatggatgnttcagcattaatttgtgttcttggaataactggacatagatactatgcggcctagatagc

SEQ ID NO: 5287 - DNA, 121 bp, Artificial Sequence
  Synthesized
  misc_feature (61): n=a or g
taccctccagtgcctccccagcaaggtgcagaacgaaccttgtgtcccattctgcaggtgntctcacctccaggtgctgtgtgtatgtaagggttgtcgcagacccatagaacagctcagg

SEQ ID NO: 5288 - DNA, 121 bp, Artificial Sequence
  Synthesized
  misc_feature (61): n=a or g
acatacctcttgggaactgaatagccaagaagtccctcttgtcagtctccagccagcaccngccccttctgctggttgggaagatgatgggatgcagggctggggctgaacgctgccacgc

SEQ ID NO: 5289 - DNA, 121 bp, Artificial Sequence
  Synthesized
  misc_feature (61): n=a or c
ttgcactgggaggtcaccaagcaggaaagcactcattttgcccccatcaacgaggaacctnaaaatgcacatattcaacagcagaagcaatagctcagacaccagaggagaaagacatcag

SEQ ID NO: 5290 - DNA, 121 bp, Artificial Sequence
  Synthesized
  misc_feature (61): n=t or c
catcatgaataagcaagtaggaggtggcctaagcattgaggcaccttcccattttatttcncagcacagagggatctctcttggagagatgctcttggagctcttggagcatctctcaaga

SEQ ID NO: 5291 - DNA, 121 bp, Artificial Sequence
  Synthesized
  misc_feature (61): n=t or c
gctgagcaactgaataaaattacaaatgcaggtgacatatttgcttaaacaccaaacgctncatttcttttagcctttccagcaatggtagtcacctgtaagaatctgaaagcctccagtc

SEQ ID NO: 5292 - DNA, 121 bp, Artificial Sequence
  Synthesized
  misc_feature (61): n=a or g
gcagggcagcgatgcatacacctcgtgacacatccgttttgaaaacctgagttcaacccangcttaagagacaagacagctctgttcccaatcctgatactacatcactatttaaccttga

SEQ ID NO: 5293 - DNA, 121 bp, Artificial Sequence
  Synthesized
  misc_feature (61): n=a or g
cctatttgattatgcagctatttgtagcaaataagccagtgtactgaagtacctatagatnaactttagtgtttgtctcatggaaactggctatgtaacaccatgtggctgtatttgtgta

SEQ ID NO: 5294 - DNA, 121 bp, Artificial Sequence
  Synthesized
  misc_feature (61): n=t or c
gtggtagtagctaattggattttaggccagtcttgcataggcatccgggggaagggactgnaaatgagcctagttagccaggaaattgcacatttaaatatagttctcagtaggggcagca

SEQ ID NO: 5295 - DNA, 121 bp, Artificial Sequence
  Synthesized
  misc_feature (61): n=t or c
agagatggtcagaaagctatgttggccctcactcaaaaggggagagcagtcttccatctcngcctggactattattaactatattggttacattcatggccattaacatcctttaaaagat

SEQ ID NO: 5296 - DNA, 121 bp, Artificial Sequence
  Synthesized
  misc_feature (61): n=t or c
tagtaccttgtcttcctttgctgtagctgcttagcagttattcagtcaatatattcacctncacatctaatgaaatgcaagaaaataattaatctcaatccatatcgttagctcaggtttt

SEQ ID NO: 5297 - DNA, 121 bp, Artificial Sequence
  Synthesized
  misc_feature (61): n=c or g
gcagcaatcgccagccagcacacagcctggcccaggtgctcctgcatagctaaaaaattancacccaaaccctaaatacagccacttgtcctgatagctcatagcctgcctctaaaccata

SEQ ID NO: 5298 - DNA, 121 bp, Artificial Sequence
  Synthesized
  misc_feature (61): n=a or g
tctgaaacacaaggaaaccagcacggctacagcaggatctctatggaaatgtcacctatgngccaacacacatttacccatccacgccaacttgggctcctcttcctcaacagctctgcct

SEQ ID NO: 5299 - DNA, 121 bp, Artificial Sequence
  Synthesized
  misc_feature (61): n=c or g
gttttttcattgcagcatggtttcagcctcttgaaatggcagagctagccgaggtgatttnagtcttttagctctcatccaaggataagccccaggtttctccccatggaccctcataaca

SEQ ID NO: 5300 - DNA, 121 bp, Artificial Sequence
  Synthesized
  misc_feature (61): n=a or g
tgctgctgccataacagggaggtggtgggtacaagatgtccaacccatcctcttccctcgnttgctcttacagccctgccatgaacaagcaggtgtttgggactcgtagaatcagagaaca

SEQ ID NO: 5301 - DNA, 121 bp, Artificial Sequence
  Synthesized
  misc_feature (61): n=a or g
cacctgtaccttttacagctagctttgaatctgttggctttaaaatgacaagtaagtctgngtgatggtgttcaacaagctgtatcacagtctgagcatcacctgagattatttaatccaa

SEQ ID NO: 5302 - DNA, 121 bp, Artificial Sequence
  Synthesized
  misc_feature (61): n=a or t
aagaaaatgtaaacggttactctgcagaagggaagagagaatgaagttgctgcagtagganttgcccttaaggagtctgatttataatggagttgacacaaaggaccttcttcctgctgtc

SEQ ID NO: 5303 - DNA, 121 bp, Artificial Sequence
  Synthesized
  misc_feature (61): n=a or g
gcattaccataccataaaggcatcccttgtcactgtgataacatggagctgaactgtgtgntgaaattattttctaatgagaacatctgtgctcttggtttgggcacatgatcaagtctga

SEQ ID NO: 5304 - DNA, 121 bp, Artificial Sequence
  Synthesized
  misc_feature (61): n=a or g
aatgtaaattgtttttagacacgatgaatcataaaagggtaagtgatttgcatgccttttncatacataaaatggggaaactggggagaaattgagaaaatgctgcacttcttccagtagt

SEQ ID NO: 5305 - DNA, 121 bp, Artificial Sequence
  Synthesized
  misc_feature (61): n=a or g
aatgactttttctcgttatttctatcacgagctttcagaatgtagtatatccccagagacnttatataggcacagggcaacgtccatcttcagtaaccaaatgtaaaccagagattctcaa

SEQ ID NO: 5306 - DNA, 121 bp, Artificial Sequence
  Synthesized
  misc_feature (61): n=c or g
ttctgtcccatgctctgccatttccaagcaccagtgacaaaaaaaattggtcatccactcnatctgactcttagtggctaatggaaatgatgggtttctgcctgcaagtctcacaacacag

SEQ ID NO: 5307 - DNA, 121 bp, Artificial Sequence
  Synthesized
  misc_feature (61): n=a or g
ttccagcttttgttcaaactgctttgatcacaagtttatttacagtcctaaagaaaggaancaacaagaaaaggacttacctcctccacagacacaggcaggataacacggctgaaagaga

SEQ ID NO: 5308 - DNA, 121 bp, Artificial Sequence
  Synthesized
  misc_feature (61): n=t or g
gatattgtaggtggctgaacattgttaaccatctgctgatgtaaatgaagtaaactgagtnttctgtatcgtaaagttttgaggttgaaccagcttgttactggagaggttactagttaca

SEQ ID NO: 5309 - DNA, 121 bp, Artificial Sequence
  Synthesized
  misc_feature (61): n=a or g
cctccagaggcctctggcagcccaacgagggtgctctgctcctcacgctggtgctgccgancgatggtaggaagcgcctgcctgcagggttgtcagctttgggaggaaacataaaactaaa

SEQ ID NO: 5310 - DNA, 121 bp, Artificial Sequence
  Synthesized
  misc_feature (61): n=a or g
acagcaatgagaggaaagtagctggtcagaaaggaaggatgggaaaatctgtggtaaaganctgacccagtgatccagtgctggacctgtacagctgcgatgggcaagaaaaggtaaatta

SEQ ID NO: 5311 - DNA, 121 bp, Artificial Sequence
  Synthesized
  misc_feature (61): n=t or g
ctctgggagcccttcttggctgatggcacagaggaggcaaacgaacctgtgaaaatacgcncagagcacctggcagctctgtgagctgataattgtaacgggaggtgttactcggtgacca

SEQ ID NO: 5312 - DNA, 121 bp, Artificial Sequence
  Synthesized
  misc_feature (61): n=t or c
agcccatgcctgtaaagccaggtgactgctctccctgcaggctcaatggacacgtctgtancgctgacagctcctcactgagctctgcccttctgttctgcacctttactgggccttgcac

SEQ ID NO: 5313 - DNA, 121 bp, Artificial Sequence
  Synthesized
  misc_feature (61): n=t or c
attaagtttctagtgaatgagatattggcaataatgtgccattagagaacgggatgtttgngtagacacggctcaggaaaagccatactgccatattccatgtcacttacaaggaaaatgt

SEQ ID NO: 5314 - DNA, 121 bp, Artificial Sequence
  Synthesized
  misc_feature (61): n=a or g
gaaaaatctctttggcatcgccgcacgacaggttgcctctctgcagaagcatggcattgcngcacgttcaggtggtgctccaaaagctgccttagctctggtttgtgctccttgtgtcaca

SEQ ID NO: 5315 - DNA, 121 bp, Artificial Sequence
  Synthesized
  misc_feature (61): n=t or c
aaagtgacagctccgagcatctcacttaacatagctaaagggctgcgctgcgaaatgctgngcggcatgaatggatccgctcacaagttacatcaacacagctatgatgaattgagctaaa

SEQ ID NO: 5316 - DNA, 121 bp, Artificial Sequence
  Synthesized
  misc_feature (61): n=c or g
atacatttttccacttcctgcaccagcggtttccctataaataccgaagcagccccacacnatggggcacacacacgtctgtttccagaagctctaccccacagtcacagctcgaggcagt

SEQ ID NO: 5317 - DNA, 121 bp, Artificial Sequence
  Synthesized
  misc_feature (61): n=a or g
ctgtttttccctcttgtatgaaatgccccaaacggcactctttagacagaggagcatattnggatacatcctctacagccatttacttcttggtgagagtacaggtacctgtgtgtatctc

SEQ ID NO: 5318 - DNA, 121 bp, Artificial Sequence
  Synthesized
  misc_feature (61): n=t or c
tggtttgacagagtgctcacagggtatggtgggccaccaaagaagtgaaaggagcattgtnggtatgaaaatgtattttggacacctgtaattgaatggataagaagtggacatccaccat

SEQ ID NO: 5319 - DNA, 121 bp, Artificial Sequence
  Synthesized
  misc_feature (61): n=a or g
tgcctactgccgccatttatcaacagtgcgaacgcatctgtctgccctcgtgaaccacacnattatcccacctgacaagccatccagtgctgcaggaggcctgaccaaagaggtctggagc

SEQ ID NO: 5320 - DNA, 121 bp, Artificial Sequence
  Synthesized
  misc_feature (61): n=t or c
ttctgagaggaggtcaggtgtccttaaatatcagaggcgtgtacagtggttttattgcaangcttatatatcattctgtatttctctgttttgaatagttactgtgtgaagactttcacgg

SEQ ID NO: 5321 - DNA, 121 bp, Artificial Sequence
  Synthesized
  misc_feature (61): n=a or g
cttattaatactgaagatggcctagaaaatgtcatgtctttttaccatgatatttacacanaaaagagcactgagcacatgcaagctcccagcaggatggtgcagtggggccggggcacag

SEQ ID NO: 5322 - DNA, 121 bp, Artificial Sequence
  Synthesized
  misc_feature (61): n=a or g
cttcttcccaaccctaaatttctatcagaactacccatagcaatattctggccacaggcanctgcagtaaaattgatcaggatgttgacacataaagatacaagcaaacgaacataataaa

SEQ ID NO: 5323 - DNA, 121 bp, Artificial Sequence
  Synthesized
  misc_feature (61): n=t or c
agaatgaaacctcaatcaagagtttttcatcaacgtcttcctgtatggacaggatgacaangctgaaatcaagtcattgttcctcctgcctcacctaaacaccagtgtggggacaatcaca

SEQ ID NO: 5324 - DNA, 121 bp, Artificial Sequence
  Synthesized
  misc_feature (61): n=a or g
atttatgtagaaagctgctgaagcagatcacatgcctttctgcccacagaacggaaagagnaccagaaagcagatatttttttcagctcagtcttgcaaagaaagtctgtttaccagccaa

SEQ ID NO: 5325 - DNA, 121 bp, Artificial Sequence
  Synthesized
  misc_feature (61): n=a or g
aaagcctatccttcctcctttataattatttctttgtcctttaaaagaaatcattgcaccnatgacaaataaataagtaatgataataatacaaggcagggatggatgtagacagaatccc

SEQ ID NO: 5326 - DNA, 121 bp, Artificial Sequence
  Synthesized
  misc_feature (61): n=a or c
gaggtgtcttttgactagaataaccccgtgtttgagttcccacccatcatttcatgtctgngccttgttcaacctgctctaaatccagacaagggctgcgggtaccagctgagccaagtct

SEQ ID NO: 5327 - DNA, 121 bp, Artificial Sequence
  Synthesized
  misc_feature (61): n=a or g
tgtggttgggtgaacacaacactgaatctatgtgaatatctactgccctgaacaaggttcntcagatgagtcagttctgctgtagcatggcagtttgcagcagagaaaggacctgtttcac

SEQ ID NO: 5328 - DNA, 121 bp, Artificial Sequence
  Synthesized
  misc_feature (61): n=a or t
actatttctgagaagaaatatttctgaatagcaaactggaacctcctctgggattcattcngccttattctactgccatgggaaactgctctgcagtagcttttaggtatttatggcagct

SEQ ID NO: 5329 - DNA, 121 bp, Artificial Sequence
  Synthesized
  misc_feature (61): n=c or g
tgagaagtaaaacttggataaaatgtacccagtttaacaaatgaaactggttggacaaaantgtgctttaaaaacagtttgttcagatgagaatgtcatccaccgtcaggatgggcactga

SEQ ID NO: 5330 - DNA, 121 bp, Artificial Sequence
  Synthesized
  misc_feature (61): n=a or g
gaaacagttgagttcacagaagttgcaaaattgatttttttccagtctctgttagcattangaaccacaatactcgcaattgagaaactgttattcattatttagatgtggcactgaggga

SEQ ID NO: 5331 - DNA, 121 bp, Artificial Sequence
  Synthesized
  misc_feature (61): n=t or c
aaacttactttaaaaaacactttaataaaatgtcctgtctgagattgaactcttaaacagntgagggcctaacctaaacacagtactgcatgcattaataaatacaagttcattaacacat

SEQ ID NO: 5332 - DNA, 121 bp, Artificial Sequence
  Synthesized
  misc_feature (61): n=c or g
aattgcttggctgggtgaactgtctgagccattgtacagggaggtgtatttgcaagatganagaactctacgttgctgttctattaacctcctgtctgcttccttacttctaaaacgatcc

SEQ ID NO: 5333 - DNA, 121 bp, Artificial Sequence
  Synthesized
  misc_feature (61): n=t or c
atctcatagttataacattctctctgccttgacaacattacagcaagaaaatcctgattcnttaaaccctcctcatgcataacctcagagcctgaaaatattttctttccacttttttctt

SEQ ID NO: 5334 - DNA, 121 bp, Artificial Sequence
  Synthesized
  misc_feature (61): n=t or g
cctcagtagcacataacagtctctctcctatcccaacatctacttttgcaaagctattcanaatataatctctttaagatctccacccactgtcaaatttgttgaaaatggcccaagagtt

SEQ ID NO: 5335 - DNA, 121 bp, Artificial Sequence
  Synthesized
  misc_feature (61): n=c or g
gctgttaacttcttttagcactccatcaatgtaagcatgtgtacttctgactcttgaactntttgtagaaggatgcactctaagtgctagagctcttctctagggttctcctacctcaatc

SEQ ID NO: 5336 - DNA, 121 bp, Artificial Sequence
  Synthesized
  misc_feature (61): n=a or g
tatgaaaagttcttacaactacaaaagccttaataatacaacattcagctgaagcacagcnacactgacatgaaaggattttcatttctaagaaatacttgaataaattagagtttgaagg

SEQ ID NO: 5337 - DNA, 121 bp, Artificial Sequence
  Synthesized
  misc_feature (61): n=t or c
ccaacatcagtctttacagctgcagaactggaaaaaaaacatctcaaaatgaagtgcctanagaggagatttaggactgaattaatagattaaagagccccagatttctacagctagacaa

SEQ ID NO: 5338 - DNA, 121 bp, Artificial Sequence
  Synthesized
  misc_feature (61): n=c or g
tgaagtttttaagtccggtagaaatgaaactgctaaacaacagcaagaattgcagcagaanatctttggctgtgctgctttgtgagaggtaggttatgttttgaggtctgtagcagtctgg

SEQ ID NO: 5339 - DNA, 121 bp, Artificial Sequence
  Synthesized
  misc_feature (61): n=t or c
tacaggagtccagtgttaggctctacacactgagacttattttgtgaaatactgtgactangtttctggcaaaatactcaacttgcagtagtgggacatctgccatttgttggctgtatcc

SEQ ID NO: 5340 - DNA, 121 bp, Artificial Sequence
  Synthesized
  misc_feature (61): n=a or g
aacttttgtaagattgttgtagtaggaactagactgaagattgaatagctctgataagtantaattctataaattcttccttatttctgagagctgtaacttggttccattcaaagctaac

SEQ ID NO: 5341 - DNA, 121 bp, Artificial Sequence
  Synthesized
  misc_feature (61): n=t or c
tggtgtgccaaacatcatatcctacctcatggcaatttgtttttgtgatatttgtgtgggngttctgacttttaggtcattcttgaaatattttctgagatatacaagaagctatctggag

SEQ ID NO: 5342 - DNA, 121 bp, Artificial Sequence
  Synthesized
  misc_feature (61): n=a or c
actactgaatctacttgcagtgaaaaaaatctgtgtctattaacatcagatgagtcacagnagtgacctctctgtgagttaatgtgattcgttacattaaattttaaaaattgtcagaaaa

SEQ ID NO: 5343 - DNA, 121 bp, Artificial Sequence
  Synthesized
  misc_feature (61): n=a or g
tatactcccggactgaacaagtcagctttagcaaaaagcttaacaaagaaatactgagatngaaaaaaagcatctcttgtgatcttctcatgcacttcagaatcacagaatagctatgttt

SEQ ID NO: 5344 - DNA, 121 bp, Artificial Sequence
  Synthesized
  misc_feature (61): n=t or g
agtggctgctgcactaagttaatgcaaagacgggcagttggtagacaatacagagagaganagacttgtcactgcctgtttctgaacctgattcctttcacagccttctgggaggattctc

SEQ ID NO: 5345 - DNA, 121 bp, Artificial Sequence
  Synthesized
  misc_feature (61): n=a or g
gaaataatttgtgttgtgctggaattcaaggcagatgatgatgattacaaattacctcacnccagaaaggctgatttttcagtgaaggaaaagagcgttgttcacatttttttggagacat

SEQ ID NO: 5346 - DNA, 121 bp, Artificial Sequence
  Synthesized
  misc_feature (61): n=t or c
tacacagcagtttaaaatacaacacaaaatgcatcttgacttgcacttcattattataaangattgctaagcagaaaccatctgtatcttccactgttaatgtctgcatcatgctgcagtt

SEQ ID NO: 5347 - DNA, 121 bp, Artificial Sequence
  Synthesized
  misc_feature (61): n=a or g
catgctgcaatgaggctttcagcaggacagcaagtatcacaagtctcctgataacatcatnggagcttacaacaccagtgcttgaaggagctctgcagattcagcctttttctggaaataa

SEQ ID NO: 5348 - DNA, 121 bp, Artificial Sequence
  Synthesized
  misc_feature (61): n=t or c
gcatttgtaggtcttacacaaaaacgtaaagtttggtttattataggaattaaaaaggtanagaaagatactgaatcttcatgttcacaccttctgtttaacatgcatcttctttgatttc

SEQ ID NO: 5349 - DNA, 121 bp, Artificial Sequence
  Synthesized
  misc_feature (61): n=a or g
gatcctgtttgcacagagacctgccctttctgtattccagaatgttcatgttgcattgtangactgcttgattttagtttcctgtttcagtaaaagattcaattacatacagctctccatt

SEQ ID NO: 5350 - DNA, 121 bp, Artificial Sequence
  Synthesized
  misc_feature (61): n=a or g
agaagtcaccctttcctccacataaacaaatcaggcctactccctcccgttttcactttcnttcctcgagataaggaatgcggagttctgcttagtacataacacattggacatgaaaata

SEQ ID NO: 5351 - DNA, 121 bp, Artificial Sequence
  Synthesized
  misc_feature (61): n=t or c
aaaaaaagaataaagtcaattctttctatggcagacgtacacatcagatcttcatttgtgntgaatgccaccaaatgcagatgggagctccgcactggagcagcagcagtccctcactgat

SEQ ID NO: 5352 - DNA, 121 bp, Artificial Sequence
  Synthesized
  misc_feature (61): n=t or c
cttctgagtacaaagtgatgtctgaacactaaagctttacttacatagaataaaatcttgntacttccttgctctacacctattaatcctttgctctctttcgatgacatcagtgtatcat

SEQ ID NO: 5353 - DNA, 121 bp, Artificial Sequence
  Synthesized
  misc_feature (61): n=t or c
acaattaataaagctctaaatcctattagaaatgtaagatatcatagctgacctaaacagngataaactttcctgtgattcccataacttgcgcattccttccccatggttcagcaaagct

SEQ ID NO: 5354 - DNA, 121 bp, Artificial Sequence
  Synthesized
  misc_feature (61): n=t or c
ataccctaagacacaaatgcaaagtacaagagggtcccacctatgatatgctaaaagcacnctcctgtccttggatacccagtcctgttattctggctcacccaaacttatggcaaaggga

SEQ ID NO: 5355 - DNA, 121 bp, Artificial Sequence
  Synthesized
  misc_feature (61): n=t or c
aaagccccaagatttctgccattacttcacctccaaagtactacatattttttcccattcncccctccctcttctcactcaaaaaaaggctcgactcctacccacaagtcattttaagggt

SEQ ID NO: 5356 - DNA, 121 bp, Artificial Sequence
  Synthesized
  misc_feature (61): n=c or g
acttatatatgactcctagttttccatttccaaaaagttctgctttttttcagtcctttanttgctatagtttcttgcagaacttttttattctgcagctgtagcaaacaaaacaaaacaa

SEQ ID NO: 5357 - DNA, 121 bp, Artificial Sequence
  Synthesized
  misc_feature (61): n=a or g
gaagagacacagagctggaccaaacgagggggatgaggatgctctgcatttttcagtttcnatgctctatgactgaaaaatcctatctgaaccgcaacgtcagagcagctaataaattatt

SEQ ID NO: 5358 - DNA, 121 bp, Artificial Sequence
  Synthesized
  misc_feature (61): n=t or g
ccccattcaggatccaccacgtaggaacctctactgggtgagctcacacacatctagcagncaatgtgcctgcaagctctgttcttttccctggtaaacacggcagcgttttgggttttgg

SEQ ID NO: 5359 - DNA, 121 bp, Artificial Sequence
  Synthesized
  misc_feature (61): n=c or g
agctatttaagttataggacagacatcattcagtcattttccagaactacctaaccactangcactaaagctcaataagtgactccttccttatgttcccaggaaaggttccctgtggatt

SEQ ID NO: 5360 - DNA, 121 bp, Artificial Sequence
  Synthesized
  misc_feature (61): n=t or c
ctaaggccatgaatatgctgagagaactgctgcatttgggtgcagtgatacatcgtaaaanctcctctgaaacatgctctcatgtccctgaggcagatgtgttccctggcctggcaataac

SEQ ID NO: 5361 - DNA, 121 bp, Artificial Sequence
  Synthesized
  misc_feature (61): n=a or g
aatgcatggaataaaatggaagtctgtgacccatttccaggagtgacttggatatcatttntattatagaaatatgagctatgctcagggtgtaggatttttgatttgcatcgttaagcaa

SEQ ID NO: 5362 - DNA, 121 bp, Artificial Sequence
  Synthesized
  misc_feature (61): n=c or g
acctttaatttagatgaacagctgtatctttaacttagccctcactgtgtgcatcattatngtactaccgttaatttcatagtcatatattgtcctctgtcccagtgtagcttatttataa

SEQ ID NO: 5363 - DNA, 121 bp, Artificial Sequence
  Synthesized
  misc_feature (61): n=t or c
acccagatcagaataattgtctctcagtgcagagcatgctaaggaatgaggtgaacattancattcagccaaagggctcttttgttcccataatcttatttcttccataccaaaggtttat

SEQ ID NO: 5364 - DNA, 121 bp, Artificial Sequence
  Synthesized
  misc_feature (61): n=c or g
gcacatacatctcaaagacagaattattctttttctcataatattctaaatttttaatggnagaaattacaccaggaagaatactttcattgctcagtatgtacaattaccatattatata

SEQ ID NO: 5365 - DNA, 121 bp, Artificial Sequence
  Synthesized
  misc_feature (61): n=t or c
tgggttacaagcgcatgctctcttgctatgacagtgtaataggggaaatgaatatgtctcnagtcttcattccctccaattttcagatctgaaacttaagcgtagagctaactaccattat

SEQ ID NO: 5366 - DNA, 121 bp, Artificial Sequence
  Synthesized
  misc_feature (61): n=t or c
ggtaaatttgactcacacaatgagtgttttcaaactttaccttgtgcctgtggtaaggacngcagtggtaatggtgtcactgtggtgtcacagttgggttggagtgatttctgttttaatg

SEQ ID NO: 5367 - DNA, 121 bp, Artificial Sequence
  Synthesized
  misc_feature (61): n=t or c
gagaaaatacccaaatcagtgcaggcgtagctaagagcagctttctccttattgtcctaancaccccccaaattacactggttaattggtattacacgcaagtctaaaatgggcatcttcc

SEQ ID NO: 5368 - DNA, 121 bp, Artificial Sequence
  Synthesized
  misc_feature (61): n=t or c
aaaactcattaaaaatcatatgttcccttgagatcgctctcaacaaacgcctgtgcaaacngccagacatgagaggagcaagtagatgctgtttatgagccttaccttactactttttatg

SEQ ID NO: 5369 - DNA, 121 bp, Artificial Sequence
  Synthesized
  misc_feature (61): n=t or c
actggtagccatttggggatgataccatgatcaaaacgcaggcaggaacagaagatttcanggcacttctgcagggaatgtagaaaaaagcacgtgcaacctcaggatcctgagcattcag

SEQ ID NO: 5370 - DNA, 121 bp, Artificial Sequence
  Synthesized
  misc_feature (61): n=a or g
agcccatgaccaggcattctccagtcttctcccttctacataaacaaagtattctctcagngctccagagcataactcgtttcttagcaggatttctggtcatggatctggtttcaagagc

SEQ ID NO: 5371 - DNA, 121 bp, Artificial Sequence
  Synthesized
  misc_feature (61): n=t or c
ttctgcgaagatactgcacctatgcattttctcagtttacaatctgtgctgcagccagcancacccatcttccaaaagaaaacaagcattctgcttctgtaaacaccaaattcttgactta

SEQ ID NO: 5372 - DNA, 121 bp, Artificial Sequence
  Synthesized
  misc_feature (61): n=a or g
tcaagcttcttatgatctctcccactgctcttttgcatatctaggtatttcagagtactanctactgactgttaactgtagagtaggttcttttaataactctaccatagcatattttttg

SEQ ID NO: 5373 - DNA, 121 bp, Artificial Sequence
  Synthesized
  misc_feature (61): n=c or g
tttatactgttcccgaagcacaggacaccttacctaatctgcaaggcctcaaacttagatnttctatctttttagcaaagtgatcaactatggaaattccgtgtattcatctcttttcatt

SEQ ID NO: 5374 - DNA, 121 bp, Artificial Sequence
  Synthesized
  misc_feature (61): n=a or t
atacagacacctaaacacacacacacacacacacacacacagagaaaatagttattctcanttcaacccatcatcattaaaattaagcccattcttctactactcaagaatctcatttaaa

SEQ ID NO: 5375 - DNA, 121 bp, Artificial Sequence
  Synthesized
  misc_feature (61): n=t or c
attgaaatggcctgctttcttctttctttctttttttttaagatatttgaggcagcaaggngctatttttcgatatacacagaccttgaagtaaactggactttggtgtctacatactttc

SEQ ID NO: 5376 - DNA, 121 bp, Artificial Sequence
  Synthesized
  misc_feature (61): n=a or g
gtatgaagggcttccctgatgcttggctctctgaaaacgagtcccaactgagacaactgcngctaatgtagtatataaatgttaaaggagggatgggaaaaaaaaaaaagaagtgtccatg

SEQ ID NO: 5377 - DNA, 121 bp, Artificial Sequence
  Synthesized
  misc_feature (61): n=a or c
aatgaaaaagccagcaactaaaacacaagtagtaacaggacttaagataggaaagaaatcntcaaatgatgaaaagtcatgacagtaaatgtatgcttacaaacacttgtacataagaggc

SEQ ID NO: 5378 - DNA, 121 bp, Artificial Sequence
  Synthesized
  misc_feature (61): n=a or g
ttaaaaatgaattattttgttccatacatttcattgtgaaaaggtgaaaaaactaaatgantttcagaagtgaagagctggaggaggaatgtgaaaaaaagtactgtgaatggttacctga

SEQ ID NO: 5379 - DNA, 121 bp, Artificial Sequence
  Synthesized
  misc_feature (61): n=t or c
atctcaggacttgccactcccagtagatgctgagggaggagcctggaagctcaaaggaganctcgggtggatgaaacacttcttgttttacctgtagtctgaacgtgaatctcccactgtg

SEQ ID NO: 5380 - DNA, 121 bp, Artificial Sequence
  Synthesized
  misc_feature (61): n=t or c
ttttcctctccctgcaccaggctggcagggaggagaagcctgacaggcaggtgcagctgcngagctgctgactggaaatgtcgtcactgagaaggaggcacgcgagcagtagctggcctct

SEQ ID NO: 5381 - DNA, 121 bp, Artificial Sequence
  Synthesized
  misc_feature (61): n=a or g
tctgaggcttctcaatttgtttcccgttctgacatgagcactgggtccttggtaccaccantttctgcttctgctgcactaccttacacatacttaagccttagtgttcaaaatcagtgga

SEQ ID NO: 5382 - DNA, 121 bp, Artificial Sequence
  Synthesized
  misc_feature (61): n=a or g
acagtactaatcaagtgataaaggcagaaaagagtaccagtatctactggtcaagtttacnaaggctaaacattactttccagtagagagtacaataagaaggaaaagactactgtccaat

SEQ ID NO: 5383 - DNA, 121 bp, Artificial Sequence
  Synthesized
  misc_feature (61): n=c or g
cataaagcaccgctttacattgcacattactgctgggtatttatgacagtttgctgaaatnagttaacacaggaaaaattaacacttgcaatgcaaggaaatgccactgttatgtaaaaaa

SEQ ID NO: 5384 - DNA, 121 bp, Artificial Sequence
  Synthesized
  misc_feature (61): n=c or g
gtttggatcagatccctatcactttgacttcaatgagcaactctagctagatgccctcatntccttttgctgtgtaaagcaacgtaatattccagtaattttaaatgctccttctctctgc

SEQ ID NO: 5385 - DNA, 121 bp, Artificial Sequence
  Synthesized
  misc_feature (61): n=t or c
ccttgtacacggctgagatgctgtcaactgcagtctggaaaaaccacctgcaaaatgtgangcttaaatgtatgttggcacatatttggcagaagagttggcaccggaaggcacagctgtt

SEQ ID NO: 5386 - DNA, 121 bp, Artificial Sequence
  Synthesized
  misc_feature (61): n=t or c
cttattaacttttggaacacagtggcttcttccacagcaagtttaatgtcacttcaaaagntgtggtgccagctgaagcaagtagtcacttctttggaatttaggcagagtttgagaacca

SEQ ID NO: 5387 - DNA, 121 bp, Artificial Sequence
  Synthesized
  misc_feature (61): n=t or g
ggacttaacgttttactgggtcatcttgtctcctgttttctttttccgtatttctccatcncttcttagttaaatgtgtcatctcttcaaaatgctctgtgtagtagtgattgaaaacata

SEQ ID NO: 5388 - DNA, 121 bp, Artificial Sequence
  Synthesized
  misc_feature (61): n=a or g
tgcagtgttctcaccggtgagtttagcagctgggaaaccagatagctgcagtgtattaatnggctttctctcctgattttggttaagtcctttcatcctgattcttccttccgtgggtaac

SEQ ID NO: 5389 - DNA, 121 bp, Artificial Sequence
  Synthesized
  misc_feature (61): n=c or g
ttttacctgagtctaaacctgaacccacttggccaaatgtgtttagtctaaaccccttttncctgtaataatccaactccttatcccagatatattcttgtctacagagttcatcttacca

SEQ ID NO: 5390 - DNA, 121 bp, Artificial Sequence
  Synthesized
  misc_feature (61): n=a or g
accttctccaagaccatgaaacaaccattttcagcagttgacaactaatgtcatcatcacnaagtccaaagtccttttcttactcttgctaactaaaatatcaaaatgcatttgaagcaat

SEQ ID NO: 5391 - DNA, 121 bp, Artificial Sequence
  Synthesized
  misc_feature (61): n=c or g
attagcaacagcctccctagcttaaatggatgtctgtcaaaaggcagttggacaataaagncaattcaccagttggatgtagtgagcaacatacacaaaaactattatgcttatgatttga

SEQ ID NO: 5392 - DNA, 121 bp, Artificial Sequence
  Synthesized
  misc_feature (61): n=t or c
ctttagggactctgatttgtgtatcacatgtcaaatcccctgtatgccattcctgttctgnagctaagggttttgtgtgctgtctctttaaccagaccagtttactgcaagaactggcaga

SEQ ID NO: 5393 - DNA, 121 bp, Artificial Sequence
  Synthesized
  misc_feature (61): n=a or g
gaacagggagttttctttaactcagtagcagcaaggagcttcttttactccactccccacnacagctacgtgtatcatattcgataacacactaggaattggttaagtatatgttacatat

SEQ ID NO: 5394 - DNA, 121 bp, Artificial Sequence
  Synthesized
  misc_feature (61): n=a or g
cttgtacttaaccactgctcccagaagggcttttctctgacttgtgcactcgtgctggacntgcaaagcagtattttacctagacagagcaacagcttaccatgaaaggttggagaataga

SEQ ID NO: 5395 - DNA, 121 bp, Artificial Sequence
  Synthesized
  misc_feature (61): n=t or c
ggcagacttggttgctgttagagaacacaaaacctcctacccttatctgggtgcagtcacngttgtttagtacaaccactgtttctgtataatgttttaaagtacctttcataaatcttta

SEQ ID NO: 5396 - DNA, 121 bp, Artificial Sequence
  Synthesized
  misc_feature (61): n=t or c
taaagtttcccttcaatgctgaaagaaaagaaacaacttggctccttctaattctaagccntatagcacccctaagatatttggaaaaatcccatcctgatacagtctgtcttatttagaa

SEQ ID NO: 5397 - DNA, 121 bp, Artificial Sequence
  Synthesized
  misc_feature (61): n=a or g
cagagaatatttcaggttcatgctgccttttacattgggcccaagtacatacaggtctgcnatatattcagttcaactggaatataaccaagggacctcttctagaatatcctctgctaga

SEQ ID NO: 5398 - DNA, 121 bp, Artificial Sequence
  Synthesized
  misc_feature (61): n=t or c
agatatcaaagctgattatttgtagacaagaggcagaactgcagtgtgacccgaaatccanttggggaaagaaatacagtgggtaggcatcattcagggtcccttagtgtgaagtttgaag

SEQ ID NO: 5399 - DNA, 121 bp, Artificial Sequence
  Synthesized
  misc_feature (61): n=t or c
gttgttgttgttgttgttttgaatggttatgaatgctatgttgagtgtttaatcaatatanggctgtgcaaaccagcagttggtaatataaggaaacaacaccactgtgtccaagaggatg

SEQ ID NO: 5400 - DNA, 121 bp, Artificial Sequence
  Synthesized
  misc_feature (61): n=a or g
ttggttttcattttgatccacaggctattaaacatgatctatgacactttcagaagagctntagtttggagttcagcctgtaactcaaactttttttccatccaacattggttattaatgt

SEQ ID NO: 5401 - DNA, 121 bp, Artificial Sequence
  Synthesized
  misc_feature (61): n=a or g
cagctacttgcaggctgaacagcttgggtttagtgtaactaaagaccatgcagatgctggngtagggcctggctcccaaaacatgaagagttttctcagttgggatcaccatcattactag

SEQ ID NO: 5402 - DNA, 121 bp, Artificial Sequence
  Synthesized
  misc_feature (61): n=t or c
tactgtcactccattgacacaagacgctgctttcaaaagctgatcctatctttctatttanccaccgctacgcgagaatttaagtgatagaactttcaagtcaatcttaagaaataatttt

SEQ ID NO: 5403 - DNA, 121 bp, Artificial Sequence
  Synthesized
  misc_feature (61): n=c or g
cgtactaaagatggaagtcacagacttaatgctatgaatcagaaattgatcagaattactntaaagtgtataaaaatatataagaggaatggattacttcgtataaaaaatttaaacataa

SEQ ID NO: 5404 - DNA, 121 bp, Artificial Sequence
  Synthesized
  misc_feature (61): n=a or g
tgcataatttggagggaagtatatgaagaatcacgcacatctctctacaggacatcccctnttaggtgttttaattgcttctgtgaatagattcaaatttctggtatgatttgatgggtca

SEQ ID NO: 5405 - DNA, 121 bp, Artificial Sequence
  Synthesized
  misc_feature (61): n=a or g
ggaattccaaggaatcttttctttccttggtttaaataaaagccgtattttttggaagacnatgtgattagactgcttcaaagccatggggggatggagggaaatcagggaaggagaagtt

SEQ ID NO: 5406 - DNA, 121 bp, Artificial Sequence
  Synthesized
  misc_feature (61): n=a or t
tatcaaggttggagcctgaagttttctttcttaattggtctgtcattgcaaccttctccanatacttcaactgtttaattgaacagtgctatgcgtagtatgaaatggatacggaagatca

SEQ ID NO: 5407 - DNA, 121 bp, Artificial Sequence
  Synthesized
  misc_feature (61): n=a or g
agcagacgagcacagtgaagcatatgcaagtaatgccatggaaacctcaatttccttgganaaaataagcctcagcaggctgagaaagtacactgtacacaataactgcattaccattagc

SEQ ID NO: 5408 - DNA, 121 bp, Artificial Sequence
  Synthesized
  misc_feature (61): n=t or g
atttagacatacgtagaagcaaggctcccttacttgggaagaatttttctccaaaattaanggaaagcagatttttctaagcacgagcagttaattctgtaagaaccagtttcaagcccta

SEQ ID NO: 5409 - DNA, 121 bp, Artificial Sequence
  Synthesized
  misc_feature (61): n=a or g
ccttagaggacagcaaattgcacgcgtcactgacttgtcagccacatttctcaatgacacngtgccagatttatgttgaaagcctgtagatgaagttaagtgaaagctaggggttacaact

SEQ ID NO: 5410 - DNA, 121 bp, Artificial Sequence
  Synthesized
  misc_feature (61): n=a or g
aacaaagatctacgacctacaaccaactttggaagtctggctatagactgagaaaaggcanctgcttctctatccaaagattcccaaagagactctgaaagaaaaataggacagaccagaa

SEQ ID NO: 5411 - DNA, 121 bp, Artificial Sequence
  Synthesized
  misc_feature (61): n=a or g
ttggaacctcgcattaactgttgcactttccctccgtgctttacaggtactgtgtctgacnagatcacaacagttatttagcccttgctatgtccttgttgagggctgcagacatggcaga

SEQ ID NO: 5412 - DNA, 121 bp, Artificial Sequence
  Synthesized
  misc_feature (61): n=a or g
gtcttcttcacactcccctgtaacaattcaggggcgaactgcaatgagcaattcagtggtntctcgtgcttacaaacagaatgttctctctctgttgttttgtagtatctctgtgtcactg

SEQ ID NO: 5413 - DNA, 121 bp, Artificial Sequence
  Synthesized
  misc_feature (61): n=c or g
aaagagtgtgaatttgttatgtattcaacactctttcatcagtttattaactcacaattgncaaaagaaacacaaagatgtagggataaatcttcctgtccacattcacaaaaatactagc

SEQ ID NO: 5414 - DNA, 121 bp, Artificial Sequence
  Synthesized
  misc_feature (61): n=a or g
agtaaagtacaataagaggtggtcaaacatggctttctctaaagcaaaacaggtatttacnaacttatctgctggattgcttgcaggaagcagtctagcatttagtatcctgggcagctaa

SEQ ID NO: 5415 - DNA, 121 bp, Artificial Sequence
  Synthesized
  misc_feature (61): n=t or c
agtgtcaggacttgattgatgccagaaacttggatccttctaagattacattcatgttagngttaagttctcaggctttttgaagggtaggaagcgtctccctataaaacctatgtgggag

SEQ ID NO: 5416 - DNA, 121 bp, Artificial Sequence
  Synthesized
  misc_feature (61): n=t or c
aggccctaatactacacaattggaatgcaggttctgcttgctcttttccatctatggatancttaagctgaaccttactatgtcttttgccttctgtgctgtttttctgccacctttggtc

SEQ ID NO: 5417 - DNA, 121 bp, Artificial Sequence
  Synthesized
  misc_feature (61): n=t or c
aaccctgctgctcacttctgctttgtctgcccaggtcaggaagaagtctcagaaatgatancagattttaggtggttttccctgcctgcaatgaagctgctactctgtttctgagctactg

SEQ ID NO: 5418 - DNA, 121 bp, Artificial Sequence
  Synthesized
  misc_feature (61): n=t or g
tgctgtcaacagacacttgcaagtaaaattacagggaggtggatgcaaatttgacctccgnccttcttcagaacctcagaatcaacaagaacaacaaattaaaaggcatagcaatggccag

SEQ ID NO: 5419 - DNA, 121 bp, Artificial Sequence
  Synthesized
  misc_feature (61): n=a or g
cccctgacagaggaaaactgctggtagcctgatctcaacctgctgccacatatgtgtagcncccatcagtaacccactcgtgtttctgctgagtaggttggtttgtaaaggacgtgtttgt

SEQ ID NO: 5420 - DNA, 121 bp, Artificial Sequence
  Synthesized
  misc_feature (61): n=a or c
gtatggtgttctagaaataattttataaataatcgattcttccagtaagggattgacctgngagccattttttcatgagtctattcatgaaacattctcctatgtgtgaactccaaagcaa

SEQ ID NO: 5421 - DNA, 121 bp, Artificial Sequence
  Synthesized
  misc_feature (61): n=t or c
tcactgttttgaccctttgcaagtgttttatcacatcttttgaaacctttcagaaggggcngcgtgctcagaaaatggtttgaaatgtgtggtttattttccccaaacgtttttacctacc

SEQ ID NO: 5422 - DNA, 121 bp, Artificial Sequence
  Synthesized
  misc_feature (61): n=a or g
ttgggtaactgtcaggttggatatgatgattaggagagtaaaatggggaagctaaaaacanggacagaggagaaaggtattttgttctacagcaggcacctcttgtctctagatgttcata

SEQ ID NO: 5423 - DNA, 121 bp, Artificial Sequence
  Synthesized
  misc_feature (61): n=a or g
tgtttccatttccattttacccgaaaaacagacaacttcattactgtggtgctgagtgcantctcagataaccatcctttggtagaacttaaaaactgtggctcagcatcagctgtaaagt

SEQ ID NO: 5424 - DNA, 121 bp, Artificial Sequence
  Synthesized
  misc_feature (61): n=a or g
gctgagattcaataaggtcttgcttctttgcaacaaaagttatatccttagaaatacaacngaggtgtatcattatatggattatccagcaagtgcaatgagatagacagtgccattcaca

SEQ ID NO: 5425 - DNA, 121 bp, Artificial Sequence
  Synthesized
  misc_feature (61): n=t or c
tcagttgcttttcatgaagcatacagaggcaaaataacacaaacagtttctgccatacttntgaagtcttggatttgtccttggtcaaaaacaggtttgttttccatgttagaacttttta

SEQ ID NO: 5426 - DNA, 121 bp, Artificial Sequence
  Synthesized
  misc_feature (61): n=a or g
ttctccagttaatgtttttcaccttactttctgcaggacctttacatacatccattttgcnaagtggctttgtccaaaggagatgctcatgttagcaataacacttttctttttaagaaag

SEQ ID NO: 5427 - DNA, 121 bp, Artificial Sequence
  Synthesized
  misc_feature (61): n=a or t
ttacatttatttgcgtttacaagtaagtttccacaaaggaaaacatctggaaacttatttngttgttgtttaatatgaaaagtgagttaaaatggaagaaatataatatattacataacat

SEQ ID NO: 5428 - DNA, 121 bp, Artificial Sequence
  Synthesized
  misc_feature (61): n=a or g
gaaacagcacagtttttaaggctatgaaagatagacttttagcaccgggtactaagttacntaactctgctgtctgtgcaaaacacacagcagatatgaccattagatatgcctatacaca

SEQ ID NO: 5429 - DNA, 121 bp, Artificial Sequence
  Synthesized
  misc_feature (61): n=a or g
gcaaaagagtgaagaaattttatttcttactgatttatattttctcaccaacctgtttcanaggggtgttgatattcctccctataattcactagaaggaaaatcatctgttcaggcaatt

SEQ ID NO: 5430 - DNA, 121 bp, Artificial Sequence
  Synthesized
  misc_feature (61): n=t or c
acatttatgtttgtgaagtggcttttaggttgttgctctttcttgctgagagtggacaagngtgagtggctggctgggtatatattaaatgctcactgtctttattttctccattttttaa

SEQ ID NO: 5431 - DNA, 121 bp, Artificial Sequence
  Synthesized
  misc_feature (61): n=a or g
gtccacacaatcccttgtctgccctacagagccagctgtgttcatgggaagtgattccagncacagaagttctttgtctcccttcttgcaaatggtgtcccaaattcgtaagaaaatctgc

SEQ ID NO: 5432 - DNA, 121 bp, Artificial Sequence
  Synthesized
  misc_feature (61): n=t or c
tcccgtactagagggaaagtatctagtccctgaagatgcatggtacacagatgggtccagnaaaagccacccaagcaagtggtgagccatcgcatgccatccctctacgaaaacaatgtgg

SEQ ID NO: 5433 - DNA, 121 bp, Artificial Sequence
  Synthesized
  misc_feature (61): n=a or g
atgaaggggttattttttgtttatttgttttacatctcatcaaatattatctctctgcatntatgtgatgtattcagaacactagttattgttcttctcataaatgggctttgtatccaac

SEQ ID NO: 5434 - DNA, 121 bp, Artificial Sequence
  Synthesized
  misc_feature (61): n=a or g
ctgggtgctttgtaagactgttgtattttttttccatgaacatgtgagtgttttacaaagntgatggtccaagaaggaaaacaaggactgcatgtaaattaatcactacaaaattcctcta

SEQ ID NO: 5435 - DNA, 121 bp, Artificial Sequence
  Synthesized
  misc_feature (61): n=t or c
ttagataaactagattactttgtcatggaaagttgtgctactgcatgtaattatgaccagngtagctacttttttgtacttgatagtgtgagtcatacaattgagaactgcatcatacaat

SEQ ID NO: 5436 - DNA, 121 bp, Artificial Sequence
  Synthesized
  misc_feature (61): n=a or g
tgacctatgtatattagtagatacagtctagcttctctcttatgagtgcagtgtagtgtantttccttccatgacaaagatggagcatgcaaacatcaaaacgaacttttgcttattctga

SEQ ID NO: 5437 - DNA, 121 bp, Artificial Sequence
  Synthesized
  misc_feature (61): n=t or c
agtgtgactgggatgtcccctggctggacaaggccaacactgtgctgagctccaggactcnactatgggcaccctttggtgggtgaggtttcacactcagcactcggcctttggcaccaca

SEQ ID NO: 5438 - DNA, 121 bp, Artificial Sequence
  Synthesized
  misc_feature (61): n=a or c
agcaaaactaagtgactcctgaaggtgtcagagggagatggcagagtgtgctgggaagtantactggtgtcactggttcagatcctggatatgtgggtttggcaagcaggtatttaatgat

SEQ ID NO: 5439 - DNA, 121 bp, Artificial Sequence
  Synthesized
  misc_feature (61): n=t or g
cttacaatctcttgcaaatttgcttttttcagtccataatcactctcataataagggggancagtgaacacaaatgagttggagaggtagtttcacccacagagtaaaattggaggaaatg

SEQ ID NO: 5440 - DNA, 121 bp, Artificial Sequence
  Synthesized
  misc_feature (61): n=a or g
ccaccgcatccaccattttgtctggatttagtgccctctgacttccacctgtgtggggcantgaaagatggacagtgtgggaaatatttttctagcactgatagcatcacagaagctgtga

SEQ ID NO: 5441 - DNA, 121 bp, Artificial Sequence
  Synthesized
  misc_feature (61): n=a or g
gcagctgctcatcatcccagtgatacaattggacaagaataacccttaaggaatcaacacnaagaataataatcctcagcaatgtcacttactacaggctaccaaaaaaaaatgaagagtc

SEQ ID NO: 5442 - DNA, 121 bp, Artificial Sequence
  Synthesized
  misc_feature (61): n=t or c
tcagattggaaaatcttcaattgccacagtttagttggtgctgacaataaaaggacagtcntctgacagctctggggaacctttaattcatgttacttcttcaagtatttagctagctagc

SEQ ID NO: 5443 - DNA, 121 bp, Artificial Sequence
  Synthesized
  misc_feature (61): n=a or g
ctacagattggatggaagaatgtccctttctccagcaagagagaaatggtcactgtccgcnttttccaccacctccattatcgattcccttcttgctgggaaaaaaataaaaaaaaataaa

SEQ ID NO: 5444 - DNA, 121 bp, Artificial Sequence
  Synthesized
  misc_feature (61): n=a or g
tgtaacttctcccagtactcaaaaccatagaaagaactttacagatgcggtatatcctccncatcaacttaccagaaaagtgtgtgctgctccctttgcctgttgccaaattgtgaatatt

SEQ ID NO: 5445 - DNA, 121 bp, Artificial Sequence
  Synthesized
  misc_feature (61): n=a or g
gaacaaatgtcatgagacggatagcggagtgatatgaagaaggaagaagtggtgatatatngcctcttcaggactgcccgacagtatgggtaacctgtcagtgatgtgcttgctctggaca

SEQ ID NO: 5446 - DNA, 121 bp, Artificial Sequence
  Synthesized
  misc_feature (61): n=t or c
cttttctgcggggttttgaaactgccaaactgagaccaatacaaaattcattcaggtccangtgtcttattcatagccttaagttgcctcatctctttttgaacctgtttttagctgacat

SEQ ID NO: 5447 - DNA, 121 bp, Artificial Sequence
  Synthesized
  misc_feature (61): n=a or g
tggaaccaaggagaggacacgcagcaacctcatcatcttttgtttcggactgctgtaaacnaggtgacgtatcaagaagaagttaaacaaacagaaaaaaaaagacttgcaacgcataatt

SEQ ID NO: 5448 - DNA, 121 bp, Artificial Sequence
  Synthesized
  misc_feature (61): n=a or g
gggggaaaaagtttgttttgcttgtaccctactttacttgagaaaagctaggtaggagacntacaataactatttgcttaatgactgacttagaaatatgtcaatgaccatttttgcctct

SEQ ID NO: 5449 - DNA, 121 bp, Artificial Sequence
  Synthesized
  misc_feature (61): n=a or g
cagaggcacctctaacccctacgtattgcagcactgctccctacacagagcagcatcactncctgtatgtggaggcttagttttgcaagcgtgtgcgttttcatatgtgagagattctctg

SEQ ID NO: 5450 - DNA, 121 bp, Artificial Sequence
  Synthesized
  misc_feature (61): n=t or c
gaaataaccagaagccatttaattattccaaaaatgtaattaaacccagaaaacttcaacntatttctcaatagttcccactgctttaatgcatatctcaaacatactatcagtactcttt

SEQ ID NO: 5451 - DNA, 121 bp, Artificial Sequence
  Synthesized
  misc_feature (61): n=a or g
cattttaatttgccatttaaagacagattcagggacattcttctgatgtctgttaatgacnaaccaagacacatcattgctttcttaaagtgggtcctttcacagtcataataggacaaac

SEQ ID NO: 5452 - DNA, 121 bp, Artificial Sequence
  Synthesized
  misc_feature (61): n=t or g
aaaactactttgttttccccttctgccctaaacttcagtctttctttattagcaccaaagnccagattctcataactactgattaaaaaaaaaaatccatgcaatctttagaatactttgg

SEQ ID NO: 5453 - DNA, 121 bp, Artificial Sequence
  Synthesized
  misc_feature (61): n=c or g
tttttctttataactcacagatgacacatctcttcaagttcataccgatgttcctcacatnaaaaggttacaggattttgcttttatgctttgattttatttatttatttattctcttaat

SEQ ID NO: 5454 - DNA, 121 bp, Artificial Sequence
  Synthesized
  misc_feature (61): n=t or c
aggagaaggcgtaactttgatttttctgcaggtgttcctctggaactctgttgcagtatanggtgtctgatggagctttcactagatcagtttgtaaatcaacataccatcctcacccttc

SEQ ID NO: 5455 - DNA, 121 bp, Artificial Sequence
  Synthesized
  misc_feature (61): n=t or c
gagccactgggcacttgatccatagacttcagtcatataaagtcctatgtaaggtccactnaattccctgcaggagaaagtttttcatctctgtaattcatttaaatgactaagagaaggg

SEQ ID NO: 5456 - DNA, 121 bp, Artificial Sequence
  Synthesized
  misc_feature (61): n=t or c
tttttctcccctccccagcgggctctctgagaccatgtggcgaccagaaatgctctcaagnccacttcttacctcagtgagttatctggatgtgtctccatgtgggactccagcgcatact

SEQ ID NO: 5457 - DNA, 121 bp, Artificial Sequence
  Synthesized
  misc_feature (61): n=t or c
ctctggttgctgctgatgctgataaaatttctgtcatggcctgtgatgaacagcatgcaangttggttcaagataagagccaaaagcgtgtcaaagagtcttctccaaataggaatcccca

SEQ ID NO: 5458 - DNA, 121 bp, Artificial Sequence
  Synthesized
  misc_feature (61): n=a or g
gcagtattcctgattctctttttaatttgattttcttttatttttaggctcagcagaaganagactggctctggagactgctgtaatgtatggtgttaaaaaacaaactacacaacccacc

SEQ ID NO: 5459 - DNA, 121 bp, Artificial Sequence
  Synthesized
  misc_feature (61): n=t or c
tctatctccagatctgatgtgcagcaccagtgagacaagaaagaattcttacccataccangtctataatgagccgaagtgacactaatggctgcaattatattcttttacattggcagcc

SEQ ID NO: 5460 - DNA, 121 bp, Artificial Sequence
  Synthesized
  misc_feature (61): n=t or c
gtttgtatttgaccttcccaaactaagcatgctggaatgtagtcagcattggctaggtgangctatcttacaaagggacaagattctatcattacctctcatcaactactggcttctgtat

SEQ ID NO: 5461 - DNA, 121 bp, Artificial Sequence
  Synthesized
  misc_feature (61): n=a or g
ttatacagaaagagatgaaagctcttttagtgaacatggtttacctgttcattcttagtgncacattgtttgcttcctccaggtcaatgttcttcttctagatgactgaaaatcttacctg

SEQ ID NO: 5462 - DNA, 121 bp, Artificial Sequence
  Synthesized
  misc_feature (61): n=c or g
tccatttcttgcagcttgaattctgcaagctattcaacagaaaagaaagcatacacaacantgatttctccccatcacttactttagggatctgacagatgacgaaacatttgattagctt

SEQ ID NO: 5463 - DNA, 121 bp, Artificial Sequence
  Synthesized
  misc_feature (61): n=t or c
ctctgaaggaaaaaaatacatatatcccttcgttactttaaaaataaagactttgccaacntattgtaattacaggctgctaaatattacctggaattgaaacttgctcttcttgaaagta

SEQ ID NO: 5464 - DNA, 121 bp, Artificial Sequence
  Synthesized
  misc_feature (61): n=t or c
acatccttacatgtaaacaagagcatcaataatgcttagctgagtgcttgagatataggangcacggaagctagactttttgttgtcattaaattattaggaacagtatttggtacagtta

SEQ ID NO: 5465 - DNA, 121 bp, Artificial Sequence
  Synthesized
  misc_feature (61): n=t or g
ctcagtgtgccatttttcctatggtaaacagaatataaaggcagaacaatttcctaaatcngtgggtactaaattttcatataaataatacagtctgattatgggataaggcatcatggaa

SEQ ID NO: 5466 - DNA, 121 bp, Artificial Sequence
  Synthesized
  misc_feature (61): n=a or g
aagattttattggagagcgacagctctaacactgcgcacagccatcggaaggcatcagcancacgctcaaagccaagggtaaagctgtggcagcctctcccgtcacgcagcgctgcctacc

SEQ ID NO: 5467 - DNA, 121 bp, Artificial Sequence
  Synthesized
  misc_feature (61): n=t or g
caaaagcagctgcagcagaataagtaatgaaatacatgtactgttttttaaaaacacttcnttggaaatgctttctaggttgagcctgtagagaactggactgctggggaggtcacagatt

SEQ ID NO: 5468 - DNA, 121 bp, Artificial Sequence
  Synthesized
  misc_feature (61): n=a or g
gcttttgctttgccagacctttcagtctgtttcttgttcctttggttcaagtagtagcacngagagaagatgctgcccacttcatcttggctgtcttttgagattgcccagccctcatgcc

SEQ ID NO: 5469 - DNA, 121 bp, Artificial Sequence
  Synthesized
  misc_feature (61): n=a or c
ttttccaaagctactctgctggttcttcttttttcaaagagccacttcagttggctcacantgaaaatgacaaagaataatcttgttggagaaatcttccctcacggccactactgctaat

SEQ ID NO: 5470 - DNA, 121 bp, Artificial Sequence
  Synthesized
  misc_feature (61): n=t or c
ggagagtggttttgttcttcctaattgattctcagtttctgtaacaaggaccacagctctngcacttatggagttctgtgacaaccagtatcattaaaggtacgtggtacagagccatctc

SEQ ID NO: 5471 - DNA, 121 bp, Artificial Sequence
  Synthesized
  misc_feature (61): n=t or c
aaacaattctaaaatagcacaaaggaactttactctgtcatgcctgaaagtgtactaatanttaagatttttttactgatggatagcaggggtaatatactaaaactgtttcttaaattta

SEQ ID NO: 5472 - DNA, 121 bp, Artificial Sequence
  Synthesized
  misc_feature (61): n=a or g
atgctaacaagtaaaaagtaaccagataaaaatcagaaactgcaagttttgcacagaatgntgatcttttgtcttcacattcacatttaacgtagagtgacttctatacctcctttgttta

SEQ ID NO: 5473 - DNA, 121 bp, Artificial Sequence
  Synthesized
  misc_feature (61): n=t or c
gaactgatgtctccatctgaagtctttcatgctcattgatggtttgtgtagttaactcagngccagaattctgatggacaggccagatattatgctcagcttttgtctgttgtgtggtaac

SEQ ID NO: 5474 - DNA, 121 bp, Artificial Sequence
  Synthesized
  misc_feature (61): n=t or c
ctatgaaagcttggcaatgacaatgttggaatgaaccagttctgatctctcttcttctganaggcaagatttcacagcatgtacattagatttagcctttccactccacccttgttttgat

SEQ ID NO: 5475 - DNA, 121 bp, Artificial Sequence
  Synthesized
  misc_feature (61): n=a or g
ccatatttgaagcttttctcatagagttttaagactgtcagagaggaaggagaacgtaagntgcctgtggttttcttacacatcatatattttagtaatatacaaacattgaggtccagta

SEQ ID NO: 5476 - DNA, 121 bp, Artificial Sequence
  Synthesized
  misc_feature (61): n=a or g
aaaagaaaaaaacctggacccctcccaaaaaggaattacttcttcaatcatgatcatggcntacttgagaagtaatgtttcagggggcagccactgcttcaaaaccctgtctgtctttgtc

SEQ ID NO: 5477 - DNA, 121 bp, Artificial Sequence
  Synthesized
  misc_feature (61): n=a or g
aagaactatttgaagccttgtaaatttttacatggatatttctagatttgtggtggggaanggcacacagttgatgaaaattcttgcacttgtgaatagtgttgtgacagccatgaaagct

SEQ ID NO: 5478 - DNA, 121 bp, Artificial Sequence
  Synthesized
  misc_feature (61): n=a or c
ttatgatacagagtttaataatgtataggtacttctgtgtagaaggtagcccatatatctncaagccccagccagtgcctttaaaactgttgcacaatgaagaagcactgttaatgtatgt

SEQ ID NO: 5479 - DNA, 121 bp, Artificial Sequence
  Synthesized
  misc_feature (61): n=a or t
atatggtccattcctagctgaacaacagccagtattacatgaggatttgcaagtagcttantttgttcagagttaaaaatgatgcagacaacatatattttttttcagtttgtgttgtcaa

SEQ ID NO: 5480 - DNA, 121 bp, Artificial Sequence
  Synthesized
  misc_feature (61): n=a or g
agttagcaagtttagtttttagctgaaaagttagcaaaagacacactgttaccctactgantatactgtttcataacatgatggcaacagctttatgatctagaccgactatttgtgtgtg

SEQ ID NO: 5481 - DNA, 121 bp, Artificial Sequence
  Synthesized
  misc_feature (61): n=a or c
tggcatgttccccagaccaattaacattagaatctgtcaaaaaacagttcaagcaaaagancttagcctctaacatgtcagactacagtgagcaattgcattttttttgactaagtttaag

SEQ ID NO: 5482 - DNA, 121 bp, Artificial Sequence
  Synthesized
  misc_feature (61): n=a or t
aaggataatgtattgtaatttttatgaagatcaaggccattggttttcaggagaagtgctntgcaatgaaggagagactgtaacttaaaaattagccatgaggtctatgatattgaatttt

SEQ ID NO: 5483 - DNA, 121 bp, Artificial Sequence
  Synthesized
  misc_feature (61): n=t or c
tgagaagaattaaatcaggcaaatagaaaaggaaagcagtaactatgactgtgtgcatttnggagattcctagcagcaatcaggattttctcttctaaaatgttttattttctgttgctga

SEQ ID NO: 5484 - DNA, 121 bp, Artificial Sequence
  Synthesized
  misc_feature (61): n=t or c
tgtgaccaggaagtcgttatgcgggtataaaaggttgtgagcacatacaataaacgtcatngttctgcaccagcaatggagtttgtttggaggactcgcctgccacacaggcctccaatca

SEQ ID NO: 5485 - DNA, 121 bp, Artificial Sequence
  Synthesized
  misc_feature (61): n=t or c
cacaacaaaattattctgtaacatacctaatctaatataaaattatagagaagcagcttcngtgatgggtttaatactgagaactttggattttctgttctccaaagcttaggcaactccg

SEQ ID NO: 5486 - DNA, 121 bp, Artificial Sequence
  Synthesized
  misc_feature (61): n=t or c
acttacaaaacagttcaagcagtgttaaccctaagatcaatacagtgctgacacgcgctgnacttctgtttcccttccattaggaacgtcagttgtgataacaacactcctcataggactg

SEQ ID NO: 5487 - DNA, 121 bp, Artificial Sequence
  Synthesized
  misc_feature (61): n=a or g
ttacagaagttttcttaaagagccaggagagtctgctgcactggactggactcagcttcantgcagtattttttcagctactcctccttcacagctgtggaccccagtaccaaaacagaga

SEQ ID NO: 5488 - DNA, 121 bp, Artificial Sequence
  Synthesized
  misc_feature (61): n=a or g
attaccatagcagtatttgctgcagacatcgtgtacctctttgtggaactgtgaaataacntgagtgtacttatgtaggtatgctggtgcttcagcagtaaaatccagaagcagcgctgaa

SEQ ID NO: 5489 - DNA, 121 bp, Artificial Sequence
  Synthesized
  misc_feature (61): n=t or c
gcattagatgaagcacagaagttcaatgagaacatttcacttattcttaatatagagtttnagccatactatcactcagccacacaggcaaagccatcctgtacatatgctagtgctgcat

SEQ ID NO: 5490 - DNA, 121 bp, Artificial Sequence
  Synthesized
  misc_feature (61): n=a or c
aggaatataaaggaaaatcacgctgtaatgctgacttttgatctagaactgagaactacangcaatttctctttgatctttcaggaaatattttaaccacataggatgagagactggcagc

SEQ ID NO: 5491 - DNA, 121 bp, Artificial Sequence
  Synthesized
  misc_feature (61): n=a or t
gggaagacacatattttttcatctttcttgcaagattttggcacatctcatatgtatgganacctaaaacaattattattgttggagaatttctcatcttcagcttgctgagatgagcaca

SEQ ID NO: 5492 - DNA, 121 bp, Artificial Sequence
  Synthesized
  misc_feature (61): n=t or c
tatatgcatgtatatatatattaggataaaatgcctgaatggaaaaatcctttataggttnacattaattttcacatagtgcctcagaatttgccgtgaaaatccttctgtttggggatgt

SEQ ID NO: 5493 - DNA, 121 bp, Artificial Sequence
  Synthesized
  misc_feature (61): n=a or g
cagatagcagtaacattcacagatttaacaaaaacaatggtaccatagctttcagagagcngagacattggaaggggatggaagttaacttgaaatcactctatgattctatgactgaaat

SEQ ID NO: 5494 - DNA, 121 bp, Artificial Sequence
  Synthesized
  misc_feature (61): n=a or g
agcaataggtacacattgctaataggccctttgatgtgtaaaaagatttgcacaccagccnaagctgtgcagcatcatagcaaaagtaaggcccacgtgactcgatgaaaagggtaatggt

SEQ ID NO: 5495 - DNA, 121 bp, Artificial Sequence
  Synthesized
  misc_feature (61): n=t or c
ataccttgctacagctaaagccgaagtattacaatcccacttcgagagctcttacagcaanactgagaactcggccagaagtcacgcggttaggaaccccttcagctcagcgctccacccg

SEQ ID NO: 5496 - DNA, 121 bp, Artificial Sequence
  Synthesized
  misc_feature (61): n=c or g
gcataaatggtccctgtcaccacaaaatgagcaagtcacaagatttaatgaatttaaatantggtatgaagtaaatccctcatttttgtgtgggaaactaatctgtaccataaggggatta

SEQ ID NO: 5497 - DNA, 121 bp, Artificial Sequence
  Synthesized
  misc_feature (61): n=t or g
atatttagatgttaaaatgagaagtagctgatatcccatgtgacagaattccttttgcttnaataataggtggtagttttcttttttgactttcaattcagaaaagtatgttgaaaagaca

SEQ ID NO: 5498 - DNA, 121 bp, Artificial Sequence
  Synthesized
  misc_feature (61): n=a or g
agcccacagtatttagtgactatattgatagcatttcggtcttgagaaaggattacagatnggctgtgcacgagaagcttgtgtgcttctgcacaggggaatcttcattaggagacctcac

SEQ ID NO: 5499 - DNA, 121 bp, Artificial Sequence
  Synthesized
  misc_feature (61): n=a or c
gtttaagccaaaagggattaaccccctgttttactatggaaaaggaatacttgcagttttntctctgatagtacataaaaaatgaattctggtaaattgttaatgctctctcttcacctgc

SEQ ID NO: 5500 - DNA, 121 bp, Artificial Sequence
  Synthesized
  misc_feature (61): n=t or c
ttgcccaaggtacagcaggatatcagtaaaggatttcagtttcatataagaggcactcaangagatgcctcactccatggcattaaaacgtattactcagtaagaaaaaaatggaagaaat

SEQ ID NO: 5501 - DNA, 121 bp, Artificial Sequence
  Synthesized
  misc_feature (61): n=a or g
cgtgtgatctgagagagccagcacagcttcaccaggggaacgtcatgcctaaccaatctgntggtcttctatgatggggtgacagtactggtagacaaagggaaagtgaccgatatcattt

SEQ ID NO: 5502 - DNA, 121 bp, Artificial Sequence
  Synthesized
  misc_feature (61): n=a or g
tagatgctcctatcttgtttctgaagtctgcagaaatgccattataaagcagtggatttgnatggtacagacattttaatggtacaaccactgaagaccagaggtctctgaggtgttcatt

SEQ ID NO: 5503 - DNA, 121 bp, Artificial Sequence
  Synthesized
  misc_feature (61): n=a or g
aggttagcatctggagacactacacaattttggctaactgcacacagtgcaaacactccancaagagttctgtcaattttcaatgatattgtttgcagatttgatgcttttgtacaggaaa

SEQ ID NO: 5504 - DNA, 121 bp, Artificial Sequence
  Synthesized
  misc_feature (61): n=c or g
gaaacaagtaagggaaacaagctgaaaaggcattcctgcagaagatgggaagcctgtaatntatttcttcagattgaatcaatattgtgtatttctagttccagaccaacaccacaccttt

SEQ ID NO: 5505 - DNA, 121 bp, Artificial Sequence
  Synthesized
  misc_feature (61): n=a or t
aaataaaatccctttaattaagcttaattatgaattcagctcagaattgctataacaatantgctcctctaaaggtttgttttctaaaatactcctcctactataaatccagttgtagatc

SEQ ID NO: 5506 - DNA, 121 bp, Artificial Sequence
  Synthesized
  misc_feature (61): n=a or g
attggactcaaataaaacttcaaaattaatttcccattgtgttttttacaaatagtctacngttaatacaaagatatctcagacgatttctatactcttacatacatagctagtcaacatc

SEQ ID NO: 5507 - DNA, 121 bp, Artificial Sequence
  Synthesized
  misc_feature (61): n=a or g
agacacttagccttgataagtatagctccactaaaaacaccaagatgctactgatttgaantttgcctttaccttcaataggtttagataagaataaggaagcttttaatttatttgttat

SEQ ID NO: 5508 - DNA, 121 bp, Artificial Sequence
  Synthesized
  misc_feature (61): n=a or c
atgagggaggtgagtgagaagttcaccctaacagctggagcacaaccatgggtcacagatnatgtgtctggtactggctgctgagtggttgtctcttccccagacatgttgtgtatggagt

SEQ ID NO: 5509 - DNA, 121 bp, Artificial Sequence
  Synthesized
  misc_feature (61): n=t or c
accctccactttgtgcaacagtcccagcagcaaggtgaacccaacacaacagtaaaacaanaggcatggttggttgtttctcccttattcacattgactgtcaaggacgagcctgctctgc

SEQ ID NO: 5510 - DNA, 121 bp, Artificial Sequence
  Synthesized
  misc_feature (61): n=t or c
tttagactaggtgtttggctttttgatggctaaggttaggtgagatgaccccctttcccanacgctgatttcagttggcttctagagctgtgttcttgacaaatttatcctgagatatgga

SEQ ID NO: 5511 - DNA, 121 bp, Artificial Sequence
  Synthesized
  misc_feature (61): n=c or g
ggtatttatggacattgatgtgatccccctcaaccttcaggctaaactctctcagcatctnctattaggagacgcgctccagcaacttcattacctctgtgggcctctgttggattctctc

SEQ ID NO: 5512 - DNA, 121 bp, Artificial Sequence
  Synthesized
  misc_feature (61): n=c or g
gtcccctctctgccctcagctcctgctccttctacagaaagccccaggacatctgaagtcngccagcctgagcccagaggtttagcttttaaccctgtgcacacacattaatctattagcc

SEQ ID NO: 5513 - DNA, 121 bp, Artificial Sequence
  Synthesized
  misc_feature (61): n=t or c
tttcagtcaacagattgttaagtgcttttactggaaaagaagtagttttattaaagacttnaatgtgttgctcagaaaaaaagaaagtgttcatgaggatgtattcatcagagctagatgg

SEQ ID NO: 5514 - DNA, 121 bp, Artificial Sequence
  Synthesized
  misc_feature (61): n=t or c
attagtctcacaatagcacagttcttcacatcaaaatctaaacaactgctgtatgtatttncagtgttctgtataaggatatatctgagtgcacacttcacatactttcccttgtcatttt

SEQ ID NO: 5515 - DNA, 121 bp, Artificial Sequence
  Synthesized
  misc_feature (61): n=a or c
atccctctcccttcctcaggtagaaattaagtaaatggataaactaacctgattgaagtanttgttccactatggtcaagttatcatcaatgtcttttacacactcaaagacttctgaatg

SEQ ID NO: 5516 - DNA, 121 bp, Artificial Sequence
  Synthesized
  misc_feature (61): n=t or c
ccagatattttcttgcacgtcatgcgctttcttttccacctcgctgtgaagacaaccacanactgttctccaaacacagctgtcaacctagttagaccttgccagcgtaggaaaatgaaga

SEQ ID NO: 5517 - DNA, 121 bp, Artificial Sequence
  Synthesized
  misc_feature (61): n=a or g
taagaagaggcacttcttaatttcttgatgtcaaaagtgatcttcctggtacgaattagcntagagttaacaatgtgcttacgtcctttaactttttttcactgaaccttgcttatcttcc

SEQ ID NO: 5518 - DNA, 121 bp, Artificial Sequence
  Synthesized
  misc_feature (61): n=a or t
tcctaactgttcctcgatctctgctctaactcagtgttttctgtggtgagagacttctgtngcctttttgcagttgcaccaacttggtagaattctgtgtgctattttggcagtaacgttg

SEQ ID NO: 5519 - DNA, 121 bp, Artificial Sequence
  Synthesized
  misc_feature (61): n=a or g
tgtaacaataatggacagctggctagctgcgaccgcctgactggaggtatgtaagggtctntggatgtggaaggtgctgttgttttctctcagggaagcaaagagagaaggtgcttaattt

SEQ ID NO: 5520 - DNA, 121 bp, Artificial Sequence
  Synthesized
  misc_feature (61): n=a or g
attatatggactatgaaactgtgaagcggggattaaacagaagtaaggttaagagaaagcnttcatgaaaatcatcaggtgttgcagacattcccttgttaggcctgcaaaagaaggccca

SEQ ID NO: 5521 - DNA, 121 bp, Artificial Sequence
  Synthesized
  misc_feature (61): n=a or g
tctgaagttataaagaaaaagagaacgactttgtgctcagggccgagggctgggaaaacangagatttggcctccccaggaaataaatttaagattatgctgatgcactacccaaatcctt

SEQ ID NO: 5522 - DNA, 121 bp, Artificial Sequence
  Synthesized
  misc_feature (61): n=a or c
cagtcattagttgttcaggctcaaattcagccaatgtcttggatgtggtaggttttgaaanatcaccctaagctctggaaccacttagccccaaatatttcaggtgtgtgttttgtcaaca

SEQ ID NO: 5523 - DNA, 121 bp, Artificial Sequence
  Synthesized
  misc_feature (61): n=t or c
gagctaaagaatgaactgctgagcccttggagagattgcattatcactgagctgctctccnactttgaccatctttacatcttcgtaatgctactgattttggaagaaccgtcctaatttg

SEQ ID NO: 5524 - DNA, 121 bp, Artificial Sequence
  Synthesized
  misc_feature (61): n=a or g
tcccccaaatatttttaattcttaagaatcttatttgtcatcatctttttggaaaaatacngaagctatgtcataaatttcacaaaccaagaaagagctttgtgaaatctgtgccttcata

SEQ ID NO: 5525 - DNA, 121 bp, Artificial Sequence
  Synthesized
  misc_feature (61): n=t or c
ataaatccattctcatactggctcagggtgctgtggtgaagctaatacttgcttaactaanagtagcagagagatggattgtgtgtatgttgcaagtggatttaaccttcaggaaaataac

SEQ ID NO: 5526 - DNA, 121 bp, Artificial Sequence
  Synthesized
  misc_feature (61): n=a or t
ttaagatggattggttgtaagtattgtactactgacaaatactgtcagtgtagatgggagncccattttgttgtgtacagtgtgtagtagtaaagcttttctgatgatgttatgtgattct

SEQ ID NO: 5527 - DNA, 121 bp, Artificial Sequence
  Synthesized
  misc_feature (61): n=a or g
gcttttgttcctctctccatccctccagattttatataggttttagtgctaaaaaagtggnctttttgtgcaataggagctctgttcacatttatataattactagtactttaaaaagaga

SEQ ID NO: 5528 - DNA, 121 bp, Artificial Sequence
  Synthesized
  misc_feature (61): n=a or g
tctgagcactggcaagagaacctgcggcaatggccacattctgctggcagcaaccaatgcnttctcatcaaagaatgctctcaagaacatgtttgctacagcagaagacagcgctcccaag

SEQ ID NO: 5529 - DNA, 121 bp, Artificial Sequence
  Synthesized
  misc_feature (61): n=a or g
tttgcaatactgggaaaacaaataccaaacaaactgacttttgtcatgatataatcagacntgtgcagatgtaatctctgctcggtgtgcttaaggagaatgggaacaaagagagttgctc

SEQ ID NO: 5530 - DNA, 121 bp, Artificial Sequence
  Synthesized
  misc_feature (61): n=a or c
ataattacttttagattttaacttttggttcagttcaagtcagggtgttctgaaataactngtcctattctataactcacctatctaattcactcatatatctgtagtaataatcaaagat

SEQ ID NO: 5531 - DNA, 121 bp, Artificial Sequence
  Synthesized
  misc_feature (61): n=a or g
ttctaaaaatgtaacagttctgtagtatctgaatcaatacgttataacttgcattgccacnaccaccacccaggcttcttcactgatgttatggctgaaccacatgtgtggggctttatta

SEQ ID NO: 5532 - DNA, 121 bp, Artificial Sequence
  Synthesized
  misc_feature (61): n=t or c
ttgcaaataaaatgaaaccaagactgccagcaggctatctcttactatgattgccgtgtantgatcttatttttcaatagcttgcaaaagaaggcaaatttggtggtcttcctacagatgc

SEQ ID NO: 5533 - DNA, 121 bp, Artificial Sequence
  Synthesized
  misc_feature (61): n=a or g
gtatagctgtctgtattaatgcaattaatatcactattaatatgatcactactgctgactncgtctttcagtggctcttcccaaagtgctctctgtgcacatccaaaaaggtcagacaaat

SEQ ID NO: 5534 - DNA, 121 bp, Artificial Sequence
  Synthesized
  misc_feature (61): n=a or g
aaatatttgtaggaatactaacagatattccagtgaattcttgccttgcatgtaaaagcgnccctgaaatttcatgcagataacaggatttataagtggcaacatgataccctgcaataat

SEQ ID NO: 5535 - DNA, 121 bp, Artificial Sequence
  Synthesized
  misc_feature (61): n=a or g
ttaattgactcagtatttctatccagcagatatttttagtgcaatggggtgatgaggctgnggagctgttaagcaacttgttttacaacaaatgggttcgtgatggattagctcagcatct

SEQ ID NO: 5536 - DNA, 121 bp, Artificial Sequence
  Synthesized
  misc_feature (61): n=t or c
tttcctcttttcctgacatttcttatttaacataatgtgcttatttgggaaattacatatnggtttttctacatcaacagtaaagctgtgtagattatctgatggataaagtgtgaatcat

SEQ ID NO: 5537 - DNA, 121 bp, Artificial Sequence
  Synthesized
  misc_feature (61): n=a or t
gtttttcatttgaatggaagctgtaagtaatgatgaggtttttagttttgccacttctgcncaagttatgaaatctttatgaaattaaaacaaagcaagaaacatctggtttcacaaaaca

SEQ ID NO: 5538 - DNA, 121 bp, Artificial Sequence
  Synthesized
  misc_feature (61): n=c or g
atatatatatatatgtatatatatatatatataaagcaatcatgggtatttacaaacattnaaaacataccagctactccttcccatgattctgggaggctgtggtggggaaatcagaaag

SEQ ID NO: 5539 - DNA, 121 bp, Artificial Sequence
  Synthesized
  misc_feature (61): n=a or g
aagtagtgttctgctctgtctggaaagaaggagaatggatcaagtagattactggctgaangagtgtgttatgatcaaggttttgggtactatgatcttgggcaggcctttgagagaccag

SEQ ID NO: 5540 - DNA, 121 bp, Artificial Sequence
  Synthesized
  misc_feature (61): n=t or c
ctaattaagatagcacagtaagatctgaattcaaaatgctggttaggctgtaaggggcctnctgtaaaggattgtatattaggctattaacctaattttagctggcctgtagttatgtcat

SEQ ID NO: 5541 - DNA, 121 bp, Artificial Sequence
  Synthesized
  misc_feature (61): n=a or g
tttctgttcatggtatgactaaaaaacactatgaaattgaagtgtcttttctacagagctnaagtgaaattcctaaggacagcactcccatacccagaccccaaaccagctgtacttttgt

SEQ ID NO: 5542 - DNA, 121 bp, Artificial Sequence
  Synthesized
  misc_feature (61): n=c or g
ccagagaagtggtggatgccttatctttgcggatgttcaagacaggttggatgggtcctangcactctgatccaatggaagctatccctatccacagcaggggtgttagaactaatgatct

SEQ ID NO: 5543 - DNA, 121 bp, Artificial Sequence
  Synthesized
  misc_feature (61): n=t or g
caaatctgcgctgtgaaatacttaatggcagagcagtctttttccaatgtattgtaaagcntgcagaaagtgtgctcaaacttcaatgcacatgagattgtttagaaacttttaaagtata

SEQ ID NO: 5544 - DNA, 121 bp, Artificial Sequence
  Synthesized
  misc_feature (61): n=t or c
tcatagtttcaaaggtagatgccatttttaacattttgtagcttggttataaaacatccangtaagtcattacacctccaaaaccctggcagtaacagttttcatttttcaattgaaatgc

SEQ ID NO: 5545 - DNA, 121 bp, Artificial Sequence
  Synthesized
  misc_feature (61): n=a or c
acacactgtggtatctccaaatatgtctgtgtcaatgcatgaaagagagtcctttggttancacaggtttataacagagtgattgttgatcctgttctctgttgaatgagtttgccttcac

SEQ ID NO: 5546 - DNA, 121 bp, Artificial Sequence
  Synthesized
  misc_feature (61): n=c or g
cagatctagcagggcttggcttctgtgagtgtggtatccgtgcaactgttgatggtgatgngttgacatactcatcatcttcttccccaagctcctgtggaagcactgttggattcatttt

SEQ ID NO: 5547 - DNA, 121 bp, Artificial Sequence
  Synthesized
  misc_feature (61): n=t or c
ttctacaggcagagttcatctcaagtttcagcatcaaggcagacactatgtaggaaagtangcagcaatccacaaactgcaaaacactatgggaaaacagtgacgtgttctgcaatgatgc

SEQ ID NO: 5548 - DNA, 121 bp, Artificial Sequence
  Synthesized
  misc_feature (61): n=a or g
aaaaaaaaatagaaataaatagtaaaacttaatgcctgtcattcaaggtactcctcatgancatggtcttactctcagaatatctgatatagtgatgtagatcaggactattctacattta

SEQ ID NO: 5549 - DNA, 121 bp, Artificial Sequence
  Synthesized
  misc_feature (61): n=a or c
acccttgttaataattatccatatactgcacagaatctgcctgagcttcatgctttaacanggaaattccaaacataaatcctcattacttttacaggaaattttaaacaaaacatgaaat

SEQ ID NO: 5550 - DNA, 121 bp, Artificial Sequence
  Synthesized
  misc_feature (61): n=t or c
atagtgatgaaaaccataggtacgaatatctgcaagtggctcacatgaaagtatttattgnttttcatgcatgagcattaaaccatagtgaaaagcaaaccttgattgaaaatgcattaat

SEQ ID NO: 5551 - DNA, 121 bp, Artificial Sequence
  Synthesized
  misc_feature (61): n=c or g
cacaaagcagtagaaaaatcttgctgaagggagcctgcagtgttacaagttgttcacagangacgcttggttgatggtgatgctaatgctaaggatttggctctgggtgcagctcctctca

SEQ ID NO: 5552 - DNA, 121 bp, Artificial Sequence
  Synthesized
  misc_feature (61): n=t or c
gcggaaaggtaaggcttctgctactcattctgccattgacaaacatgaaaaatattcacanacctgcaaagattccatttgtataggtgcagtatcactattttagttagggatgctgaaa

SEQ ID NO: 5553 - DNA, 121 bp, Artificial Sequence
  Synthesized
  misc_feature (61): n=a or g
gaggaagagaggccctttctttttctctcccagaatgccatgtagggctagcagtgttacngtgctgaaaaatgacacatccttttgctgattgtgcaggtgaaagaaaacacagcagtat

SEQ ID NO: 5554 - DNA, 121 bp, Artificial Sequence
  Synthesized
  misc_feature (61): n=t or c
aacatagctatcttttccaaaagtgaatagaaatctgggataaggaaatcccaggaaaatnctgacatgaagttactttcaggagtgcaggcaacagcttttcaagggtacaagactatgt

SEQ ID NO: 5555 - DNA, 121 bp, Artificial Sequence
  Synthesized
  misc_feature (61): n=a or c
gtgctgtggagccacatgtttgagtgatttgctttgtactattccaagtccttcttagttnataatgtcaatatactagtgaagaaactccactgcaaaaatgcatttttttcagatggga

SEQ ID NO: 5556 - DNA, 121 bp, Artificial Sequence
  Synthesized
  misc_feature (61): n=t or g
tgggaaaacagacgtcaagtgatttagctcaagtctgcaaaaaagttactttttacttttnttgttgttgtttttagtaccataaaagtagactttaaccgaaggtgtttcagaagttcta

SEQ ID NO: 5557 - DNA, 121 bp, Artificial Sequence
  Synthesized
  misc_feature (61): n=a or g
tcagaatcacaggagctttgttggagaggatttcaaatacacaagggagggacaaagcacnggacaagcatcagaacggggagcaaatttaggggcagaaggagtgaggagctttgtaaag

SEQ ID NO: 5558 - DNA, 121 bp, Artificial Sequence
  Synthesized
  misc_feature (61): n=a or c
tacaggaatgagtaatgaacagcctcagagtaatataattgtgatgattcaagaataagtnatttaactatctcttgttggtagatggatttgctctttccttgttctaagatgctaaggc

SEQ ID NO: 5559 - DNA, 121 bp, Artificial Sequence
  Synthesized
  misc_feature (61): n=t or g
gacctagaagctgtgcaacagttgtgctttaaatgcagagcagcaaggttaatgcatggcnaatgtaattgattttgagcggcctcagaggctagctttaaagaaaaatgtacgcgcaatc

SEQ ID NO: 5560 - DNA, 121 bp, Artificial Sequence
  Synthesized
  misc_feature (61): n=t or c
ctttctttccccaggcttttgcacccaaagtgaacatgccagaaaactggataaatgccantctttttagttgtcgttttccagttattgttaattcccaaccgcttcatgagaaattact

SEQ ID NO: 5561 - DNA, 121 bp, Artificial Sequence
  Synthesized
  misc_feature (61): n=a or g
atgcccttgcaaaacaaagtggattcacccttactgtccatcaagaatagcttctggttcntgctatcctcttgtttctaaacctttgcataaaagtagataaagaaaataccttttaaga

SEQ ID NO: 5562 - DNA, 121 bp, Artificial Sequence
  Synthesized
  misc_feature (61): n=a or t
aagcataggagtctgtgagcagaattcactgaacttcataagaaactggacgtaagattgncagtcttttctgtttatatatcatctactagatttcaaatttatcagtgaaaagtatcac

SEQ ID NO: 5563 - DNA, 121 bp, Artificial Sequence
  Synthesized
  misc_feature (61): n=t or g
ctatcatctgttaatactgctctggcaggagcaaaaaatacttaagatgttagcggccctnagtaaagaatgtgacactcagcctctctcttccagcagagaataacatgcctgcgaaatg

SEQ ID NO: 5564 - DNA, 121 bp, Artificial Sequence
  Synthesized
  misc_feature (61): n=c or g
cttactcttaagtatcaatgttgcattgctggaaatcatcaagctaagattatatttagtntctgtattcttttgcagtttgattctctaaaagacaaagcattggtgttgcacatataca

SEQ ID NO: 5565 - DNA, 121 bp, Artificial Sequence
  Synthesized
  misc_feature (61): n=t or g
tttagagtacttcattgtgcaaaagggaagaaggattttatctgtgtgctgcgaagaaagnatcagtgacttgcaatgtgaataatcaattacagctttcacaaaccaaccaagttaattc

SEQ ID NO: 5566 - DNA, 121 bp, Artificial Sequence
  Synthesized
  misc_feature (61): n=a or g
gcaagttttacttcattctaccctacaataaatataacacggtgggacagaggcaacaaanaaaaaactcctcgcagcaataaatattaattattcaccaccttttgtttttaagtgtcag

SEQ ID NO: 5567 - DNA, 121 bp, Artificial Sequence
  Synthesized
  misc_feature (61): n=a or g
gcctgttacacctgccttgctcagttactctgggcttctaccctgcaagccatcatttcangagcacctgagcactaaaagccagtacccaggctcagtcactatcagcaacagcagcatc

SEQ ID NO: 5568 - DNA, 121 bp, Artificial Sequence
  Synthesized
  misc_feature (61): n=t or c
caaatagcagcctggcagtggcaataagcagctgatttcattatgatgtaggatctcttanaggactgtcgctcctaggcttctacaccttctcccagcatgatggtgtatagctctgtga

SEQ ID NO: 5569 - DNA, 121 bp, Artificial Sequence
  Synthesized
  misc_feature (61): n=t or c
tattataataatatctgtatattataataataattggcattcttagacccataaaccaacntggtctcggtgaaagcaaggaagaaattcctttcattgtaaaggtaaatgtttctaaaat

SEQ ID NO: 5570 - DNA, 121 bp, Artificial Sequence
  Synthesized
  misc_feature (61): n=a or c
aacctaaagaatttctttcccttgtctatacaataattcttcaggaatctttgtcccaagncatactgaggtcaatgagtttctcttgttttctctcacaaaggcccaaatgctacaaaca

SEQ ID NO: 5571 - DNA, 121 bp, Artificial Sequence
  Synthesized
  misc_feature (61): n=t or g
ctgggcacaagatggggtgtaaggttcaatagctttgtttagagatctagaattattacancagttcacaggctttctcaacacttctccagcaggagtccataaaatggggcccacaggt

SEQ ID NO: 5572 - DNA, 121 bp, Artificial Sequence
  Synthesized
  misc_feature (61): n=a or g
aaccctgagggtcagagtttatccgctgagtgcaaccttgtgcctcctggccaggacaggngtgatggaaattgctttcctccatctcctgttctgtccttttgtctttcaaggcctggtg

SEQ ID NO: 5573 - DNA, 121 bp, Artificial Sequence
  Synthesized
  misc_feature (61): n=a or g
tggacacagcaagaggtaccccatgcttatcattattttagccatgtttagtttgtgttgntgggcgaagatcataaagagaagtcagatgcagcctgagattttatactggataggaggt

SEQ ID NO: 5574 - DNA, 121 bp, Artificial Sequence
  Synthesized
  misc_feature (61): n=a or c
taatttgaaacttacagctgtcatcaagaaattatattcagctttatttctaaggtcttanagactaaaagcctcagtttctgaatgcttcatgatatatatttattttaacattaactga

SEQ ID NO: 5575 - DNA, 121 bp, Artificial Sequence
  Synthesized
  misc_feature (61): n=a or g
ttagccttcatgactcttgtagatgtacagtgaatgagggcagttgtcacaaagggtctancaccacttaatgagtgactgggaaaaatatcagcaaatactaagtcggttcaagcttggt

SEQ ID NO: 5576 - DNA, 121 bp, Artificial Sequence
  Synthesized
  misc_feature (61): n=a or t
tgtattgtacttacagtgtttatcttagttactatggtcagaagtgtgttcggaaccatgntagtacaactctcttccactacaaacctctactggtcagaaattacgcttcagatctgct

SEQ ID NO: 5577 - DNA, 121 bp, Artificial Sequence
  Synthesized
  misc_feature (61): n=a or g
catagtccttgttctgaatctgttacaaggcctgcctggatgttagggcagtagtgtttcnaaacaaaaagagaggtgtataaagctatcaaaaaacaaatgcaactaagtgtcctgatat

SEQ ID NO: 5578 - DNA, 121 bp, Artificial Sequence
  Synthesized
  misc_feature (61): n=t or c
agtttaaaaccattagccttcatcttgtctctgtgtccatgagaaagaaataagtcaagantgtaacgttcaacttttgaggtcctttatcttgtaactggagtgcagaaggaaatcacag

SEQ ID NO: 5579 - DNA, 121 bp, Artificial Sequence
  Synthesized
  misc_feature (61): n=t or c
atttttaaaggtgcctctctccttttcacacagtcactgttggtacagttctcccttcatntttcagctgaaatcatcagccattacacacaaatactgtcaggccacgtcgagctctcac

SEQ ID NO: 5580 - DNA, 121 bp, Artificial Sequence
  Synthesized
  misc_feature (61): n=a or g
tggtaggtgcataaagataattcactcactcatggttgcagaggagtatcaaagcctgganaaacacagggcttcagacaaacatatttcttttgcatttcctagcagatgacttagatat

SEQ ID NO: 5581 - DNA, 121 bp, Artificial Sequence
  Synthesized
  misc_feature (61): n=a or g
ccaaaaaagaccatattgagaaagctaccttggaagatgaagttagtaagaggatgtaggnctgaggacataaatccatcttattcgtggcaagggcagacagatgaatccaagctgtatc

SEQ ID NO: 5582 - DNA, 121 bp, Artificial Sequence
  Synthesized
  misc_feature (61): n=a or c
atgtcctctcccccaccgtatccacttagtgtaagatcagcctttccccaacacgttcaanacatgcaaccgagtggttccatattcaatggctgttaaggaaaagaaggagaaaaaaaaa

SEQ ID NO: 5583 - DNA, 121 bp, Artificial Sequence
  Synthesized
  misc_feature (61): n=t or c
gaatgtcagccccaccaattctagatacatcaggtggtgtgggccagcaaagctcagcatncatcccagaaagttatctggtcagaaaggggtgatgtaaagctttcagaaaagttctagt

SEQ ID NO: 5584 - DNA, 121 bp, Artificial Sequence
  Synthesized
  misc_feature (61): n=a or g
agggtagaaacccaggattcctaatccagcagaccctcctaatgccactttatcccacacntatgataatagggctatgactgacaggctgctatgccgtctgtcttccttatttcctcac

SEQ ID NO: 5585 - DNA, 121 bp, Artificial Sequence
  Synthesized
  misc_feature (61): n=a or t
tgtcaacctgttccaatgcctcactgcttttattgtgaaaacctttttctttgtattcaantatctcaattgctcctatttaagcttggaacatttccccttgtcctgtcataatagactg

SEQ ID NO: 5586 - DNA, 121 bp, Artificial Sequence
  Synthesized
  misc_feature (61): n=t or c
tttattgagaacatgcagggaattgtaacaggaagtcaactgacagcatctgagaaactgnacagccatgtggatgagatattttcattgttcagaaatctgtgagttaggttcaatatgg

SEQ ID NO: 5587 - DNA, 121 bp, Artificial Sequence
  Synthesized
  misc_feature (61): n=a or t
atcaggcaatcaaatttcagctgtgtcaattccttatgcttgcaaaagagaccttacatanctttctaatcagatgatgaatgacacatggatgatacccagagatggctgcatttcagta

SEQ ID NO: 5588 - DNA, 121 bp, Artificial Sequence
  Synthesized
  misc_feature (61): n=t or c
gcaatcaactattgttttctaagccacaccattaatatatctctattcagttttttcttcntgcatcacctaatttccagcagataaaatcagagatgagatgtctggtatttcccacaat

SEQ ID NO: 5589 - DNA, 121 bp, Artificial Sequence
  Synthesized
  misc_feature (61): n=a or t
ggtagtcacgtcctactcatcatgttttgcaaccaccatctcgttttttccagcacaggcnttcccaggtaggatggtcatgtgctatatgtcctacatgagttgatgtgacgttacagga

SEQ ID NO: 5590 - DNA, 121 bp, Artificial Sequence
  Synthesized
  misc_feature (61): n=c or g
ggcacgttaaaatagcaagatctgttcacagacctctcttctcagcacagagtgattcttngtacgcaccgaacaccaaagaccacttggctgtggcttggaaactgcatattgtagctgt

SEQ ID NO: 5591 - DNA, 121 bp, Artificial Sequence
  Synthesized
  misc_feature (61): n=t or c
tatgatctgttcataatttgtcagattttttgtgctaaatttaaaagctcattatcccagnacttcattctgacaccacatggaagatgccaatgtctacgtgcaatgcaaatactacagc

SEQ ID NO: 5592 - DNA, 121 bp, Artificial Sequence
  Synthesized
  misc_feature (61): n=t or c
gcattaatgaggacctgtactacatcccttacatgtcagctgctgggcatctgcatctcanagtgtcgtgcctaaccatgggtgcctgggcttgctatttgcagcagtgagacaggctatg

SEQ ID NO: 5593 - DNA, 121 bp, Artificial Sequence
  Synthesized
  misc_feature (61): n=t or g
ccactgacttccaaatagtaaggaggagtaccagagtcacagaggagagagtgattcctgnaccatcatgcttgttttcctgttttgtttttgttttgtttctgtggaaactactgtcatt

SEQ ID NO: 5594 - DNA, 121 bp, Artificial Sequence
  Synthesized
  misc_feature (61): n=t or c
tagatttgctgctgagagttgcatcaggatgtctatttggatgcgtgacaacacattattncaccgtaaaacatatcaataaattaattgtttgcaagttcccagcccaattttgtgcagc

SEQ ID NO: 5595 - DNA, 121 bp, Artificial Sequence
  Synthesized
  misc_feature (61): n=t or c
tgagactgaacttcctcctagaactcaacatgtactacctgcttggcaacacagtatcttnttgcaaggtaatcacatcctcaggttagaaaagaaagagttagacaattagaaaggaaca

SEQ ID NO: 5596 - DNA, 121 bp, Artificial Sequence
  Synthesized
  misc_feature (61): n=t or c
acttggttaaatcaggatcaaagaacagctcaggcagtgggtcagaggacttgtaaccttnacaataggatcaagaattggcaatctacatgacacagcttgaacaggatggcagaatgga

SEQ ID NO: 5597 - DNA, 121 bp, Artificial Sequence
  Synthesized
  misc_feature (61): n=a or g
gcaactggttagtctctcattgcctagtatgctaaagtttgcactcttttaaacctttacntcaactcagtgtccagccaggatgcagcaatgtgcatctggcacagcagaaactgctgca

SEQ ID NO: 5598 - DNA, 121 bp, Artificial Sequence
  Synthesized
  misc_feature (61): n=a or g
taggtcatgcctcttctaattatttggttttcattttctgtgtcactagcagctttctgtnctgtgtaccttgtctgtagacaaacatctgagaaactaagatataaagtggcagaaagta

SEQ ID NO: 5599 - DNA, 121 bp, Artificial Sequence
  Synthesized
  misc_feature (61): n=a or g
ctgatgtctgtttgtaaaaatgtaaacttctatagcattgcatccaaaggatagcataacngatgaaatgtttcttgagtctttgatgtctgaattaggtagtcgatgtcacaggtagtct

SEQ ID NO: 5600 - DNA, 121 bp, Artificial Sequence
  Synthesized
  misc_feature (61): n=a or g
ttaacacttaactgggaagatttgtataattcttagcacagtgctgtcattttagaggacnatctgtgaggaaatgtgatgtcttaatcagtttagtggaaaggatgatagatagggattt

SEQ ID NO: 5601 - DNA, 121 bp, Artificial Sequence
  Synthesized
  misc_feature (61): n=a or c
tactttctcagagtgtagagcaggcactaggttacaacaggcttcctacctttcttgcctntgctagtgtttcaaatatttgtgctcttcttcaggtagatttaatatcacttattgtagt

SEQ ID NO: 5602 - DNA, 121 bp, Artificial Sequence
  Synthesized
  misc_feature (61): n=a or g
tgcatgctgtacgtttaagagatgactggcagaggtgtgttctgagaacagtaacttacangtaagggactattttaaattcatgctatctttgctctagacttttggagattccgaagta

SEQ ID NO: 5603 - DNA, 121 bp, Artificial Sequence
  Synthesized
  misc_feature (61): n=t or g
cctgatgcttccagacagaagctcttgtgtttgtacccattgtctcttgccctggcactgngcaccaatgaaaagatcttggctccaccttagagtcatagaactgttaaggctgaaaaga

SEQ ID NO: 5604 - DNA, 121 bp, Artificial Sequence
  Synthesized
  misc_feature (61): n=t or c
gtactaatatgaagtaatggaactgcttgggctgctttttacttcatttctaatccaaaanttttgccagcatttgcaagaccaatagatatctgagctatatttcaagttggctctgact

SEQ ID NO: 5605 - DNA, 121 bp, Artificial Sequence
  Synthesized
  misc_feature (61): n=c or g
tggcttttaagtctgtatttgtcagatattgacaactttaagctaaatatcatgataaaantgctcaggtgaaggctaaaagtgagcttgtatgtcttcaggggagataagtcaggggatt

SEQ ID NO: 5606 - DNA, 121 bp, Artificial Sequence
  Synthesized
  misc_feature (61): n=t or g
gatgtgttcccaagcatttctaaaacttttattatctcttggcattaggaacaaggaccancctctctagtgctgctgcgttcaaagtgcagtggtcttcacatgtacagggatcagaaga

SEQ ID NO: 5607 - DNA, 121 bp, Artificial Sequence
  Synthesized
  misc_feature (61): n=t or g
tgcccttgcctggagggagcctatggtaaagagcctatggcctctttccatacctctaccntctgatgttctcatatcaagcctgatggaattagtttagcaatagttatgcaaggtcttt

SEQ ID NO: 5608 - DNA, 121 bp, Artificial Sequence
  Synthesized
  misc_feature (61): n=t or c
gtttcctcaggaaggcttcactgaaagtattcttgcctgagctgacttgatgcttttgcgngagattcaaacaacttctagtcaggacctcagggaggtaaggttcagtcactatcactgt

SEQ ID NO: 5609 - DNA, 121 bp, Artificial Sequence
  Synthesized
  misc_feature (61): n=a or t
ctctgcttccatacactctaaatgttaaccttgctttaaccttcacgcttctataaaagtncaaaagggattggaacctcccacaccctccacaaccacatgatgtcagcacactgaactc

SEQ ID NO: 5610 - DNA, 121 bp, Artificial Sequence
  Synthesized
  misc_feature (61): n=t or c
ggagctccagtcctttctctaccagaaaaggcctgaacctgcatctccaacctggttatcncaaacagcagattacgtggtgtctcagggtgggatgttctccatcttgctgcggcgtgtg

SEQ ID NO: 5611 - DNA, 121 bp, Artificial Sequence
  Synthesized
  misc_feature (61): n=a or g
gatggttcatacatcccacccaccagaaatggatcttggcttacccaatctcagccattanctgtgaggcttctaaatcacctccaaagccagtaagagagagaagtaaactcacactgtg

SEQ ID NO: 5612 - DNA, 121 bp, Artificial Sequence
  Synthesized
  misc_feature (61): n=a or c
atagaaacttaacaagacttcatagttagaccagggtagaagcttcacctgcagctcagancatgagtaagatttaacagccatgcctgtcaagttggcaagagttaaatatattcaacaa

SEQ ID NO: 5613 - DNA, 121 bp, Artificial Sequence
  Synthesized
  misc_feature (61): n=t or c
gctgggtcaaaccacaacaacacagtagatcagtaattttttgaagtacgtgcaggcctcngggaccctaagagcagctccttctccacaacctctccatgtgcctcctctgttccatcct

SEQ ID NO: 5614 - DNA, 121 bp, Artificial Sequence
  Synthesized
  misc_feature (61): n=t or c
caagtacccaccctacaagcagacatgttgctgatgagaggagataattttgacacagtgngtgactaatctctggaactcactgcctctggaaaccattgatggggggtgttggaaggag

SEQ ID NO: 5615 - DNA, 121 bp, Artificial Sequence
  Synthesized
  misc_feature (61): n=t or c
aaaataaactatgctatagtagtgcaagattgagccagaagaaattcactgtaacaacttntattgattgaatttaaaattttgaatctctcttacttgggtataaatacatcagtttggt

SEQ ID NO: 5616 - DNA, 121 bp, Artificial Sequence
  Synthesized
  misc_feature (61): n=a or c
cttctttttaaaaaaatatatataattcaaaactatgagaaaaattgcttatgagtagatncaagaataagttcccaaagaaagccacaatcctacgctctcacgtaaatctcccctcggt

SEQ ID NO: 5617 - DNA, 121 bp, Artificial Sequence
  Synthesized
  misc_feature (61): n=t or c
cttcaggagggactaggcatggctgtcgtgaagtgtgtcccagtgagctaagagactatcnttctgtagaacttctttgaaggtccagatctactcaagttctgggatgcatgtctaaagg

SEQ ID NO: 5618 - DNA, 121 bp, Artificial Sequence
  Synthesized
  misc_feature (61): n=t or c
tgggtgcaggctcctcatctgtgccagtgtctgtccttgcagtgacttcacctgcactgangttatcttcagcctgtgatgtggcagcctactgctgtctgtggcagcatttatgggtcag

SEQ ID NO: 5619 - DNA, 121 bp, Artificial Sequence
  Synthesized
  misc_feature (61): n=a or g
gaaaggtcccattctgtgaaatgctgagcatgactttccttttactcctgcaagaatcagngactttcaggctccctgtagtccaaattcctactgacctcacagtttgattataaaggca

SEQ ID NO: 5620 - DNA, 121 bp, Artificial Sequence
  Synthesized
  misc_feature (61): n=t or c
ccggaggagacttcccacacccacaggactcacctaacccagaaaggcctggaaggagcangcagatgttccctatgccggagtacccagtgtgagcacttgatgttcaaacaggcactga

SEQ ID NO: 5621 - DNA, 121 bp, Artificial Sequence
  Synthesized
  misc_feature (61): n=t or c
atgtccatgagactacaagaagaatcagacaggcctcgtgttctgctcagtgccactgcgntctgactgtgcctgtggacatgtgcccgcagcacagagcttccatcttcaaatgaaggaa

SEQ ID NO: 5622 - DNA, 121 bp, Artificial Sequence
  Synthesized
  misc_feature (61): n=c or g
tcccttctctccctttaccttcttaagtcctctgcaactccagtaggagtttggtgggganaacacagctgccacagctgactcccagcagaatcagcgtttcacagtactgctggctctg

SEQ ID NO: 5623 - DNA, 121 bp, Artificial Sequence
  Synthesized
  misc_feature (61): n=a or g
acatgatgatcatttccctcacataaaatgcaaaactaagacacttgtcctgaactataancatagaaacatcaatatagaaaacatcaccatgatgtatttagtgctgtaatgcaacggt

SEQ ID NO: 5624 - DNA, 121 bp, Artificial Sequence
  Synthesized
  misc_feature (61): n=t or g
cttagctggctaccatggtgcacacacacacacgcattgcaaaagctacatctttcaatantctgaagcattatagttatctgaagaaaccagaacttgaaacctactatttgcaacaaga

SEQ ID NO: 5625 - DNA, 121 bp, Artificial Sequence
  Synthesized
  misc_feature (61): n=a or g
acagctctgaagaagcacttatgctcatgacaagctatacagccaaggaagaacacatccntagtgtcaaagacatgagccttgctcatgtaactgatagtaaatggacatctatttcacc

SEQ ID NO: 5626 - DNA, 121 bp, Artificial Sequence
  Synthesized
  misc_feature (61): n=a or g
ttctgaggatcccctgaaataccaaagctacatttgcttatgtagagccaaagcacaaccnaagtgtgggagaagttatgtgggatagcctgagcaagctggaaacagaattctgtgcctg

SEQ ID NO: 5627 - DNA, 121 bp, Artificial Sequence
  Synthesized
  misc_feature (61): n=c or g
gctttccctgtgggacttctgcccagctttgctgctggctcatggggctgtctgtgcctgngctctcttatcttctgcagcgcaatatatttacagggtttgtacctctgggctgtagagg

SEQ ID NO: 5628 - DNA, 121 bp, Artificial Sequence
  Synthesized
  misc_feature (61): n=t or c
attgagttcactgatccaacactataaggctgtcaaagtgtatcacctccaagagtgcctnctctagaataactgagaaaaccaaggagggcttcatagttttgattctcaaccttttctt

SEQ ID NO: 5629 - DNA, 121 bp, Artificial Sequence
  Synthesized
  misc_feature (61): n=t or c
aactttcaatattgaccccaaagaaatggcccttagctggcttatattgaaagcatacttnactatgtccctttgacatcttcattctgttaaggatttttttctaaatacatactaacaa

SEQ ID NO: 5630 - DNA, 121 bp, Artificial Sequence
  Synthesized
  misc_feature (61): n=a or g
tatctacagcaagtcctacagcagtgtgggagatttcactgttacaaagttatactaaacnggattgttccattactgtcaaactatgtggatgtaagactacatttctctgtgagctaca

SEQ ID NO: 5631 - DNA, 121 bp, Artificial Sequence
  Synthesized
  misc_feature (61): n=t or c
cttttaggaagatgccataaagactactttacttcattttccattttgtaacttgctcacntcctgatgaatgccaggagaaatgtcataattcttggaggtcactttcttctaagcttgt

SEQ ID NO: 5632 - DNA, 121 bp, Artificial Sequence
  Synthesized
  misc_feature (61): n=t or c
ggtgctcgcgtggtgctggggaaattacgaaccaaaataaaggggagcagagaggagcttnctaaccaagctctcgagtttcatgaaggttataggaacatgcttggttttgaggcatctg

SEQ ID NO: 5633 - DNA, 121 bp, Artificial Sequence
  Synthesized
  misc_feature (61): n=a or g
taaagtgctgactagctagagctagaaaaacctggacactgatgtctctgctcagctaganttatctattgattaactgttttccgaaacaaattccttatcctctgacaaacaattcttc

SEQ ID NO: 5634 - DNA, 121 bp, Artificial Sequence
  Synthesized
  misc_feature (61): n=a or g
atgttctggatgcacctttatctcatggactttttattaaatttgtgtgatggtacagctntaatggagcaagcaagatcactaggtgagcaggtacacgggtggtcttcaccttagccaa

SEQ ID NO: 5635 - DNA, 121 bp, Artificial Sequence
  Synthesized
  misc_feature (61): n=t or c
ccgcacagcatcacagccatgtaccggctgtgcacagagctcctgcccatgccacattccngatactcactttccttgggagaggatttgctatccactgtccttttgctgctctaatccc

SEQ ID NO: 5636 - DNA, 121 bp, Artificial Sequence
  Synthesized
  misc_feature (61): n=c or g
atacatatgtataagataacattctcactctatccaaagggacgtatctctgatgagtagnttatgcttttctatatatatacatttcttatcctattaaaggaaatggaggcctacctct

SEQ ID NO: 5637 - DNA, 121 bp, Artificial Sequence
  Synthesized
  misc_feature (61): n=a or g
gcagataaagccatagttaaatgtctctctcaacagacagaaaagacagctctgtttgaancatgctcgtgcctgtggctctgaagccactggttttgatgggagaatgattgctccatta

SEQ ID NO: 5638 - DNA, 121 bp, Artificial Sequence
  Synthesized
  misc_feature (61): n=a or c
ctgtttgtacctgagggtgaaaataattctgatgatttgacacagatattttgaaggtagngaattgttgtgggggaaataaaagtaaaatgtatagtgggttattaaggacatgcagttg

SEQ ID NO: 5639 - DNA, 121 bp, Artificial Sequence
  Synthesized
  misc_feature (61): n=a or g
cgttcaagccacagatatggaaggcaatcttaactatggtctctcaaacacagcgactgcnatcattacggtgacagatgtgaatgacaacccccctgaattcacgaccagcactgtaagt

SEQ ID NO: 5640 - DNA, 121 bp, Artificial Sequence
  Synthesized
  misc_feature (61): n=t or c
accagaaggctgtgtgggtgagagaaagaaatgagtaatgatttggaatgggggttcatanacttcaggttttgtgcttaggctgaagcagaagctgcttacttataaatgtaggaagcct

SEQ ID NO: 5641 - DNA, 121 bp, Artificial Sequence
  Synthesized
  misc_feature (61): n=t or c
aagcaggcctttaccttatataaaggatataaaagagatataatttgttatcttaacctgnaatgagatcagcaaagattttaagcccctccacagcctactcactgttccactgtagttc

SEQ ID NO: 5642 - DNA, 121 bp, Artificial Sequence
  Synthesized
  misc_feature (61): n=t or c
ttcttcatttaacccagattcgtttaataggtattcacaaaatgagtacccatttcctcangaatttttgctctttcaagacaaatttcttatggtatgtcacatttccatctcatgcaca

SEQ ID NO: 5643 - DNA, 121 bp, Artificial Sequence
  Synthesized
  misc_feature (61): n=t or c
aacaatttactttcagacctcgcccactgttctcctgcctttatgctactgacctctctgngagctgttctgcctgacttctgtagggtccaaccgagtctgagggaatattaaacaattc

SEQ ID NO: 5644 - DNA, 121 bp, Artificial Sequence
  Synthesized
  misc_feature (61): n=a or g
tctgcttccaggtgtggattttgtaactggaaaatacacgtaccacacaaactctttcttnaatacctctggatttgaaaacctcggtggttaagctaagaactctgttagaagaagaaga

SEQ ID NO: 5645 - DNA, 121 bp, Artificial Sequence
  Synthesized
  misc_feature (61): n=t or c
tttggttgcctttgtgcagacctgttaaataagtgtattgtgctggggcaaaaaggaacangcaccaattcagctgtgtaattaagagcgttcggttgtacaccgctgcagtcaatctgcg

SEQ ID NO: 5646 - DNA, 121 bp, Artificial Sequence
  Synthesized
  misc_feature (61): n=a or g
actttcctaaataattagcacaaagcatccacttctgcacacaagctttattggttttacnaattaataataggaacgaatctcgtgtaataggtttgaggcattgagtttacatcacttc

SEQ ID NO: 5647 - DNA, 121 bp, Artificial Sequence
  Synthesized
  misc_feature (61): n=a or g
tctgaccatgggtgcgtattgcagtgtaattttacagcatttatgtgtattcatcccagtnaggaagcctcaaatgtaatgtgttacctaaacatccgctctttaaacaaaacatctgtac

SEQ ID NO: 5648 - DNA, 121 bp, Artificial Sequence
  Synthesized
  misc_feature (61): n=t or c
cccaaatcactgcaattgttcctaccactcagcagaataggacttgttaaaacacctcccnggtgctctgggctagcatccctcggcacggggccacacgcttgccctgcagaggtaatta

SEQ ID NO: 5649 - DNA, 121 bp, Artificial Sequence
  Synthesized
  misc_feature (61): n=c or g
tcaaaggggaaaaaaattgcacttataaaatatcattcttctcttggaagaatctacaatnctaacctccatatgtctcatctgcctgtcaggctccaacaagctttcagacaggctgcac

SEQ ID NO: 5650 - DNA, 121 bp, Artificial Sequence
  Synthesized
  misc_feature (61): n=a or g
ggttttcccaaagtattttccttttctgggcaaatagtagaggagtcctacacaggatggnagcagaatcccatatcagtgtggagataagctgtgataagaaatgagaactcagtgaatg

SEQ ID NO: 5651 - DNA, 121 bp, Artificial Sequence
  Synthesized
  misc_feature (61): n=t or c
gttcttttagatgaatacaaggccttgaggctgtgcaaaaacagccccgaagcttttatangttcctttgggaagattttaacagatgttttattttcatctttttctgtcttttttttct

SEQ ID NO: 5652 - DNA, 121 bp, Artificial Sequence
  Synthesized
  misc_feature (61): n=t or c
aagagggcattttgggtagaccacaacaggagtttttgatgtaaaagcattctattttggncagcgtaaatggttcccaccagacatgagccacagacatgactattgctatgaacaacac

SEQ ID NO: 5653 - DNA, 121 bp, Artificial Sequence
  Synthesized
  misc_feature (61): n=c or g
aatcacttgttaagcacaaggctgccaaaatcattaaaacacaacagtcacctgtaccagncagttgtaaaactgtttcaaagacactccatcaaacatctttatacttacagtagcctag

SEQ ID NO: 5654 - DNA, 121 bp, Artificial Sequence
  Synthesized
  misc_feature (61): n=a or g
cccatcctgggactgacacaaagtcatcccgtgcagccagacaaggctgctttggtaggcngcacatccagagcgagcggcagcacttcggttcccgttacggaccgggattgctgccgcc

SEQ ID NO: 5655 - DNA, 121 bp, Artificial Sequence
  Synthesized
  misc_feature (61): n=a or g
ctgcaatagtaaaaggcagctttcagtgagatgcccagcaggaacgctggcttccaggacnccaagtcactgttatctgctgattctcatcgtaaatgtatctatgaaagtcttcaaagaa

SEQ ID NO: 5656 - DNA, 121 bp, Artificial Sequence
  Synthesized
  misc_feature (61): n=t or g
tcactctaacagatttaaaatattcacaaaacataattgtaagttctgctgtacaaaaaanacaagattgctgcatagttactgggtgatccagaattaaaagctgtgggtgcagacagac

SEQ ID NO: 5657 - DNA, 121 bp, Artificial Sequence
  Synthesized
  misc_feature (61): n=t or c
catgggcacacaaacagtccttcctagtgtaagtggaagagaaacctcaaccttaataaangcattactactatgtcatcaattaaaagaaaagagtcaacagggttatctccctctttat

SEQ ID NO: 5658 - DNA, 121 bp, Artificial Sequence
  Synthesized
  misc_feature (61): n=a or t
ctgcagaactgccggtgccatccaaggtgtgcactgactgctgctctcacctgtgcagttnaacagaaggcagcttttctgtgtcctcagatagctcatcttcccttttcacctgccagtc

SEQ ID NO: 5659 - DNA, 121 bp, Artificial Sequence
  Synthesized
  misc_feature (61): n=a or g
ggctgcatgtgactgtggagcttccacagggcactgaaagaaaccctgagaacaagtgcantacgacagcttgctgctggcctttgtttaggggtatgttatggagttgctggagtagctg

SEQ ID NO: 5660 - DNA, 121 bp, Artificial Sequence
  Synthesized
  misc_feature (61): n=t or c
tcttcatgtagcccaatatctttaaaggtggtctttacagaattattcttgcagatgccangtgtcagttctttgtaaatagtagtggattggaagtggtatcctaaaggtttcagacagt

SEQ ID NO: 5661 - DNA, 121 bp, Artificial Sequence
  Synthesized
  misc_feature (61): n=t or c
gccctatgcaaccccaagccctgggctgcgcatcaatgggtgctgtgggaatggaaagcanggcccaatcccattgcaatacccctcaaaagcatcaagttggcctttacctagcaaaaat

SEQ ID NO: 5662 - DNA, 121 bp, Artificial Sequence
  Synthesized
  misc_feature (61): n=t or c
caggttggaaaagaccttaaagatcattgagtccattcacacagatgtgcgcaaacatgantgagcttcatgacagatgggcagcatgtcagcaggacactgctcccatctttggaacctt

SEQ ID NO: 5663 - DNA, 121 bp, Artificial Sequence
  Synthesized
  misc_feature (61): n=a or g
gtgccttactgcacccgcttctccaggaccctctagaaagtaagcagacactcatagtgcntttcactcctttctttgcaccccaaatgtgcactgggtttgcctgatggaggcagcagct

SEQ ID NO: 5664 - DNA, 121 bp, Artificial Sequence
  Synthesized
  misc_feature (61): n=a or g
tcctgactaagtcaattaattgacttcagtttgtattttccaagtatctcgctgaaagccntaacatccaggctgaggcattctccaagaacccatcatatccaataaagccaagatcaag

SEQ ID NO: 5665 - DNA, 121 bp, Artificial Sequence
  Synthesized
  misc_feature (61): n=t or c
tctgcagaagagacctgtcctgctcggtgtaatctatgctcacagcactgatgtgtaaccntggcatggagtgaataacagcagcaacacccgtgcactcctggtgctgcagctgcagctt

SEQ ID NO: 5666 - DNA, 121 bp, Artificial Sequence
  Synthesized
  misc_feature (61): n=t or g
tgctccactcctcacatcctgcagaaatcagattacacacttactgtctgcaggcactgtnactgacctgcaggtggatcattagcactgactgcagcctatctttagcttcttaaggcta

SEQ ID NO: 5667 - DNA, 121 bp, Artificial Sequence
  Synthesized
  misc_feature (61): n=t or c
ggaggctttgctcccatccgagccccagggagcagttccaagcagccgtcctcaggcacanaagcaaagcacagggcatcacactgacagaccctgagcccactttccacgcatctcctgc

SEQ ID NO: 5668 - DNA, 121 bp, Artificial Sequence
  Synthesized
  misc_feature (61): n=t or c
agagggcagtcaggcacctctctgaatggagccagggtccattcctgatgtatggcacctncagcagttactctgtgaaacaactgaccatatctctatcttttctgccacagctcctgac

SEQ ID NO: 5669 - DNA, 121 bp, Artificial Sequence
  Synthesized
  misc_feature (61): n=t or g
tagatgtccaattaaatcagattggtcaaaggaataaaatattttgaatatctatatgagnctttcaaagagctcactataagagaacagccacaatctgttattaaaagaaggactgtta

SEQ ID NO: 5670 - DNA, 121 bp, Artificial Sequence
  Synthesized
  misc_feature (61): n=t or c
tcagatttcactgaggatgtcaacaataaacagtcttttcaggtatgtcctcgctggaganagaagcatctgcataatctcaaatcaaaacccaacagtgcaaagaagagggttcaacagg

SEQ ID NO: 5671 - DNA, 121 bp, Artificial Sequence
  Synthesized
  misc_feature (61): n=c or g
gggccgggcggggctggaagtgcggcgggggatctgcgaggaatcgctgtcggaggagagnttagatcagtacgagtttgacttaaaataacaatcctgatctcttaggggctaagaagtg

SEQ ID NO: 5672 - DNA, 121 bp, Artificial Sequence
  Synthesized
  misc_feature (61): n=a or g
cattttagaaagatctcttgcaaatctcatccgatctatgtgagaaacaaggatgattatngtggtttgacagcaaagaaaaatgttccttattaattttttttctttgggggaaaaaaaa

SEQ ID NO: 5673 - DNA, 121 bp, Artificial Sequence
  Synthesized
  misc_feature (61): n=t or g
gtgagcaaagagtaaaaggatttgcccagggagtgggagacagagctcagctccttgctcngaaggtaccagacggttgtgttataaagccatgctccagccatctgtctgctctgctatt

SEQ ID NO: 5674 - DNA, 121 bp, Artificial Sequence
  Synthesized
  misc_feature (61): n=t or g
tcaacgtgttgctaggcagactatccggctccaacttttattcctgctgcacgtgggagcntaggtgaaagtgttgggaaaacaagtgctgggaccagcatgggagcactgaaaggaatgg

SEQ ID NO: 5675 - DNA, 121 bp, Artificial Sequence
  Synthesized
  misc_feature (61): n=t or c
tccctacaactgtgggcaccaggaaaatcaagacctgtaacacaatgtaacacaaccatcnccagttccactgccttggagcaggtttgttctcatcgcaggtgggaagagagctgagcag

SEQ ID NO: 5676 - DNA, 121 bp, Artificial Sequence
  Synthesized
  misc_feature (61): n=t or c
agcaaactgggaagaaagggtattaatctttaggtcacttcagagttcctgagagtaattnggttttacttttccaactcacttctgtcttgcagaactttggctgtttcagtgccatgtc

SEQ ID NO: 5677 - DNA, 121 bp, Artificial Sequence
  Synthesized
  misc_feature (61): n=a or g
aggtgggaccgagggcttttatagtagcaggctatcaaaggaacgtgaggaatgcggggtntaaacagattagatctttttccccttcttgtagaaaggcctaggtttcttccctttcctc

SEQ ID NO: 5678 - DNA, 121 bp, Artificial Sequence
  Synthesized
  misc_feature (61): n=a or g
agccaagcaaagaataaagcaagaaacagcaaaaccctcatttcctcagccctctgttcangggatggatcgtttctgaaagaaggaaaaaaaaaataagttacagcaaaggaagcaacaa

SEQ ID NO: 5679 - DNA, 121 bp, Artificial Sequence
  Synthesized
  misc_feature (61): n=c or g
ccccacctctggaagggccctattgctccagcgtgacctgggtggatggagacatgagggngactaagcagtgagtttgacagtggatggggaaaagaataaatggcattttttttttgca

SEQ ID NO: 5680 - DNA, 121 bp, Artificial Sequence
  Synthesized
  misc_feature (61): n=t or c
tctgcggggattgggagctcaggataagacaaccagcattaatgaaatcctggcggtgctngggaacgttattcattactgcagccctcatcaacagcccctcacccaaaagaggtggggg

SEQ ID NO: 5681 - DNA, 121 bp, Artificial Sequence
  Synthesized
  misc_feature (61): n=a or g
aatggagaaccaagcagcaccagatgctttcccataacaaacccatcctgagggtggtccntgcacttgcaaacagagaacactgagcaaagtagaacagttaattaaactggcctgactt

SEQ ID NO: 5682 - DNA, 121 bp, Artificial Sequence
  Synthesized
  misc_feature (61): n=t or c
atcgtcatgaaattccctagaaatattctgcatgctataaaaacagcgtctggaacacagngctttcccaaatctggcccactcgccgactttgatacagtcataacataaccacaaaacc

SEQ ID NO: 5683 - DNA, 121 bp, Artificial Sequence
  Synthesized
  misc_feature (61): n=t or c
gaggtgattaatcaggggcttagaaatctccaatagaagacatcgtagaaacagtgccacngtggaaccagaggaacagcaaagtaccactgagatcgtgagtcagtgcgtggaattgcgg

SEQ ID NO: 5684 - DNA, 121 bp, Artificial Sequence
  Synthesized
  misc_feature (61): n=c or g
acaagttaggctaaattctcaaagtttattttccaaattgactctcctagttcccatgtangcaaggagggaaacaagtttgctccactaacaaacatctcacaggctgcactccggcatc

SEQ ID NO: 5685 - DNA, 121 bp, Artificial Sequence
  Synthesized
  misc_feature (61): n=t or c
gtgataatggggaacatcacacaggatggtggagttaattcaggtgctcattaaatcactntgtgaagagacatcgcttgtggctgggagctgataatagctgaggcctagagtaatggtt

SEQ ID NO: 5686 - DNA, 121 bp, Artificial Sequence
  Synthesized
  misc_feature (61): n=t or c
atgagacagcccccgtgtacccgagtcattcaccttcagcagcttggcaaaggcttccaancctgaaacactgcggggctgtttttactgctgccgaagccatacaagtaattactattcc

SEQ ID NO: 5687 - DNA, 121 bp, Artificial Sequence
  Synthesized
  misc_feature (61): n=a or g
taatagaagatggaaatggctgcaacagaaaacaagtgatatcagagcacacagctcctcngtcctgctggggatgctaatgtcatgcagacctgctgtagcccacccagttcaacagact

SEQ ID NO: 5688 - DNA, 121 bp, Artificial Sequence
  Synthesized
  misc_feature (61): n=a or c
agaaaagtgactttgcattttcttttagaactaacttgacaaatcagtaaatgttagcacnacagcttagtatagctcaggcagagagggcaggttatgcattttgaaatgaagacttgtt

SEQ ID NO: 5689 - DNA, 121 bp, Artificial Sequence
  Synthesized
  misc_feature (61): n=t or c
ctgggatgctcgtggttatgttcagacaccagtgggctgtggtgtgcagtggcactgaccngggagaggctcctgctcttctggatgcccttcctgctgctcatccatgagtgaagtgagt

SEQ ID NO: 5690 - DNA, 121 bp, Artificial Sequence
  Synthesized
  misc_feature (61): n=a or g
taaactagggagagaactgacttgatgaggtgcagtgagaactgagggaacacaagtatcntcactgagatggagctgctctctaatctaaatccagattagataaggttgcacttatcat

SEQ ID NO: 5691 - DNA, 121 bp, Artificial Sequence
  Synthesized
  misc_feature (61): n=t or g
tgaagagtgagatctgagctcctggctcaagcgtggggacaggacttggaataagaggggnaaactgaggcaaagaacaggaggatgatgcttcactttgagccagcaaccacaaaccaag

SEQ ID NO: 5692 - DNA, 121 bp, Artificial Sequence
  Synthesized
  misc_feature (61): n=a or g
gctgaggacttcatgataaagcaagaaaataaagtggcatagtgacaaggacaggctaccntggatgcattccctttggagagaccaacaggaggaggaaaaaacagctgcttggaaatca

SEQ ID NO: 5693 - DNA, 121 bp, Artificial Sequence
  Synthesized
  misc_feature (61): n=t or g
ggaggaccaagcagctaacagatgttccaaagaggagagagactcaatcccacatcagcantctggacatgaggacttggagatgttgagccattgggatagaacacctcacaaccccctc

SEQ ID NO: 5694 - DNA, 121 bp, Artificial Sequence
  Synthesized
  misc_feature (61): n=a or g
ctcaatgttctctagagctcccttccaacccctacaattccctgattctgtaacttgcatntacaggctaaaatattgcatgatctgatataaactttttctttccaaccacagtggtcct

SEQ ID NO: 5695 - DNA, 121 bp, Artificial Sequence
  Synthesized
  misc_feature (61): n=a or g
aaaaaaaaaaaaaaaaaaaaaaaaaaaaaaaaaagtttaatatatagggaaatataatagnatctggaaattgtgatttaatttccccttttcactttttgtacatgttagattggtttgg

SEQ ID NO: 5696 - DNA, 121 bp, Artificial Sequence
  Synthesized
  misc_feature (61): n=a or g
atccttcatcccttgtcccatctgcattggcacgaggatttatatactaacaacgatacantgatcaaggatctgatctggattaaagttaagctgagaaaaaaacgtttctaatgatgca

SEQ ID NO: 5697 - DNA, 121 bp, Artificial Sequence
  Synthesized
  misc_feature (61): n=t or g
tccaacatggaatagtttatgagtctatgattctacacagcaaatccaatggatccaatgnaactttatccttcatcctggtaccatctctgattttcctcatcctgttgcttttactctc

SEQ ID NO: 5698 - DNA, 121 bp, Artificial Sequence
  Synthesized
  misc_feature (61): n=a or g
gttaatgcctgtgtaattacgcatgcacacagtgccctgcactgggtgttgcttaattccntgctaaactaaatgtctgtatgctgtgcaggatggatttatgtctctcttcgcaaatgct

SEQ ID NO: 5699 - DNA, 121 bp, Artificial Sequence
  Synthesized
  misc_feature (61): n=c or g
tggtactcagttttgaaaggtgcaacaacagctgccaatgttgtaattactgctgcactanagagaaatctcagatcccagtgctatcaaagctgcaccttccaccagctctcacttcaca

SEQ ID NO: 5700 - DNA, 121 bp, Artificial Sequence
  Synthesized
  misc_feature (61): n=c or g
tccatatattttgttttctaaactaatcaaaaggaaataaaacagagtcagctgaagtctncactgtttatttatttctatgaatgtcatttcccaaatgtaactttttctatcccctctc

SEQ ID NO: 5701 - DNA, 121 bp, Artificial Sequence
  Synthesized
  misc_feature (61): n=t or c
gttgagtccatgcacctgcccaccaacttctactgcagaccaaaaatgccatgatttcagnccagatttgtggcattctctctgctttctcacagaaaaccccttccttcctccttcagcc

SEQ ID NO: 5702 - DNA, 121 bp, Artificial Sequence
  Synthesized
  misc_feature (61): n=a or g
gcctcagttgttggcttcagcagctttgggttgtgaagacgccccctctaatacaccaccncaatcactttttgatgcaacactattattattactataaggctgctgacttctcctggtt

SEQ ID NO: 5703 - DNA, 121 bp, Artificial Sequence
  Synthesized
  misc_feature (61): n=a or t
aaatactaagtgttgcccttctggcaatcacataatctcttctaactatggatggatcttntacacctagacgacacgtagacatttgcacattaacagctaaatttggtgccttattcag

SEQ ID NO: 5704 - DNA, 121 bp, Artificial Sequence
  Synthesized
  misc_feature (61): n=t or c
aaacacagaactccaaacaaaatcctccatgtggccaatttcctcaggtcaaggcatttantctcatttgaacgggcaaacatctaacccaaattattactattctgtaggcacccagaca

SEQ ID NO: 5705 - DNA, 121 bp, Artificial Sequence
  Synthesized
  misc_feature (61): n=a or g
taaaggaaagctgtcaatagggctgatatggttatcattgtggatcactatttgggaaatnccgatgtagttaagccagttttggatctgaaaaagcccgaaaagcaacaccagagagcta

SEQ ID NO: 5706 - DNA, 121 bp, Artificial Sequence
  Synthesized
  misc_feature (61): n=c or g
ctgaaagcaaaaaagttggctttacttgcaacagtgctttactacttaacaagcatagccntgatcatgcagggagacccttgcaggcagattgcagaattcaaggcctaaattaatattg

SEQ ID NO: 5707 - DNA, 121 bp, Artificial Sequence
  Synthesized
  misc_feature (61): n=t or c
gccaagagacaggtttgtttttgcttgcgttttgtcactttgacggttgagacagtcacantgaaatgcaaggaaaaaactgcaagagctagaagcagattatgcttctggcatttcgctt

SEQ ID NO: 5708 - DNA, 121 bp, Artificial Sequence
  Synthesized
  misc_feature (61): n=t or c
tctgcagaaaaagctcagtgccacagccttcagtttcatttgattagctgtctggcttctntgtatatctaagactgctaatgaatttatattttatatttttacctgctcataagtcctc

SEQ ID NO: 5709 - DNA, 121 bp, Artificial Sequence
  Synthesized
  misc_feature (61): n=a or t
cactatgggaagcagttgggcagcgctgcacagttcttcctgctgttggtggccacaaacnactttacaatagcaggtggtgtttggctacatctccaaggacagctctgtgcagctgctt

SEQ ID NO: 5710 - DNA, 121 bp, Artificial Sequence
  Synthesized
  misc_feature (61): n=a or t
caaaacttacattgttctttgtttcttgtatttacccagcactggagaataaaaagcttgnctgaatggttctgctttgatattgcttctttaagccattactaaggggttcttacacagg

SEQ ID NO: 5711 - DNA, 121 bp, Artificial Sequence
  Synthesized
  misc_feature (61): n=c or g
agtgtctactgtggggttgagctcattccccaccccataagcacagcaaagggatccaganctcaacctcagcccaaagcaatgctgtaggaaggggagtgggcagggatggcccaggaga

SEQ ID NO: 5712 - DNA, 121 bp, Artificial Sequence
  Synthesized
  misc_feature (61): n=a or g
gtaggtattcaatcttatgaactgaaagggtgtttgatattaaaacttaggatttgtaggntaggtgtatgaggttgtagtgtttacttgttttaaagatgaaaaaagtagatacaatagg

SEQ ID NO: 5713 - DNA, 121 bp, Artificial Sequence
  Synthesized
  misc_feature (61): n=a or c
attagtttatgcaattcagaagctttgaatagtagagtatattaaaaatcagaaaacatanggctcatgtgtgcgtgtgtactgctacaacacccgagggaagattttaagcaaaaaagtc

SEQ ID NO: 5714 - DNA, 121 bp, Artificial Sequence
  Synthesized
  misc_feature (61): n=a or g
tcctaacaacatgcaagtcagttgtgctttggtgtagcaacacagggcttctgcagcagcnctcctctgatactgtttttctctaaaaaataataagatttccaggaccaataacgatatc

SEQ ID NO: 5715 - DNA, 121 bp, Artificial Sequence
  Synthesized
  misc_feature (61): n=a or g
tgtgggtgctgcatcccaaagcagacatcattgcaaagccagcagagcccattagatgtgntactcatgctggaagtgatgcttgggttcttgtggaggagaacagaataatttaaatctc

SEQ ID NO: 5716 - DNA, 121 bp, Artificial Sequence
  Synthesized
  misc_feature (61): n=t or c
aacagtgaagcagcagtgacagggcagaacagcttatgctactcacgacagtattctccanagagagagagggaaatgaatgcaaggagcagacgaagtgcaggtgaggctgcctatgagg

SEQ ID NO: 5717 - DNA, 121 bp, Artificial Sequence
  Synthesized
  misc_feature (61): n=a or g
ttttctttgccatgtgcatcatccatgtggtagtcagtctacttggttactttgaccagantatcttcagcagaccagatctcctccccagaaccacagtacctcattttttattattttt

SEQ ID NO: 5718 - DNA, 121 bp, Artificial Sequence
  Synthesized
  misc_feature (61): n=t or g
cgactcctccagctgaaagaccattcatttctcttccaacctatatccagtgttctcagtnctggaagagaggggcagcatgacttgaaacatctccaccagtgcttctactctgcacagc

SEQ ID NO: 5719 - DNA, 121 bp, Artificial Sequence
  Synthesized
  misc_feature (61): n=t or c
gttcaagtcagagtgaaggggatggcctgtctaatggctcttcttcagctcttgactccanggttccaccaaaactgcagaaggaacaccaccgacaaacaatataaacaactgaatcatt

SEQ ID NO: 5720 - DNA, 121 bp, Artificial Sequence
  Synthesized
  misc_feature (61): n=a or g
attcctgaatgctagaaggactcaacttacacagtcgtatttgtcctttctccacaggacncccacttctctgaactgcatgagcattcccttcaagttgccaagagccaaggatgcaagg

SEQ ID NO: 5721 - DNA, 121 bp, Artificial Sequence
  Synthesized
  misc_feature (61): n=t or c
tgacataagagatttcaacccagatccagaggtaggatgcagtcatccgggtctcaggctnccaagagtgtctgatgtctctcctgaaggctgaggggcaatggtggcatcacgtggggaa

SEQ ID NO: 5722 - DNA, 121 bp, Artificial Sequence
  Synthesized
  misc_feature (61): n=a or g
agcattagggaagcattcattctgtatgggagaaggaatgcagaatggtaggaggtctccnccctcataggttgtcctaaccttgacacagccgacctgctctggtgccaagggcagccca

SEQ ID NO: 5723 - DNA, 121 bp, Artificial Sequence
  Synthesized
  misc_feature (61): n=t or c
cagccctctgagaaaggaacaggctggagagacgagtggcaccagaatgccttttacaaanggtacctgggccgttcttattaacgatgaactcttattcattattattcttactaacaat

SEQ ID NO: 5724 - DNA, 121 bp, Artificial Sequence
  Synthesized
  misc_feature (61): n=t or c
ttcagaacaatgaaaccaaattcacagacagaaatagagttagtggtagaaaagattaatnttgagtatcaagctgagtatttcagacatctgaattaaaagcacagctcttcagtctccc

SEQ ID NO: 5725 - DNA, 121 bp, Artificial Sequence
  Synthesized
  misc_feature (61): n=a or g
gggatggtggcactacagatgtgtcctttgtgctccatggagataattaaaggcagtcccntggcagggaaataagagaagcttataaaaaacatttgcacggctctttttaatctgtaat

SEQ ID NO: 5726 - DNA, 121 bp, Artificial Sequence
  Synthesized
  misc_feature (61): n=t or g
gggtcaaatctatccagagagctggggctgagggatagatgttagactttcagatgcatanatgtagtgaataattgattgcacttgttattttgggtttcttcacttgatccagggtcaa

SEQ ID NO: 5727 - DNA, 121 bp, Artificial Sequence
  Synthesized
  misc_feature (61): n=a or g
acttttttttttttttttttttaacactgtgaggtgtgcagttgcatctctttgggctctnccaccacacaaacttctgctgctgaagagcagggactgctggaggccactcagacccgct

SEQ ID NO: 5728 - DNA, 121 bp, Artificial Sequence
  Synthesized
  misc_feature (61): n=a or g
aagccacaatgtcataaactgactctcttccaacttgtttgttatgatctacattagctgncctgcatattgtggtgttggaggcaattttagtagtttagaagatatatagatcctctca

SEQ ID NO: 5729 - DNA, 121 bp, Artificial Sequence
  Synthesized
  misc_feature (61): n=a or g
tacctttgttaggaaaggatcagtcaccctctggtaaactcatctcttgctgcactgaccncaaagggaacacagaaaacctgatcttagtgttgcatgaactgaaaggtttggttggatt

SEQ ID NO: 5730 - DNA, 121 bp, Artificial Sequence
  Synthesized
  misc_feature (61): n=t or c
ttgctattggcaaagaaggcaacaaacaggagatgacagacatacactcagcactgaaaangttgggatgacattaggattttcttcttattatcagtgatagagtaactacgctggaaag

SEQ ID NO: 5731 - DNA, 121 bp, Artificial Sequence
  Synthesized
  misc_feature (61): n=t or c
aagagctgcaattcatgcccgttcataatgacccatttctcctaaccccatctcaacatcncccagaagtagttagcaacaagagtacactgccagccaggaaagcagagccagcagcgga

SEQ ID NO: 5732 - DNA, 121 bp, Artificial Sequence
  Synthesized
  misc_feature (61): n=t or c
caattattttcacaatagaagtttcttttacttcaatagctcaagtgcccacctagtttgngtcaaacaaacccagtttggtaatacaaacaaacatttttcttggtgcttgaatggaggc

SEQ ID NO: 5733 - DNA, 121 bp, Artificial Sequence
  Synthesized
  misc_feature (61): n=t or c
ttgagatgccagtcagttacagactatacatctcttcctctcattacgttttagattcagngcaaatcactcagtattataagatttatttctgctcgtaagatagatttctgctaatttt

SEQ ID NO: 5734 - DNA, 121 bp, Artificial Sequence
  Synthesized
  misc_feature (61): n=a or g
caaatcatttaatttaggtcattacatcagctgaagatacagccctctttttacctgaaantcatctgaaaggagaccttcagcattatggatctggcaacagtgcagtcccattctgtga

SEQ ID NO: 5735 - DNA, 121 bp, Artificial Sequence
  Synthesized
  misc_feature (61): n=t or c
tttccttttgaactcctaaaagctgactgaaaacattttagccatcacttgtaattccacntggtcataaaatgcttccagtgctatgtttcttgacctatttagaggcagcaaagacagt

SEQ ID NO: 5736 - DNA, 121 bp, Artificial Sequence
  Synthesized
  misc_feature (61): n=a or g
ctttggagaattcaccattggagatgataagtctctggtaagcacacaccgcgggctcctngtgcatcagcagttcaaatcactccatgacaccaggcagcatctccattccaaatcagag

SEQ ID NO: 5737 - DNA, 121 bp, Artificial Sequence
  Synthesized
  misc_feature (61): n=a or g
tgtgattttgtattattaaatcattcataaactgcctcattgattcttaaattttccagangctgttgctttctgtgcctcatctgcagcctttaagagtttcagtgattctgggagtgct

SEQ ID NO: 5738 - DNA, 121 bp, Artificial Sequence
  Synthesized
  misc_feature (61): n=a or g
gtaaagactccaatcctaatttgccacgtactaggcaggacccttgataaattcctctccnatacaggttctaacaaagctgcagtaacagagactgaaatactactttaaatcctatttt

SEQ ID NO: 5739 - DNA, 121 bp, Artificial Sequence
  Synthesized
  misc_feature (61): n=a or g
taatagtaataatctgtccaacactttcctaaaccttataggcttctggaggtaatactgntgctcactgttcatgttttatttcagattttcaagtcctgtgacaagagaattaatagga

SEQ ID NO: 5740 - DNA, 121 bp, Artificial Sequence
  Synthesized
  misc_feature (61): n=a or g
gaggatggattccagcaggaacgtaacttctgctgcttcagctcgaggatccaccgctgcncttccatgtagctcaaactcacagctgctctaagcaggtggaaacagggcgagcccatct

SEQ ID NO: 5741 - DNA, 121 bp, Artificial Sequence
  Synthesized
  misc_feature (61): n=t or c
atgcaattttgagccgtaatagcaaaggttggagtgactgatgtcacatttgaatgatacngctatagcttcctcctccgtatgtatctgaaataggaatcttggaatctgttctctgggt

SEQ ID NO: 5742 - DNA, 121 bp, Artificial Sequence
  Synthesized
  misc_feature (61): n=a or g
catctggtaatagagtaatgctaaccttagtgtcctgagcgatcaaaagacaagacagaanggatataatctaactggacagacactttatttaattaatctcagcaataattcatccaga

SEQ ID NO: 5743 - DNA, 121 bp, Artificial Sequence
  Synthesized
  misc_feature (61): n=a or g
cacatatttgctgtgtccccttttagcgagtgtgtaacactattggttagaagttaagtgntactaatgaatataaatgagtgttacaatagagtgaacttttctttcctcctgaaaatat

SEQ ID NO: 5744 - DNA, 121 bp, Artificial Sequence
  Synthesized
  misc_feature (61): n=t or c
ttaatatatttgcaattattgatcctgaatgtgtagttcactgattattggttagtaaatngattaagtatttctctgtatactatgtgaactgagccattttcatctggaacagaaagca

SEQ ID NO: 5745 - DNA, 121 bp, Artificial Sequence
  Synthesized
  misc_feature (61): n=t or c
tagtaactgccactaaaaagccatttgtatgggaaatgatacatttttgaatgacatcttntctttagtgagaattggccatgcctgcaatagcatgtctttctttttcacatggtttaca

SEQ ID NO: 5746 - DNA, 121 bp, Artificial Sequence
  Synthesized
  misc_feature (61): n=a or g
ggcagaagaatttgtaatgttgcactccaagatcgtaagggggtgggagacttccttaacnccctcttatacctagggagcttaaacccacactttcttctatgcaaatatccatccacat

SEQ ID NO: 5747 - DNA, 121 bp, Artificial Sequence
  Synthesized
  misc_feature (61): n=t or c
gacatctgcttccttacatgagttagactcatctgattaggcagtaaaaaactaaaaacanctgtctcacaattggctttatttttcaagagagttcttgttcatggtcatcaagcatcag

SEQ ID NO: 5748 - DNA, 121 bp, Artificial Sequence
  Synthesized
  misc_feature (61): n=t or c
atgaaatgtctaattaccctctcgtgataagattacttttctgaaaatgctttaattcttncaagcagaggcaaacaatccagatgagtgaccaaacaaaaaagccttcatgcatactgct

SEQ ID NO: 5749 - DNA, 121 bp, Artificial Sequence
  Synthesized
  misc_feature (61): n=t or c
atagtggcttttaatgcactgtgtgtcctaatgacttttgattaactcaggaaaagaaggncagctctgaccccttacagaaatacatacgatactctcctccatatcaatctgaaacaca

SEQ ID NO: 5750 - DNA, 121 bp, Artificial Sequence
  Synthesized
  misc_feature (61): n=a or g
ttttttcaagagaatcgtcatctctcagaagcattttaccaaaagcattttgccagaggcnaactgcttagcaggaggttcatcttgggagaaattccctgtaagcattttcccttgcagg

SEQ ID NO: 5751 - DNA, 121 bp, Artificial Sequence
  Synthesized
  misc_feature (61): n=a or g
tatctcagtcccatgaaggcaagagtgatggaaaagcagttttatgccgttatgttatagnggagttaaagatggaagctatggcaaaaatgacacattgatccttttgtcatagctccca

SEQ ID NO: 5752 - DNA, 121 bp, Artificial Sequence
  Synthesized
  misc_feature (61): n=a or g
ccagtgaaattagtttttgtgatatgcatcaaaaatgtgatctgtgtgcaggccaaaaccntagagatcgtgtattattgaaaaatattgctcagttagaagaaatcttgtagtttactcc

SEQ ID NO: 5753 - DNA, 121 bp, Artificial Sequence
  Synthesized
  misc_feature (61): n=a or g
ttaaactatggtacctgagcagctgcttcctactgcaagtcttttggttcaaggtgtgtgncttagtgctgagttgtataaggcataagtgatcttactctaaagaaatgagtatctacgt

SEQ ID NO: 5754 - DNA, 121 bp, Artificial Sequence
  Synthesized
  misc_feature (61): n=a or g
tcttttctttccttttttcccctttcaacatttgcattaactagcaaaaccacacggacangatgattaaagaagctctaacacataagagacagcttgaagcagcagcaaaaccctaggt

SEQ ID NO: 5755 - DNA, 121 bp, Artificial Sequence
  Synthesized
  misc_feature (61): n=a or g
tttcaggaggggtgactgaagaagtacagtaattatcagtggatttctattcactttatgnaaaaatccctccaatttaaaacttcagtttcattcactgccagacaggagttgaaatgca

SEQ ID NO: 5756 - DNA, 121 bp, Artificial Sequence
  Synthesized
  misc_feature (61): n=t or c
taagtaaaaatgcaaaaccagagagctggaaagatgcctctctctcattcagatggcttanggtttccagctccagaaaggtcatagtcagagtttcagtgtctatgtacatcttttttct

SEQ ID NO: 5757 - DNA, 121 bp, Artificial Sequence
  Synthesized
  misc_feature (61): n=a or g
tgtgtctaaaaagtcatcctcaactatttaagcattttgaaggtgttcacaggtgcagtgnttagatttgtcctcaagtccacctctggagagatatatcagagtaagacatattgtgtgg

SEQ ID NO: 5758 - DNA, 121 bp, Artificial Sequence
  Synthesized
  misc_feature (61): n=t or c
aaagttaacttcttgcaaaaatggagatatcttccccaagtgctgtaatgttagcatcagnctttcacctaagagctgcaaacggaaaaaaagcacaaataggttatgtgattatttagca

SEQ ID NO: 5759 - DNA, 121 bp, Artificial Sequence
  Synthesized
  misc_feature (61): n=t or c
cgctgggagatataatcagtgggacagaatcagataaacacactaacaaaaacgtaagctnataacttgcaaaaatttgaaacaaaggcagatgcctgtgtaaattatgtaagctcacatt

SEQ ID NO: 5760 - DNA, 121 bp, Artificial Sequence
  Synthesized
  misc_feature (61): n=a or g
tttttctttgtgcgggaatagatctaaggatcattttcttggatgacttttaaagcatcanttgaaaaagaacaatgcggtttcctgcaggtctgcagttttcagccttttgatactcctt

SEQ ID NO: 5761 - DNA, 121 bp, Artificial Sequence
  Synthesized
  misc_feature (61): n=t or c
gactttgctttcctgggggcctgcagtgctcctacctggctgcacacggagcctcccagcngactgtgcgaagccaacgccgttatccgcaatgcattggtacaccccggagtcctgcatg

SEQ ID NO: 5762 - DNA, 121 bp, Artificial Sequence
  Synthesized
  misc_feature (61): n=c or g
gcttcagcaacaattcaatttatgagtcaaaatgtggctgttaattttccccacaaagctntgctgcaaagtgatatggaaaaaaaagattaaaaacctctttttcctattgaccgctccc

SEQ ID NO: 5763 - DNA, 121 bp, Artificial Sequence
  Synthesized
  misc_feature (61): n=t or c
tttaaaatggttactgcaatagcctgttcccacagaatggtctgttcctttcttaggctgntggttgtagcaggatgcagccctgttgatgagagaaaggcactcccaactgacgggaggt

SEQ ID NO: 5764 - DNA, 121 bp, Artificial Sequence
  Synthesized
  misc_feature (61): n=t or c
cacctcctgaagaagacataaaagcctgagcagctacacaggattaaaggattttcggagngctccacgaatgtacagcaatgcagaaacagggctggcagcacgcagccctcagacccat

SEQ ID NO: 5765 - DNA, 121 bp, Artificial Sequence
  Synthesized
  misc_feature (61): n=t or g
ctctctaagatctcattacaaagtgaaacttgagatattctagggaatattcataagtgtngttcttagtccgctaaaatctccgaatatcaatgtacttcatagcaaatgccatgagaga

SEQ ID NO: 5766 - DNA, 121 bp, Artificial Sequence
  Synthesized
  misc_feature (61): n=a or g
ggtacacatgaagtattcaacatgagctgttaaactgccagctgaaaagatccgagtccangagtttcataatacatttggatgccttgtcactcattgcaagaatccccaaagaaccatg

SEQ ID NO: 5767 - DNA, 121 bp, Artificial Sequence
  Synthesized
  misc_feature (61): n=c or g
gtgagccaagaaattcatgacagctaacagcaagcatggctagaatctggctgatatgtgnacatgctgtgttcaagaatgtacgaaaagtctctcttagcactgttcctcattagaagca

SEQ ID NO: 5768 - DNA, 121 bp, Artificial Sequence
  Synthesized
  misc_feature (61): n=t or c
gaagcatctctatgcaatttggatgcaggcagagcatcagcagccggaccacactcacatngctccatcatcacctgcagcagtgtgtgaccccgatagcatgagcacctgtcctgccggg

SEQ ID NO: 5769 - DNA, 121 bp, Artificial Sequence
  Synthesized
  misc_feature (61): n=a or c
agctaactaaattgtgatgaagcaaaagactactttagtctccattggagctgactcctanaatgtgcttttgaagacaagcataataagagaaaataagtgaagatgcagtcaaatatgc

SEQ ID NO: 5770 - DNA, 121 bp, Artificial Sequence
  Synthesized
  misc_feature (61): n=t or c
ccctcaaaaccctctttggcagagggtaataagggtatttgaagggatttctagaattgtncaacaaaatatggtgaccctgtgtaaggaaaaaaaagttaagcccagacaaatgtgacct

SEQ ID NO: 5771 - DNA, 121 bp, Artificial Sequence
  Synthesized
  misc_feature (61): n=t or c
aatggttcatatatcagagatctgtacaaccacaacaaatgctaaacaaaataggaatcantttaaaataataagatggtacttttgttctgtaaagagtgtccctacattcactgattta

SEQ ID NO: 5772 - DNA, 121 bp, Artificial Sequence
  Synthesized
  misc_feature (61): n=a or t
tctgtgcactttcagtctggctttgtggtgcagaagatgtgccctatgggatggattcttnttctcaccttgccatctaccttacgatgggagccttgagcatgagctgaaggatttctta

SEQ ID NO: 5773 - DNA, 121 bp, Artificial Sequence
  Synthesized
  misc_feature (61): n=t or c
ttcagaaagcccccacagcaaccagcagcatcaaccatcattgcatataagccacgatctngtatgcccatgcagggatgctggcagaacagttcgtccccgatgggccgcacctgtacct

SEQ ID NO: 5774 - DNA, 121 bp, Artificial Sequence
  Synthesized
  misc_feature (61): n=a or g
gacagcaataagcaggcagtcccgaatgcagagaatgatgagctgatgatactctgactgnattggaccccacctctgagcacattcccattactgggtaaaagccacagcatctcagtga

SEQ ID NO: 5775 - DNA, 121 bp, Artificial Sequence
  Synthesized
  misc_feature (61): n=a or g
cctttcctaatatccagtttttcctaatatctagcatctggaattgtacagcaaacctacncaatggaaacacgttcaaaactttcctgatgggatgttttcaaataaaaggtaatatttc

SEQ ID NO: 5776 - DNA, 121 bp, Artificial Sequence
  Synthesized
  misc_feature (61): n=a or g
aactagtgacctcaaaggggcaatagctgagacaagtgttacggttgtagctgtgaagctnagtaaaaagcttagtgcaaagaaatactgtatgtgcctttagacagggctatacaaatat

SEQ ID NO: 5777 - DNA, 121 bp, Artificial Sequence
  Synthesized
  misc_feature (61): n=t or c
tttattatagctagtccctgtagatcgcaagcatggtagcttgtaaccacttggttgatgnagaaaatagattgaaagccttaattctgtcagctgaaggttaagttttccagaccttgag

SEQ ID NO: 5778 - DNA, 121 bp, Artificial Sequence
  Synthesized
  misc_feature (61): n=t or g
tgcccaggttatgtcattcatgaccaaccgagtgtacgggggtgtgcttgcttccttctgnccatcacagaagtcccaaaataggggtttctcatggaacctactcttcctgatgtcagaa

SEQ ID NO: 5779 - DNA, 121 bp, Artificial Sequence
  Synthesized
  misc_feature (61): n=a or g
ctaatattattatcgtagctgcataacaaagttaaatacttattaaagatgtaactgaaanaatcactcattcatttttcggttagctgatatatttatatgtgggttatcttgggtaaat

SEQ ID NO: 5780 - DNA, 121 bp, Artificial Sequence
  Synthesized
  misc_feature (61): n=a or g
ccaccagaatgcagtaatggagttttgcttagctcctgctcacttatcaacccctagactntgcatgaagatggtgaccaaaacaggtgagaaggaagactgtgatagccaggagcaagga

SEQ ID NO: 5781 - DNA, 121 bp, Artificial Sequence
  Synthesized
  misc_feature (61): n=t or c
tctttctttggatcctactccatgtaaagtctctgaccagacatgggactatagaaaaggntcttgacggcttgtagattgtttctgagtcccgttctgctagtctgtacttcttggttca

SEQ ID NO: 5782 - DNA, 121 bp, Artificial Sequence
  Synthesized
  misc_feature (61): n=t or c
agctggaaaaaaggggaaaaaaaaaaaaaaaaaaagattatgcaagcttgagctgttgttncctgtctgtgcaaataggtgagaaatctaatacaatactagcttcaggacattgactcac

SEQ ID NO: 5783 - DNA, 121 bp, Artificial Sequence
  Synthesized
  misc_feature (61): n=t or c
caagattagaaacctgaacagaaagcagtgagactctatttagaaaagcagattaaatacntcaccttgcaaacatggagagtagcacatgctaaaacagatgtcctgtccagtggaacta

SEQ ID NO: 5784 - DNA, 121 bp, Artificial Sequence
  Synthesized
  misc_feature (61): n=a or g
gttgttctgggaaattcctgtagccttttctacccataatgacaaaaaaatggggctggcnacactatttttgccactccaacgcacacgggcacacaagcaggtagagggaaggaagaca

SEQ ID NO: 5785 - DNA, 121 bp, Artificial Sequence
  Synthesized
  misc_feature (61): n=a or g
aaacgagaccgagctctcctccaggagctgctatttataccccggggactgatgagcaccngcagcacagtagagcacaatggggagcagcagtagcctgattgctgaggggtatttttag

SEQ ID NO: 5786 - DNA, 121 bp, Artificial Sequence
  Synthesized
  misc_feature (61): n=t or c
cagcttcatctgcaagggggagaaagtccaaaccctacccctaaatatcccatccagctgnctcacaaaggtcaccccttcatcaggacatgaagggtatacagtcctgcaggcatatggc

SEQ ID NO: 5787 - DNA, 121 bp, Artificial Sequence
  Synthesized
  misc_feature (61): n=t or c
acccacgtgcaggagggagatttgcaccctgcgctgcccaacgagctcccagtgccagcangctttggatacagtgctgttcacgcagggatggatggatgtcctttgcccctgggataac

SEQ ID NO: 5788 - DNA, 121 bp, Artificial Sequence
  Synthesized
  misc_feature (61): n=a or g
acatcgttatttaagattaccgtgttttttaaccgtatttttttaaattgcttccatctanctcagcatttgaaaaacctcaaagatcacactgtgcacaatcacaattaatatgtttgtt

SEQ ID NO: 5789 - DNA, 121 bp, Artificial Sequence
  Synthesized
  misc_feature (61): n=t or c
tgtggagtgtgagggccatgccagacatctgcctgaggatcacaggggttttaagagctcnctgtaacatccactcatactctgtgaattggctttcggttgtaggtccatgttagaattt

SEQ ID NO: 5790 - DNA, 121 bp, Artificial Sequence
  Synthesized
  misc_feature (61): n=a or g
acatgcagtgctgacggtgcaaagctgctaatgagtggttagtcttgatcactgataggcnagggctatttgtttcctacttgcagaagagtgatggatgcaaaacataaaggaacatgca

SEQ ID NO: 5791 - DNA, 121 bp, Artificial Sequence
  Synthesized
  misc_feature (61): n=a or g
agctcaactttaagcaaacctggggttaaaacattcctaaaacaaaggtgttctgcacagnttggaaacctgtaattgctggagatggatctgacaaaggcataggctgtgccatgtggtg

SEQ ID NO: 5792 - DNA, 121 bp, Artificial Sequence
  Synthesized
  misc_feature (61): n=a or g
ggctgagatatgccactgaaagggttagatttgttcttcccttccttgcaaaccagcaacnggccttgagcacaaccaaagcccaaggcacaaacactataaataacgttaatggggccac

SEQ ID NO: 5793 - DNA, 121 bp, Artificial Sequence
  Synthesized
  misc_feature (61): n=a or g
gcttctcaaaatgtaagatatgggaagttgcaaaaatcctacctaaaaatcacagtaacantattcctgaatgatagttctgaccctttgtattgagatgatagcagccttcgtggaagtg

SEQ ID NO: 5794 - DNA, 121 bp, Artificial Sequence
  Synthesized
  misc_feature (61): n=a or g
catcttttggttgtttgcccgcattacatcttacagaattacagtatcacagagcataggnaaagttaataaactttccacgcagtgcagagaaaaatcatagaatccttagaattggaag

SEQ ID NO: 5795 - DNA, 121 bp, Artificial Sequence
  Synthesized
  misc_feature (61): n=a or g
acctgtgagtcaagtgaccaacaagcaagattttgcatgaggtaggtagaagcagctccantttgggtttaattttcttcatagaagttaacattagacagagagaagtccctttcatctt

SEQ ID NO: 5796 - DNA, 121 bp, Artificial Sequence
  Synthesized
  misc_feature (61): n=t or c
ttacacaatccccaaattatttttcctctatctcccagatcaaatttttactttagtttgngaagtgtttgggaaaactttccttccttgggtcaatgtggtgggtttcataccaggagca

SEQ ID NO: 5797 - DNA, 121 bp, Artificial Sequence
  Synthesized
  misc_feature (61): n=t or g
cttgtgaatgatggggatgtcaagatgccagatgtatcagatgtctgtttccagtgctagngtatacctctttggccagtttttctcagctgttcttgttctgtcccctcccagcccctta

SEQ ID NO: 5798 - DNA, 121 bp, Artificial Sequence
  Synthesized
  misc_feature (61): n=a or g
tagatcatagctgtgctgagcgaatttttggtttagatggtagttgggtttgtcagccttncttgaaatagagtacaaatttacaacatataggcatacaatacacatttggcatttaatg

SEQ ID NO: 5799 - DNA, 121 bp, Artificial Sequence
  Synthesized
  misc_feature (61): n=a or g
ccaggggggaaggaaggctggagtcttccacagctttgtgtgtctagaacaatgtatacantcagttatccagttttggggtgtaaaacttcttgtttgaaattttgaggtcttataaaca

SEQ ID NO: 5800 - DNA, 121 bp, Artificial Sequence
  Synthesized
  misc_feature (61): n=a or g
gtgtcctttttccacatctgtataaaccatatacatttctgctcttatttaatgtgtagcnctgctgtgtttggtggcaccactgcatgcagaggtctgggtctgaggaagggatatgggc

SEQ ID NO: 5801 - DNA, 121 bp, Artificial Sequence
  Synthesized
  misc_feature (61): n=t or c
taatactgaaaataaaagtaggaatggactctatgctccacttctggaactgttcatcctncagcctaaatgaacaaaactctgtttggatctatttagctatgactcagtgtccaaatcc

SEQ ID NO: 5802 - DNA, 121 bp, Artificial Sequence
  Synthesized
  misc_feature (61): n=t or c
ggcaaagtccttagttagaatgagctatggggaaaatgcccaattccacagacatcaaccntttatccagtggtcatttaagcctactttcatttccaagacagatttcattctacaaaaa

SEQ ID NO: 5803 - DNA, 121 bp, Artificial Sequence
  Synthesized
  misc_feature (61): n=t or g
taaatttgtaaagtcagcacttatatgctgaatcacttctggaattaagctatggcaagtnaaaagatgaatgaaagcagccatgtggtggtttaatgtgctgcagcttatttatgtatgt

SEQ ID NO: 5804 - DNA, 121 bp, Artificial Sequence
  Synthesized
  misc_feature (61): n=a or c
ctaccacctgtgtagtgtggggagtctcagagccaagaaaccaattcagtctgcgtaaggnagccacataaggcttaattcagaggccatataaaggaaacacaacccaagaacacgtagg

SEQ ID NO: 5805 - DNA, 121 bp, Artificial Sequence
  Synthesized
  misc_feature (61): n=t or c
agcttcacagtgattcaggttggggcattcaagagctcactggacggatggatcatgctgncctctctgtgggaggttgagtcctcttcttggaaagtactgaagaggaaagaaagagatt

SEQ ID NO: 5806 - DNA, 121 bp, Artificial Sequence
  Synthesized
  misc_feature (61): n=t or c
ggctgcaaaactgttaaaatgttgactcttctaatctaaccacattattatttagcaccangattctaaacatagcgagagtggctggttttccactgactagggcttgatagcatcacaa

SEQ ID NO: 5807 - DNA, 121 bp, Artificial Sequence
  Synthesized
  misc_feature (61): n=a or c
cgggcagcatctttctcagagacactcctcctcctgattaagcagttttataccagcaggnaccatggaaattccacagacattttctatcctaacctctttttaagttgtagatgctgag

SEQ ID NO: 5808 - DNA, 121 bp, Artificial Sequence
  Synthesized
  misc_feature (61): n=a or g
cagagattcagaggaaaagcacacaggaaaaaaaaagaacctccgggagatcaaagagtcnacaagcacctgctgagcacattgattttacaaccagggggatttttttggcagctctgtc

SEQ ID NO: 5809 - DNA, 121 bp, Artificial Sequence
  Synthesized
  misc_feature (61): n=t or c
gtgttctgttttgctccttgtggttacagagcaggcagtgcttatgggctgcgatgaaatnagatgaagttttccaagcgagcggaattcctctttacaaaagctcattgacggctgctgg

SEQ ID NO: 5810 - DNA, 121 bp, Artificial Sequence
  Synthesized
  misc_feature (61): n=a or g
ctcagaacagcccacctcgtcaaggcaaacacagactgacgttcacctctatatcacaggngcaagaaagaagatttgcattcctacaagttgtgcctgcaagttgaatttattcccaaca

SEQ ID NO: 5811 - DNA, 121 bp, Artificial Sequence
  Synthesized
  misc_feature (61): n=a or g
ctaagtggggacaggaaggaagcaccaaagactccattaaaatcagagataatagaaatanctacttaattcttcataggtatagtactgctttagttttaaaaacacatccatctctaag

SEQ ID NO: 5812 - DNA, 121 bp, Artificial Sequence
  Synthesized
  misc_feature (61): n=a or g
agggaccccggcctccgtgggagcacctgtacttgtagacctacatacaggaggtgatctntgctttgccacctcttagtagcgtgcaggtagccacagagtcagaactttatgattgatt

SEQ ID NO: 5813 - DNA, 121 bp, Artificial Sequence
  Synthesized
  misc_feature (61): n=a or g
gtagatttactggacaaacaagctacgccagatccacattctgctactgcaagcgttaccntggcaagcatcctctagaataaaaatgcttcacaaatgagtcattgtttcctgcaatacc

SEQ ID NO: 5814 - DNA, 121 bp, Artificial Sequence
  Synthesized
  misc_feature (61): n=a or g
tccagaagttctttcagcctagttttccccatctatcttgtcaccttgcaccttggtcacnggtggtgataattccagccattaagtctctggcaaaccttacattaaaagggctgagaat

SEQ ID NO: 5815 - DNA, 121 bp, Artificial Sequence
  Synthesized
  misc_feature (61): n=t or c
aagggtcatagatgaatattggaagtttgggggaataaaaatgtacaccacagtcatttcntattctctatgagagttacttgaggaggggaaaagtggtatcttctttgcccttgcttag

SEQ ID NO: 5816 - DNA, 121 bp, Artificial Sequence
  Synthesized
  misc_feature (61): n=a or g
ttgaaactcctaaactatgtacatgcaatagaggcatgcaaaaaaattgttgttgcaatcnctaagagacaagtggaaggctccaaaaaattcttggtacgccaaacaagagtccagggat

SEQ ID NO: 5817 - DNA, 121 bp, Artificial Sequence
  Synthesized
  misc_feature (61): n=a or g
gatcactcaaatgggctttataaacgtctgagtatctatagctttgctgggaattgaagcntttcaaagtttggtgtgactgagggatttagatctgcaggaatgagggtgcaaattgacc

SEQ ID NO: 5818 - DNA, 121 bp, Artificial Sequence
  Synthesized
  misc_feature (61): n=t or c
agcacaacaggagcatcaggaactaccctatgctaaaatctttccaagtaagagaaagtanagaagcagttctcattctttaccttagctttcaggtaacttgcctcaaaagcttctccta

SEQ ID NO: 5819 - DNA, 121 bp, Artificial Sequence
  Synthesized
  misc_feature (61): n=t or c
gtcacaacctgcccagcacatcagctggaaggtttgacagcagttcccattcaatgtttanaacatcagcagctgaatgaatttcactgggaggactctgaatcccatctactctgtccat

SEQ ID NO: 5820 - DNA, 121 bp, Artificial Sequence
  Synthesized
  misc_feature (61): n=a or g
ctgcttttggtggttcgctgccgctagataacctcatcctggctcccttttcccatcaaangttggacctgaggatattttcgacccgggctattttctgacgcccgaacaccgaagccga

SEQ ID NO: 5821 - DNA, 121 bp, Artificial Sequence
  Synthesized
  misc_feature (61): n=a or g
gtggaatttgggtgggaggagagagatggaaatgagcgctctaccatatatactacagggnacttatttcaatgaacagagcaattcacatttaaatcaggacgttaacaggacggttcct

SEQ ID NO: 5822 - DNA, 121 bp, Artificial Sequence
  Synthesized
  misc_feature (61): n=t or c
atctgtttgctttgtacttggaaaagcctccttagcagcatcactaatgaggctaagcatntacacacctaagataaacagttttccccagcaatttgcttgctgagtagtactgagattg

SEQ ID NO: 5823 - DNA, 121 bp, Artificial Sequence
  Synthesized
  misc_feature (61): n=t or c
actactgctgactcccagggctgaagaagcctcccccccacctcacatcttcttctttatncagttcacatttgcacaaagagctgacttcataacaaagtcttttaaaaagaaaagcctc

SEQ ID NO: 5824 - DNA, 121 bp, Artificial Sequence
  Synthesized
  misc_feature (61): n=t or c
gtgttttaactcccctgatgataaagtttaaaaataccttgggttcagattgttccactcngccattatcctcctttggttgcctcagtgggtgaccttcacccttttggcttggatgtgt

SEQ ID NO: 5825 - DNA, 121 bp, Artificial Sequence
  Synthesized
  misc_feature (61): n=t or c
ggcctaacactgccctgagagcagcagctgtcccagggttagcagcaaaaagggacagcangcttgcaaagagataactcactacttcattaaaaccaaagcatttcaccaaggcaggggc

SEQ ID NO: 5826 - DNA, 121 bp, Artificial Sequence
  Synthesized
  misc_feature (61): n=t or g
tagtacttaatgtctctaaaaggatgagtgagctaaattcagcttctcaatgctgatattnagaaacagacaaatttcttgaaaaatccaagaatgtgtctgtgtttacatccagaaaggc

SEQ ID NO: 5827 - DNA, 121 bp, Artificial Sequence
  Synthesized
  misc_feature (61): n=t or g
gataaccacatttctttctgcaaagctctgttttggctaggacaagatatgttctgatcanactgtcttcatggccatttaaaaaaggaacgtaggtctgagacaacttccaacctcagtc

SEQ ID NO: 5828 - DNA, 121 bp, Artificial Sequence
  Synthesized
  misc_feature (61): n=a or g
agaacccaaaatatactttgatgcagtttacaggaaaccttgttagtgcctttgcagacangggtgcttgctgtgaaacaagctagggtactaacaatgcaacacactttcttgactgttg

SEQ ID NO: 5829 - DNA, 121 bp, Artificial Sequence
  Synthesized
  misc_feature (61): n=t or c
tgtttctctgtatgtaagaactaaccaacaaaggaaaacttaaaattaggcaggataaccngtgaattttctcttcagttataccactgaacattgcaacagctgtctaccacagcatccc

SEQ ID NO: 5830 - DNA, 121 bp, Artificial Sequence
  Synthesized
  misc_feature (61): n=c or g
tcttctggaagaatctgtagtcataaattgaagactgaatgaaccagaagaaaagctaatnaaactcattttaggaggaaaataactaacctttcaaagtatagctaataagttgagggag

SEQ ID NO: 5831 - DNA, 121 bp, Artificial Sequence
  Synthesized
  misc_feature (61): n=a or g
ggatgcccagagccccacccaacctgcatacaaagacattccaaagcaggcaaacttgagntgagaataagacctttcctctcagaagttatcagcctcttaagatcttcaaataaaccaa

SEQ ID NO: 5832 - DNA, 121 bp, Artificial Sequence
  Synthesized
  misc_feature (61): n=t or g
atggacagccctttttctgttttcctaaaagtgcgagaagtagaaatataataagcaaagngttgagtaaaggaattttaactcttaccttgtagcaatgttgtgcgttgcattaactatg

SEQ ID NO: 5833 - DNA, 121 bp, Artificial Sequence
  Synthesized
  misc_feature (61): n=a or g
taaaactctgatcctttacatgaaaagaaaatgtggaattgtaatatttatacaacatggnaagtgccctacagctcacaccaaagcaagactgccagatgtttggcaatttacgcatgtc

SEQ ID NO: 5834 - DNA, 121 bp, Artificial Sequence
  Synthesized
  misc_feature (61): n=t or c
tcattaacagtattgtctttcctcagataaaccaagtcctcctcagggtggaaaaaggagnaaattataaactacgaaaatgcgaacaattttgaaaatcttacagaaatgaatttgatgt

SEQ ID NO: 5835 - DNA, 121 bp, Artificial Sequence
  Synthesized
  misc_feature (61): n=a or t
cctatgggcttatctccctatcaaacagagcaagtttagtgcgttgtgctccattttgganaaccaagttgactgctacttaactattatcctactggtgcttgaaattctggcagtaagc

SEQ ID NO: 5836 - DNA, 121 bp, Artificial Sequence
  Synthesized
  misc_feature (61): n=t or c
aatcctgcatggatccttgcaagaagcaaaggcacggatggggcaaagccatgctctgtgntgagctgttgccccccaaaaagcatttgcacaaggcagggagcagagccctccaaatgct

SEQ ID NO: 5837 - DNA, 121 bp, Artificial Sequence
  Synthesized
  misc_feature (61): n=t or c
ttgtagggatgtgggggctcagagtgtgtggcactgtcccaccacatcattccagtcagcngtaatggtgatcagggaggtttcctccctccttagggcccagcaggtttgctataggcag

SEQ ID NO: 5838 - DNA, 121 bp, Artificial Sequence
  Synthesized
  misc_feature (61): n=c or g
accagccagcattcaggttgtgttttgttctcatctcgttttctttgagtgagctttaaantgtgccttgcagtgctaggaatcacaaaggaagggaataaaaccaacccaaacctcatca

SEQ ID NO: 5839 - DNA, 121 bp, Artificial Sequence
  Synthesized
  misc_feature (61): n=a or g
gcatctgatgttctgctgtttcctggtctgcctcactactctaacctttctctctagatanatccacctttctacagtgtcttggttttcaaatggaggtgggcctggttcctatgagtgc

SEQ ID NO: 5840 - DNA, 121 bp, Artificial Sequence
  Synthesized
  misc_feature (61): n=t or c
cttccccagccgctcccatcgctaaggagcagttttctccttggcccaagcaaagtgttcnctgttcccctcaccaagaccactcaccgtagtgtggatgctgcctacccagagggcgagt

SEQ ID NO: 5841 - DNA, 121 bp, Artificial Sequence
  Synthesized
  misc_feature (61): n=a or g
tttaggttggaagggaccttaaatatcacctccctgccacaatggcacctgaacggccacnggagcaattttgctcatggcagacataaggaaatcatagaattggaaagaccacgaaggc

SEQ ID NO: 5842 - DNA, 121 bp, Artificial Sequence
  Synthesized
  misc_feature (61): n=t or c
acaaaatctgtcttcttttacagcaatcgcacttcttggaatttgactcaggctgctccanagccaggattaaaggattcagctcctgaattttatcccaggctccatttatcaaacagac

SEQ ID NO: 5843 - DNA, 121 bp, Artificial Sequence
  Synthesized
  misc_feature (61): n=c or g
ctccacaaaactgtaagtgaccgacaataaaaacgaaatctgatacattcctatcaaaatncatttcatgtctagccttaaggatgatgcaagaagcaattattcagaagattaaactgtt

SEQ ID NO: 5844 - DNA, 121 bp, Artificial Sequence
  Synthesized
  misc_feature (61): n=t or c
ggacaactggagatgcaaaatgcaacacctctagagccaggtggtggtctgctgctggtgnatttacaactccttttccaatggcaaagaggagtctcttcaaactcttaagggtgatatt

SEQ ID NO: 5845 - DNA, 121 bp, Artificial Sequence
  Synthesized
  misc_feature (61): n=t or c
gctaggttttgaacttgacagcctcaattttctttgctgccaagatgacttaattccttangtcttctcctcaacttacaggtagtagcagggaaggatacttgtcaaactgttctggcca

SEQ ID NO: 5846 - DNA, 121 bp, Artificial Sequence
  Synthesized
  misc_feature (61): n=t or g
atcagttagtaaaagttattacttctaaagacaattcagtctttgatccttgtccactccnaatgggaaagtgtttgcatcctctttaatagtcataaagcccaaagatggttgtgtcctt

SEQ ID NO: 5847 - DNA, 121 bp, Artificial Sequence
  Synthesized
  misc_feature (61): n=a or t
aaagatgctggctgtccctttgtacttcattaaaccccttatctccttaaatagccagcantcaaaactcatgcactttctgcagagacctgaaggagagaggttatttattgcttgcatt

SEQ ID NO: 5848 - DNA, 121 bp, Artificial Sequence
  Synthesized
  misc_feature (61): n=t or c
atacaaaattgaaatttactcttgagccatctttaggtcaaaatggttttcagcaggtaantggattattatcatctgggcttatggagtactgggctcacctcagttaaagtacttgccc

SEQ ID NO: 5849 - DNA, 121 bp, Artificial Sequence
  Synthesized
  misc_feature (61): n=a or g
gcttcccctgatggaacggctgtgggcatggcaatggagcagtgctgatggggttacagcnttggggagatggctttgtttgctggcttcctgctgcaggtctcagtttttgggatgcaca

SEQ ID NO: 5850 - DNA, 121 bp, Artificial Sequence
  Synthesized
  misc_feature (61): n=a or g
tctgttcatagacttgcaaatgcacgttggaataggaagaagtgatccatagctgcaggancagacccagctcagctctctgttgcagcctcagagctcggagcctcctctgcagatctgt

SEQ ID NO: 5851 - DNA, 121 bp, Artificial Sequence
  Synthesized
  misc_feature (61): n=a or g
tcaattctgggttaagaccaaaacctgaactgtgcaccgcagtgcgtgcaaggaaagcacncttggtttaaacgggacaaagatgcaaaatgtgatgtgctcaagtaaaggtgtcaaaggc

SEQ ID NO: 5852 - DNA, 121 bp, Artificial Sequence
  Synthesized
  misc_feature (61): n=c or g
ttaggtgagctcccttcttcctgagcaaatccaatgtgatgcactgcaactcttgtgtctnatcctttgcaggttatgaagacctaccatatgtacaatgctgacagcattagtgctcaga

SEQ ID NO: 5853 - DNA, 121 bp, Artificial Sequence
  Synthesized
  misc_feature (61): n=t or c
gtctctggatattttctgtatcaccaggaggaagttacaacttcagtaactccagtgacanggggctttgacttgtatgtgataatttagtgtaatactgaaacagcacaatggaagaaca

SEQ ID NO: 5854 - DNA, 121 bp, Artificial Sequence
  Synthesized
  misc_feature (61): n=t or c
gaaagcgtgtggctacttttttggattgtaaatccaggttagagcagctccttccatcccngaggatcccacggtgctctataaatacaccgtgccctgggatcccttccagcaccgagct

SEQ ID NO: 5855 - DNA, 121 bp, Artificial Sequence
  Synthesized
  misc_feature (61): n=t or c
aaacacactgctttgtactgactgcttatcagtctcacagcttggagaagcaaatttcagntggtcttaacctaccttatgccttactatgtacatatgtacctgaaataaaaatggagta

SEQ ID NO: 5856 - DNA, 121 bp, Artificial Sequence
  Synthesized
  misc_feature (61): n=a or c
ccaaccttaatgattctgtgaagctcagtaggttgttttgtttgtatcgagggggtggaantgctgcttatgggttcataccttctacgatcttcagttcctttgatgttctcctctccct

SEQ ID NO: 5857 - DNA, 121 bp, Artificial Sequence
  Synthesized
  misc_feature (61): n=a or g
gcttaatttggagcaaccacaggctttgttgagtgagtagctaatgaagttagtctggctntccccttctttttgctgtgaaaaatcctgtatttgagtttccctaccaaacaggattttt

SEQ ID NO: 5858 - DNA, 121 bp, Artificial Sequence
  Synthesized
  misc_feature (61): n=a or g
gtggtttcactggagcacatttgtgtgtggttatctcgtggtgctttgagtgagttttggnctttgttcctaccgtggttttggtgcctactaaagttttcctgaacagtgctgagccctg

SEQ ID NO: 5859 - DNA, 121 bp, Artificial Sequence
  Synthesized
  misc_feature (61): n=a or g
agggggacagcacgaatttctgcactgaaatggagggatttaatggttgctgatgctcagnaagtgctgtggatccactcagtagtaacaactggttttcctcaaaagaggaataagcctt

SEQ ID NO: 5860 - DNA, 121 bp, Artificial Sequence
  Synthesized
  misc_feature (61): n=a or g
ctttctcaggaaatgcacgtaacagatggataaggcagggcttccaaggaatggtttagtnctgaaggtattgatgagatattctgttgtttctggcagtagatttggtctgtgctacacc

SEQ ID NO: 5861 - DNA, 121 bp, Artificial Sequence
  Synthesized
  misc_feature (61): n=t or c
caaacaggctcgtcactttgtgcctccatctggcggggacatactttccatttcagcaagngctagaatgggtggacagcaaagggaaacgtgaaaacagcaaagaaacgagaagaatgaa

SEQ ID NO: 5862 - DNA, 121 bp, Artificial Sequence
  Synthesized
  misc_feature (61): n=a or g
ttaaatcagagcctgaagtacagcaccgagccgtggtggtgtgattttcagagacattccnaaatgttattaaagctaaacaaactcatttaagcaccatgtctctccttctgtatgctaa

SEQ ID NO: 5863 - DNA, 121 bp, Artificial Sequence
  Synthesized
  misc_feature (61): n=a or g
agtgagatgcaacaggtctgtgaggcttacagcaggtactccccagcacaatcacatcagngtagagctgggaacaccaaaggcaccatcacttgctacaaaaatactaaataagatagcc

SEQ ID NO: 5864 - DNA, 121 bp, Artificial Sequence
  Synthesized
  misc_feature (61): n=t or c
agatggccaaccattagaccgaagactctcatattgatggccatcagatcctcccacctanccatattcccaatctttccatgtcattgcttgccagacctcgcagaaaggaggcagagac

SEQ ID NO: 5865 - DNA, 121 bp, Artificial Sequence
  Synthesized
  misc_feature (61): n=t or c
cctaggcagcatgaatcaaagccagcggcttgatgctatggctaaactaaagcaattccantgtagagttctgatttccacagacttggtgagttagtgtttcgtagtgttatgtgactat

SEQ ID NO: 5866 - DNA, 121 bp, Artificial Sequence
  Synthesized
  misc_feature (61): n=a or g
agccctggaaccgctcgctgctccatgcagtaccaaggagatgggtaattgggggcctgcntccttggccagattactctcagagtaaacttttattttgaattctgttttctggcttcac

SEQ ID NO: 5867 - DNA, 121 bp, Artificial Sequence
  Synthesized
  misc_feature (61): n=a or g
aaggagggaagtcagatcgtggtgtaggaaagtcacatcatttgagccattcatcagcatnctggtgggtcttacaccgatctcatggatgcttcccatttctgcagatgcaaagtgctgt

SEQ ID NO: 5868 - DNA, 121 bp, Artificial Sequence
  Synthesized
  misc_feature (61): n=a or g
gaccttccctcacctaggcctgaaggactaggcctcggggtgagcaggcctctgggttcantcacacatgttccttagcacaggacacaagaacttcacaaagcagaagatataaaaatca

SEQ ID NO: 5869 - DNA, 121 bp, Artificial Sequence
  Synthesized
  misc_feature (61): n=t or c
gtgacccgttaatggcagcttgcattcaggagaccctcagaaggttctgctcatctcacantgctcctattcatccctgcacagattcctccaggaccacttaaatcaccctctgctccag

SEQ ID NO: 5870 - DNA, 121 bp, Artificial Sequence
  Synthesized
  misc_feature (61): n=t or c
acatcaattgttcaaaagctctctctcagcccatctgtagctgggtgacagctatgggcangaattcagtaaaaaagatttattaactcccatgtgcagtccttttcactcttttttcact

SEQ ID NO: 5871 - DNA, 121 bp, Artificial Sequence
  Synthesized
  misc_feature (61): n=a or c
tgtctatatctgtctataagcacatttattcacaaaacaactccagaaacctaaaaaaggnacttaccacaacaatcacattcgtcgcaggaatgggaagattttccacttctaagtcttg

SEQ ID NO: 5872 - DNA, 121 bp, Artificial Sequence
  Synthesized
  misc_feature (61): n=a or g
agaggcaggtaaatcagcatcctccagctgcatagcaggtgggtggcttgctgcttccacncctcctttctccgcggagggaacaagcctgaaagggtcctcgcttatttcgcagatgggg

SEQ ID NO: 5873 - DNA, 121 bp, Artificial Sequence
  Synthesized
  misc_feature (61): n=t or c
caattgctgaaatgaatgttggtctttatcatagtattaatgctggggcagattttgctangtgcagacagcccttcatcggtacacatccccgatatgatttttgactctttcccaagaa

SEQ ID NO: 5874 - DNA, 121 bp, Artificial Sequence
  Synthesized
  misc_feature (61): n=a or c
tgtgatggcagtgaatgtgtatcagcctatggccaagccttcacggaatgcaccagtcccnaaacaacacctgcgtgcatgttttggggctgttatcaccagctttttgcaccagagtcat

SEQ ID NO: 5875 - DNA, 121 bp, Artificial Sequence
  Synthesized
  misc_feature (61): n=a or g
tcttgtctttatttcagttctcccttccagtccacctatacatgcaccagtagcttctctnatgcttgcagtttcttgcaggcagcagagccagtaagtgctcctatgtgtaatacatata

SEQ ID NO: 5876 - DNA, 121 bp, Artificial Sequence
  Synthesized
  misc_feature (61): n=a or t
tggtgctggaccttttctggtctatctgagaacatccatagatatttcaaaaaaagaaatnacacttaggaaatactaggcactgcatcagatatttcctttggtgtttgcaacaactgcc

SEQ ID NO: 5877 - DNA, 121 bp, Artificial Sequence
  Synthesized
  misc_feature (61): n=a or g
ttcacattcgatgcatatggcacagaacaaaaaccaaagccacctgcaaagtattttctcnagctccttatacttgatatattgcagcactcacacccgcatagggcttgtctgacaatgg

SEQ ID NO: 5878 - DNA, 121 bp, Artificial Sequence
  Synthesized
  misc_feature (61): n=a or g
agtgtgtttccacagacatagaaacaatcagtcagtcaagagaaatgctgcttgcttccantgtgaaagctaaacctatcctgagcaagtaagttatactgcttcctcagatctctaaaaa

SEQ ID NO: 5879 - DNA, 121 bp, Artificial Sequence
  Synthesized
  misc_feature (61): n=a or g
aaactctgtagttaaatattttatattattttcattttaatataaacaatatgctgttacntattcagtagatcttagccatctttatcatctttgtccaagtttgcatatgtcagagtac

SEQ ID NO: 5880 - DNA, 121 bp, Artificial Sequence
  Synthesized
  misc_feature (61): n=t or c
ggaagtaataactacaacaaaaatattaaatccgataaaacaaaacacagtcgcagccctntctctcataaagctccccagtttttcagcctatttggtagcaaactatacgtcgcagtgg

SEQ ID NO: 5881 - DNA, 121 bp, Artificial Sequence
  Synthesized
  misc_feature (61): n=t or c
atttaaatattttatagttcattcttccaacattattttctatatcgatatgaatatcccngaacataatggctaagacacatgaaactaggtggcaacagttttaggtccttcttcaaat

SEQ ID NO: 5882 - DNA, 121 bp, Artificial Sequence
  Synthesized
  misc_feature (61): n=t or c
gacttgaactgtaagagtcttaactgaaagtttttttaggagtgactatctttaataaccnagatatagaatttgttagtctattgacatcttgcagctagaatttactggatcagcaaat

SEQ ID NO: 5883 - DNA, 121 bp, Artificial Sequence
  Synthesized
  misc_feature (61): n=a or g
gctgtcatcctggtcaaggaatcaagctcagtttgactgccctcagctctactgaaacgcngggctgggctctacccacacagccctacagaggaacaacacgagcacatggctccagcca

SEQ ID NO: 5884 - DNA, 121 bp, Artificial Sequence
  Synthesized
  misc_feature (61): n=t or g
cgctaagtgatatttttcttctcaatatatagctacatcttttgcagtttgaacgggaganaagagatcttacactctgggggacaccccatgtgcagcgtgctcctgatgatgctcccag

SEQ ID NO: 5885 - DNA, 121 bp, Artificial Sequence
  Synthesized
  misc_feature (61): n=a or g
cttccccacactttgccacatacctccaggctctccaccatcctatcccacctctcccacntcctctcgacctctctttatctgctgcactgaatctttccttgcttggccatcagcatgt

SEQ ID NO: 5886 - DNA, 121 bp, Artificial Sequence
  Synthesized
  misc_feature (61): n=a or t
gctcaatgtgctgccagcacagctctcctccagctgcacaaagccatgtctaccagcccangcgaagcatccccatgagtccctcactgggacaatgtcacaagcattcatggcagctgct

SEQ ID NO: 5887 - DNA, 121 bp, Artificial Sequence
  Synthesized
  misc_feature (61): n=t or g
actttcctgtcaagccctcactttctggaagaaatactcaggatattttgcccagaaactncactgttccaacagagcctcagtggggagaaagaacaattgacagtctacctaatgggtt

SEQ ID NO: 5888 - DNA, 121 bp, Artificial Sequence
  Synthesized
  misc_feature (61): n=t or c
tgctataggaaaaaaaaaacttacggcctctacccagtgacacttcagcagaacagacatntagcatttactgaaaagcagtaggaggtgaggtggtcccttgaccctttcaaagaccatc

SEQ ID NO: 5889 - DNA, 121 bp, Artificial Sequence
  Synthesized
  misc_feature (61): n=t or c
acagagtgcaatatattgtagagctacttacataaaatttttagcaagcataaagtaatgngaaattatgttacaccagtctataccatctcatagtgccatgaccagacagcttaggtaa

SEQ ID NO: 5890 - DNA, 121 bp, Artificial Sequence
  Synthesized
  misc_feature (61): n=t or c
agctctactgggaccacaaaccctcaaggtcctcgactaaacctccactaaacctctaccntttaccccaccaggacctcagtgcaacgcctcggtggacctgattggcacatgctggccc

SEQ ID NO: 5891 - DNA, 121 bp, Artificial Sequence
  Synthesized
  misc_feature (61): n=a or g
cagaatttcaataatagcatcccctctcagtgtctgtcaacttgtggatctttgcaagacnaatagtttttcactatgtatttatgtagtggctttttcatatgaggtctttgaataccat

SEQ ID NO: 5892 - DNA, 121 bp, Artificial Sequence
  Synthesized
  misc_feature (61): n=a or g
aagtattctaaacccagttgtgtgagacctcaaatgggacttcagatgggagcagacatangaaataacaaggtacaatcattgcaggcctaattgtaacttgagggagagccatctagtg

SEQ ID NO: 5893 - DNA, 121 bp, Artificial Sequence
  Synthesized
  misc_feature (61): n=a or g
aagatcctcccctttgctctgacttgagtttccagcacagaatttcattttttttaccctncttgcttacgttgaatcttgatgtaccaaaatgctgcagcaaagctactccatgcagcag

SEQ ID NO: 5894 - DNA, 121 bp, Artificial Sequence
  Synthesized
  misc_feature (61): n=c or g
cctgtgtttgctccttgttgggtgcagtacgccaagggacagcagaaagctttctgactcngtgctgtccgaggaggctgcttcctccgcagttatttacagcttgctttggagaaaagcg

SEQ ID NO: 5895 - DNA, 121 bp, Artificial Sequence
  Synthesized
  misc_feature (61): n=a or g
gtgggggcaggggaagaggaattcagctatctggcccttagcttgccagatgccacatcgntcttgtctcctttgtttgatggagcagcccatgacgggaagaatctctccatgaaagaca

SEQ ID NO: 5896 - DNA, 121 bp, Artificial Sequence
  Synthesized
  misc_feature (61): n=a or g
agggtgctggtggagaaatgctgggaagcagcagactgccttctgaatattccattatggnatgtgcagcaagggaaagaacgatctgcttttctgctccgctcacttgaaaggtgctgag

SEQ ID NO: 5897 - DNA, 121 bp, Artificial Sequence
  Synthesized
  misc_feature (61): n=t or c
atcgtggctctgtttccttaaattggacaaactgagctaaaggatggccgtgttggcactngtggctcaccctcagtgtgagggttgagaaacccaaacagcaactacgtcatggaatggc

SEQ ID NO: 5898 - DNA, 121 bp, Artificial Sequence
  Synthesized
  misc_feature (61): n=t or c
agtgaggctgggacccgatggtgttccttcttgagcacaaacatcctctaacaaacagttngggaaacataaacatgaatgtttgagtgtcttaaagtgaccagcagtcctaacaggagca

SEQ ID NO: 5899 - DNA, 121 bp, Artificial Sequence
  Synthesized
  misc_feature (61): n=t or c
tgatgataaacttgctgagttttccagctttggtgatggaatgagtgttgtgtgtgtctanaactgatcctaatcactgctggagccactccagagtccttgcagggatctctgggagagt

SEQ ID NO: 5900 - DNA, 121 bp, Artificial Sequence
  Synthesized
  misc_feature (61): n=t or c
tggttactgtcccaggtttgactctggttctggatccaaactgtagcatcatctgttttgncatatgagccctggggtgcaaacccctggagaccctatagagtgaacgtgtgcattagag

SEQ ID NO: 5901 - DNA, 121 bp, Artificial Sequence
  Synthesized
  misc_feature (61): n=a or g
aaacttgagcatatgactagcagagataaagcacaccaccactcaaacacacaaacatatntaacacacatacagttctcttaccattaaatgtaaacaaaagtgtctttttagtttcggg

SEQ ID NO: 5902 - DNA, 121 bp, Artificial Sequence
  Synthesized
  misc_feature (61): n=a or g
gctgttctgaaggtgagcagggacctacagaaagtaaataagattcacagtgtttgtacancagtgatgttattggcatactgacataaacaattaagtgatgaaataccaaatagaaaga

SEQ ID NO: 5903 - DNA, 121 bp, Artificial Sequence
  Synthesized
  misc_feature (61): n=t or g
ggcagccttgggcagcaagagaaacttggggcatctgaaccacagcactcagtcagagggnttgtctgctgtgttctgccctggagttcattttgggccttagaactgttgaggagcagga

SEQ ID NO: 5904 - DNA, 121 bp, Artificial Sequence
  Synthesized
  misc_feature (61): n=c or g
ggcactggtggcgctcctgcagggttggagcacagcagtggtgccattgggcagtgtggcngtcgggtttggtaacaacatttgcctgctttggagtaaaggtgcccagagtggcacccgg

SEQ ID NO: 5905 - DNA, 121 bp, Artificial Sequence
  Synthesized
  misc_feature (61): n=t or c
caggggctttattaccagtttcagcttctcttaattttcagagttgtcttacactgcaaantgtatttgaactgaggctttagggttttccttaaatacagtactttgaatgactttcaaa

SEQ ID NO: 5906 - DNA, 121 bp, Artificial Sequence
  Synthesized
  misc_feature (61): n=a or g
gcccagcacagctcctgcagcactgctctgcccatgagatctgaaacaggacaggaacagngaagatggatggggaagaaggccatgggacagcgtgcatgtgtgtggctggagcgttcac

SEQ ID NO: 5907 - DNA, 121 bp, Artificial Sequence
  Synthesized
  misc_feature (61): n=a or g
cctcagcaactaatagggatgaaaggctgcatgtggttctccatgtaggtgtatgggtttncttgagctgcatgtcacaagatcaccaagaatcaaacactaggtaaagggtaagtacgtc

SEQ ID NO: 5908 - DNA, 121 bp, Artificial Sequence
  Synthesized
  misc_feature (61): n=a or g
ccccaaagagtcccctgcatggcccagaagtcaaacagtgttgcgaagctgaaaggactcncagactgacattgaaattagccatccagctcacacacaggggccttcactccccttgctc

SEQ ID NO: 5909 - DNA, 121 bp, Artificial Sequence
  Synthesized
  misc_feature (61): n=t or c
ttatacagagagctgcgtctcatcgcgtgggatttctgtgtttgttaaggatgagatacantgtggtgcagggatgccctcatccatgctgaaaccacagacattgccatcgtttctgcag

SEQ ID NO: 5910 - DNA, 121 bp, Artificial Sequence
  Synthesized
  misc_feature (61): n=t or c
tctagagtgacttcattttaaacacagagcagtggagataacagtggcaactctagcaaantgcattcagacttcctgcactactatttgcaagtgagcagaaaacagactgtggtagtca

SEQ ID NO: 5911 - DNA, 121 bp, Artificial Sequence
  Synthesized
  misc_feature (61): n=a or c
gaatgttttgtatgtggcttctgaggtgggaatctgctggaaaacaccagcaaggtggacnacagcttctctcctatttgatacacaatcccagtcagagagatgctacagtactgccttg

SEQ ID NO: 5912 - DNA, 121 bp, Artificial Sequence
  Synthesized
  misc_feature (61): n=a or g
cccggcctgtcccggtcttgttttcatagcagaactaatgaagttcgtgttttactgcggngtgtgaggcagtgccaggagctccctgctgttcccagcacagaaccacgggctgtgagcc

SEQ ID NO: 5913 - DNA, 121 bp, Artificial Sequence
  Synthesized
  misc_feature (61): n=a or t
aaaattttttatatttaatgtgtacttaacatgaggatctccattaacaagcagtaagagnaatgcacgtcccaagatgagcatgttttttgtatgcttcatcaaagatcctttctgtata

SEQ ID NO: 5914 - DNA, 121 bp, Artificial Sequence
  Synthesized
  misc_feature (61): n=t or c
ggatggatccagcctggctgtaaaagtgcaagcagtgatttatccaccccaacctgccctncatcagagttccttccttgtcatcctacagcaccgtgggctgagcaatgaaataagtcct

SEQ ID NO: 5915 - DNA, 121 bp, Artificial Sequence
  Synthesized
  misc_feature (61): n=t or c
gaaatctgaaaggaatcctatgatatgatctcaaaagtggcttgaaacattaaagtagtcngaaaataaggggaattctttaatatcttactcttgtactgtgcaacattgctacaaagat

SEQ ID NO: 5916 - DNA, 121 bp, Artificial Sequence
  Synthesized
  misc_feature (61): n=a or g
gctgctccactgggctctgttccctgcaagaccgttaccatcgaagtgctcactcttacgngagcagcgacagacacagagcccctttagctccatctccccagccaaaccatgacaataa

SEQ ID NO: 5917 - DNA, 121 bp, Artificial Sequence
  Synthesized
  misc_feature (61): n=c or g
cgaaggctgcacaagttcaatgaggtctcagctcatgtgagcgtcagctgggactggaaanccaaaccctgtgcgctgcgaagtgtcagtcaccctttcaacaaagcgtgtattggaatgt

SEQ ID NO: 5918 - DNA, 121 bp, Artificial Sequence
  Synthesized
  misc_feature (61): n=t or c
ttaagtgagaaactgggacctcaggtgtacttttgtgcaatgcagtcttcaagagcttcancaggtagtaaagaagcaagcagagaaaggcttaggagataaagataactcaagtatggct

SEQ ID NO: 5919 - DNA, 121 bp, Artificial Sequence
  Synthesized
  misc_feature (61): n=t or c
ccaaagcccccaaaggtacgtccagttggttctctgggagcatggggcactctgaggccangcagacacaaagaacgcggttggttaagaaactgaaacggcatttttatcttttctcaca

SEQ ID NO: 5920 - DNA, 121 bp, Artificial Sequence
  Synthesized
  misc_feature (61): n=a or g
tgcatttctgtgtcttttctgacacaagatgaccagtgctgtttcaagatgtaggtgcacngtgggatttctgcaagcacagactgctttcttctagcatcatctctgcaccatttgcagc

SEQ ID NO: 5921 - DNA, 121 bp, Artificial Sequence
  Synthesized
  misc_feature (61): n=a or g
aggatcagctctcatctctcctcctccttccccacactgcagtgcagcaagcaggagaacngagaactgacagtgcttgggcagccctgctgctgcagaagagctgcctctattagccaag

SEQ ID NO: 5922 - DNA, 121 bp, Artificial Sequence
  Synthesized
  misc_feature (61): n=t or c
aggtgatgcactgccctactgctagggcaggggtggctgcaggtccagcagggatagcacnagcactttgagatggacaccagctctgacccctgcccaatactgtaggatggcacaaggc

SEQ ID NO: 5923 - DNA, 121 bp, Artificial Sequence
  Synthesized
  misc_feature (61): n=t or c
tgaagaagatgatgaagatgatgatctggaaggtgaagaggaggaggatggagtagatgangaggtgaggctctctgtcattactgtatgttgtgagcagcattttggcttatttaacact

SEQ ID NO: 5924 - DNA, 121 bp, Artificial Sequence
  Synthesized
  misc_feature (61): n=a or g
gctgatgattcaaaaatgacaccaccaggagaacagcagtgtgctcagttagggtaagaangaaacgacagacacatttgtgggaggtacaatggaaaagacactgaagcttaatagaatt

SEQ ID NO: 5925 - DNA, 121 bp, Artificial Sequence
  Synthesized
  misc_feature (61): n=c or g
ccatcgattttcccttcattaactgaattccataaaccattctttaaaatcagaaaatatntgctaacactgatctcaccatagtctgaagcattcatcccccacaagacaaagaagagaa

SEQ ID NO: 5926 - DNA, 121 bp, Artificial Sequence
  Synthesized
  misc_feature (61): n=c or g
aagagccctgtcaaactcagcagcaaaatggggcaaagcctggggcatccctggctctgancatgaacgtgcccttgccaccttgagtaacacagtgagtattccagataaacaggagctg

SEQ ID NO: 5927 - DNA, 121 bp, Artificial Sequence
  Synthesized
  misc_feature (61): n=a or g
gacaccattaatctgtcctgtgacagccctgaagcaaagacccacacccacagcctatccnagcagtatgcccacacacagagccctgtggtcactttgcagctctctcaatgtaaatgtg

SEQ ID NO: 5928 - DNA, 121 bp, Artificial Sequence
  Synthesized
  misc_feature (61): n=a or g
tcttttgatctctcctaaccacagtaaaatattactattagaacaagattactattggtancagtacttcttatagaagttcatgagagccttgtccactattcacaatgagatgacagat

SEQ ID NO: 5929 - DNA, 121 bp, Artificial Sequence
  Synthesized
  misc_feature (61): n=t or c
tgttggcagatgtgcatggaggtttctgcaggaaatgggaaaataaagtcaagctccatcngccccttagcctgcagagagccacatggaccctctctgctcttccaagagaaaacccaca

SEQ ID NO: 5930 - DNA, 121 bp, Artificial Sequence
  Synthesized
  misc_feature (61): n=t or c
ggcaaatggactgcgggatgctctttgctcactgcgaggagatgaggtctctgtttgctcngagctctctgcagaccattgtttggatacgttggaacccatcccggaaacaaaaagtgct

SEQ ID NO: 5931 - DNA, 121 bp, Artificial Sequence
  Synthesized
  misc_feature (61): n=a or g
tatgagtcaagccagaaaatcagagaccatcaggcaaatggcagtgtttcatgtgcaaggnctttcgttgcattacagccagaagtctcacctgctgtattaacgtttggttttcttagtg

SEQ ID NO: 5932 - DNA, 121 bp, Artificial Sequence
  Synthesized
  misc_feature (61): n=t or c
aggggagattctctggcgcattctgtctgcagaagcactgggtttcttcagaagatcttanttaggaacaggcttacaggcctatgaagagcctgtatccagccaggacactcaaggacag

SEQ ID NO: 5933 - DNA, 121 bp, Artificial Sequence
  Synthesized
  misc_feature (61): n=t or c
gtaaaaactgtgttactgtaggttttttttcttaatggaatgacccattatggaactacangtggtctgtattgaaggatcaaactaaggtgtggagattaacccttcgctgttatgtttg

SEQ ID NO: 5934 - DNA, 121 bp, Artificial Sequence
  Synthesized
  misc_feature (61): n=t or c
aggtaccgtagtgtgtacatcaacaaatctggtttagttccactcaaagagatcctaaagnctttgccttgcaatgccagagttttgaagagcaaagtttggagaagtactagaaaacaaa

SEQ ID NO: 5935 - DNA, 121 bp, Artificial Sequence
  Synthesized
  misc_feature (61): n=a or g
gggtttcgattatttttttccctttaaaaatacaaatatacgggtgttaaaatgaaagcantgaggcctgtgtgttgggaaggtcttttcctttgggggagggtgagtaggaaggctccgg

SEQ ID NO: 5936 - DNA, 121 bp, Artificial Sequence
  Synthesized
  misc_feature (61): n=a or g
cctttctctcaggcaggcctggagccggctgaccatcttgcaatacttgggcattctagantaaatggcatttgaactaattcttacttttcagtgtagcttaaaggttgggctttttaag

SEQ ID NO: 5937 - DNA, 121 bp, Artificial Sequence
  Synthesized
  misc_feature (61): n=a or g
gagtgccttattgcacgcagaggtcagggcagcagccctgctgcttgtctctgtgctaccntagcacagatcctaagagaccgcgttggtttccaacctgtcatcctgctctggcactgca

SEQ ID NO: 5938 - DNA, 121 bp, Artificial Sequence
  Synthesized
  misc_feature (61): n=a or g
ctggggctctagggggtgtcagccccacggcactcaatgtcccccattacctttcttctcnatggcttccaccagcttcaccagcagcggaggcgcaacctctggagggctgaactgctcc

SEQ ID NO: 5939 - DNA, 121 bp, Artificial Sequence
  Synthesized
  misc_feature (61): n=a or g
aagattgaagacaaatatgaaaggattattatcgactcatactagttacagatacctaacnttagaaaacatcatttctgggtccttcccatattgtatgaggaaaaaaaaaaacaaaacc

SEQ ID NO: 5940 - DNA, 121 bp, Artificial Sequence
  Synthesized
  misc_feature (61): n=t or c
gaaacagaacacaaagtcctgctagagtgaattccccgaaaccgttacggcaggagcaaangcatgtgagcacaaagctagcaatattcataggaaatctgactcatctcaatatataatg

SEQ ID NO: 5941 - DNA, 121 bp, Artificial Sequence
  Synthesized
  misc_feature (61): n=t or c
ggaacaaggcaagaaggagaatttaagtagagaatacttcttaagtctttccaaggtaaangaatatatcttaccaatttttcagcttctagaagtccctttagaaagtctactttacgtg

SEQ ID NO: 5942 - DNA, 121 bp, Artificial Sequence
  Synthesized
  misc_feature (61): n=t or c
ccatcaaccagccaattgtcaggattcttgaaatcaggtatggggacagagagcacattcnttcacctgcacatagttctcacagccccttcccaaggtcttcatttaatgaagaccatat

SEQ ID NO: 5943 - DNA, 121 bp, Artificial Sequence
  Synthesized
  misc_feature (61): n=a or t
agtcagtggtgactgtatacttaacttcccattctttggaatttctatcctgtatcccagngggaggaaagcattgaatcccacaatgaggtcggggtgttcatggaacagctgtgaaacg

SEQ ID NO: 5944 - DNA, 121 bp, Artificial Sequence
  Synthesized
  misc_feature (61): n=t or c
gtatccctctggcatacagagtaataattaaagaaaaattagtaatgtgtatttatggaanaggccccttttgcacacaatgcttggctagatgactgtgaagattaatcaagtaagaaga

SEQ ID NO: 5945 - DNA, 121 bp, Artificial Sequence
  Synthesized
  misc_feature (61): n=a or g
gctttcctactgtatgagcaaagcattatttctgtgcaacttataaaattactcttccgancatggtactgtgacctagaaacagccaccactgctatctatgacctatgaccccgttgat

SEQ ID NO: 5946 - DNA, 121 bp, Artificial Sequence
  Synthesized
  misc_feature (61): n=t or c
cctcccagggatgggaggaccaggaaggcagtgggaccacctgtctcttactcacttgtcnccctctgcttcttttactgcccatccccctacgctgcctcttactcctcaatttcaggct

SEQ ID NO: 5947 - DNA, 121 bp, Artificial Sequence
  Synthesized
  misc_feature (61): n=a or g
gaggtcagtcaaatacgtactgagtcttgctgtaattattgctcacgttaaatgaatgtgntttctagcagcagccagaaagagagctgattttgcttttgctgaggaattgttaacgata

SEQ ID NO: 5948 - DNA, 121 bp, Artificial Sequence
  Synthesized
  misc_feature (61): n=a or t
ctaaaataatatttaaagtgggttaccattttacatcttctcaaaaaacaacattacttancacagaatactgtagaaaaatcaaaccttgcagctccatgtgtttttactattttctatt

SEQ ID NO: 5949 - DNA, 121 bp, Artificial Sequence
  Synthesized
  misc_feature (61): n=a or g
tagaagcaagtagaataagtagaatttcattggagcttgggtaaattttgcacggcgtacnttttgccaactttacctttcaaactgtgtttcagagtgtggccaagcattttgcaaaatt

SEQ ID NO: 5950 - DNA, 121 bp, Artificial Sequence
  Synthesized
  misc_feature (61): n=c or g
ttgtttgtcggcctttgaagggaacaaattgccatgttgctagaaaaacaaatacttcctntttgggagaacatagagaacttcagggtaaagctatgatctcttgtttgctacagtaact

SEQ ID NO: 5951 - DNA, 121 bp, Artificial Sequence
  Synthesized
  misc_feature (61): n=c or g
atcacaccacagatttggggagggctgctcggcctcttggcatgtgcaggcacaggagganatctgtgagctgcttgtagaaatgaggacctggtgcactgctctgccttccttgcctctg

SEQ ID NO: 5952 - DNA, 121 bp, Artificial Sequence
  Synthesized
  misc_feature (61): n=a or g
ccacctcatgcatggtgctattattaacaaaacaaaagcgaaagtccttatgtgggattcntggaagtactgaagaaccaaactgtgaattaaacatctcctgcctacatttagtctaaga

SEQ ID NO: 5953 - DNA, 121 bp, Artificial Sequence
  Synthesized
  misc_feature (61): n=a or g
tacttcccccatcgagtgttatttattagtaacatgtctgcctggctgagcaattcatggntagctttttctatcagatgtaagggcaaaatacctagccatgaagcatatagaagggaca

SEQ ID NO: 5954 - DNA, 121 bp, Artificial Sequence
  Synthesized
  misc_feature (61): n=c or g
ttatttaaactctctactgctagaaattgcttcaattgattacacctgggatattaagcantgtgctacaaagatatcacattgcaatctgtctcctccaatcacttgtacagttgcttaa

SEQ ID NO: 5955 - DNA, 121 bp, Artificial Sequence
  Synthesized
  misc_feature (61): n=t or c
aaaccttggtttggctatttttggttcattggttggttttacttgcacataaacctgaatnaccacagcacagtgaaaacaaagttctccctctgatccagatcatatttcaaagcattac

SEQ ID NO: 5956 - DNA, 121 bp, Artificial Sequence
  Synthesized
  misc_feature (61): n=a or g
gtcctgctcacaccaaatggggggcaaagctggaagctcaagaacccttgtctgcaaagtngacttccatcatcttgttttctctaattcgtccgttttggttgcaaattctcaggaggca

SEQ ID NO: 5957 - DNA, 121 bp, Artificial Sequence
  Synthesized
  misc_feature (61): n=a or g
gagggctctgtgtgttattacagacacactgagacacacggaaataggaatataacagacnaaatggcttggcttgccagtgccgagggctgtgtaagaagctgtttctctaaatgtggtt

SEQ ID NO: 5958 - DNA, 121 bp, Artificial Sequence
  Synthesized
  misc_feature (61): n=t or g
ggtgatggtgcctcaggttatctctgacattagcaactagacggagtcccttgtaacactngtgtagtgtagctacgtaattgggaattcaggtcggtgtggaatggaaacttccagggat

SEQ ID NO: 5959 - DNA, 121 bp, Artificial Sequence
  Synthesized
  misc_feature (61): n=t or c
agactaattgcccacatcaaaaacagtcttgcttagtcactcacagtatgaatgtacatanagacaaattctcaaaggaaaaaacaggttatatgccagtaacgtacagttccttgagaca

SEQ ID NO: 5960 - DNA, 121 bp, Artificial Sequence
  Synthesized
  misc_feature (61): n=a or g
tttctatgagctaagttccaccacctactaatactaacatactgttttgtatataaaaaangtaaggcatttgttttgcttcattctataaataaaggcatcatacatagttgcattaata

SEQ ID NO: 5961 - DNA, 121 bp, Artificial Sequence
  Synthesized
  misc_feature (61): n=t or c
tatgcacaaaggcttccttgaggagaaacagcaggtactgatgggattcctgaattcctcngggaggagcacgaggagctaatgaggagactgctaataaggagcacagatgccaggtaga

SEQ ID NO: 5962 - DNA, 121 bp, Artificial Sequence
  Synthesized
  misc_feature (61): n=t or c
cctaagagacacttaagctcaaggcacagccagccatatccccccaaatacatacctattngggatgttttggtgactgtaacacacaaagaacaattatagcatgataaaaagtacctct

SEQ ID NO: 5963 - DNA, 121 bp, Artificial Sequence
  Synthesized
  misc_feature (61): n=c or g
aatgataattatctgccctgcaggggtgttatggggctggctggatgattgcgaaagttangggatttgcttatgtaagagatagcagctgtgtgttagcacaaaggaacaccaacatatc

SEQ ID NO: 5964 - DNA, 121 bp, Artificial Sequence
  Synthesized
  misc_feature (61): n=t or c
tcaaaatgtctgatttttgaatttgtttccatcgtatctacagctcattaaaatgaggtgnaatgttccctaaaatattttttgtatttttacctgcttttcttcccttgaattttgtctg

SEQ ID NO: 5965 - DNA, 121 bp, Artificial Sequence
  Synthesized
  misc_feature (61): n=a or g
cttacggggagtttaacagaggaaagagccttgaagggagacgccagagacacagctaaanagctgagcttctaatgttgagtcttttttgtttcatcagctctgttgttcccccagttgc

SEQ ID NO: 5966 - DNA, 121 bp, Artificial Sequence
  Synthesized
  misc_feature (61): n=t or c
gaaagtgaaggatgtttgctcaaagaagatgaatcacttacgaatctgaagtaattttacngagggaacatgccagcaagcagcaccccacagatgtgctgtgtctgggcacccacacaca

SEQ ID NO: 5967 - DNA, 121 bp, Artificial Sequence
  Synthesized
  misc_feature (61): n=a or g
gaaccatgccttgctttggttggatgtgtggtgctcctgcataagcagcctgtcgcagcantggttatggttggcaaaaaaagaaatggcatccaaaacgaggcaggaaagaatggcaacc

SEQ ID NO: 5968 - DNA, 121 bp, Artificial Sequence
  Synthesized
  misc_feature (61): n=c or g
ctgcaacagacaccccaaaaggaaagggagaagctgatcctgacactgaaaacgctgcaanaggatgagcccagaccaagaaggatgtacggctctgtttgccacttgtagtatcgagttt

SEQ ID NO: 5969 - DNA, 121 bp, Artificial Sequence
  Synthesized
  misc_feature (61): n=a or g
agaggtgctgtactgatatgagacaccagtgagataactgtagatgtaatatatgtatatncaccacatgacgcacatgttttgtgtatgtgatggataaggaaacctttggcttctgcat

SEQ ID NO: 5970 - DNA, 121 bp, Artificial Sequence
  Synthesized
  misc_feature (61): n=a or g
gccctgaaggaggaagaagaggtcagaggaacaacacagtcactggacagattagcagagngaaaaggcagaatgggcaagaaggaagcacaatagctacctccaaagcacatacagcctg

SEQ ID NO: 5971 - DNA, 121 bp, Artificial Sequence
  Synthesized
  misc_feature (61): n=t or c
gttttcatgcaggatttgaacctttgctgtaagggagaggaaagttgtaaaggtcaaaagnagttcctgaaagaaactaacaatacaagaagacaaactgtgtataagacaggtactgcaa

SEQ ID NO: 5972 - DNA, 121 bp, Artificial Sequence
  Synthesized
  misc_feature (61): n=a or g
gcgtggcacctcagcaccctgctggcagtaggctgatagcaattccctcttgtgtttcacnctgcttacacctgagctgcagcgatcttgtgaaggaaggcagaacttcttagacctgttg

SEQ ID NO: 5973 - DNA, 121 bp, Artificial Sequence
  Synthesized
  misc_feature (61): n=t or c
ggagtattcaccttatctgtgccatgaaggctgtcttgcttcagggtcgtaggttgacatnaattactgttcatgctttgcttctgtaaagatactggaatacccttttcaaatgtgtgtt

SEQ ID NO: 5974 - DNA, 121 bp, Artificial Sequence
  Synthesized
  misc_feature (61): n=t or c
tttgtaacgaattcctgaaagtttgtgtactgtcaaataagaaaagtcaggagaggaaaanccttttcccatcaccacaagaaggcagtttttctatcttctgcactctgattccgtacta

SEQ ID NO: 5975 - DNA, 121 bp, Artificial Sequence
  Synthesized
  misc_feature (61): n=a or t
tccttgcatacctgaaggacactcctcactgcatctcgattctgatgcccagcagcctgangcctgccctcaccaggccatagtacagctgttgtgtgctgttcagtacaagttagcatgc

SEQ ID NO: 5976 - DNA, 121 bp, Artificial Sequence
  Synthesized
  misc_feature (61): n=a or g
gcccggggcattgctccttgtcaaatccccaaccagggattgtccgtgttccttcacttcnttgaggttgcaccagaattcctgacacgctacaggagtggtatgcaaagggccgccacac

SEQ ID NO: 5977 - DNA, 121 bp, Artificial Sequence
  Synthesized
  misc_feature (61): n=t or c
ttctaaaactttaggattaaatgattaaaggagtacagatccagaggaaaggagatataangtaagatttctcttcagatgattttgacactggctaccacacaaaaacttttctacacac

SEQ ID NO: 5978 - DNA, 121 bp, Artificial Sequence
  Synthesized
  misc_feature (61): n=t or g
attaaggacgtgacgcctttgctattattacttctgatgaaactggggaaaatcaggactncagaagcagatctgcaagctgtacagggctaaagatcaatgtgtgtgaagcagaaggggg

SEQ ID NO: 5979 - DNA, 121 bp, Artificial Sequence
  Synthesized
  misc_feature (61): n=a or g
ccacctgtgggagaggcagagatagtgggaacccaccctccacgctggtggcagcaggagnaaaccattggtcaacaccatcatgaaattgcaaggctccttccactccactcatgtaaga

SEQ ID NO: 5980 - DNA, 121 bp, Artificial Sequence
  Synthesized
  misc_feature (61): n=a or g
ctgtcagacatgggcaatagcagccactgggcaaggtttgctcctctgccagggcagctcnttcaatgccaggctagcactgacttgggttttcagtgagtgagacaacaaggaccgcagc

SEQ ID NO: 5981 - DNA, 121 bp, Artificial Sequence
  Synthesized
  misc_feature (61): n=t or c
cctgcccagtttcctttcctactagggacagagggctgagtgggaccccattcagcccatngcatgagctgttgtccagcttctcagggggacaggagaagagtgaggcgacatccctttg

SEQ ID NO: 5982 - DNA, 121 bp, Artificial Sequence
  Synthesized
  misc_feature (61): n=a or g
caagctgcaggtgagctgaggagtttggctctggtttagaaagtctttgcacgggtaatangggggtttccctagagctctgccagggcagacttggagttcccaaagcagagcctggctg

SEQ ID NO: 5983 - DNA, 121 bp, Artificial Sequence
  Synthesized
  misc_feature (61): n=t or c
gtattgaggcccctaacacagtgtgggggcatcttctcgtaggaatttgtcaggatctcangaacaagttggattgaatgacttgagattagccatgggatctgctgagttaatgcacagt

SEQ ID NO: 5984 - DNA, 121 bp, Artificial Sequence
  Synthesized
  misc_feature (61): n=a or c
cccttctgtaatgctggaagcgatgggatttgaccacatgcaccaggatggcacacagtgnagaggagctgtgttagcaaccccccttgggtatttttaagaaggaaaagttgctttttat

SEQ ID NO: 5985 - DNA, 121 bp, Artificial Sequence
  Synthesized
  misc_feature (61): n=t or c
ctgcccttgcatttacaaggatggccagtcacgtcactcactctaatgaaattacattagngagacagcaatttgactcttcttaattctaccagtgaggaaagcgctcctgaagataaac

SEQ ID NO: 5986 - DNA, 121 bp, Artificial Sequence
  Synthesized
  misc_feature (61): n=t or c
tatttagatctcagtacccccatgtcactaattctagattcctcaggtactatttcatgtncattaacataattattcatctaatcttgagccgtttccttgtctttcacttttagtttct

SEQ ID NO: 5987 - DNA, 121 bp, Artificial Sequence
  Synthesized
  misc_feature (61): n=t or c
ctaaacagttttaatgtttcatcccaaatcctatttactcaaacaagagccgatcgaggcngcggtaaaacccagcctgtccaaacctttaaagctcgtgtaattttattttatttttttg

SEQ ID NO: 5988 - DNA, 121 bp, Artificial Sequence
  Synthesized
  misc_feature (61): n=a or g
cagtgcagtttggtaatggcactcctgagcctttgtgtttaccagtaaattaggggagtcntgtagggttgcaaatgcaagcactcagaattagcatgagtcattcttacagttggcacgt

SEQ ID NO: 5989 - DNA, 121 bp, Artificial Sequence
  Synthesized
  misc_feature (61): n=a or t
gttgttccataattacacataaagaactataagactctgggatgaaagacacagtgaccangtaaaaactgttattttgatgatgtatgaactatacagtagcagtcaagatcagggatta

SEQ ID NO: 5990 - DNA, 121 bp, Artificial Sequence
  Synthesized
  misc_feature (61): n=t or c
ctgcaggtttgactttttttaaaaatgtaagatctcctgatccagaacctgtgtagcttcnggagaaagcttctttctggctaaatgaaatttgaaatgtaaatgttcacagctttttttg

SEQ ID NO: 5991 - DNA, 121 bp, Artificial Sequence
  Synthesized
  misc_feature (61): n=c or g
ttatgttaatgctctacttatggcatgcctggtggggtgaagatgcatgttcgctccttantcaagtaatgcattgctcttgttgtgttgcgagaataggcgagctggtcaagagggtttg

SEQ ID NO: 5992 - DNA, 121 bp, Artificial Sequence
  Synthesized
  misc_feature (61): n=a or g
ttgagcatcttcacgttttaggacaaatgagggggaagactcccctttgttttacttactncccattttcatcttacaagtagatctttattactggttgcattatgtgctctggtcttaa

SEQ ID NO: 5993 - DNA, 121 bp, Artificial Sequence
  Synthesized
  misc_feature (61): n=t or c
tctgtacacagatagccccactaagcgcacaaggaggctaaccacctgctctggccaaacngctttggtacagccaaggctaggaagaaacacaagtgtctctaaatcagttttatggtcg

SEQ ID NO: 5994 - DNA, 121 bp, Artificial Sequence
  Synthesized
  misc_feature (61): n=a or g
tcgttatttaagactgcctaaaactggatttagatcctgaggttgggtatgcaaattcganagtcttggcacatgaaacatcccccgtggcttcatttttgtcacaagtttccacgtctat

SEQ ID NO: 5995 - DNA, 121 bp, Artificial Sequence
  Synthesized
  misc_feature (61): n=t or c
gaatcaaaaagcaaatatggtctgatagtgaagcactgacaacacaaacaaaagaaatganatttgggatttcaaaacaaattatcccattacattgttggaagtctggacattgatatta

SEQ ID NO: 5996 - DNA, 121 bp, Artificial Sequence
  Synthesized
  misc_feature (61): n=c or g
ttcatgaaaaaaatgttaaaaaaaaaaatcatacaagagactgaagcaaaacaacttcacnttcttatattgagataaagctccccgaggtttcttattttaaacttccagaaagatttta

SEQ ID NO: 5997 - DNA, 121 bp, Artificial Sequence
  Synthesized
  misc_feature (61): n=a or g
tgtctgagtgaacctgcatgctgatgccaaatctcctttcttcagagctgtgttccatgcnggaggacactgctgttctctttactgttgtcttctatgacaacagtacctatacaaagtg

SEQ ID NO: 5998 - DNA, 121 bp, Artificial Sequence
  Synthesized
  misc_feature (61): n=a or c
tgcctgctctgtcctttaccagatgttcaggctttgagatattttgccgtacacaatggtntgaatctgtaaaagaaaattccacctgttgtgttctgcccagcagccgagaagcaaatag

SEQ ID NO: 5999 - DNA, 121 bp, Artificial Sequence
  Synthesized
  misc_feature (61): n=a or g
aattttatctggctgctccctctgccttttatcagagctgtttggctggggttcaggggtnttagagggagctgcagaggttttggcttgtggagttgagtgacaaggtgtgagaggacat

SEQ ID NO: 6000 - DNA, 121 bp, Artificial Sequence
  Synthesized
  misc_feature (61): n=a or t
gagagttcacagcctctccacaaatcttctgtgctgagccactcttctggcaagtaatttntttctttagatctgattagaatttcctctgagataactcatgactggtacctcttgtcct

SEQ ID NO: 6001 - DNA, 121 bp, Artificial Sequence
  Synthesized
  misc_feature (61): n=t or c
acattagggcaaaaggagaaagttttccttcatacgggatcaaacactcaatagaataacntcccactgacagaaggacatccccatggaactgttggatcaactgtccctgtaaccatcc

SEQ ID NO: 6002 - DNA, 121 bp, Artificial Sequence
  Synthesized
  misc_feature (61): n=t or g
ctcagactgactaaagcggtttattctagctagtaaaacctagaagcgttttatattccgngagattaaaacacaactgagtcttttaatggaagtggaattcactgttaagctaacttca

SEQ ID NO: 6003 - DNA, 121 bp, Artificial Sequence
  Synthesized
  misc_feature (61): n=a or g
tggctccaagatgctcccatgcaggagctgaagggcaaagtcatagcagctgattaccagngcaataggatttcggtggaacaccttggtaatgaaggaaagatgaccacagtgctgctgc

SEQ ID NO: 6004 - DNA, 121 bp, Artificial Sequence
  Synthesized
  misc_feature (61): n=a or g
ctttgtgcaaagtgtaattagctgtcagtcgcatttgccaccactgagtacctgattatancagtggcttgacatcttctgtgaatgaatgcaggaaagtgaagagacgtaccctttgctg

SEQ ID NO: 6005 - DNA, 121 bp, Artificial Sequence
  Synthesized
  misc_feature (61): n=a or g
cttgtgaagtgcagagcctgcaggtctgtttgctgtgggctgtgctgcacccagaatatgncatcccgttttagggctgtcctgattcaagggatatgctgaattgctggagagggcctag

SEQ ID NO: 6006 - DNA, 121 bp, Artificial Sequence
  Synthesized
  misc_feature (61): n=t or c
ccatatacacaaagcaaacgctggtagagttggtcccaatttattccttatttttaattangttcttctgatatatttaacacgcaaaaaatgccacacatggaacagccccgtatcctgt

SEQ ID NO: 6007 - DNA, 121 bp, Artificial Sequence
  Synthesized
  misc_feature (61): n=a or g
atttaaatgctgagctgaccatgtctatgcactgcagtgaaaagattgtgagtcatttcantgtgtttggggcaagtttggttaggacaaaagaaaaaagagctgggatggttccttttta

SEQ ID NO: 6008 - DNA, 121 bp, Artificial Sequence
  Synthesized
  misc_feature (61): n=t or c
ctttaggtatatttatctatggtacctatgtaaggattggtcctataatatggtctaatanggtcctacaagcctcttgcagtgacagacagaaaatttatctgtgagcagattcatttca

SEQ ID NO: 6009 - DNA, 121 bp, Artificial Sequence
  Synthesized
  misc_feature (61): n=a or c
cagcataacatatgatggaataaaacaaaccttaagcatttcaagttaccgatgaatctanaagaagcagaaaggtttcagggtataaatctcaaaattccctggcacgtagtttctttct

SEQ ID NO: 6010 - DNA, 121 bp, Artificial Sequence
  Synthesized
  misc_feature (61): n=a or t
tgcaattgcagaactgtaatttatgttcttgccctgcttaggaaatacattaaacatacangattatcttttacactttaaaatcttagaaataaaagcatggtgggaaggaaataaacag

SEQ ID NO: 6011 - DNA, 121 bp, Artificial Sequence
  Synthesized
  misc_feature (61): n=a or g
actttcatgttgcagcatccttggatttcagagaaatgtttaagtgcttctctaataactntaattaaagtgtaccccatgctcacatgcatggggtagactagaagcagggtgtatcaag

SEQ ID NO: 6012 - DNA, 121 bp, Artificial Sequence
  Synthesized
  misc_feature (61): n=t or c
agaatatttatcctctttgacctcttctaaagtgtagagacataatttagttttttagaangtattcccaaaatgtggcattcctttatgtgtgcgtaaagaaatccccaacttttagatg

SEQ ID NO: 6013 - DNA, 121 bp, Artificial Sequence
  Synthesized
  misc_feature (61): n=a or g
ttgtcatgcttgagtgggtgagtgcaggataatttcttaaatgtatgttacattatatttntgaatactactcacttctataacctcatctgacttccccccccttaatttccaaagaaag

SEQ ID NO: 6014 - DNA, 121 bp, Artificial Sequence
  Synthesized
  misc_feature (61): n=t or g
gactacatttacagattttcttgtggtccagtagtaattgtaggttggctttcctgcctantcaaaaaatcatcgaagtttattttaattactgatttcataagtggcagatagtcatatc

SEQ ID NO: 6015 - DNA, 121 bp, Artificial Sequence
  Synthesized
  misc_feature (61): n=a or g
agtgctcacatcacgaaagacaacagatgtgttctgaaaatatccccacgtaatccagagntgaatttgaattttggttctcactgttagcaaagagagagcaaagaactatttccacttg

SEQ ID NO: 6016 - DNA, 121 bp, Artificial Sequence
  Synthesized
  misc_feature (61): n=a or g
gctttgtccaagaaccaggtctcttttttagaagtgctttttcagggtaggcttgggaagnaggcttatgcttttgtctactcccaacaaagcacaactccaggaaaaggctgtgtgtcag

SEQ ID NO: 6017 - DNA, 121 bp, Artificial Sequence
  Synthesized
  misc_feature (61): n=a or t
cagaagttgccaatgtttcttcaggagcccacacactctaaacaggttggaagtctcattncttgtagtaaatacaaatgagcatagggaacaccatcacaagctagaaatgaaatctgtt

SEQ ID NO: 6018 - DNA, 121 bp, Artificial Sequence
  Synthesized
  misc_feature (61): n=a or c
tgtcaaccttaacatgtccgactgtttcacttagtaccatcggtgagggagaggtctttgnaataaaatttgacaataaaatctcaaatgtaatataataaattagaataattggtatgat

SEQ ID NO: 6019 - DNA, 121 bp, Artificial Sequence
  Synthesized
  misc_feature (61): n=a or t
agtagttgtaccaaacttggagtaaaattttctaaatacttcaagtatttagtaatgaganttcaatatgtcatttatgcctgagcatatgatagagtgatccaatatgttacaacaagaa

SEQ ID NO: 6020 - DNA, 121 bp, Artificial Sequence
  Synthesized
  misc_feature (61): n=a or g
cccttctgagctattcagtgatcttctatggatacggggatgagaactgtgcactgtgcgntgtctctgatatggctcagagcaacctgtcaaggtaccatagtccttgcttttagttctg

SEQ ID NO: 6021 - DNA, 121 bp, Artificial Sequence
  Synthesized
  misc_feature (61): n=t or c
gcaggtataaggcaaagacacggcagctcgttttcactcccattcctgccaatgtagcccntcttctactgaggtagaacactcactagaaaatgtattggctttttttatggattcaaag

SEQ ID NO: 6022 - DNA, 121 bp, Artificial Sequence
  Synthesized
  misc_feature (61): n=t or c
gataatgttacaatatactaagtgagcaacatcagctcaaatccctattcccacaagctgnggatccaggtctgaatctggagagaattctttaaggtcagtttaggtgaggagaggcagg

SEQ ID NO: 6023 - DNA, 121 bp, Artificial Sequence
  Synthesized
  misc_feature (61): n=t or g
gtaatgctggtaagtgcgcatatatttatttgctagcagcgggctgcactttgggaacttngggaacctggaggagacatctgctcaaggatcatccatagggagaggctgtttgagaaga

SEQ ID NO: 6024 - DNA, 121 bp, Artificial Sequence
  Synthesized
  misc_feature (61): n=c or g
aggcttgctttgtcccctcagggccttccttatggaactcactcccaggcaggcactgagnattgcaagtcctctctctgctgtgttcttggcctttaagccttcatggtctgtgctgttg

SEQ ID NO: 6025 - DNA, 121 bp, Artificial Sequence
  Synthesized
  misc_feature (61): n=a or g
aattatgatctgtcactgagacatactctcacttgatatgagaacaggcaaatataggccntgcattcattttgtgtgtgatccaagcacagggcagtgtgcagtgagcctgcagtgttcc

SEQ ID NO: 6026 - DNA, 121 bp, Artificial Sequence
  Synthesized
  misc_feature (61): n=a or g
actggagatggtggtaatcatttttcatgttttggcacagtttacctgtgtgtgagagggntgggaaacttctaataaatccaaggggatgttactgcattattttcacatcctctttgtt

SEQ ID NO: 6027 - DNA, 121 bp, Artificial Sequence
  Synthesized
  misc_feature (61): n=t or c
tgacattacctcagtgaccgccatttcacacacagccatctgtggggatctctgtcgtgantttggttatggccaagctgctttgcgctgatgaactgctctcccttccttgacttctcag

SEQ ID NO: 6028 - DNA, 121 bp, Artificial Sequence
  Synthesized
  misc_feature (61): n=c or g
atatgtttcttcccttgtttttccatggtagagaatatctgtgaattctaggtgactgttnggctgtgtcagctgagtgcagtgtgtaagtatgggaaggtgtaaggagttctggcacatc

SEQ ID NO: 6029 - DNA, 121 bp, Artificial Sequence
  Synthesized
  misc_feature (61): n=a or g
attctcccatgagactcagaaggcgaatatcctgaaattgatctgtgtccagagcaatacngggcaggaatggaaatgggaataagcacggaggaatttactgagcaaaataatcatttat

SEQ ID NO: 6030 - DNA, 121 bp, Artificial Sequence
  Synthesized
  misc_feature (61): n=c or g
tactcaatcctttgggattcaaattcttcccatatgttgaacaacatggaaccagtactancaaaagtctccaactcaggcaagctatctctagtttaagttgattttttttgtttgtttg

SEQ ID NO: 6031 - DNA, 121 bp, Artificial Sequence
  Synthesized
  misc_feature (61): n=t or c
ttttttcccactaataaatgcaaaatgacatggaatacacttaaccaagctgcacttttcncctcactagtctcagtctctaatgtttcactaatatttttaggcttgtaaaatgacacta

SEQ ID NO: 6032 - DNA, 121 bp, Artificial Sequence
  Synthesized
  misc_feature (61): n=t or g
tgttcacatcctggctgctgtaattaaagaggcagagatgtgctgtctaaaaaaagagganaaagcagtgcattgctagatggagaattttcttttttctatgttattatcgttgtctcct

SEQ ID NO: 6033 - DNA, 121 bp, Artificial Sequence
  Synthesized
  misc_feature (61): n=t or c
gaaacacacagtctttagcaagaatgcattcagatttctactcaacctattgggccatcanagacaaagccaagtgctgttatgaaaaaaggtcaaaagaactggacttgtttagcttgga

SEQ ID NO: 6034 - DNA, 121 bp, Artificial Sequence
  Synthesized
  misc_feature (61): n=a or g
gaaagattttaccaactccaaaagtaaaactagagacacataggcagtaaccaataagccnttacagacctcctctaacacaaaactaggtcaaactatacaccatgtttcaaatatacaa

SEQ ID NO: 6035 - DNA, 121 bp, Artificial Sequence
  Synthesized
  misc_feature (61): n=a or g
acaagagaagctccagttctataatgcagtttcatgctgaggctcagtgtgaaagtgaggncattcctgtccctgttcccaagatttgttcctgggtattatcctgatgcagaccggccag

SEQ ID NO: 6036 - DNA, 121 bp, Artificial Sequence
  Synthesized
  misc_feature (61): n=t or c
ggatgtgcagggtatcataaaatcacatgcaaactagttgtattgtgaagtgttgtattanactattccttaagtctagtaagtgcagcaggatttactgcctcgtggtttcatctgttgc

SEQ ID NO: 6037 - DNA, 121 bp, Artificial Sequence
  Synthesized
  misc_feature (61): n=t or c
agaaacttgcctaggtagatgatgcttttgttttgctctcacaagagtgttttaggttttnatctgtcagtcattaaacatttttctaaatatttgaagtttttaaaagtcttctcaaaaa

SEQ ID NO: 6038 - DNA, 121 bp, Artificial Sequence
  Synthesized
  misc_feature (61): n=a or c
atcttttaattatgaccatatcttcctccaaatctcttcataaaggaaatccgaagtcttnagataaaaaacaattaccgtccacattaatgtcactcatttagctctgatcttgctgatt

SEQ ID NO: 6039 - DNA, 121 bp, Artificial Sequence
  Synthesized
  misc_feature (61): n=t or g
ttatacgtttggttttcttgcatttgatgccatatttttggggcttctaagatgacttttncagaaaacttcccttgtcttgtctcccaaacatgctcagctcagaagatgagcaatattc

SEQ ID NO: 6040 - DNA, 121 bp, Artificial Sequence
  Synthesized
  misc_feature (61): n=t or c
ctcatactactcttcatctgtccttatttctgtcacctagactgtcctttgtagcttgctnccatgctcacttgtagtaggccccctgctttccttactttctttctaaggctttctcttt

SEQ ID NO: 6041 - DNA, 121 bp, Artificial Sequence
  Synthesized
  misc_feature (61): n=a or g
gtgcagatgttaatactcagctgaaatctctccctttgtagaggaggaattcatcactacnctaatccttacaaggagtcgtgctactatacgagcagaatctgagcacaacttattatct

SEQ ID NO: 6042 - DNA, 121 bp, Artificial Sequence
  Synthesized
  misc_feature (61): n=t or c
gagccatcaccttcccctcagactgcctactactattacctatcctaaaccttttacattntgttcttttgtgtaagtgcagtgagaaaagctgcttccatgaaaactttatgagcttctc

SEQ ID NO: 6043 - DNA, 121 bp, Artificial Sequence
  Synthesized
  misc_feature (61): n=t or c
cagacatcacagaaaacagcatggatttccttgatacacaaggagttctctttttcatcantgaaactccagactcagtaaaataacgtaagagcaatgatgcagttgaaacactcatgga

SEQ ID NO: 6044 - DNA, 121 bp, Artificial Sequence
  Synthesized
  misc_feature (61): n=c or g
gactttacaggtccctgccactgtagaatgaagagcataggatcattctcactcctaagcntgataccgtatttcatatctgccttctgactgacaaggtgtgttgaatcttcaccttagc

SEQ ID NO: 6045 - DNA, 121 bp, Artificial Sequence
  Synthesized
  misc_feature (61): n=a or g
cacagacgtataatttccagctgcattaactgagttttattctgctggactagggtgttangaggtctgattagaagggagaaatgtgtatgaatggtcaggaatttgggatgcttaattt

SEQ ID NO: 6046 - DNA, 121 bp, Artificial Sequence
  Synthesized
  misc_feature (61): n=t or c
ctctcagctcttttggttcacagatcacccaggagcagcctatgattttctgcaatttgantatcttctgtttggcaaatgtatttgctccctatacgtacctgttcacacagacatataa

SEQ ID NO: 6047 - DNA, 121 bp, Artificial Sequence
  Synthesized
  misc_feature (61): n=t or c
agcttagttatacttaaacgtgacatagaaatgacgcagaaaaagcatgaacaatccctcntataaggatgcactctatctggttttattgctctgaaacatgaaagcttctaagaaattt

SEQ ID NO: 6048 - DNA, 121 bp, Artificial Sequence
  Synthesized
  misc_feature (61): n=t or c
tcctcacaaaatgaccactagagcaacacaaagtgggcaagagcagggatgaaattcaganttcaagttacattaatcttgtagcaatcatttttttttaacttataaaaatacatactgc

SEQ ID NO: 6049 - DNA, 121 bp, Artificial Sequence
  Synthesized
  misc_feature (61): n=t or c
tatctcctatagcttaagctttcccaaattgacttcagaggaaattagctttagtcgtganataagcagatataagaagggaatccagagttcccaacttcttgagaaacttgagtttgat

SEQ ID NO: 6050 - DNA, 121 bp, Artificial Sequence
  Synthesized
  misc_feature (61): n=a or g
tgtattgtttgagtcactcgtctcattctatggctgtcccctattggaaatgagggatggntgccacatgcagaacctgatcctgggaacatgaggatcagagatacatcatgagcaactt

SEQ ID NO: 6051 - DNA, 121 bp, Artificial Sequence
  Synthesized
  misc_feature (61): n=a or g
taatttatatatacataagtgaaaggtcagacttacaatacaccatctcagtatttggcantgttcctacccctgctcccattggtaagctgtgatgcactgtatcagtcttctcagccca

SEQ ID NO: 6052 - DNA, 121 bp, Artificial Sequence
  Synthesized
  misc_feature (61): n=t or c
aaatgctggataccttccacaggtattttattttatctcacctctccaattgtacatttcncattgtacacaatgggaatctttccattgactatcccagtgctgggctaagttccatttc

SEQ ID NO: 6053 - DNA, 121 bp, Artificial Sequence
  Synthesized
  misc_feature (61): n=a or g
cgtaggaagagagtcgtgcagaatgtacactgcgctgcattgggtgcttgccctgacttcngctctgggctctgcattgttcccaaagagcctgctgcacagcttttcagtgaaagaaagc

SEQ ID NO: 6054 - DNA, 121 bp, Artificial Sequence
  Synthesized
  misc_feature (61): n=t or g
tttcacacccttaaccacacctataccgccttttggaatacatgcagccaggtctgtttgnctacgttctctgcagttcctgagaagtagagttgaagtgctcccacttgtagaggagctc

SEQ ID NO: 6055 - DNA, 121 bp, Artificial Sequence
  Synthesized
  misc_feature (61): n=a or g
tggaagcctgttcccagcatttgatcaacttcatggtagtgacgtttctcccagtgctcantctgactttgccctggagcaggtttgtgccattcccatcctgccatcagttcgtgggagc

SEQ ID NO: 6056 - DNA, 121 bp, Artificial Sequence
  Synthesized
  misc_feature (61): n=t or c
cagtaaaaacagtcagaatgaagcatccagtcccctggataagagtgggttgagctggaangcttctacctggtaaacttgcccaggagaaacccaacctgattcagagcttagtgtaatt

SEQ ID NO: 6057 - DNA, 121 bp, Artificial Sequence
  Synthesized
  misc_feature (61): n=a or g
atggcaacgaagatgggtcaaggctttaataccacaacatctgaccctgtgttacatcccntgtagtgtcggagagtttccagttccccagcagaggggaactcaggcattatttgccctc

SEQ ID NO: 6058 - DNA, 121 bp, Artificial Sequence
  Synthesized
  misc_feature (61): n=t or g
cctggcccagcaccaacctgaagcacgaatgctggctgaagaaagcccaaactgcaccttncagacacagaaaccttcaagcaatgcgaaattgcattctgaggaaagacctcagcttgta

SEQ ID NO: 6059 - DNA, 121 bp, Artificial Sequence
  Synthesized
  misc_feature (61): n=t or c
ctagaattgaaaatactaaatgccttaagccacaaaatactttcagtgtactcctgatttngctgtgactaagaagcattgtaactctcaaggagatgagactggtccccagggaccgtgc

SEQ ID NO: 6060 - DNA, 121 bp, Artificial Sequence
  Synthesized
  misc_feature (61): n=t or c
tgaagcttgaccgtttcatttcagctgagtccagatggacatatagagggaaggtatttgntcatggtaaaagacagctctgctccagtggtaaatctttagaaatctgtgaactcttccc

SEQ ID NO: 6061 - DNA, 121 bp, Artificial Sequence
  Synthesized
  misc_feature (61): n=a or g
aaaaaaagggtgaaacttcaaaatcactgttcccaaagtgttacttaaatatctgtgctgnttgactgggctgatcggctgctgtttatgagactaaagtagatgcaaaaatgagtcctgg

SEQ ID NO: 6062 - DNA, 121 bp, Artificial Sequence
  Synthesized
  misc_feature (61): n=t or c
acctggtgttgtttgccatgagataatgttcagaacagaaatctgctgtagcttcactgtngcatatgtcacttttttcttgaaaaacaaccaacacacttaagagcacttgttcagtgct

SEQ ID NO: 6063 - DNA, 121 bp, Artificial Sequence
  Synthesized
  misc_feature (61): n=a or g
gacagctgacaggacgttcactgaagactagggactgactgactgacaattaagataacantactagtcttggtcatataatgagacccatcacacaattgaactagtttctcaggtgcta

SEQ ID NO: 6064 - DNA, 121 bp, Artificial Sequence
  Synthesized
  misc_feature (61): n=c or g
gatatatatgacctcccaagacaattttcctgaatggcccccatttaaaattttcttatanttttcctgagtataggctctgagtacctaccattgcatactctgatggtgtcagcctgca

SEQ ID NO: 6065 - DNA, 121 bp, Artificial Sequence
  Synthesized
  misc_feature (61): n=t or c
aaacatgaaaacttttagaaccaggacctgaccttacttcatgacaaccatgacatttgtnctgcagtacaaccctctccctatgtgaccaggctcttgtgttttgtttatagacagcatt

SEQ ID NO: 6066 - DNA, 121 bp, Artificial Sequence
  Synthesized
  misc_feature (61): n=t or c
taggtgctgtggttgatggagtatcaagtctcccctcccaaagcactaagaagattttctnaggccatgttgggctcatctaaacgaagagcagatatgctgccctgcgtaattagtaaca

SEQ ID NO: 6067 - DNA, 121 bp, Artificial Sequence
  Synthesized
  misc_feature (61): n=a or g
tttttcaatcagaggttaatatcagtattattgggaaggcactgatatcttggcccacttncatgtatgacctcatattaaacagagcaaatttgcataaatttcttgtcactaaaatgat

SEQ ID NO: 6068 - DNA, 121 bp, Artificial Sequence
  Synthesized
  misc_feature (61): n=t or c
ttcagtgatatccatttcttttatccattgatttcaatacaatttcccgttactcaggaangcgagttcatttcaacactgcagacgtgattctgcttaattcaattatccttttaaaata

SEQ ID NO: 6069 - DNA, 121 bp, Artificial Sequence
  Synthesized
  misc_feature (61): n=t or c
gcctgtgtgtctgagtgtgttaggcttatttttcctgagaggtgaaagctttgccaaaaancctctcattctcagtgaatcctagaccaaggctggaagccatgagaattagctgcaggtg

SEQ ID NO: 6070 - DNA, 121 bp, Artificial Sequence
  Synthesized
  misc_feature (61): n=a or g
tcagaagatattttattggtagcacacagaaataatcagaggaaaggagctttggcagccngagggggactgccagcaactccaaagaccactgggaacacagggcaagttcattagctgg

SEQ ID NO: 6071 - DNA, 121 bp, Artificial Sequence
  Synthesized
  misc_feature (61): n=a or g
ttatttataaaatactgtatgctttgctttataaagattggctgataaaggaaaatatacnagtcaaggcatagcacaggtatttacaatgagaaaaaaaaatacagatttttctggaaaa

SEQ ID NO: 6072 - DNA, 121 bp, Artificial Sequence
  Synthesized
  misc_feature (61): n=t or c
accacaaaacatgttagaatcaagctggcactcctaaaattatccccatgcagtgggtgangtgagcccacctgatgtgaactgggagagcccacgggtgagaagggatttttactttgtg

SEQ ID NO: 6073 - DNA, 121 bp, Artificial Sequence
  Synthesized
  misc_feature (61): n=a or g
tagcacaactacgcataaggcttcttgttggaagaacctttaaatgtgacatattgagacntaaggaaattttatgaagaaaatgaaatgtgctaataagcatgttattacctatttagga

SEQ ID NO: 6074 - DNA, 121 bp, Artificial Sequence
  Synthesized
  misc_feature (61): n=a or g
taccttacgatcattttcaggggtagcagcagagctggaaggtatccattcatatctacantatctgttgatgtgttgaactgtcctgctggagctaacagtaactcataccggtagtggg

SEQ ID NO: 6075 - DNA, 121 bp, Artificial Sequence
  Synthesized
  misc_feature (61): n=a or g
tgggcggctgtgcagtagcttgctcttcctggctctgctccctttctgtccaaatccagcncaaggttttactgcttttcctggactgctcagtaaggtgggaagcagccttatccatgat

SEQ ID NO: 6076 - DNA, 121 bp, Artificial Sequence
  Synthesized
  misc_feature (61): n=a or g
tgcattttaaaattatcagggtatgagttagataaggagaagtcctggtcccaaggttctncctatgctgtgtttactgctctgccatttttacataacagggcttatgcagatttggcag

SEQ ID NO: 6077 - DNA, 121 bp, Artificial Sequence
  Synthesized
  misc_feature (61): n=a or g
gtcataaatagagatttcaagtcaatagccatcactaagatggatgctttcaaagcacccntgtggcacttttgaaaatgtaaacctaaagttctttttgtatgtaatgcagtcaaatcca

SEQ ID NO: 6078 - DNA, 121 bp, Artificial Sequence
  Synthesized
  misc_feature (61): n=a or c
aatttcttatgggagaaaaaaatttcacagttgggttcccatcagcctggatcaaaacttntatgaatttgactgcattataggaaaatgataagattagtgtgacaagtctgtaaagcta

SEQ ID NO: 6079 - DNA, 121 bp, Artificial Sequence
  Synthesized
  misc_feature (61): n=t or c
gatactttgatgtaactcagtgcaggttttgtagaaacacctgacgtgtatgtttagttcntaaacaccttctgtgcttgatttatcctcacaggttgtcaaggtattcagatgacctgaa

SEQ ID NO: 6080 - DNA, 121 bp, Artificial Sequence
  Synthesized
  misc_feature (61): n=c or g
gtgacgtctgtgaggttggggggggcctcacctaattttaatttagtatctgatctgggcntttgtgaacatatttcttcatctttgtaacttctgttcttcagagtgtacaaaatgtatt

SEQ ID NO: 6081 - DNA, 121 bp, Artificial Sequence
  Synthesized
  misc_feature (61): n=t or c
taactgtcttgaatatgccaggaagacattttggcacgtgacagtttatgtctcccagctnccctaaatctgattgtgcagattatttgaggtatggtgcaaagcctagttcttagttttt

SEQ ID NO: 6082 - DNA, 121 bp, Artificial Sequence
  Synthesized
  misc_feature (61): n=t or c
caatcataatcaattttttttcttttttttttttaataaaaaattgctcactgagaaatangtgtccttcaaatcaatgtacttctaaatgctggctgagacattagacttactacacagc

SEQ ID NO: 6083 - DNA, 121 bp, Artificial Sequence
  Synthesized
  misc_feature (61): n=t or c
ccgaagaaaaattaagcattttttaacttctttctgaagaatactctcccaagaaagcagncagcatctgataaccggttaggacttctgaagaggtgaattgctttagatcttttcacag

SEQ ID NO: 6084 - DNA, 121 bp, Artificial Sequence
  Synthesized
  misc_feature (61): n=a or g
ccatatatgatatgccttttgggaacgtcacaattaaaattccaggaaaacttgtaagtcnctccctaataaccatctcaataattcattagaaaaaaatgttgtcagttcctaattttct

SEQ ID NO: 6085 - DNA, 121 bp, Artificial Sequence
  Synthesized
  misc_feature (61): n=a or g
tacgtgatatctctggttaaatgcctctctgcacatgagaaagctattctggggcatgatnacatatgatcatacgggtcctctgcacctgagatgcgagcacagcttctggaaagagaac

SEQ ID NO: 6086 - DNA, 121 bp, Artificial Sequence
  Synthesized
  misc_feature (61): n=a or g
tgtaaaacttctaaaatgttggtcctcaatattttctcacacctcttgaatacatggcacncttaactcttgtatagtatgttgatgtgactattaggagaatatgtattagggtctaatt

SEQ ID NO: 6087 - DNA, 121 bp, Artificial Sequence
  Synthesized
  misc_feature (61): n=t or c
caaaaatgaaaatccttagaaattcagaaaagttgtggtaattacaagcagaggctcttcnccactagcatttccaatatggtctgacttggaattgggtcagctacctggcagttgcact

SEQ ID NO: 6088 - DNA, 121 bp, Artificial Sequence
  Synthesized
  misc_feature (61): n=a or g
gcatgaaaaaataagtatcagtggagacccagctgctagcagagaagtgaaggagaaattntgactttggggatcaggtttactcctggactttcactgtaccatgcggggtaggactagg

SEQ ID NO: 6089 - DNA, 121 bp, Artificial Sequence
  Synthesized
  misc_feature (61): n=t or c
aaggaacagaaggcatttagcatatgctaatactgagtctcttctgtgcatctgttgaacntagaaagtataaaatccgtgatggagacttgtaagatagtactcagacggatatgagagt

SEQ ID NO: 6090 - DNA, 121 bp, Artificial Sequence
  Synthesized
  misc_feature (61): n=t or c
ggattttcgctctctctccctccctctcttaacctctcatgaatccagacatacacagttnttagaagcctaatagtcaagagtcaaaagcattgtgtttgaaaagcaggaacgcagtgga

SEQ ID NO: 6091 - DNA, 121 bp, Artificial Sequence
  Synthesized
  misc_feature (61): n=c or g
agaaaatggacaagtacttttatggttggtctaaacactctttagctgacgttcatgcaantgaagcctggaggctgaacaaggagaagccttattgaggaggtggaagctgtgctgtgaa

SEQ ID NO: 6092 - DNA, 121 bp, Artificial Sequence
  Synthesized
  misc_feature (61): n=a or g
aaacatatcacagagcagtgcatggcaaacactccggtctgataaccatgagcttcagcantggcagtagtggagctagcatcatctgatgctaggacatagaaggagaacatgacattaa

SEQ ID NO: 6093 - DNA, 121 bp, Artificial Sequence
  Synthesized
  misc_feature (61): n=t or g
cgcctcgtatctccagcatccctcctcccttcttgttggctcagtctctggtttctctgcngtgttttgtgatgtctgcacagcagtcagcaggcatggtgggtgtgctgtccttgtgctg

SEQ ID NO: 6094 - DNA, 121 bp, Artificial Sequence
  Synthesized
  misc_feature (61): n=t or c
tgcctgttcaatcctgatgatgaatgtctcacatcttgtgggcagcaaaagtccccagttnggttactggtctagtgatggtggtgtctgaattcagagaacatgcagtaaagtgaaattc

SEQ ID NO: 6095 - DNA, 121 bp, Artificial Sequence
  Synthesized
  misc_feature (61): n=t or c
ttcacaataatcccaaacagaatggcccctgggaaagctggcaatgagatcatgtgctccnaccatgcaggaaaaaggaactataggctctaacagcactgcagctgccatatccccaggt

SEQ ID NO: 6096 - DNA, 121 bp, Artificial Sequence
  Synthesized
  misc_feature (61): n=a or g
atgcatgaatggctaaggaacggcacaatgcagcagtaaggtttaattgttcatgatcttnaagagcaatcatactgagatctggaacaggtttccaactttgttaagttaagcttatgtc

SEQ ID NO: 6097 - DNA, 121 bp, Artificial Sequence
  Synthesized
  misc_feature (61): n=t or c
acttggattttaaatggctgaagtagcttaccaaaggccactgcttcacagcattgactanggttcatttctttcagcactgaaatgctacatttcatcaagagtttggcaggaggttagc

SEQ ID NO: 6098 - DNA, 121 bp, Artificial Sequence
  Synthesized
  misc_feature (61): n=a or t
gtgtcagaagcttcttgggaaaatagaggtagaataatttgccccagttgccctctccacngtaagtgtcatcccattagaaactgatttaaagcctagattgtgaggtttaatattcctt

SEQ ID NO: 6099 - DNA, 121 bp, Artificial Sequence
  Synthesized
  misc_feature (61): n=a or c
agttctgtgaagctaacatcagggggtgcaagaaaatggcactgccctgcagtaaaattanggctactttcttggagagctgagtcccactggtgtctattttgtgctactccttttcagt

SEQ ID NO: 6100 - DNA, 121 bp, Artificial Sequence
  Synthesized
  misc_feature (61): n=a or g
gcatacacaccatgccagtttgagtctccagctttgggagaggacactgtggtgaagaacnagctctgattttgtctagagggctgagtttctttgatgcttttcagtctgagtcagtcat

SEQ ID NO: 6101 - DNA, 121 bp, Artificial Sequence
  Synthesized
  misc_feature (61): n=a or g
tcctccttgagtattttctggattttctaaatactctttccagatgagacaaccagagtgngacagtttttcaagatgtgggaatatgatgattgaagctgctaagttattttataatcta

SEQ ID NO: 6102 - DNA, 121 bp, Artificial Sequence
  Synthesized
  misc_feature (61): n=a or g
gtagaaggcaagctacctttgtgaggactggaaagatcttggctaaatcccaccaggacangaggtgaagcagatctcagtatcaaaaaaagtagccttcctcctgtttgaaaccttttcc

SEQ ID NO: 6103 - DNA, 121 bp, Artificial Sequence
  Synthesized
  misc_feature (61): n=a or g
ccatgagcagacacttaaagaataagccactttggaaggaagtgctttccttccaagcagncttaaatccctatttaataaggatactaacatccacatagtgaaaaaagctggaaaattg

SEQ ID NO: 6104 - DNA, 121 bp, Artificial Sequence
  Synthesized
  misc_feature (61): n=a or g
aatgattctgttcaggcaaagacatgagatagaactgccacatcttggagaagtgcttgancacccacctgggagcctcacagcattgctgggtgcacccagcagctattccagtgattgg

SEQ ID NO: 6105 - DNA, 121 bp, Artificial Sequence
  Synthesized
  misc_feature (61): n=t or c
atcagggatttctacttcctcaaggaaggcaaggagagagaaacttttcagatctgtcctnactttcagtgaaagtaaacgtgagatgtgtttttcatctgaccttatcctcagtctgcat

SEQ ID NO: 6106 - DNA, 121 bp, Artificial Sequence
  Synthesized
  misc_feature (61): n=c or g
ctccttccaattgcttggaaatgggaatcttctgtggaagaacttatctgctcccaaggancagagcaccaaggacatcacatccatgctacgtataaagaactgccatgggaaggaagca

SEQ ID NO: 6107 - DNA, 121 bp, Artificial Sequence
  Synthesized
  misc_feature (61): n=a or c
tcgcacgtgctccaccatcttcctcgccacgtccttctgcacctgcggcacgaaaggaccnatgcctcctttgccaagcccaaagcgtgcttagctttggatgactgaaatgctcattgct

SEQ ID NO: 6108 - DNA, 121 bp, Artificial Sequence
  Synthesized
  misc_feature (61): n=t or c
tcagcagaaacctgccaagtcaagcccagaacgctgcaggacatacgtgaggttggcccangtgtcacagcaaaaggcaaagcacagacttgaatgccgtgctgaagaaataattgcagta

SEQ ID NO: 6109 - DNA, 121 bp, Artificial Sequence
  Synthesized
  misc_feature (61): n=t or c
tatcaacaagaagaaacaaaactgacaacttcaccctatttactccttcttccatgatctntgaagtcaactgaagatcatgatatggaaaagatgtccctttataggttccctttaaaca

SEQ ID NO: 6110 - DNA, 121 bp, Artificial Sequence
  Synthesized
  misc_feature (61): n=a or t
atagtacatccttgtgcccagtgctcacataatcgtgtaacttaaggcactcacttgatangctttcttttctgggggcaaagttaaggctgctgtggcaattctcaatttcataatataa

SEQ ID NO: 6111 - DNA, 121 bp, Artificial Sequence
  Synthesized
  misc_feature (61): n=a or g
gctgctcggggctgtgccggcacagcacaagggccatgcctcagagtggcagccaactacntccaggggtgctcagttgcacctttttgttcttatgaaggcagagaaaattcagaatgaa

SEQ ID NO: 6112 - DNA, 121 bp, Artificial Sequence
  Synthesized
  misc_feature (61): n=t or c
ttaggaagcagcaaaactaacggtgtttgcatattcctacctgttgtacttccttgtctgnccagtacgacagcctttacgcacggctcaaacagcccactaccagattacatccctacag

SEQ ID NO: 6113 - DNA, 121 bp, Artificial Sequence
  Synthesized
  misc_feature (61): n=t or c
tgcactcattccctctctcctggattggagccttccaggcctgccagatgaaagctccagnttccccagactggttcccaccatctgcaggtaattgcaggcacgcatgtggatgcgaggg

SEQ ID NO: 6114 - DNA, 121 bp, Artificial Sequence
  Synthesized
  misc_feature (61): n=t or g
aagagtttattctacatctgctttagctttgcttctatctatgctactttgcatttggctncaggaatacacaacatttactcaattagttgagcacatcctattacccaaaacagttctg

SEQ ID NO: 6115 - DNA, 121 bp, Artificial Sequence
  Synthesized
  misc_feature (61): n=a or g
tatccataggtagaaaacttcacccatatcataggtgtgcggggttgcaaacgctccttanaaatgatttaaactgtgaaagctctttttatttaagtaatgtataaaaacatgacagttc

SEQ ID NO: 6116 - DNA, 121 bp, Artificial Sequence
  Synthesized
  misc_feature (61): n=a or g
gtattcagaagctcactgggagtaaaaggaacaattgttgttaaaatatgctgtggcctgngttaactgacaaagatagataagtatattaaaagttaaaacagaaacaaaaccaattaac

SEQ ID NO: 6117 - DNA, 121 bp, Artificial Sequence
  Synthesized
  misc_feature (61): n=a or c
ttgtgtgttttctttgttgttttttccccaggaataacaagcaacaacaagatttagtgantcttcaaatggatcatttggtactaacacggaaaatataaatttcaagtactctggaatg

SEQ ID NO: 6118 - DNA, 121 bp, Artificial Sequence
  Synthesized
  misc_feature (61): n=c or g
taaataagagactggcttaactagagagaggatgagagccagcatcatgctatggttcagntgaccaaaagccattcttggagaactgaagtccagcctgacttctgccacagagctcgtg

SEQ ID NO: 6119 - DNA, 121 bp, Artificial Sequence
  Synthesized
  misc_feature (61): n=a or g
gcatggtataatgagatctgtggtgtaatgctgtcacaaaagccaaagtcctaaaaacacngcaggtaccaacgatgcctcagtacagcaaaaatacaaaaggtgctcaaatgtctctcta

SEQ ID NO: 6120 - DNA, 121 bp, Artificial Sequence
  Synthesized
  misc_feature (61): n=t or c
aaacacagttggaaggagggggctggcccgtagtaccagagcatgacataatgagatgagngcgcaaaccagggcttccagcaccttgcgttgctgcatttgacagattttctggtcttgc

SEQ ID NO: 6121 - DNA, 121 bp, Artificial Sequence
  Synthesized
  misc_feature (61): n=t or c
aagaggatgaggttacccactgactttttcccaaccctatgtgcagtccttatagcgcagngatgaacgctttcatcttccatcagtgtttcctgcattctccttgagatgctgtgccatc

SEQ ID NO: 6122 - DNA, 121 bp, Artificial Sequence
  Synthesized
  misc_feature (61): n=t or c
tcttttccgcatttcatgtaatttgaagatcaatgaataaaaaaggccagaaaaattagtncaacagcatctcattatggtcttccctgaatagaatggaaaagcaagggtagacagatat

SEQ ID NO: 6123 - DNA, 121 bp, Artificial Sequence
  Synthesized
  misc_feature (61): n=t or c
tcagggacatttgatgcctaatgagtacagtacggtgctgtggggtgtggtagtaccatgngaactcccatttcagacagtctactccttgctagggcacagcgctccccgcttccagttc

SEQ ID NO: 6124 - DNA, 121 bp, Artificial Sequence
  Synthesized
  misc_feature (61): n=t or c
acatcctcccacctgtcctctttgtgctttggagaacagtgcaggaagctgcctcctggcnctgcagcagatgctgcaagctgatgctgtggaataaagctgccccagtacaaacctggtg

SEQ ID NO: 6125 - DNA, 121 bp, Artificial Sequence
  Synthesized
  misc_feature (61): n=t or c
tgttcttacccagagctaccagagcagggacacacgtgatgctcccagaaggtacagccangtcagaaagaaggcttgtgctttgggaacgttaccatccagccactctgggattctgcag

SEQ ID NO: 6126 - DNA, 121 bp, Artificial Sequence
  Synthesized
  misc_feature (61): n=a or g
ccccaaagagcagtcagcataaacatgctgctgcctccaggcatttggctgaggtgtaacngagtgcctgtaatgagtggctctgggagggctgagggcacacggaggacttagttgagat

SEQ ID NO: 6127 - DNA, 121 bp, Artificial Sequence
  Synthesized
  misc_feature (61): n=a or g
atgggcacaaggcgggtccctcagtctgcctcccaaacctggcagagctacaagggccagnagaatcgcagctccccgaggcctcagagcaatcttgcccacaagaacaagtttttaagat

SEQ ID NO: 6128 - DNA, 121 bp, Artificial Sequence
  Synthesized
  misc_feature (61): n=t or c
tttatttgtagtaacataagacatgcttggaaatgcagaaggcagctctgatattcttggngcatctgtccttgtttgactgtttgaatcgagactggtgtgtgtgtgtccagtagtaact

SEQ ID NO: 6129 - DNA, 121 bp, Artificial Sequence
  Synthesized
  misc_feature (61): n=t or c
ttgctaatatagacaggtcaccacaatgaaaatagctctatctccttggctaccacaggangccattactgcccctgtaaaaagtattcttttattcggaaaggtgctaaactgtacttct

SEQ ID NO: 6130 - DNA, 121 bp, Artificial Sequence
  Synthesized
  misc_feature (61): n=a or g
tgcagtttataatcaggatttttgtgtcatgccctcatttctgttcttgtcggtcaagtcnagagcatacaactcaacaggctctcctggtatattttcaactggactttaccataaacac

SEQ ID NO: 6131 - DNA, 121 bp, Artificial Sequence
  Synthesized
  misc_feature (61): n=c or g
ctaataactgtcaagacaggtggtactttcaatctgtttatcttatcaaatggttattgangtgcttgcaactttcacattttaaattattccctgattttggaaggttaattaaagtttg

SEQ ID NO: 6132 - DNA, 121 bp, Artificial Sequence
  Synthesized
  misc_feature (61): n=c or g
ttcacggatgaagtgtacccatcgtcagttctgccttttatctcccataacacaaaatttncttcaacatttctaacataagtatcaacatcgtatctgtaaaacatggaatgtgatcctt

SEQ ID NO: 6133 - DNA, 121 bp, Artificial Sequence
  Synthesized
  misc_feature (61): n=t or c
ttgtttttcccctctgtaaaataggaatgaggcacactttcggtcatcatgtggggctaanggcagttacaaatattgcattgactcttctgatgcctctcagtgcccacttgccagttta

SEQ ID NO: 6134 - DNA, 121 bp, Artificial Sequence
  Synthesized
  misc_feature (61): n=a or g
ccgtggcactgaggatctggggaccacctactagcctccacccagtcagtcatcccacccntaagccagccaccagggtcctctcacaagaactggtgcacattgtgcaggacattcagca

SEQ ID NO: 6135 - DNA, 121 bp, Artificial Sequence
  Synthesized
  misc_feature (61): n=a or g
tttcctttgtttccatcagcactggagtttgaagtctgggagatactaggagtgtgagacnttttcatgtttatggcatggatatatgtggatatggctccgcctctttgtctgcatcttt

SEQ ID NO: 6136 - DNA, 121 bp, Artificial Sequence
  Synthesized
  misc_feature (61): n=c or g
tttcgttttgaatgtctaagcgtgcgtcgatacctgataacgcggctgtacgtaaataccnatagctgatgcttgctttagtaaagtgcctctgaggaaggaggaagaccgagctgtaaaa

SEQ ID NO: 6137 - DNA, 121 bp, Artificial Sequence
  Synthesized
  misc_feature (61): n=t or c
ccgtgcttttctgtgctaagagtttactgcctctgcacaaagtgtcacatacaatacttangtattacctctcaaacaatactgcatcagtctgggtgagataaaattcatgctggaatag

SEQ ID NO: 6138 - DNA, 121 bp, Artificial Sequence
  Synthesized
  misc_feature (61): n=a or g
cacccacaaaatctgctataaacctagttgagaaagataaggaggagattgctgtgtcacncaaaactttgggtaatcaggacaaagctcctggacatgataaagcagcaatgaagatagc

SEQ ID NO: 6139 - DNA, 121 bp, Artificial Sequence
  Synthesized
  misc_feature (61): n=t or g
aatatgaaatcctcagtgagttcaccttagacaagcacatctgaggagttctcccctgtanaaaaggtctcaagattggacttctacagcagggtatactgtcttgtagaagaggctgctg

SEQ ID NO: 6140 - DNA, 121 bp, Artificial Sequence
  Synthesized
  misc_feature (61): n=t or c
tttatgatgtccagcccaggaaatgcaccaaaggagctgtagggtcgaatcagacagggcncctcttcatctggcgtgtcatgctttatttttgcaattagagctgctccttactgggcaa

SEQ ID NO: 6141 - DNA, 121 bp, Artificial Sequence
  Synthesized
  misc_feature (61): n=a or g
ttaggtttcctcagagaattcttaatcaaagaatgtatacaactatatcatatttaattcnatgtatcatgctaagccataagaaaatggacagctgctatctatttctgcatactgcctc

SEQ ID NO: 6142 - DNA, 121 bp, Artificial Sequence
  Synthesized
  misc_feature (61): n=t or c
tagtatgtaaattagcctgtctatcttaatgtgtctcatattaaagtgatttcttctcatnttcccaaaatatattttcagaataagtaaaaacatatatatatatatctgtatattagca

SEQ ID NO: 6143 - DNA, 121 bp, Artificial Sequence
  Synthesized
  misc_feature (61): n=t or c
tgaacaagtctatggcaaaggaattagtagggctctcacagtttcaggaactgtgaaaggnagcagaacagacatctcccattgaagataccttactcattacgtttcttaggttgtggca

SEQ ID NO: 6144 - DNA, 121 bp, Artificial Sequence
  Synthesized
  misc_feature (61): n=a or g
tacaatcacagacactaaaaatccctcttccatatttgtttcccagtattttacaatcccncatccttctccctaccagaaggtgttcattttgccctaaaggggacgtgaaatgaataaa

SEQ ID NO: 6145 - DNA, 121 bp, Artificial Sequence
  Synthesized
  misc_feature (61): n=c or g
aactgataacgagtgcatatggatcttttcagtttaatgctttgtttacactgaacactgntttgcctgcgaagtgtgctttaaattactctgctttattttaaaccaaatattaacctct

SEQ ID NO: 6146 - DNA, 121 bp, Artificial Sequence
  Synthesized
  misc_feature (61): n=t or c
gccaagttcctaagaagtgcccagaagcgcatagtctgatgtaccaggtctctgcctcatnccgggctggtggattcatgttctccatggagccttcagcattaaatgcaacaggaaatgc

SEQ ID NO: 6147 - DNA, 121 bp, Artificial Sequence
  Synthesized
  misc_feature (61): n=t or c
gctttcttgcttactcacctcctgactctccaaactcatcattgctgacatgaaggacagnggcagctgtgagtagaaaggtgcagtgctcatacacaaactgtatttgcagaatatccaa

SEQ ID NO: 6148 - DNA, 121 bp, Artificial Sequence
  Synthesized
  misc_feature (61): n=t or g
ggcatctctgccacaagaagctacgtgagttaagacaactgagttaggaacgaggaataangttatttctagctaaatgggcaaaattgtcaattttcacagactttctcccactcctcta

SEQ ID NO: 6149 - DNA, 121 bp, Artificial Sequence
  Synthesized
  misc_feature (61): n=t or c
agatttttatcatcagacttatcacttaggtttagaagaccatggccaggagtggtaactnttgagattgcttccatccccaagaaacagtcatacattgttccgctccctcttctgccag

SEQ ID NO: 6150 - DNA, 121 bp, Artificial Sequence
  Synthesized
  misc_feature (61): n=t or c
ctgcatgctttattgagtgcaaatactgttttaccattacttttaataatctgggactttntgtactttactttctacttgtttatatcagcatcttaagttgtgattgagtagcttgtgc

SEQ ID NO: 6151 - DNA, 121 bp, Artificial Sequence
  Synthesized
  misc_feature (61): n=t or c
ctgcactgatgcagtgtcacttcatgtatactagtacagtcttacccatgtagataccaangttcaggattgagactcaaccttctagttctgattgcttctgtttaatagtgtttaatga

SEQ ID NO: 6152 - DNA, 121 bp, Artificial Sequence
  Synthesized
  misc_feature (61): n=t or c
aaatttcaagtagacataaaaaatatgcaagaataatctcttaagggaagtggcagaaganatcactcaaattatgtaaaattttacccgttttgaagaatttaggactttattacagtga

SEQ ID NO: 6153 - DNA, 121 bp, Artificial Sequence
  Synthesized
  misc_feature (61): n=t or c
agccagggatgtaaacacagtaatcacatttctggaagcagtcactgtactgcacttctcnagtcactgctctcgtgcaaagccatcctgtctacaggaatgacaagaaagtagaaaacag

SEQ ID NO: 6154 - DNA, 121 bp, Artificial Sequence
  Synthesized
  misc_feature (61): n=a or g
tccaatattaagtttttcttaaatgatatttacgccgaacattgcagttagaagaagctgnaggaaagaaaaaggaaacatgatgcttattacaaaaatgactacttcagcacagaaaatg

SEQ ID NO: 6155 - DNA, 121 bp, Artificial Sequence
  Synthesized
  misc_feature (61): n=a or g
gtgggaaggggttatacagtctatgagctataagcaaaatgactgcgggagtgaagaatgntttagtgatgctacttgttgctgttacagtgttgttggtttggttttgtttaaaaaggga

SEQ ID NO: 6156 - DNA, 121 bp, Artificial Sequence
  Synthesized
  misc_feature (61): n=a or g
tgtctcttggctaaatgctcatattttgcatgatgagggcctctcaacctgaatgaccctntgattagtgcctcgagcattctgcatttctaaagctgttgaactttctccagagttatga

SEQ ID NO: 6157 - DNA, 121 bp, Artificial Sequence
  Synthesized
  misc_feature (61): n=a or g
tggtggggaggaaaacaagttaacatgagtgactctgatgaagggagatgatgaagcaaantgctgatataatcagtccttcaagtaagaagcctaggtgtttaaaatgaatctgtcatct

SEQ ID NO: 6158 - DNA, 121 bp, Artificial Sequence
  Synthesized
  misc_feature (61): n=t or c
taagatgtaggtgcccgagttgtatttgtggtaatggctcatattgaatacttcgctaaancaggccttaattaattgaaaaaccgagacatataaatgcattaagggttaatgttacagc

SEQ ID NO: 6159 - DNA, 121 bp, Artificial Sequence
  Synthesized
  misc_feature (61): n=t or c
taaattgcaagactgctgttaccaccagcatattgcttaaagtctcacctttggaggaagngtatcattttcattcttgagaacaaaccttccttctcgatcatctttgttccagtttaat

SEQ ID NO: 6160 - DNA, 121 bp, Artificial Sequence
  Synthesized
  misc_feature (61): n=a or g
taatgggcacaaactgtgcagatctgatgctggcttcactaggagtaccaggatatctggncacttttaatcattctcttttgtttcctcattcctgcattagttttaactctggaaaatg

SEQ ID NO: 6161 - DNA, 121 bp, Artificial Sequence
  Synthesized
  misc_feature (61): n=t or g
gaatgttcttgtggatcacactgtagaggatgctgccttcatggtttaaacagggaaaaangtatatggaacaagactgagaagtcaaggttggtgtgggcaggcaattggagggtgcaag

SEQ ID NO: 6162 - DNA, 121 bp, Artificial Sequence
  Synthesized
  misc_feature (61): n=t or g
aactaagctttttgaactgggaaaactgatctctatttatttcactctctcaaaagagaanaaaaatgagctttcttgcttttccaactttatatcacttactctttctctgcaactgcag

SEQ ID NO: 6163 - DNA, 121 bp, Artificial Sequence
  Synthesized
  misc_feature (61): n=a or g
aggtaaccgttgaagtatcccccagtgaaaaggttcagctgctgcttaactctggaaaatntagatactgttttttatataggacagtaagcgtatgcagtatctaagactgacacttgca

SEQ ID NO: 6164 - DNA, 121 bp, Artificial Sequence
  Synthesized
  misc_feature (61): n=a or g
tctgctatcaagactgcacaagtatgaacttatttctgtcatcttccatgtctggaagccntgaagtgagacctggagaagtgctgtcctgagttctgctcacactcacatccttgtggtt

SEQ ID NO: 6165 - DNA, 121 bp, Artificial Sequence
  Synthesized
  misc_feature (61): n=a or c
aggaattttgtgcatccacagtagtgtctgtgagggcactggattgaagaagaataagggnagattatatggatatgttgtatctgtcttacatgactgcaaacaggcagactgaacgtgg

SEQ ID NO: 6166 - DNA, 121 bp, Artificial Sequence
  Synthesized
  misc_feature (61): n=t or c
gcaaacacatctacacctactctctccagtggctctctagtaactgtgcctgtcacttagnctatctttggacaacttttgctgtaatcaaaatactggatcatcctctaaagtactgcta

SEQ ID NO: 6167 - DNA, 121 bp, Artificial Sequence
  Synthesized
  misc_feature (61): n=t or c
tagcatttctatttcccctcctcaccccctcccaccagactaattaccagctcattaaggntgtcctaatgaattatgttacagcattaagaaagggcttgaaataaatgctcgtttaggt

SEQ ID NO: 6168 - DNA, 121 bp, Artificial Sequence
  Synthesized
  misc_feature (61): n=a or g
cctgggaaaaaaagatgcagccacctatgtagcagccatgtcagtgtaagacaaggccagnggccagttcctactctcctttttcatataggcagtgcttttgacttcatcgagcccagca

SEQ ID NO: 6169 - DNA, 121 bp, Artificial Sequence
  Synthesized
  misc_feature (61): n=a or g
catgaaatgcctaaataattattttttagttcagttccctatctatgtttgttgagtgagnacagcttagtaatcagtctgaataatagcaaggtatcttgcctgcagacatctcactgtc

SEQ ID NO: 6170 - DNA, 121 bp, Artificial Sequence
  Synthesized
  misc_feature (61): n=t or c
aaatagacatgtgctggagtgtgtgaaattccaagttatttttccccttatattgcatctngaggggaaatcagatactggagtaggtacccaaagtagttgaagaattggattgttgtaa

SEQ ID NO: 6171 - DNA, 121 bp, Artificial Sequence
  Synthesized
  misc_feature (61): n=t or c
ataattactgttactactgttgtcttctggtttacagtgtttctttattagcagctcctantgccagaaggtttaagcatttaataatctgtcaaggtggtcttttgcttgtttttttttt

SEQ ID NO: 6172 - DNA, 121 bp, Artificial Sequence
  Synthesized
  misc_feature (61): n=a or g
ctgttatttttaaatgctagggaaaagtaatcccagccaacgatcccactcagagatacgnctgtaaagaaagcagggagctattgtgaatttgttgttgtgcctccactgtgtgggagag

SEQ ID NO: 6173 - DNA, 121 bp, Artificial Sequence
  Synthesized
  misc_feature (61): n=a or g
taataaaaaatgaaggaggaatgtgtctgtttaacagttctttctatagcccaccactacngtattatgaagccctaagaacatcccattctgcatgtgtcaagttctgacagagtcctgc

SEQ ID NO: 6174 - DNA, 121 bp, Artificial Sequence
  Synthesized
  misc_feature (61): n=a or g
ctctgaccatcctcccactgttctgtatgaaagctaaatactgagataacagcaaaaaatntgggatttcaattttggagatggtttgggtactatttttatttaaaaaagaaaaaaaatg

SEQ ID NO: 6175 - DNA, 121 bp, Artificial Sequence
  Synthesized
  misc_feature (61): n=t or c
atgtaaaacatatgtttaaaacatgttcaccgttgtgcatcatgcagtaacgatggctgangctgaaggaccaatagatatcaggtgtgatttgataggtgcatgggttgtttttttcctc

SEQ ID NO: 6176 - DNA, 121 bp, Artificial Sequence
  Synthesized
  misc_feature (61): n=t or c
agcctcagcctttcttgtttgctgttttgttgtttcagttctcagctggagattatttctnctttctgtctcctcttgatacatgaatgtgctgtgtcaggcttgccttcaggtcagtgtc

SEQ ID NO: 6177 - DNA, 121 bp, Artificial Sequence
  Synthesized
  misc_feature (61): n=a or g
attaggttgggctgcccagacctaggcatatggtgcttcagggtttgataagcccaacagngttggtcttccatcctgggaaagggccactgaattctcagctgctgaaaggtgtgagtag

SEQ ID NO: 6178 - DNA, 121 bp, Artificial Sequence
  Synthesized
  misc_feature (61): n=t or c
caaatagtttgcagaaaaagtgtgtgaaacctgtgtgaggtaatgaggtttaaatccctgngaattggggcttggtgaaatcattcaaacccggacaagatgctgctctggtttgaaagtc

SEQ ID NO: 6179 - DNA, 121 bp, Artificial Sequence
  Synthesized
  misc_feature (61): n=a or c
ttggatattccaaagctttaaaacaaaagtagaaattatttcataatattacatctcacanattttacgtccctgaacaacacagctagatgtcaataaataagattgatctatagcttct

SEQ ID NO: 6180 - DNA, 121 bp, Artificial Sequence
  Synthesized
  misc_feature (61): n=t or c
caaggggctgaacagatttccattccatattaccactgattcctactatatcccctcaccntttaaatgctctttcacttttcatacaacccttaccagcgaccattctcacgggtttact

SEQ ID NO: 6181 - DNA, 121 bp, Artificial Sequence
  Synthesized
  misc_feature (61): n=t or g
gatgtagcaaaaatcaatggtcttttgcctgtgctatagtactgatattttaagtgactgnttttttcctccaggttagagtgatgacttgtgaataaaggtaaataaagctctactgctc

SEQ ID NO: 6182 - DNA, 121 bp, Artificial Sequence
  Synthesized
  misc_feature (61): n=t or c
tttcctattcccactgcagacaacatctcttaggctattttcaggtcatttgcttttctcngaagccatctgaccacttggtaagcacgaggttctcacacctctccctgtctggacaaag

SEQ ID NO: 6183 - DNA, 121 bp, Artificial Sequence
  Synthesized
  misc_feature (61): n=t or c
gaaaaaaagcttatttcctgctactgaaactgcagctcagactagataggaagccaagagntttcactggaccccaagggaaggttgtttggtaactcttgttgaaattcagtgggagttg

SEQ ID NO: 6184 - DNA, 121 bp, Artificial Sequence
  Synthesized
  misc_feature (61): n=a or g
gaccagagcgaaattctaaagcaagtatgacttaaccttttcggaagaggactatgttacngagcacttaaacgtactggatgtacttaaagcaattgggccagaaaggttacacttgtaa

SEQ ID NO: 6185 - DNA, 121 bp, Artificial Sequence
  Synthesized
  misc_feature (61): n=a or g
ctatactgacagagcatcttaatatagttacagaactacgtggagggcaatgaaagagggntattctgtcacctagtcacttctgcttttgtgaagccacacataacacaaagttaattaa

SEQ ID NO: 6186 - DNA, 121 bp, Artificial Sequence
  Synthesized
  misc_feature (61): n=a or g
ctctgcccgcccggcgtctttacctattgctatatttaaaagagcgatgttcggtatttcngattatctataatcagtaattcccatctaatcaattagatgttgataggtttgcagaaaa

SEQ ID NO: 6187 - DNA, 121 bp, Artificial Sequence
  Synthesized
  misc_feature (61): n=a or t
atttaagagcttgaggtcttgcatttctctgtcctgctgcacagctgtgtggctgaaaaangtttcccttctggtggtacagtttcctgagaactccatgaagttactgccacagagttca

SEQ ID NO: 6188 - DNA, 121 bp, Artificial Sequence
  Synthesized
  misc_feature (61): n=c or g
ccccagaaattttccttaacttttccagtgtgatcagtagagcagttctgtatggttctcntttggattgggagcacaatggtcacagacgttacttaaaaataatgacctaacatcaaaa

SEQ ID NO: 6189 - DNA, 121 bp, Artificial Sequence
  Synthesized
  misc_feature (61): n=a or g
ggctgtaaaggaatatcacaaaactactgtaattcagtagtgtttgtaagcactcttttcnctcacaatgtcctgtcccagtccttaaagtgcatatgccaatttggttcaagttttataa

SEQ ID NO: 6190 - DNA, 121 bp, Artificial Sequence
  Synthesized
  misc_feature (61): n=a or g
agggttgaaattctctccataaagacagactgagaatactgagattcacagcaggtatganaactcagctccacaatactgacagtaacaaactgaaaattttcagagtggtaaactgcac

SEQ ID NO: 6191 - DNA, 121 bp, Artificial Sequence
  Synthesized
  misc_feature (61): n=c or g
ctgcttaagaggtggagggatttggaggccattaacacaaaatggagaaaagctacatttnattttgtaagagaaggaaaaggcaagctgcaggagacaattccacttactttgcagaagg

SEQ ID NO: 6192 - DNA, 121 bp, Artificial Sequence
  Synthesized
  misc_feature (61): n=a or g
gggaggtgacccatagagatgttaatgccctgccaggatcagcgtgacagcagaaattccngcgctgttcagaagaggttttgtatcaagctctctgctaaagcaaaggtaacactgctgc

SEQ ID NO: 6193 - DNA, 121 bp, Artificial Sequence
  Synthesized
  misc_feature (61): n=t or c
ctgaaaaggttatgaattgttttggctgagagagagaagggacaaggatcagttaagaagngtgcatttttggatctaaagggtatttacttgctaagggggtaagtaatacgtggtgatc

SEQ ID NO: 6194 - DNA, 121 bp, Artificial Sequence
  Synthesized
  misc_feature (61): n=a or g
cagaaagcagcgtgtgaggtagcacttgctccttcacatggctggggctgcaactggggangacttgctggaactgaggattcagctttcatcacggctttggaaacctgtgctggggttt

SEQ ID NO: 6195 - DNA, 121 bp, Artificial Sequence
  Synthesized
  misc_feature (61): n=t or c
agtgtacttcattgtaagcgtatgaagatcctccttgaaaagttacacttgtacattacangtatgtattccattgcctcaaacagttatgagcacacatatttttgaataacaagatcat

SEQ ID NO: 6196 - DNA, 121 bp, Artificial Sequence
  Synthesized
  misc_feature (61): n=a or g
ttctatgtgacatagagctatgagcgctaggctagttcatgagagggggagtttatgacancagagaagcctatatagtgaagaatgaaacaagtaaaagcagaagcatcctctttgcctt

SEQ ID NO: 6197 - DNA, 121 bp, Artificial Sequence
  Synthesized
  misc_feature (61): n=a or t
ttttttgttgtgttgttttacataggagcagtcacactgggtcagagaggaagtcgttcanagtccattatctcctctcagaggaaagctggtagcgggtcagagaaaagtacatgacctg

SEQ ID NO: 6198 - DNA, 121 bp, Artificial Sequence
  Synthesized
  misc_feature (61): n=t or g
gaggcttttctttaccaaaaccaaggttatgatgggtgaacaaactgagcaatatgtgacnctagtaagtgtgacaaaacctgtgctcacttgcagaggtgggttctagtggtgagaggac

SEQ ID NO: 6199 - DNA, 121 bp, Artificial Sequence
  Synthesized
  misc_feature (61): n=t or c
tggcacagtgtacatccagaaggcaaaggcagcatcagcagttcaaggctgtatgaaatantttggatatttgccaattatttctcatgtatttaatagctttctaaatgttctggctttc

SEQ ID NO: 6200 - DNA, 121 bp, Artificial Sequence
  Synthesized
  misc_feature (61): n=a or t
ccaacgttatttaaaagcctttattctggaaatgttaatgtgtattcttaatttacttacntaaatagtctgcccttcagaaagtagtgtatcttatgcttaagacttttaaaggctaatt

SEQ ID NO: 6201 - DNA, 121 bp, Artificial Sequence
  Synthesized
  misc_feature (61): n=a or g
taaaccataggttatgcaccactgctgataagcaagcgtattctttagaacggttcactcnctggcacaaatgttgccagtacctgtggtcattcttggagagggagagtgcgtagcagag

SEQ ID NO: 6202 - DNA, 121 bp, Artificial Sequence
  Synthesized
  misc_feature (61): n=t or c
ttcttcactctcctccagccacacataattttcaaaatatagcaaggtgaaatttcctttnttctgtctagactatttttattgccctctaatatcatataattaaaaaaaaaatcacagt

SEQ ID NO: 6203 - DNA, 121 bp, Artificial Sequence
  Synthesized
  misc_feature (61): n=t or c
ttgaaacactatttattccagaacgtagatttggattatatttatgtaaaaagggtaaggnatgatatgtgggcatatggctacagtttcatatgtggaatattatcctcagcagtgctaa

SEQ ID NO: 6204 - DNA, 121 bp, Artificial Sequence
  Synthesized
  misc_feature (61): n=t or c
caagtagctttgtttcacttattaaactatctttatcttgacccacgagttttctttcttngcttttctgatgccattccccatcttgagtaagcaagcagcttgagtgcttagtttctgg

SEQ ID NO: 6205 - DNA, 121 bp, Artificial Sequence
  Synthesized
  misc_feature (61): n=a or t
aaagatagcacgagttattacttcatgtcttcaaagttaccctttaaaatatttcaaattntcttttagtctgattattaggaagcactaacaacaagctgctggcaatagaatctaactg

SEQ ID NO: 6206 - DNA, 121 bp, Artificial Sequence
  Synthesized
  misc_feature (61): n=t or c
agatgtattgacttggaaatcctattgcaagattagcattttagcagattttataaattcnaaaaaatatgagatattagaggaatgaaagggatgtggatgttttcagggtttttgtagt

SEQ ID NO: 6207 - DNA, 121 bp, Artificial Sequence
  Synthesized
  misc_feature (61): n=t or c
atgtcatttgagaaattatgccacaatgagaattttcagtttggttgtttcactgcagagntcttggagctgaaattcatggctcgttgttactgggcccatcacttttcttctctctata

SEQ ID NO: 6208 - DNA, 121 bp, Artificial Sequence
  Synthesized
  misc_feature (61): n=a or g
tgactaagcattcctgaaggacaagatctaaatctcagtgagattattagaagtctttggntccagctcaaagtcatggaatgttacgttaaaatgtggtagctgctgtttggtcccgtaa

SEQ ID NO: 6209 - DNA, 121 bp, Artificial Sequence
  Synthesized
  misc_feature (61): n=t or c
caggaaaaaaatgttatgttttagtgtatgtatttgtgtttttcttattgcattagaaganaggagacagattataatttaggaaagtatctacagtttagaacatagatctgcttacctg

SEQ ID NO: 6210 - DNA, 121 bp, Artificial Sequence
  Synthesized
  misc_feature (61): n=t or c
tttcaattacgctaaatgactttaatcctgcaaatgatgttctactttaattagaagttcntctctttattacagcatgatggatgtccactttattagattcaagtgtgacactataagc

SEQ ID NO: 6211 - DNA, 121 bp, Artificial Sequence
  Synthesized
  misc_feature (61): n=a or g
catctgaagctctggctcagtactgagaagagattatttgttattgcaagtaaaacatacntaaaatgtaggttattttatctttagaggcttggatgaaaatattattctagggcgcatg

SEQ ID NO: 6212 - DNA, 121 bp, Artificial Sequence
  Synthesized
  misc_feature (61): n=a or g
cctaagtaagctaacccctgctgaaataaatgggcagactgacttatgtcactctagaganctgtcatgttatgactgtgccctcctcaatgggctgtgcagttaaagatactgtctaatg

SEQ ID NO: 6213 - DNA, 121 bp, Artificial Sequence
  Synthesized
  misc_feature (61): n=a or g
ggtggagcagccgacaaggcagtcttttgtgttctccagcatgaatcatcatgctcatccnaaggcgcgtgttaagcacatattaagttgttgcaggatatgggccacatttagagcactg

SEQ ID NO: 6214 - DNA, 121 bp, Artificial Sequence
  Synthesized
  misc_feature (61): n=a or g
aacctaaaatgtaaatatacaaaacactgtgatgctgctaaacatttatcagtcacacctntaataaatatacagtatctgtatttgtctgccaaacttcttctagttaaatactgagctt

SEQ ID NO: 6215 - DNA, 121 bp, Artificial Sequence
  Synthesized
  misc_feature (61): n=a or c
gcataatatggtggtccttatttaaatcttccatgcagatgtcatactgggttaattgacnaggcactggattcgattgtatgtataacagcatagcgaccactgatgctcggggtagtgt

SEQ ID NO: 6216 - DNA, 121 bp, Artificial Sequence
  Synthesized
  misc_feature (61): n=t or g
aaagggtacaaatcatcttctcccaactccatcactgaatgggagacagtgaatccacttntgtttctgccattatggactagagaggggtactttgactagcaagacctttgacatagtt

SEQ ID NO: 6217 - DNA, 121 bp, Artificial Sequence
  Synthesized
  misc_feature (61): n=t or c
aagtctagatccttgggttcttctgagtactgtaatcatataagtctgctcttggctactngcttatgtgaaaaagcaaatgctttacattgttatagtcagcagagatgtgaacagctcc

SEQ ID NO: 6218 - DNA, 121 bp, Artificial Sequence
  Synthesized
  misc_feature (61): n=a or g
gcagtgcctgacctcacctgatttttgtagtcgtgcttgtgggggtgcaagaaggaaggancaggaacttgctgggtgattaccatgagttattaaattaacgaaataacaattttaatat

SEQ ID NO: 6219 - DNA, 121 bp, Artificial Sequence
  Synthesized
  misc_feature (61): n=a or g
agttgtcctgaccacaggtaaagaatgacaggctccagctgatgtgaaaaccccaagtttnttataaatcacaaagaaaaacataacatcagctaaattgagaaagggtgcttcacacacc

SEQ ID NO: 6220 - DNA, 121 bp, Artificial Sequence
  Synthesized
  misc_feature (61): n=c or g
tggtaccttcagagcataggattgagtctagtgtctgctacaatcagacacttaatttctnttccctaatctggaggggcttttgttgttctttttttggctttgttcagtggtttgttat

SEQ ID NO: 6221 - DNA, 121 bp, Artificial Sequence
  Synthesized
  misc_feature (61): n=a or c
agtctgaagtccagcacacgttactaccttgctaaatgacctacacgactcttctataaanttgttctgattctctttccccccttcacgtctgcaatcaaatagaaaagttactcttgtc

SEQ ID NO: 6222 - DNA, 121 bp, Artificial Sequence
  Synthesized
  misc_feature (61): n=t or g
aaaggaatagctccaagtctctcccgattgaatgttaagagttaccagatgctaataaatnaactctacctatgcctaacattaatctgaatgttgaattcatctttaatggcaattggac

SEQ ID NO: 6223 - DNA, 121 bp, Artificial Sequence
  Synthesized
  misc_feature (61): n=t or c
ctgctggtgagcgctgctgatctgccaagtgtatggccaaagccccaaatattgctgtatngaaccactgaacaaaattgagttgcaaactgacacgaagctatggggtgatattttggaa

SEQ ID NO: 6224 - DNA, 121 bp, Artificial Sequence
  Synthesized
  misc_feature (61): n=a or c
tatagatatatactagatatgactgaatttaagcaagagataaatatatctgcccttatanaagatgatcctgggattcaccccaaggaggctgagctggattgatccttgccaggagcag

SEQ ID NO: 6225 - DNA, 121 bp, Artificial Sequence
  Synthesized
  misc_feature (61): n=a or g
attttattcattatcaagatttcctataaacttgtcatatcttccttctcactcttagtgncagaggagagtaaagctggtatgcagattgttgttgagcttttagtggtttgttattgct

SEQ ID NO: 6226 - DNA, 121 bp, Artificial Sequence
  Synthesized
  misc_feature (61): n=t or c
tacaactctgctatactgaaatggtaatatcatgtatgaaaagatgtattttacgttgtgntatcttaatggaacatactttacagactatacacagatccacagacacttttttccttga

SEQ ID NO: 6227 - DNA, 121 bp, Artificial Sequence
  Synthesized
  misc_feature (61): n=a or g
attgcattgctatgtgcaccaaatacttttccccaaaaaggaccacccatacaaattagantacaataaacatttaagtgcctgactttgatttggacctatatattccttaacagagttt

SEQ ID NO: 6228 - DNA, 121 bp, Artificial Sequence
  Synthesized
  misc_feature (61): n=a or g
acagaagacaaataaaggccatgatcatagacacaacaccagttaaatatgactattggcnatattaagtactgacatttcttttcttaatgcatttgtaccagtatcaaacctcccctga

SEQ ID NO: 6229 - DNA, 121 bp, Artificial Sequence
  Synthesized
  misc_feature (61): n=a or g
gaggcagagattctcccattaaaaactggcactgttccattaaatttatgctattgcaccntttgtaaccataaatctaccctcttgtgaatatgcattatgaaacagattttagttacag

SEQ ID NO: 6230 - DNA, 121 bp, Artificial Sequence
  Synthesized
  misc_feature (61): n=t or c
aaaattaatctgttagaggaaagtgttgggtttagactttttagatgttatcttcttctantgtctttccagttcaatatccccatggcaatgctgtacaaataaacaaacaaacaaacaa

SEQ ID NO: 6231 - DNA, 121 bp, Artificial Sequence
  Synthesized
  misc_feature (61): n=t or c
aaaggacttttaatttccctaataagagtcttgataatttaatgtaaacaggacttatccnctccctttggaagaaacaaggatagttttaaaatctgaagagattttgaccagttgcttt

SEQ ID NO: 6232 - DNA, 121 bp, Artificial Sequence
  Synthesized
  misc_feature (61): n=a or g
aatatagtaagtatcacacctatttgcaggccttctaaaatgtgtctctttgagatggacntgaataaaacaccatagataacacagctatcctttagcatctatctgagcatgttaaatt

SEQ ID NO: 6233 - DNA, 121 bp, Artificial Sequence
  Synthesized
  misc_feature (61): n=c or g
agcattgctgtaatatatatatattttgtttttaaatcttttaaaatgttgcaaacagtgnaaaaagtcagtctcctattttacccaatatagaggtttatcctagatccttcagtgcttt

SEQ ID NO: 6234 - DNA, 121 bp, Artificial Sequence
  Synthesized
  misc_feature (61): n=c or g
taccaaaatactactagagataattaacaaattagcttactgatcagactgttctagtaanaagtctctggtagcaagtcagagcaggttccaagggtagtaaaactctaagcataaatat

SEQ ID NO: 6235 - DNA, 121 bp, Artificial Sequence
  Synthesized
  misc_feature (61): n=a or c
aagcaaataataacaataaaaaagggaccggctgcagcacttctctggggagctaaacatntctgcagctctccatacagtttgtctctcatccacagagatcttaaaaggggattgtttt

SEQ ID NO: 6236 - DNA, 121 bp, Artificial Sequence
  Synthesized
  misc_feature (61): n=t or c
attcatgtgagaaagagactttgatctctctgcatgtacttaccagttatttaactgatangctcctgcgtggactcatgctggtatggctttacttccttcagctcctacaatcatgatt

SEQ ID NO: 6237 - DNA, 121 bp, Artificial Sequence
  Synthesized
  misc_feature (61): n=a or g
tctgtagctttagaaatattgcacatgtataaagtcttacgtgctaatttgcagtggaatnttccttatgcatcattgcatgggatgacaaaagtcatctgcaagtctgagtttaactgac

SEQ ID NO: 6238 - DNA, 121 bp, Artificial Sequence
  Synthesized
  misc_feature (61): n=a or t
aggactaactttgagttttgcaagttttcagattttaccactctcttgaattattttatcngagtttaccactgagtttacgcttctctgcactgcaccattctaactgttcattctcttc

SEQ ID NO: 6239 - DNA, 121 bp, Artificial Sequence
  Synthesized
  misc_feature (61): n=t or g
tttaaataaagacatttaggtggatagtactttaacagggttatttatgagaatgtttctnaagaggtaactatgctgtgactatgttacaaacattacattttgaaacaaaagtaatctg

SEQ ID NO: 6240 - DNA, 121 bp, Artificial Sequence
  Synthesized
  misc_feature (61): n=a or g
aagggacatgattatcttatctagcttatgaagacagtgattattgtattatgccagaggngaagcaggcaacaggacagaattgctgaaatgacttggtaaaattctgagaggaaaaata

SEQ ID NO: 6241 - DNA, 121 bp, Artificial Sequence
  Synthesized
  misc_feature (61): n=a or g
attcgtattgattctagcagcaactattcacttgagtgtgtaagaagcaaacagcagcagnaggaaaatgctcttttaatgtctcctgactgtaagtagaactgtgtgtgctcactcacag

SEQ ID NO: 6242 - DNA, 121 bp, Artificial Sequence
  Synthesized
  misc_feature (61): n=c or g
ttcactagccacattctgaaagctcaagaacagatatatagggaggacctttttaaatctnacatctaatttgagctgtagttaatattctagactgtggtttgcaatattcagttaaaac

SEQ ID NO: 6243 - DNA, 121 bp, Artificial Sequence
  Synthesized
  misc_feature (61): n=a or g
gccagactaaagtgcccatgcaatcaccatctggaaaggtggaaaaagtagattagcatanatatttctttctcaaaagagctgatgtgtaacggtgacacattttctttactttaggtga

SEQ ID NO: 6244 - DNA, 121 bp, Artificial Sequence
  Synthesized
  misc_feature (61): n=a or g
aatccatggtacgtttctggatgtgcaagtagaacttgctgcatgactcaaaacgggatanctatgaattttatgtcttccagttgcttcccctgggaaacaatgttaatgatatcttctt

SEQ ID NO: 6245 - DNA, 121 bp, Artificial Sequence
  Synthesized
  misc_feature (61): n=c or g
caagtactcaaatacttgagccccaaatctctccttcttttagaagcccagaagagccatncgcaatactgcaggaaatcatcaggctttctgtgtaaaaatacagaatgactgtaaatag

SEQ ID NO: 6246 - DNA, 121 bp, Artificial Sequence
  Synthesized
  misc_feature (61): n=a or g
cttttttttttttttttcgttatgttttcctttctcatgatgtggtagagctgataccagncagagaggttagctacaacaggtcttttctggggccattgtatgttgaactgatgagagc

SEQ ID NO: 6247 - DNA, 121 bp, Artificial Sequence
  Synthesized
  misc_feature (61): n=a or g
cagctatgaacagcggggcaaaagctttggcatttttccctcccacaaacctccattaaangtcaagcaaactacttagaccagctattagagggatgaaagaagaacagttttgccatat

SEQ ID NO: 6248 - DNA, 121 bp, Artificial Sequence
  Synthesized
  misc_feature (61): n=a or g
tattctggtccactagcagaagtccttcttgtcagccagctggcaacaaaagcagaagacnttaaaccagtgcttgaagtagagcactgtgtggcaacaagccatgccaccacttgctctc

SEQ ID NO: 6249 - DNA, 121 bp, Artificial Sequence
  Synthesized
  misc_feature (61): n=a or c
tgattttctttctatggtgaacataaaatctatgatgtttgttcaacaaagcaattcttanagagatgaggcttgagaatacattaagttaccgtgaacagcagggtccagggggaacaga

SEQ ID NO: 6250 - DNA, 121 bp, Artificial Sequence
  Synthesized
  misc_feature (61): n=t or g
ctgcacggcctaaagcaacagaacaagctcagttctctgaatcacgaggcgaaatcccaancccaccgacttcattagccagcagtcctgccattaaattaacccaactcgtatggctttt

SEQ ID NO: 6251 - DNA, 121 bp, Artificial Sequence
  Synthesized
  misc_feature (61): n=t or c
tcttggtctgcaatggtttatacctatctagcagcaaaatgttattgttcagtgagattantctgactgataaccagagttttaaaagcaataacaaggaattagtatgttattgtagaag

SEQ ID NO: 6252 - DNA, 121 bp, Artificial Sequence
  Synthesized
  misc_feature (61): n=t or c
tttcatcatttgggaaacttcatgaatttttaagtaaaccttgtgtaaattttccattctnggagcctgaacttttgttttagcagcagctgttacttactcctaaagatattttacctta

SEQ ID NO: 6253 - DNA, 121 bp, Artificial Sequence
  Synthesized
  misc_feature (61): n=a or c
tgcattatcgtctgaattttcaagtatacatctgaatcaacatggtaggacacaggcctgntacatttcaagtttcacttttccttctttgtctgttatgaagtattgagagcagaacact

SEQ ID NO: 6254 - DNA, 121 bp, Artificial Sequence
  Synthesized
  misc_feature (61): n=t or c
caaagtcttctttgagttcaggcttgagacagataagcaggttaaagtgaataatgtacangtttgattactcagcagtgcttgatttggtttggctacagtcaaatggatgtcatattta

SEQ ID NO: 6255 - DNA, 121 bp, Artificial Sequence
  Synthesized
  misc_feature (61): n=t or c
aaagtgatgtgtgatgagtgtgacagccccttgcatgcagagcctgggcatagctttttgnagtctgtcaggtcactgtttgaatttgcaatttcagtgaaatcaatagctaaattcttct

SEQ ID NO: 6256 - DNA, 121 bp, Artificial Sequence
  Synthesized
  misc_feature (61): n=a or g
caatagcatatgcacctcagctcttgttgcaaggcttgcagacatcagatttgaacagagngtcaaatctgtttgcgtatttaagaattacagtgggaaggaaagagtaccttcaatcaat

SEQ ID NO: 6257 - DNA, 121 bp, Artificial Sequence
  Synthesized
  misc_feature (61): n=t or c
caaattataatatcaattataatttattttttcatgaaggctaaacatagagacactgagnttcataagtagctgctggtaaagctcttgtttgggaacataagattaaaaacatcaaggg

SEQ ID NO: 6258 - DNA, 121 bp, Artificial Sequence
  Synthesized
  misc_feature (61): n=t or g
ctattttacatgttctatattagtcacttaaatggaagaagcgatgttgttagtatagggnagagagaaatacagaagcaagtttaacaaaggaagtaaaattgtggttatttcaccctga

SEQ ID NO: 6259 - DNA, 121 bp, Artificial Sequence
  Synthesized
  misc_feature (61): n=c or g
tgcactatgctgcatgctaggcaggaccacacatcacctccttttcacctgagtcaatggntgccacttgcggacaggaactaggagatagataggaagtggggatgagaacctgtgaaga

SEQ ID NO: 6260 - DNA, 121 bp, Artificial Sequence
  Synthesized
  misc_feature (61): n=t or g
aggtcttttcgatttcgtttcagtatcagcggttgctttaaaattattaagtcgtagcagnaatggactgtggccggtgccgtctgaggacttcctttacttaatttcagttttgttctcg

SEQ ID NO: 6261 - DNA, 121 bp, Artificial Sequence
  Synthesized
  misc_feature (61): n=t or g
attgaacgcttctctgtgctgaccttaagcctgaggttacaggaggggacagaagatgatntattagttagtttatctgttatatttccatccactcctcagcagtcagtactcaaaatta

SEQ ID NO: 6262 - DNA, 121 bp, Artificial Sequence
  Synthesized
  misc_feature (61): n=a or c
agatgccttgcacctccactgttcatttttctcctggaagaagatgcaacagagatatagngtttcaacatggatgagccactttgaatcacattgaaatcagctatccaattttagccta

SEQ ID NO: 6263 - DNA, 121 bp, Artificial Sequence
  Synthesized
  misc_feature (61): n=t or c
agcaggatggcataagagttcagaggtagggagaggacacagcaacgacatttaaagacantgttgaagtcgaggcagatcattttgccctcacttcctctgtgggtagatgacaggcctc

SEQ ID NO: 6264 - DNA, 121 bp, Artificial Sequence
  Synthesized
  misc_feature (61): n=a or g
ggtggggcgtggtggtccctggggatgtaatggctgctgtgtgccactgcccatgctgcanatggtgaacgttgagatcttgtacagaaacctgggcctttttatttgaaacacaattaac

SEQ ID NO: 6265 - DNA, 121 bp, Artificial Sequence
  Synthesized
  misc_feature (61): n=c or g
gagaaacagctcatgggctacaagttaggcacacacataagctgcattcatgactaaatancagagatcttgagaaaccacttttcacagtgtggaaattcactttgcaaccaaaggctag

SEQ ID NO: 6266 - DNA, 121 bp, Artificial Sequence
  Synthesized
  misc_feature (61): n=a or c
caatgaagaatatctttgctgtaatataagtttttacacagatacaaggacacacacgagnacaaacacagagttttgcttggatagtctcatcttcagtgagatgaattcatcagcttgg

SEQ ID NO: 6267 - DNA, 121 bp, Artificial Sequence
  Synthesized
  misc_feature (61): n=t or c
caacaacggtccttccactccactgcttctttaggatcttcactttgcaattcagatacanaaaactcactcagaagccaccatgttactgtctcttatgatactgccttggggctcgaga

SEQ ID NO: 6268 - DNA, 121 bp, Artificial Sequence
  Synthesized
  misc_feature (61): n=t or c
actcagtgtggtggcccaggcaatcctgtaatcctgactaccttcaagtgataagtgatgnattaagtgtatccaaagtcaggagaaaatagctgcctgatgctttttcttttctgatcag

SEQ ID NO: 6269 - DNA, 121 bp, Artificial Sequence
  Synthesized
  misc_feature (61): n=a or g
aaactgggttggataatgctcagtgtgttttatttgcttcttacctgtaaatcttgacttntgagattgtgcttagctgtagagggtgacagttctgttttacttgaatcaattcaattct

SEQ ID NO: 6270 - DNA, 121 bp, Artificial Sequence
  Synthesized
  misc_feature (61): n=t or c
gattctggtccatttacgtctttcaggctgaatcaaagagcttccctttgaacccataagntataaacagctgattcagctccccagtcctatcataccatctctagaaaattagggaaaa

SEQ ID NO: 6271 - DNA, 121 bp, Artificial Sequence
  Synthesized
  misc_feature (61): n=a or g
tggtgtgaatataggagtacatccaatcgcaccactgatacacaggcacttataaagtggnttaggctggaagttctgcccattgagatagtaaatgccattgagctcacatcctacagca

SEQ ID NO: 6272 - DNA, 121 bp, Artificial Sequence
  Synthesized
  misc_feature (61): n=t or c
caaaatttatccagggtctttgtctcctgtgcaagtacactgagaagcctgtggttacttntgagatatatttattcagatagatcacatgaagctaatttaatttgacagaagtgaggag

SEQ ID NO: 6273 - DNA, 121 bp, Artificial Sequence
  Synthesized
  misc_feature (61): n=t or c
tgttcagcactagaagaaaaaggctaagggaaaggtgagaatagggcccgttttctacaangtgtgtgactctgtgaggagccgttctgcatgggtgcctggtgtatttgcataaactaac

SEQ ID NO: 6274 - DNA, 121 bp, Artificial Sequence
  Synthesized
  misc_feature (61): n=t or c
ttcacttcaacagctgaaaatcacagacatttctcatgtgagttttcaaagttattgtacnacacacactattgccttctcacagaaacgtaaacactgatcaggtgtttccaatgacaag

SEQ ID NO: 6275 - DNA, 121 bp, Artificial Sequence
  Synthesized
  misc_feature (61): n=t or c
cccctgccagatgtatggccaccaatcaccagatctggtactatactaggttacccagagncccatccaacctggaaatatatataccagattagaagctgctggtgtggaattgatttgt

SEQ ID NO: 6276 - DNA, 121 bp, Artificial Sequence
  Synthesized
  misc_feature (61): n=a or g
taatcatcatttagtcatctggcagagggtctttggaaatctggtgagtagcagttatccngctcctgttacaagaaaagataaaatggcgtgataatctgaaatggcagctagtttaaac

SEQ ID NO: 6277 - DNA, 121 bp, Artificial Sequence
  Synthesized
  misc_feature (61): n=a or g
cgtggttcagcctccctgcattactgtgtgccttgcctctggagcccggaagggtcagttngtgggtcttgcactgaccctggccaagggctacttctacatgataggtttatccatacga

SEQ ID NO: 6278 - DNA, 121 bp, Artificial Sequence
  Synthesized
  misc_feature (61): n=t or c
aatctatattttggaagattcctgcacccctttctctatcgtctgtcccatctctgacatncaacaagcatgaatttgtctctcacatccgcatggagcctaagtagtgtgaaacttctgc

SEQ ID NO: 6279 - DNA, 121 bp, Artificial Sequence
  Synthesized
  misc_feature (61): n=a or g
caagtgagaaccctacatgatctgacgcactgtaaaagctctgtcctccgctgctaacagncacaggcacagcacttggcatgcactgatgagaaaccaacaaaacttatctcagacctga

SEQ ID NO: 6280 - DNA, 121 bp, Artificial Sequence
  Synthesized
  misc_feature (61): n=a or g
attgctccaagcatttcatcccctaccaaggcaaaagcaccagttgaatttagaaaggatnaactagagggtgtgcaaacaacaatgttgcctattatgaaggagtgaatccgttgggatt

SEQ ID NO: 6281 - DNA, 121 bp, Artificial Sequence
  Synthesized
  misc_feature (61): n=t or g
gtacctttggagcctaaaggttaattcagttagttgtgaggcattgtaactgtgctttaanggtcttgtccacaacccatgcattaagattgacaacgaactttgaagtaaagactcttct

SEQ ID NO: 6282 - DNA, 121 bp, Artificial Sequence
  Synthesized
  misc_feature (61): n=t or c
atatgagttttgtttgtttgtttgtatttcattttagttcatcagagaaagaaataattgnatttacactaattctgggaagtaaggttatttgaagaaggtctggggtaaatcaagagct

SEQ ID NO: 6283 - DNA, 121 bp, Artificial Sequence
  Synthesized
  misc_feature (61): n=a or g
ctttcatttgtgttcatgccactgtcacactacctcagacttgggcaacgtttacacttgngaatccattcagttgctgctgatgggtttctccagtgatggatgtgtggagttgtttgca

SEQ ID NO: 6284 - DNA, 121 bp, Artificial Sequence
  Synthesized
  misc_feature (61): n=t or c
gaaaaaaagcaaggcattgctgcttctgcagcttcttattcaatcctgtcttatccctgtntcagatagtgtcaccatatatttgcacggtctttaaactgttgtttttgctaattttgtt

SEQ ID NO: 6285 - DNA, 121 bp, Artificial Sequence
  Synthesized
  misc_feature (61): n=a or g
tcttagagagctggaggatctctaaaggttaccagaagtagcagtacatacacagccctcngaagctgcttgaaaacaccacagctatactttggtgaggcagtggcacaggctgcccagg

SEQ ID NO: 6286 - DNA, 121 bp, Artificial Sequence
  Synthesized
  misc_feature (61): n=a or c
tctccagtgtgcacacttcttttccataaaaggacaaagaggtgaagcaccagaacttatnccttccaccattaaccatgaaataagcaccacatgcgcccctactttcagctataacaaa

SEQ ID NO: 6287 - DNA, 121 bp, Artificial Sequence
  Synthesized
  misc_feature (61): n=t or c
ggatttctcagttatttctgtgttaaaattttacccaatgaaaaaaaaaggttaactttcntctgtccatctctccctctgtatgcatattaaagtgggaaaaagacaagaaaatgattgg

SEQ ID NO: 6288 - DNA, 121 bp, Artificial Sequence
  Synthesized
  misc_feature (61): n=t or c
agcttcaatttcgcatccattcatcccaacagtttatattctgaaagcaatccttattcangctgtgaagggaaacgggaatgtttgcattacagggagggatgtgatgcttggcccttta

SEQ ID NO: 6289 - DNA, 121 bp, Artificial Sequence
  Synthesized
  misc_feature (61): n=t or g
ttggcttccatgatttcaagcagataaattcctgtcctctctgggaggtggccagtgccanacagaggtgccaaaatttggctatttgaggagtaataagatagctcttgcctgtagccac

SEQ ID NO: 6290 - DNA, 121 bp, Artificial Sequence
  Synthesized
  misc_feature (61): n=t or c
tcgtgatttttaaaaatttgcatgctagagatgcaggtggaaaaaatttccatatggagangcctttgttttttgccttcttcctgcaaatatatacataggggaaacctgcaagggttag

SEQ ID NO: 6291 - DNA, 121 bp, Artificial Sequence
  Synthesized
  misc_feature (61): n=a or g
acatggcaggcttgaaataactaactcttcaggttacatgaaaataaccattactccaaanactgacaccataattaacctgtatgatgaaacaggctccttccttttatgactacttcac

SEQ ID NO: 6292 - DNA, 121 bp, Artificial Sequence
  Synthesized
  misc_feature (61): n=t or c
aggggcagaaggaagatgtctgcccagagctgtgacctggccaggaaaactgcctgagcancacagaaggctttgtagctgagaaaagcattcagtcatgatattaaactttttttcctag

SEQ ID NO: 6293 - DNA, 121 bp, Artificial Sequence
  Synthesized
  misc_feature (61): n=t or c
cattatttttcctgctaattaaattgaaaggtgtaatttcatcattaagtatatgtcaggnggaaaagtatcaaattctaagcttttagtacagaatagtttcaggttcactactcataga

SEQ ID NO: 6294 - DNA, 121 bp, Artificial Sequence
  Synthesized
  misc_feature (61): n=a or g
cctgccccttctcaaataaacgtacattagaagatgcatgagaagcttctgaaacattatntaaagtagggataccaaaagctgtgtccatgtctttcacagaactccacccagccctcag

SEQ ID NO: 6295 - DNA, 121 bp, Artificial Sequence
  Synthesized
  misc_feature (61): n=t or c
gtctgcatggaagaaatggacctgggggtgggtattgtttgatgctcagctatacataagncagcagtgtgccccagtacccaagaaggccaatggcatcctggcttgcatcagaaatagt

SEQ ID NO: 6296 - DNA, 121 bp, Artificial Sequence
  Synthesized
  misc_feature (61): n=a or g
cattctctgaagtaatacgtgccttcagtctccattcatgagtggtagagtttcaatgtgntgaaaacttggatccggaacgagagcaagggaggacagtgctcaggccctgactgcttca

SEQ ID NO: 6297 - DNA, 121 bp, Artificial Sequence
  Synthesized
  misc_feature (61): n=t or c
caaagcacatttccaagcgctcaacttccagttaaaacagaaagcagttccatggaaatgnggccagcatttatgtgtataaatcaacttagaggcttttctgagcctatgttttgtttct

SEQ ID NO: 6298 - DNA, 121 bp, Artificial Sequence
  Synthesized
  misc_feature (61): n=a or g
tatagatggggggaagtgataatactcctattcaaattctatttaggtcttaatttggggncaggcagaaggagaaattaaccttttcacttgtatgtgtcaagcagctgagcaaaaatag

SEQ ID NO: 6299 - DNA, 121 bp, Artificial Sequence
  Synthesized
  misc_feature (61): n=a or g
gggcacttgttcaagttgattgacttgctgaagtaactgtccggtttggtggttgccaacnatccagctaagtaagtaagttatacagaagctaacagaagtcatttcagaacctcaacgt

SEQ ID NO: 6300 - DNA, 121 bp, Artificial Sequence
  Synthesized
  misc_feature (61): n=a or t
ctaattcgttgggatgctttttatacctagctttcagttcagattctatctttaatctgcngtaatattctcactctattcagaataccttcttttttccccatctcaatctcagttttct

SEQ ID NO: 6301 - DNA, 121 bp, Artificial Sequence
  Synthesized
  misc_feature (61): n=a or t
taaaggcatgaaaggaaaacttaaaatgttccaatgttttatatttttcttacattttccntgtgtttcatcagagaaagaagagcaacacagttcttggtctctcccagtaatgtctgtg

SEQ ID NO: 6302 - DNA, 121 bp, Artificial Sequence
  Synthesized
  misc_feature (61): n=t or g
cctttattagtaatgccatgtaagttccctgtactttttattggtattggctttcatgcanatagcagacattttgagcaaaaacgggtataaaattgctatcagataggaccctgtgtat

SEQ ID NO: 6303 - DNA, 121 bp, Artificial Sequence
  Synthesized
  misc_feature (61): n=a or g
agctccactgtggaaatgaaagcacgttattgtaatagaattcgatgtctactcattactngggaagcaacttgctccaggacttgcccttttcctatgtaaggccacactttcttgccag

SEQ ID NO: 6304 - DNA, 121 bp, Artificial Sequence
  Synthesized
  misc_feature (61): n=a or t
tggctgacaaatgccaaagctctctgcagagcaggaagtttgatattctaagttttgcctnttctggcaaaaatctatcttcagggtagggcacacttgggccctaccccgagccacccac

SEQ ID NO: 6305 - DNA, 121 bp, Artificial Sequence
  Synthesized
  misc_feature (61): n=a or g
cataggtagcactgagggtcatagctaacacaaaatgtgtaaaggatcatattgaggaagnaataatcagttttactaggtaacagagataaagagcaagcacaagcagagggaagaactg

SEQ ID NO: 6306 - DNA, 121 bp, Artificial Sequence
  Synthesized
  misc_feature (61): n=t or g
aaaaaaatgtaatatatgacaatcatagccagtatgggaataccaactcctcttttgagantggataccaatatcatatccttctgcccaaggtgactgagctcacaaggttcagtgtttt

SEQ ID NO: 6307 - DNA, 121 bp, Artificial Sequence
  Synthesized
  misc_feature (61): n=t or c
acgcattcagtagagcaaaatgacagaagcaatttcacagtctatcctacagagaaaatanacctacagaatcatcctgttatttgcccaaatatcatgtcacaatcagctagtgttcaac

SEQ ID NO: 6308 - DNA, 121 bp, Artificial Sequence
  Synthesized
  misc_feature (61): n=t or c
aagcattatgagttcacatttttactgagcaaagcatttaagcatcagttacgtactgtcnatttatttcagtttatatgatacatgcacctgaaattatataaatgttgaaatccattta

SEQ ID NO: 6309 - DNA, 121 bp, Artificial Sequence
  Synthesized
  misc_feature (61): n=a or g
ttgctgctgcacagagaattgtaccagcatgaaagaaatgattagtaaagacaggaaaatntatgtaggtgcttgtgacaattgatattaccacattgcttatttttgaaaggactgcaag

SEQ ID NO: 6310 - DNA, 121 bp, Artificial Sequence
  Synthesized
  misc_feature (61): n=a or g
gcactctctcttttcatacatgtaaaatagggcttgcctgcttccagtgagcacagtccantatcagcttcagtaaataatgaaagacaatgagaatacagccacacagttttgtcgtatg

SEQ ID NO: 6311 - DNA, 121 bp, Artificial Sequence
  Synthesized
  misc_feature (61): n=a or g
caggtcctcctatcccccactcccgtttgcacagaaatcttaatgggctttgtacagaaantttggctggaaaatctgaaaacttcctaaattcccacctgttctagtgtgcaggtctgag

SEQ ID NO: 6312 - DNA, 121 bp, Artificial Sequence
  Synthesized
  misc_feature (61): n=t or c
acttgatgtagcaaaagttccctttccaaatcgcctttctttaattttgcttcatgattgncatttttcattcgctaattttattcatgctagactaggccagtgacctaaaactgccagt

SEQ ID NO: 6313 - DNA, 121 bp, Artificial Sequence
  Synthesized
  misc_feature (61): n=a or c
acaagtactcagtactgatctgcacaggcagcaatacgtacttactcagtccccacacaantctacttaaggccctaccactagaggaacagtatctgaaatatttatgtaacctgacata

SEQ ID NO: 6314 - DNA, 121 bp, Artificial Sequence
  Synthesized
  misc_feature (61): n=t or c
atttagataatgtatatttgtgaccataaatattttgtcctcttacagtctgtcagtgaangttatgcccagttggagaaacttacataaactgaagagatgcaagcgttgctttcttaga

SEQ ID NO: 6315 - DNA, 121 bp, Artificial Sequence
  Synthesized
  misc_feature (61): n=t or c
gatggtctgtgggtggagtcactgtcatgatggtaagacttggagctgttatggtcatgangctgggactggttgtagtcctggtagtgacttagaggttgatgttgtggtagtagggcag

SEQ ID NO: 6316 - DNA, 121 bp, Artificial Sequence
  Synthesized
  misc_feature (61): n=a or c
aatttaaaaaatgaataagagtagtagtattttttgaataaagatacatggatttttagantcctaaaatatttggaccttgctactttccgaattaggtatcagtttaatacccatcaat

SEQ ID NO: 6317 - DNA, 121 bp, Artificial Sequence
  Synthesized
  misc_feature (61): n=c or g
ttatttgttcaactaaattattgaatagatacaattagaattgcagccacatgagtagtantttttcagttaactcttgctctgactcacagtctttgcagtctgtgaaacttcctctgct

SEQ ID NO: 6318 - DNA, 121 bp, Artificial Sequence
  Synthesized
  misc_feature (61): n=t or c
taagtattgcgtaatttttctaacacattgacataatgtcccattctaatactggcataanaatagagactgctcctatgaaatacttatgcatattcatggagaagtacaaaatctgcat

SEQ ID NO: 6319 - DNA, 121 bp, Artificial Sequence
  Synthesized
  misc_feature (61): n=a or g
ccgaatccttaaggacagccctaaatatcctaatgcttagggtggaaaccacccaggtacntgcttattgagcagtctgtgggcagtgatgtggtaaggcagcgaacatgggtgaggtgaa

SEQ ID NO: 6320 - DNA, 121 bp, Artificial Sequence
  Synthesized
  misc_feature (61): n=a or t
taattatgaatgattctgcattataatatgattagaaaaaatagataaggcacagctgaanttcctaaaaattgtgtacaatcagaagccataacagatagacaaaagaattcttgagtgc

SEQ ID NO: 6321 - DNA, 121 bp, Artificial Sequence
  Synthesized
  misc_feature (61): n=t or c
gttcccacaaggaattgaagggaggaggagggacgacagcacaggaggaaggaagttttancatcacttcagtggtgggatacctgaagcagaaagaacactgttagtgttccagaagttg

SEQ ID NO: 6322 - DNA, 121 bp, Artificial Sequence
  Synthesized
  misc_feature (61): n=a or g
gaggtccctctgttcctcagtgccagagaacccatgtcctcctggtgcaaggggctttagnagggtgagagccatgcgggctctgcatctgctagtcctctctgtttgaagaaatttgcct

SEQ ID NO: 6323 - DNA, 121 bp, Artificial Sequence
  Synthesized
  misc_feature (61): n=a or t
gaataatacctttattatactcaggttttaacccataggtactgtctgcatgcatcgtggncatatactgcccaactggtcatcatagcagagcaacattagaggaggacaaatgaataat

SEQ ID NO: 6324 - DNA, 121 bp, Artificial Sequence
  Synthesized
  misc_feature (61): n=a or g
tgtaggccacttctctggagaggctggaagaatgatgtcatggggagtgagagagaggctncagttctaaacagtgtgggtggttgctgtttgctcagagggtggtgaagccttggcacag

SEQ ID NO: 6325 - DNA, 121 bp, Artificial Sequence
  Synthesized
  misc_feature (61): n=t or g
tctggcttcatcacttaatttttatggtgaaattattccagctataccaacttttctctcntcattttttcttccagttagggaacttgtaaattgaaaatgggcttctactaagccaaca

SEQ ID NO: 6326 - DNA, 121 bp, Artificial Sequence
  Synthesized
  misc_feature (61): n=t or c
gtgttcatcagaggtctcagaagaaaagtctgtaaagtgtgccctttggcagattctttgntacttaagaaatacctatgttttgtcatcttccactgcattctgttacagagatctttct

SEQ ID NO: 6327 - DNA, 121 bp, Artificial Sequence
  Synthesized
  misc_feature (61): n=t or c
tttgcccctcagagctctcctccactaactggaggaccaagttatggtccttgcagcctgntgtgctgctgagatccttttttgcattgatcgcatgatttaaatgctatgcaattatatt

SEQ ID NO: 6328 - DNA, 121 bp, Artificial Sequence
  Synthesized
  misc_feature (61): n=a or t
cctgctaagcttgcttaagcttgcaagaggaaaaacactcgttaatctgctctgttctctncccatttaaataaaacatcttttctcagatgtgtactccgaaaatggaaccactgctgtc

SEQ ID NO: 6329 - DNA, 121 bp, Artificial Sequence
  Synthesized
  misc_feature (61): n=a or g
gttgtccagtgaaacagttactatacattagaaagaaatgtgcactttgcttcctaactantgcttgggacttcaatactgagaaaaagaaaaaaaaaggaataagtaatgtactaccttt

SEQ ID NO: 6330 - DNA, 121 bp, Artificial Sequence
  Synthesized
  misc_feature (61): n=a or t
gtgtactcacataaaaaatgcctttgaacgttcttcatttaagaccatggaaggcagtatntacagacaaataaggaaatggttcagcagcccacagtgctgtaatagattccaagatgag

SEQ ID NO: 6331 - DNA, 121 bp, Artificial Sequence
  Synthesized
  misc_feature (61): n=t or c
cgggaagtttcttatagatcaccttgccttgagcaaactcagaaaaggggtttcaagcagncaagcaagcctaccacaagacaacatgtatttacaatgatgctcacattcccaaacactg

SEQ ID NO: 6332 - DNA, 121 bp, Artificial Sequence
  Synthesized
  misc_feature (61): n=t or c
agcagacagatgctcaactgatagtgtaagtttagaaaaaaaggtaaataaggtcatcctnagacagccagctgcagattaggcctggagctgctccaggttacatggtattggctggatg

SEQ ID NO: 6333 - DNA, 121 bp, Artificial Sequence
  Synthesized
  misc_feature (61): n=a or t
gaacctgaaaggtagtttaattccttcaggtaatctgcccttggcttctcaggcacagagngacaaacagaagtagaagccatttcaccagggcacatacagctggatttttaaaaacatt

SEQ ID NO: 6334 - DNA, 121 bp, Artificial Sequence
  Synthesized
  misc_feature (61): n=a or g
tatagtgctgatgtcattaaaatattaatgtctatcagctgagaattggatgggggcctgntttgtttttcttcccatcagaagtataaacttcagaaagtgaatgtgaagttgtgtgaaa

SEQ ID NO: 6335 - DNA, 121 bp, Artificial Sequence
  Synthesized
  misc_feature (61): n=a or g
ttaaaacttcaaggtttaatgcactggcactttttagtcctcttattaatctctatcaccnaactaacctatccctggaccattctggtcagacttgcctcagctcaggcactcatttctc

SEQ ID NO: 6336 - DNA, 121 bp, Artificial Sequence
  Synthesized
  misc_feature (61): n=t or c
caaagagcacttccagtgaggtgccatcagaatccaacatggatgtgttttgttcaaatcnctctgcttaacactttcactaaaccagaatgacaaattatgagtattttcataaaaacag

SEQ ID NO: 6337 - DNA, 121 bp, Artificial Sequence
  Synthesized
  misc_feature (61): n=a or c
attgaaaaaaacaaacaaggagatgcaaaaatccaaactaaactttcctgtgaaatttccnaagcagaagtaaggaaaaaggaatgtagagcacaaaatgtataattcagctcatatttat

SEQ ID NO: 6338 - DNA, 121 bp, Artificial Sequence
  Synthesized
  misc_feature (61): n=a or g
cagatggcaagaggcatgcagtggagggaaactaatcaatagaaggaaagagaagactccnattcctgagggactggttgtgggatttgaaaatgccttagagtttggcagaaaaagcaga

SEQ ID NO: 6339 - DNA, 121 bp, Artificial Sequence
  Synthesized
  misc_feature (61): n=t or g
cagaaatattgcaatccccaatctgatatcaaaaaggtttaataaccaaagactaatttanaagaaaataaatagcttcagtcaagttgggaaattcaccactgtagctagcagcattttt

SEQ ID NO: 6340 - DNA, 121 bp, Artificial Sequence
  Synthesized
  misc_feature (61): n=t or c
ctaccaattcccttttggataggcaatgcatattagtgctcctggtggatcagtataaagncaatctgacgtgacatcagaaggagttatgaagttggggtagattaaaaggcactgtaga

SEQ ID NO: 6341 - DNA, 121 bp, Artificial Sequence
  Synthesized
  misc_feature (61): n=a or g
tttccttactgttttccagttccttttaataatcaatgtagtgtaaatactaagaacactntggaaagtaaatgttcaactatgaggattttcaaccttgtaatgagaacatgaagtgtat

SEQ ID NO: 6342 - DNA, 121 bp, Artificial Sequence
  Synthesized
  misc_feature (61): n=t or c
gcttccaatcatgatgttttgatagtaccatgaaacaaccagaagactctaagctcagagngatgaagtgaatagtagtaacaataagggctggtaaaatgatgcttcatgatatgctctc

SEQ ID NO: 6343 - DNA, 121 bp, Artificial Sequence
  Synthesized
  misc_feature (61): n=a or g
cagccctgagtcagtcatgagtttcacagacttattttaaccctacagaacttaaaagccntgtgtagctcctgaaccgttggagacttgtgaatggtccagatgtggccctgccatcaaa

SEQ ID NO: 6344 - DNA, 121 bp, Artificial Sequence
  Synthesized
  misc_feature (61): n=a or t
gctgctacatgtcagaaaaggactcagagcacttatttcctaaagtctgtgtcatacgggnatgcagtctgaaggtaaaagtttgactgggctttatgaatcccaaacaaaaccaaacagg

SEQ ID NO: 6345 - DNA, 121 bp, Artificial Sequence
  Synthesized
  misc_feature (61): n=t or c
cagggcttttgctttacttactgaattgtcttaacatcaagccatgagttctcacactttnacctttctaattgtttcccccattctactggagcacagaggggaagtctgtgcaagtgac

SEQ ID NO: 6346 - DNA, 121 bp, Artificial Sequence
  Synthesized
  misc_feature (61): n=a or g
tcattacagtctatccgatgactttattctaaagtatgattttaaacagaaaacagatggngatactgttaagagctggattctaggatgtatgtcaaatgatcacttcctgagaaatcat

SEQ ID NO: 6347 - DNA, 121 bp, Artificial Sequence
  Synthesized
  misc_feature (61): n=c or g
actttcacctatattcttcttggcatcacactaacacttcatgctgagcagtggtgtcatncataatagcctcacttatgctcagagctcttttcctctttccccttccattgaatactag

SEQ ID NO: 6348 - DNA, 121 bp, Artificial Sequence
  Synthesized
  misc_feature (61): n=t or g
tttcaaggagtttttaaaagaagtagtaaataatcttatcccattataaagattatttcanagtcttcagaaccttgtacaacttggttctgtttaattatcaactttaatttgttagaag

SEQ ID NO: 6349 - DNA, 121 bp, Artificial Sequence
  Synthesized
  misc_feature (61): n=t or c
ggaacttgcttttttcttcttgatttcattcatatgtgaccaagctatactcttatgctcntcctttgttatctgtccctgattaccactttttgcatgctccctttctgagctgcgtttc

SEQ ID NO: 6350 - DNA, 121 bp, Artificial Sequence
  Synthesized
  misc_feature (61): n=a or g
tagcaacagcatgaaactcttccccccattctccctgaggagattgaaggaataaaagaantaatatgcaaatgtggaaatattatgaaaaaaattgacacggttacttttcacatttcct

SEQ ID NO: 6351 - DNA, 121 bp, Artificial Sequence
  Synthesized
  misc_feature (61): n=t or g
attttaggctggcattctcaagcagagcatttcacagtagccttcctcagtgacaaaatgnttttgcctcatatattctaccctatagctcaaagggacttgaagtctgtcttctctagat

SEQ ID NO: 6352 - DNA, 121 bp, Artificial Sequence
  Synthesized
  misc_feature (61): n=a or g
cctgtatgaagtagtcatgggtgtttctttgacatctttatcaaggatgttctaggcgttngtgactccagaatttactaaaactttcccttttctcctggtcttcagtacagtctggtcc

SEQ ID NO: 6353 - DNA, 121 bp, Artificial Sequence
  Synthesized
  misc_feature (61): n=a or g
ttggctacaaaatctattaactcatgaggccttattgccagcaaatgtttcgaatctcacngattcaaatgcctggttgacctttcatgtaagaaaatattagctgttttgttttctcagc

SEQ ID NO: 6354 - DNA, 121 bp, Artificial Sequence
  Synthesized
  misc_feature (61): n=a or g
tatgctatttatctgagctagacaacatcaatattgtgagacagacttgcacatagtgagnaaacacaccaaaaccagaactgaaaatgtcagtatgttttctgactccacatgcattact

SEQ ID NO: 6355 - DNA, 121 bp, Artificial Sequence
  Synthesized
  misc_feature (61): n=a or c
ggaaaataagagaaatctggcagatgtaaacagctttattccattaaagttggtgatcatncttgagggaatttatgtttgtgcacttggaatgcttttttagaggggactcgaatataca

SEQ ID NO: 6356 - DNA, 121 bp, Artificial Sequence
  Synthesized
  misc_feature (61): n=a or t
tagacttccttattgagtgttgcaaatgaaacagacgtttcattaaggaagcacgttcaanatatttttgtgaacacaagacattttaagattttttaggtaaattacctaacaatttgaa

SEQ ID NO: 6357 - DNA, 121 bp, Artificial Sequence
  Synthesized
  misc_feature (61): n=t or c
tcaaaacaaaacaataaaaaacaaaaatggaaaaaaacggaaaacggaaacaaaacaacantgaatgggaatgaaagggcagtaggtaaagcaaaatattttaaggatgctgtggtgaaat

SEQ ID NO: 6358 - DNA, 121 bp, Artificial Sequence
  Synthesized
  misc_feature (61): n=t or c
tgctatgtttacaaaacagtttcaagaataaggagctgaaacatttttgcttcacattggntgttttcctgctttctgatctttgtgtttatgcctttgactttctgtgtcattcttcttt

SEQ ID NO: 6359 - DNA, 121 bp, Artificial Sequence
  Synthesized
  misc_feature (61): n=a or g
agtcctgatgaaattatatgaattaaaaaaacagaacaacaattaacatttgaagaggtanttttatcagagtgtactgcattaaaacttaagttgctgcatttctagtgctgttttaaat

SEQ ID NO: 6360 - DNA, 121 bp, Artificial Sequence
  Synthesized
  misc_feature (61): n=a or g
taatgatggggttatatccttcccagagaaagctaaggtactacaatagtctatcaaaaantcctgttcagtaaataagactgaaagcatggataggatgttgacaccattaagaaagaaa

SEQ ID NO: 6361 - DNA, 121 bp, Artificial Sequence
  Synthesized
  misc_feature (61): n=t or c
aatgattgcttggcattaaagacataatagcaattttggaaatttacattccatagtttcngttttttgctttttggctaaatgtacaagcatgtatttatatcacagcaatatatgattc

SEQ ID NO: 6362 - DNA, 121 bp, Artificial Sequence
  Synthesized
  misc_feature (61): n=t or c
acagtgttttggctactcgatggagcaggcagagtgcgtgagaagagagaacttctctcangtgacttaaatattttaatacgtagccgactgtatcaaagcagtgaacaaacaaacagtg

SEQ ID NO: 6363 - DNA, 121 bp, Artificial Sequence
  Synthesized
  misc_feature (61): n=a or g
gtgatggccagtgagtgctacagatatctcaaacatctctgatcattgtgaattttaggcngactagattaaaatagtttgaattctgttcaaatgggagttgaagaaacaggtgaaaaga

SEQ ID NO: 6364 - DNA, 121 bp, Artificial Sequence
  Synthesized
  misc_feature (61): n=a or g
gtgactagaacaaaagatttgggcaagttcttcaattgccagctctttcagaagcatgcangaattgaggatgactgtggctatactgaaaacccaagcatgactgaaattccaagtaagg

SEQ ID NO: 6365 - DNA, 121 bp, Artificial Sequence
  Synthesized
  misc_feature (61): n=t or c
acaaaatgatatgaaactacttactgtagttgcagattttacaagcaactacttcacatcntctatctctctgttcaacctttcttccaaagacctgtattatcaaatacggaagcatgta

SEQ ID NO: 6366 - DNA, 121 bp, Artificial Sequence
  Synthesized
  misc_feature (61): n=a or c
caagtggagagcagaaatcttgctcagtatgaaggaagaggcattaacaccagagaagtcngtgtccttgtgtgagggctttcatccaggcttcatgtgatcccgtaactggtgtgcatag

SEQ ID NO: 6367 - DNA, 121 bp, Artificial Sequence
  Synthesized
  misc_feature (61): n=t or c
gagcctcagcaaatttagtttcagtcttcaaagcctaaagcaagccaaggacattggcaanttgtagcattacccactcctgagcctgcttcccatgtcacgttcttcaaagagatataca

SEQ ID NO: 6368 - DNA, 121 bp, Artificial Sequence
  Synthesized
  misc_feature (61): n=a or g
gaatggataatgcaccttcaaaagtaagtactacaaaagctgctataaaattctatgagcntctctaaaaccgagagctgcaagggcaaattgatttcaaaagttctctgaaaaggccttg

SEQ ID NO: 6369 - DNA, 121 bp, Artificial Sequence
  Synthesized
  misc_feature (61): n=t or c
agtttataatcgatgcacaggctgtttttcacaagaaagatgctgagcagcggaatagagnggagactaggacatcctggccaggttaagaaataaatccagaaggcttgagcaataccca

SEQ ID NO: 6370 - DNA, 121 bp, Artificial Sequence
  Synthesized
  misc_feature (61): n=t or g
gtactttactgtgagacagcttcagtttctctctcctgcttaccatgtagcagagattccntacctacagagaaataacaggagacttagtataaaattaaaaaaaaatcctgacttagga

SEQ ID NO: 6371 - DNA, 121 bp, Artificial Sequence
  Synthesized
  misc_feature (61): n=a or g
taataatgaggaaggctagggactgtgaagctttgtgcttgcataaccttcagctctgggncagtaaggtgcacaaaaagccaccgaccttgctgacagatttaacatcattagcaccttc

SEQ ID NO: 6372 - DNA, 121 bp, Artificial Sequence
  Synthesized
  misc_feature (61): n=t or c
accttcgaggtatttaaaaagttacagcagtgtttgttttttctcagataaatcagttgtnggatcgctgaatgtgatgttgagtgtcctaccggttatcaccagtgtgcattgctgaact

SEQ ID NO: 6373 - DNA, 121 bp, Artificial Sequence
  Synthesized
  misc_feature (61): n=t or g
gttatttcatcctttagaacccaaggggtaaatgctatttaatccttgtgattttctactnctaatttctttaatttattctatgatctcttttacagctgctttatctttagatagatcc

SEQ ID NO: 6374 - DNA, 121 bp, Artificial Sequence
  Synthesized
  misc_feature (61): n=t or g
tgcagctcttcattcttcattctaaactagaatttacttcagtgttacctctacttagggnaaggcaggcattgttacattagatatatcaggagaggcgatttacctgacatttttagac

SEQ ID NO: 6375 - DNA, 121 bp, Artificial Sequence
  Synthesized
  misc_feature (61): n=t or c
agagagtggaaaagcagttccaacatgtttacaaaacatctatgaacattctcattgaatngtgtatgtgctgctttggaaaatgcttctaagcacttggattttttgtaaggtttgtgtg

SEQ ID NO: 6376 - DNA, 121 bp, Artificial Sequence
  Synthesized
  misc_feature (61): n=a or g
tgcattttcttttttctctcttgtaaatatatattccgtgtttgggtgcacatgctgcacntgatttaaaacccatttactcacatgccttcatctcggagagcacctgaaatcactggtg

SEQ ID NO: 6377 - DNA, 121 bp, Artificial Sequence
  Synthesized
  misc_feature (61): n=t or c
aaagtgaaatccaacagctacaagcaaattggatgcacttgggagctgcccacatgagcangcctgtccccaaagcatctgagcacatgtgcatcacacacctgagacaggcttgggaaaa

SEQ ID NO: 6378 - DNA, 121 bp, Artificial Sequence
  Synthesized
  misc_feature (61): n=a or g
aaagcttctaactgatgtcagttgatatcaatcaaaacacaattgtttcacatttgtttcnctacagcttgctgtgcttatatatatttataaacatatacacatatacatgtgaacatat

SEQ ID NO: 6379 - DNA, 121 bp, Artificial Sequence
  Synthesized
  misc_feature (61): n=a or g
aattaacacgtcagatgttgagtttatctttaaccaacttgtctattcctaaagaagtgcnttgtatatgtttcacatcttgtctccatgccagggtaccactgttacaccacatttcctt

SEQ ID NO: 6380 - DNA, 121 bp, Artificial Sequence
  Synthesized
  misc_feature (61): n=a or g
ctatttccctgttgagttcttttaaaactcacaggtgtgaactggcatgttatgttatagntgctgtgccctgtaatattaatttgtcatttagttcctcaaatgtctctttcagtgtttc

SEQ ID NO: 6381 - DNA, 121 bp, Artificial Sequence
  Synthesized
  misc_feature (61): n=a or g
ctacagcatctctcagggcaatgacaaaatcactttgtttggtacaactgatacactccancccatatcaagtactctgtgtggcatacctcaggctgtatctgctcttgtaaagcaaaca

SEQ ID NO: 6382 - DNA, 121 bp, Artificial Sequence
  Synthesized
  misc_feature (61): n=a or t
ggttagactgtaaccaaaatggtcttatgattgtctgatttctttgtttctagaatttctncatctaaactgacaaattatttaatgctgcctgatgcaatcagagcagctagcaacatct

SEQ ID NO: 6383 - DNA, 121 bp, Artificial Sequence
  Synthesized
  misc_feature (61): n=a or g
gaactcttcaaataaattatatttaaatatctcattttgaatgaaataaatacttgactcntgccattagattcatctgatgtggcaagaccttgagaattgtcgaagtactcagaaaaaa

SEQ ID NO: 6384 - DNA, 121 bp, Artificial Sequence
  Synthesized
  misc_feature (61): n=a or g
cttttgtcaaatactgaattcaactctgtgaattgatgctatggatatggtagaaggagancatttgtgtttgagactgaagagaactttgaaaaataaactgagtagacttagtagagat

SEQ ID NO: 6385 - DNA, 121 bp, Artificial Sequence
  Synthesized
  misc_feature (61): n=t or c
ttaactggtgattctccaagtattattcctttctatgttgttactatgcacacagctattntcattttacctatttggtagattccttgtaaggtgcatatgcattttcttcttgccaggc

SEQ ID NO: 6386 - DNA, 121 bp, Artificial Sequence
  Synthesized
  misc_feature (61): n=a or g
taagaactctctgtctcataattatttgacaaatgctttgaaactgagttaatcaggcatngatgtctatgaaaaaaggatgaagagatttggaaccacaaatggctttattagctttatt

SEQ ID NO: 6387 - DNA, 121 bp, Artificial Sequence
  Synthesized
  misc_feature (61): n=t or c
tttaaaggacttatactatcagctggtaacagttgaccagcaaataaggtatttagattcnaccaaatcctatgtcttgaacatatactccttgccctccgggaggatgccctagccagct

SEQ ID NO: 6388 - DNA, 121 bp, Artificial Sequence
  Synthesized
  misc_feature (61): n=t or c
ttctcatcagtgctttgcatgtaattcttaatgccattacattagaaatcaatttgttttnatcgaatcagagctaaacatccacttacaactgttagtattttaaactggcccccacttt

SEQ ID NO: 6389 - DNA, 121 bp, Artificial Sequence
  Synthesized
  misc_feature (61): n=t or c
cgaaagtgccactgacagaaggagggaatttatcctctgttctttctattgataactttcnactcctgatttttaatacggcagtttggaaacaggcacgttcctgtgtgactcataggtg

SEQ ID NO: 6390 - DNA, 121 bp, Artificial Sequence
  Synthesized
  misc_feature (61): n=t or c
atagatttgaagaaaacctgagctgaggttttcattttgagcagagaaattattgagcttnaaagtataagatgctaaggctttggtatttactctctggtgttctgatactgttgagtca

SEQ ID NO: 6391 - DNA, 121 bp, Artificial Sequence
  Synthesized
  misc_feature (61): n=t or g
aagctgaatataaagctgtccaaagaattttggtgcaggtcattggcaaaactcctcctanatacacactggagttgaagagggtggggaacttgcaaacattgacaataattctcgtcca

SEQ ID NO: 6392 - DNA, 121 bp, Artificial Sequence
  Synthesized
  misc_feature (61): n=t or c
atattgcataggcctagctgtgctcctgtcaccatttcatgggcagatgggaggactcagnccaggatctgacagaaaggcctagtccacaaaatcaggtgattataggtgcaaaaccttt

SEQ ID NO: 6393 - DNA, 121 bp, Artificial Sequence
  Synthesized
  misc_feature (61): n=t or c
tttctgccagtgagataaaaattattattccggttccttctttgttaatggtcaactgacncacgttaaattgattattgcagacttgggggactgtgtctttttatgcttgtttgtgtta

SEQ ID NO: 6394 - DNA, 121 bp, Artificial Sequence
  Synthesized
  misc_feature (61): n=t or c
caagaatacccttttttgatgacgagtccctggtcaccttgtccccaacttaccttacacnacactgtgtttagcattggttttctcatgatacatcagtttgaaggaagagtgactgaaa

SEQ ID NO: 6395 - DNA, 121 bp, Artificial Sequence
  Synthesized
  misc_feature (61): n=t or c
aggagtgctgggtgttggagtaggtgtcacagtgtaatgctcaggtgggatggaaggctcntcagctcttctcagaatgtgcttcttcagtgcagagagttttattctgtgactctatgat

SEQ ID NO: 6396 - DNA, 121 bp, Artificial Sequence
  Synthesized
  misc_feature (61): n=a or c
gtttgaaacttctgaggttttcatcctgtccagcagttgactgatgttattttcaaattantgggagagaagaataggaagtaaagacactgtatgggaaggagatagatacactacaagc

SEQ ID NO: 6397 - DNA, 121 bp, Artificial Sequence
  Synthesized
  misc_feature (61): n=t or c
tcagaagattatgtttttgacagcatttcagggtaatgcttcaagcctctctctctgcccnttcccctcttgtgttcttagcattggtttggccaagctcactcccttctgtgccgagtct

SEQ ID NO: 6398 - DNA, 121 bp, Artificial Sequence
  Synthesized
  misc_feature (61): n=a or g
gaatacctcatgcacagaactaatgttcactttttattatgtgcaacatctgtggattttngtgtcttctgcaaactcttatgtgcaaataagagtgaaagaagtacatcagagattttct

SEQ ID NO: 6399 - DNA, 121 bp, Artificial Sequence
  Synthesized
  misc_feature (61): n=a or c
tcacagtctctaacattataaccaccggaaagtttcagagtaccattgccgtagctttaanctctgttagataaagcattttgctcctgtgaggatgtgaacagaatgtcaaagcaatgtg

SEQ ID NO: 6400 - DNA, 121 bp, Artificial Sequence
  Synthesized
  misc_feature (61): n=a or g
ccagccaaagagttaacattatctgaaggctgtaccagacctggagaagcacagccctaancagggccgttggagttttgcattataactggattcacagattgtctccccaggccaagac

SEQ ID NO: 6401 - DNA, 121 bp, Artificial Sequence
  Synthesized
  misc_feature (61): n=a or g
ctttggcagaggagaactgttcctttttctcctttagaaacaaaaccccagagcccagagnagtcctgggttatctgttcccctaacagacctgcttgtgtactactagaagacgcactgg

SEQ ID NO: 6402 - DNA, 121 bp, Artificial Sequence
  Synthesized
  misc_feature (61): n=a or c
tctggatcctttgcaattttgtactctcagaaattagactgttaagctttgaccagccagntggttgtcctgagttgttgaactatatgtcttaaaaaggaaaactgtaagctcatagtga

SEQ ID NO: 6403 - DNA, 121 bp, Artificial Sequence
  Synthesized
  misc_feature (61): n=a or t
cttagcaacctacctcaggaggtacagattgccttgacaaagtgacatttgcctgcctgancaggcagcctgaatctcatcatagaaataaaagcaaagattgtccatattaattcaaaca

SEQ ID NO: 6404 - DNA, 121 bp, Artificial Sequence
  Synthesized
  misc_feature (61): n=t or c
aatcaggctgttttcccacagtacattagaagtcaatacagctgcactaatagataacctnccagattcaggttgattgatcagaaagtaatgaggtattacagcaaagaagtgtgactac

SEQ ID NO: 6405 - DNA, 121 bp, Artificial Sequence
  Synthesized
  misc_feature (61): n=a or g
tattcactcagcagacttttcagctgccatttaatttcttacataaaaatcctcttaattntgtaaaatggtgaaaagatactcattatttaaaatgtttaaaaaaaaaatactttcacct

SEQ ID NO: 6406 - DNA, 121 bp, Artificial Sequence
  Synthesized
  misc_feature (61): n=a or g
agcacagattatcactgcttaggagagaaatatcattcacactctttattctaagaatccnacaaatgcataattcacaatccaggattaatcttaactaaaaattgtattatttttgtta

SEQ ID NO: 6407 - DNA, 121 bp, Artificial Sequence
  Synthesized
  misc_feature (61): n=t or c
agatggtacaacagctattgcattgtgttgtacatcgttatgttcatgtcgtaatacagantataggaggattgaggacatgactgtgctggaccctgatttgttttctggttgaacgttt

SEQ ID NO: 6408 - DNA, 121 bp, Artificial Sequence
  Synthesized
  misc_feature (61): n=t or c
aaagttaaaattattgcaataaaatggattctttcactgctgttgaaagtgtgccttcaantatagttgtatatcattctactgaacttcagagattctttttgctaaaagttcaccttat

SEQ ID NO: 6409 - DNA, 121 bp, Artificial Sequence
  Synthesized
  misc_feature (61): n=a or c
ttgtcactcagtgactaagcagcagatgggcttatacaacttccagttttcatgggtggtntcctctatgcttttactgcaggggactcttaaaaaaaaaaaaaaagaaagaaagaaagaa

SEQ ID NO: 6410 - DNA, 121 bp, Artificial Sequence
  Synthesized
  misc_feature (61): n=c or g
tcttcattaactgcaagattagttgaagcagaatttgactgagtcagagatatccttttgncaaattgagtttgccaaaataatagtccaaatgcttctcgcagttgcaaacaatctgtat

SEQ ID NO: 6411 - DNA, 121 bp, Artificial Sequence
  Synthesized
  misc_feature (61): n=a or g
gttactttttgttagaggatttcttcaggctgaatttggagctctgaacaagatgtaatcnacgtctatattgcttagcatttcactgtgaatgtctgatggcttggctgactgatctagt

SEQ ID NO: 6412 - DNA, 121 bp, Artificial Sequence
  Synthesized
  misc_feature (61): n=a or g
cctcaaagaactgtcaaaagtgtggtgagaaggttgcagaaatatactgtgcaactactcnaacttcctcatttactttaccgtcacttacagcttttcaaaatgtggactgtagacacag

SEQ ID NO: 6413 - DNA, 121 bp, Artificial Sequence
  Synthesized
  misc_feature (61): n=a or c
gctgtggggtttttttaagggtacaaacatgttttgctaacgtatgctttaacaaggcttnatttaagtagtagcttgactttttaacatatttctctcactttgtgttctttttcaagca

SEQ ID NO: 6414 - DNA, 121 bp, Artificial Sequence
  Synthesized
  misc_feature (61): n=c or g
gtattaaggtaaaactgtgtgtgtaacattttctggtctgcttgtttgttggctgtttctnatagaaatggagctatcttgagtttgaaacatgagtctcaaatggtgctctgactgctga

SEQ ID NO: 6415 - DNA, 121 bp, Artificial Sequence
  Synthesized
  misc_feature (61): n=a or g
aaaaaagaagactgtatcttcggactgtgcacacatgagatgttcatagattaatgcatcngtaggtatcctttgggtcttggagatcatagaatcattaaagagtagttaacattaatct

SEQ ID NO: 6416 - DNA, 121 bp, Artificial Sequence
  Synthesized
  misc_feature (61): n=t or c
gtctagatgaagtatgcacctggttggtgtctacaaaggtagcttttccatatttactatnattgttagctgacatccttcctcaggtctcagctgcttgtgttatttcttcctaatgtct

SEQ ID NO: 6417 - DNA, 121 bp, Artificial Sequence
  Synthesized
  misc_feature (61): n=a or g
tcaaaacaatgccttgctgccaagattcccagatgtttgcatggtgtgctcaatcttttancagtccaagtgttttgtactaagggctgaacatttatccacaaaaaacatggtaaaaatg

SEQ ID NO: 6418 - DNA, 121 bp, Artificial Sequence
  Synthesized
  misc_feature (61): n=t or g
agagcctcagcaccactttcttgcactcaccatgtaaacaagcttttgctgggagaaaagnatgtgagggtctcttatgtactgtctttaatttttactcttcatcaggtgcagaagttgc

SEQ ID NO: 6419 - DNA, 121 bp, Artificial Sequence
  Synthesized
  misc_feature (61): n=a or g
acagacgtgctcagaagttcactccagcactgagacatgggcagaatatcaaagtctctcnctgtgggtcatgtattacacagcttcatccctcacttacatgtaatagactcatctcaga

SEQ ID NO: 6420 - DNA, 121 bp, Artificial Sequence
  Synthesized
  misc_feature (61): n=a or c
gtcctctgtccgttcgttcttctgtctcgatgaagtgaatttgtagatcccaagcttcatncagctaaataacgcaaagtaagcaacattttgtgttttctgcattttttttccaatttat

SEQ ID NO: 6421 - DNA, 121 bp, Artificial Sequence
  Synthesized
  misc_feature (61): n=a or c
agggcaaaactgtaatcacagtagaaaagtggtccttaatgctctaaaaaggaactatcantcgttataggcattatttatcagctgcaaagttggatgaaggaaatgaaaatatatcatt

SEQ ID NO: 6422 - DNA, 121 bp, Artificial Sequence
  Synthesized
  misc_feature (61): n=t or g
tcatccagtgaattgaaatcttttttttcttgttgacattgttaactatgtagtgccactngtttacctacgttgcacaaacttttgcttgctttcagattttcagagcttctaaaatttg

SEQ ID NO: 6423 - DNA, 121 bp, Artificial Sequence
  Synthesized
  misc_feature (61): n=a or g
tctggaaaatatcaaagctcattttcaagttgggttgacttaagcaacacagtctattgantacagtttggacttgatattcaggtatccttttttgatacttaaaatgttattggctgtc

SEQ ID NO: 6424 - DNA, 121 bp, Artificial Sequence
  Synthesized
  misc_feature (61): n=a or t
tggctttgctaacaagcagtctgttgagaattacagaaaatctctttctttgttctcattngaacaattcattgaatactaaacatattgcatagctcagtgttttggtatctatgagggc

SEQ ID NO: 6425 - DNA, 121 bp, Artificial Sequence
  Synthesized
  misc_feature (61): n=t or c
aaaggtattgtcagaagagttgcctatggcaccaggctgctatgtttagttaacttactangttgtaggaattttagataatcttactttaggctttgatactgtataggtcagtttacaa

SEQ ID NO: 6426 - DNA, 121 bp, Artificial Sequence
  Synthesized
  misc_feature (61): n=a or g
ttccttgactatcaaacctaaagatccaagctcttaatttacctcatagagtgctacacangctaactttatgtagggaagtatttatctctttgactttggttctgtacttgcgaaatac

SEQ ID NO: 6427 - DNA, 121 bp, Artificial Sequence
  Synthesized
  misc_feature (61): n=a or t
agtatatcaaatgcccacttttgccttaaaagaaaaatgttcaaacttagttttataggantatattagaattatttatcttcattgctagtcaggtaggttttgatgaggtcctcagtta

SEQ ID NO: 6428 - DNA, 121 bp, Artificial Sequence
  Synthesized
  misc_feature (61): n=a or g
ttcaaaaaaaaccagcaagatttgagctaaatgttactgcatgccctgcatgacctcactnaaatatgaatgttgcacagcgtgcgtatcattgccaagatggacctggcacatctgaaga

SEQ ID NO: 6429 - DNA, 121 bp, Artificial Sequence
  Synthesized
  misc_feature (61): n=t or c
atacaatcttgagcacttctctagctcacacaaacctatcgcctcattctacatcagtgangggtaacttcccatttctgttccagtctcctactataaaaatatgactatctatttgcat

SEQ ID NO: 6430 - DNA, 121 bp, Artificial Sequence
  Synthesized
  misc_feature (61): n=t or c
agtttcaatgtagtcatctacaacatcatggattatttgttgtggccatttagcgttaatnggaatacttttctgggatattttgattccactgaagttccagtatgttttccaacacacc

SEQ ID NO: 6431 - DNA, 121 bp, Artificial Sequence
  Synthesized
  misc_feature (61): n=a or t
ttgctgcctataaagaagttacattgctttaaatcaccatgcagacacagaaccctcagancatgatttaatataatgtgctccacttgtaaatagcgtaacagcaaaacaacgtattgtt

SEQ ID NO: 6432 - DNA, 121 bp, Artificial Sequence
  Synthesized
  misc_feature (61): n=t or g
ttctaggaagagctgggatttccgacagcctttaggtacccatcaacctataagttagctntgatttcttcagctgtatcattgcattctgagtctctcaccaagaaaatattcacagtgg

SEQ ID NO: 6433 - DNA, 121 bp, Artificial Sequence
  Synthesized
  misc_feature (61): n=a or t
aataaagcttaatctgttcccagccccatcatagatatacaggagctgtttctgttaactnctggccaggttccttcattagctgaaatcaatagctttcagcatatcaggtgttgctggg

SEQ ID NO: 6434 - DNA, 121 bp, Artificial Sequence
  Synthesized
  misc_feature (61): n=a or g
tactcttgagtgcagaggtaagaaaggaatttattttgtgtgggagacatgaggtttttcnggtgtctgagaagatctctgtcttggagaatgatactttaatgggtagggctttcaggga

SEQ ID NO: 6435 - DNA, 121 bp, Artificial Sequence
  Synthesized
  misc_feature (61): n=t or c
aggaggccgccagtccaacctcctcccaggacagggtcaacttcatgccagggcaggttgntcagggctctgtccagttgggtctcagaaggatggagatggcacagaccctcaggatacc

SEQ ID NO: 6436 - DNA, 121 bp, Artificial Sequence
  Synthesized
  misc_feature (61): n=t or c
aagggagtgaacagcttaatgaagcttggctcatcttctgcagaaatcccaggatgctgtngctcttctgaaagcagcagatcgcacagggagagaaaactttctaattggtaggagataa

SEQ ID NO: 6437 - DNA, 121 bp, Artificial Sequence
  Synthesized
  misc_feature (61): n=t or c
agagctccaaaactaataattccgcacgcttggccccaggttttaggccagctggttcttncacaaggtttcaggacttcctgctgttggtttggctgggagaggagtttgccaggtgaag

SEQ ID NO: 6438 - DNA, 121 bp, Artificial Sequence
  Synthesized
  misc_feature (61): n=t or c
aacttctgacatgtttgataggcctggtaattgaaccacacttctagggcttccttagcangctgagataccaaaccagctaactacagacaattaaggtctgtaacttgaagagaaaaaa

SEQ ID NO: 6439 - DNA, 121 bp, Artificial Sequence
  Synthesized
  misc_feature (61): n=a or g
ttcgagtgaccttgatgctgaacaacaggatcttcttccactgcagacctatgctgaatcnttgccaaagctgctttaagtctgaaatctagaagcattacttcttacaccacagtgcaac

SEQ ID NO: 6440 - DNA, 121 bp, Artificial Sequence
  Synthesized
  misc_feature (61): n=a or t
gcatacctggcatatcttcatgaccctggaatgagcttaccaaagctagtctctcatattnatacccaccttatattgtatttacatttttgaaaatctggcactgatgtgaagtatagaa

SEQ ID NO: 6441 - DNA, 121 bp, Artificial Sequence
  Synthesized
  misc_feature (61): n=t or g
acagtgatgggtttctgaggctgaagagcctgttctctttgtgactttctgccagactttntgtctggcaaaggatgcaacagcacgtcctgcacgtgcttgctttacatgggtaagagtg

SEQ ID NO: 6442 - DNA, 121 bp, Artificial Sequence
  Synthesized
  misc_feature (61): n=t or g
gctagatgtatttacaccctgcttcaaaactggcctctctcctgacatcaagaatgagcanggaagaggaaagtgagggaggctcctacggtccaccagaacttatggagaacaacaggtg

SEQ ID NO: 6443 - DNA, 121 bp, Artificial Sequence
  Synthesized
  misc_feature (61): n=a or c
aagaacacgtgctctgacccacagtgggtgtagttgcacatatgcctccactggtgaaggnaaactgttctcccagagggaggtcatagaatcatagaatcatcaacattggaaaagacca

SEQ ID NO: 6444 - DNA, 121 bp, Artificial Sequence
  Synthesized
  misc_feature (61): n=t or g
aagccaaaactcagactactcccttctggacatggagagcagagcagtgactccatctttngaggaaaaaatctcgtcttaaatcttagaattatagaatcatagaatccttagagttagg

SEQ ID NO: 6445 - DNA, 121 bp, Artificial Sequence
  Synthesized
  misc_feature (61): n=t or g
gtccaaattatttgggctgaaagaaagataaaagtcggtccgctgggacagcaacttcaangttactctcagaaagccaaagtcaatgttgtttttgggatggtaacagaagttcaactac

SEQ ID NO: 6446 - DNA, 121 bp, Artificial Sequence
  Synthesized
  misc_feature (61): n=a or g
atccctttgtgggacatatttgactgatgtatagccatcctgccagcaaccaatttagtgntctcctgtccataatgtcttcatacgtatctatatgtcttcatacgtggtctatactttt

SEQ ID NO: 6447 - DNA, 121 bp, Artificial Sequence
  Synthesized
  misc_feature (61): n=t or c
ctcactgtgctttccattgggtttccacaatacctggatagctctcatcaaaacctgcccngtggggtgcattcgctgtgaaacaccagcaaatttatctcacccagtagctgcaacgctt

SEQ ID NO: 6448 - DNA, 121 bp, Artificial Sequence
  Synthesized
  misc_feature (61): n=t or c
ttccaaatcccctccttcctctcactggttgtgcaggcaatttaagccatgtccaaactangagctccaaatgcacgggttcaggcatacaccctggctgtatcctgactttattctgggg

SEQ ID NO: 6449 - DNA, 121 bp, Artificial Sequence
  Synthesized
  misc_feature (61): n=t or c
tccagctcttctgtggctagtggtgtcagagcatgcaggagatgctaattcttgggcaatnggggttagtgaaacaggtccatacatttcccccagccctttcaaagagctgcttctcaga

SEQ ID NO: 6450 - DNA, 121 bp, Artificial Sequence
  Synthesized
  misc_feature (61): n=t or g
tttcctagcatatatgtagcattcatgtcttgttttcttctccctgaatcatggttaacancatttttgctttcccttgaactgcatggagccaaggcagtgaaggctgtatggatctggc

SEQ ID NO: 6451 - DNA, 121 bp, Artificial Sequence
  Synthesized
  misc_feature (61): n=t or g
aactctgagtattgtgtgctgctacctctgctgaacccgttgttgcagaggaatagtatantatggctcttttctctgtccatttcaccactataaactgaagataaagcgtagcttaaaa

SEQ ID NO: 6452 - DNA, 121 bp, Artificial Sequence
  Synthesized
  misc_feature (61): n=t or c
tcccacagagatcttccctcagcagcctcatgcacacatgcagtgccatgcacagtacagnttgtgtgcagcagagtgcagaaattcatttggctctgcccgaaacgtgtgctggaccaac

SEQ ID NO: 6453 - DNA, 121 bp, Artificial Sequence
  Synthesized
  misc_feature (61): n=a or g
ctttctccttgaaaacactgaagacggtaacagcaaaaaaaggaaatgaggcaagtgaccnctaatagtaagaaaagcaggagcaacttgggtagagaaataaggcaaagcaaaaacaaca

SEQ ID NO: 6454 - DNA, 121 bp, Artificial Sequence
  Synthesized
  misc_feature (61): n=t or c
aacaaaatttggcagcaggattctgaaccactccaaaatctctaacctgcaatgcctcagntctgagatgaaaaaaatccaggtttcacagagttgttctggctcttggaggactcctggg

SEQ ID NO: 6455 - DNA, 121 bp, Artificial Sequence
  Synthesized
  misc_feature (61): n=c or g
catttgctctgatacaacccaagtaagaggacttatcatagaattgtccaaattggaaganacctttaaggaaggggcctctaggcccactccctgcactgaacagggacacccacagctc

SEQ ID NO: 6456 - DNA, 121 bp, Artificial Sequence
  Synthesized
  misc_feature (61): n=a or g
cagcattaataatcccagctctctcatcctctgccagtatgtcagatattctaattccttngttgccttaatggacctttgctgcagttactccaatgtgcagatgtctaccttgctctct

SEQ ID NO: 6457 - DNA, 121 bp, Artificial Sequence
  Synthesized
  misc_feature (61): n=t or g
atcctcagtcttcacaatcagtagagaaacttaggcattttgaattgtgattaggtaagantatatctctctgaagatgcatttttcttcccttcttgactgtcaagacaataggaatatc

SEQ ID NO: 6458 - DNA, 121 bp, Artificial Sequence
  Synthesized
  misc_feature (61): n=a or g
tctggaggtcttttctttgcaggaaaactttatattttttccaggtaacaaagtgaagctnatgagcctgtagttccttgggttgactttttgacctttatttttttcattgagtacctag

SEQ ID NO: 6459 - DNA, 121 bp, Artificial Sequence
  Synthesized
  misc_feature (61): n=t or c
actgtgccctcccttccccaactttctgctgctgcttatgcaatccgtgcttgagcgacanttggaaaccctaagtgagccactgcaattagagttagccttgcctgcctctttttccctc

SEQ ID NO: 6460 - DNA, 121 bp, Artificial Sequence
  Synthesized
  misc_feature (61): n=a or g
gcataattttttgccttgtttattcaattctgtacatataactgtttccaaaaagtctttncaataaactacatacccatcaacatcttcattcctctaattacatttttgttcttatgac

SEQ ID NO: 6461 - DNA, 121 bp, Artificial Sequence
  Synthesized
  misc_feature (61): n=a or g
gatagatgagtttataaaagctgtttagtcttgggagacatgacattgacaagctctcacnattctgaactggacaaaaattttactaagcagttgtttttgtttttttagtctataaaca

SEQ ID NO: 6462 - DNA, 121 bp, Artificial Sequence
  Synthesized
  misc_feature (61): n=a or g
atttttattacagtgctttgtgaaaatacaatcacctttcctgtgacacaatgggatattnacatctaagtatcttccgcaagttcagtttttgtctgtgtttactgaaatggatagaata

SEQ ID NO: 6463 - DNA, 121 bp, Artificial Sequence
  Synthesized
  misc_feature (61): n=a or c
cagaaaaaaataaaaagtaaaaaataaaagcaatttctaccaaatcttaaaggttaagaantccagcagctctactgaatcctggtgtgaggcatatcaggaatgcatcaccaaccagtgg

SEQ ID NO: 6464 - DNA, 121 bp, Artificial Sequence
  Synthesized
  misc_feature (61): n=t or c
tccttgatgcaaacctggatttgcaccagggtcacataaagaagatgtgcccatgcacaantctttatcactgttcccctactagatggttttagaatgatggtccctatttcgcatgcaa

SEQ ID NO: 6465 - DNA, 121 bp, Artificial Sequence
  Synthesized
  misc_feature (61): n=a or g
ttttcatcctccagaagtaaaaaaaaaaaaaaaaaatgttgtcagctaagtttagttatgnttttatcaccagttatacaaatgaaagactgtgatgtgtctgtgtgaggttggataccag

SEQ ID NO: 6466 - DNA, 121 bp, Artificial Sequence
  Synthesized
  misc_feature (61): n=a or c
gatcttatgggtgatgtgtttgccagatgttgtctcaggcagagcaatcacagaaagatanattttgatctttggtgaaggaatcgaggaaggctgaaacttcctcaagaatgaaaccttg

SEQ ID NO: 6467 - DNA, 121 bp, Artificial Sequence
  Synthesized
  misc_feature (61): n=a or t
ggagaagcttgcttccaaccttgaacagatgaatggcaatcacatgcaagatgaggaagantgagtctttttctctgctgggaacagaagtctccttgcccctgcagtgtccctgaacaat

SEQ ID NO: 6468 - DNA, 121 bp, Artificial Sequence
  Synthesized
  misc_feature (61): n=a or g
tctcaaaacaagtgtttgtactgatatccaaccaaagtctacagtgactctttcctcctanttctaagttatattgttctgtaatattttacccacattaacacaaacttgctatatagat

SEQ ID NO: 6469 - DNA, 121 bp, Artificial Sequence
  Synthesized
  misc_feature (61): n=c or g
ataacagttcaagagctgagagaagataagactgagtggacagttttgatgtcagactctngatttgtcccagaaccttttataaatgtggcaacaatgacttaaaacacatatgttgatt

SEQ ID NO: 6470 - DNA, 121 bp, Artificial Sequence
  Synthesized
  misc_feature (61): n=a or g
tagaatcctgagatcctcaaccctcgttctgcctcagctctgttccaaactgcatgttctnctgtggctgtgcctcgtgctcagcttcttctcctgcacatcaggagaactctggagctga

SEQ ID NO: 6471 - DNA, 121 bp, Artificial Sequence
  Synthesized
  misc_feature (61): n=t or c
tgtgctgaggtctcctaccagggcctcgtgagcactgaagaactttgggttacaactccantgccctaattaataaatgccacagtaggcaatgctggtggcttcccctgcattttgtttc

SEQ ID NO: 6472 - DNA, 121 bp, Artificial Sequence
  Synthesized
  misc_feature (61): n=a or t
taccattttgttaccaggtgaagtatcacagtagagatccctctgaattttgctacagcanggtagaggagatctacccaatatcataaaaattatagtatgtgcattttgtgaatgaaat

SEQ ID NO: 6473 - DNA, 121 bp, Artificial Sequence
  Synthesized
  misc_feature (61): n=t or c
cgagaattgctgcttatacagcaagaatacttgaatgcatcaggatccaaccacaggctanaaaccaagcccagtctgatagccagactaactctatgctcacaaaggaattgcatttcct

SEQ ID NO: 6474 - DNA, 121 bp, Artificial Sequence
  Synthesized
  misc_feature (61): n=a or g
ccagctaagaaaggcctgccaggcaacacagctctgctgcctctttccaaagcacataacnacaattttgaaccattagcgcaacacaaaccaggtaggaaaatgcctggaggacctaaat

SEQ ID NO: 6475 - DNA, 121 bp, Artificial Sequence
  Synthesized
  misc_feature (61): n=t or g
tgcttctgctcagcctctcttaagccagaaaggacctctccattcttatgctacaggctgngaacatgcctgaaggctggaggattactgcctgcgaccttgtgcttactgcaaagctatg

SEQ ID NO: 6476 - DNA, 121 bp, Artificial Sequence
  Synthesized
  misc_feature (61): n=c or g
ttacagacccaaaacgatacgctgcagtagctacgtccaattatttccctgcatacagagntgatgaatgtggttcggcctacagtgccttccaagcactacctgggttagctctgcaaaa

SEQ ID NO: 6477 - DNA, 121 bp, Artificial Sequence
  Synthesized
  misc_feature (61): n=t or c
cctgaagcatctcagatttcatttccttcactgaccccaaacctacagaacctgggctttnaaaccctcacgtcctgaactgaagcccattcctgggccccaaactcctctattgtgtccc

SEQ ID NO: 6478 - DNA, 121 bp, Artificial Sequence
  Synthesized
  misc_feature (61): n=t or c
cattaagattggaaaagaccactaagatcatcaagttgaattgtcaacccattatcaccanaccccctaaaccatattgcatcacctgtttatttccattgtcttgggcatatcccggttc

SEQ ID NO: 6479 - DNA, 121 bp, Artificial Sequence
  Synthesized
  misc_feature (61): n=t or c
cgcagagctgagctgagggctgtgggctccacaggagctgctccaagaagtaattgtttgnggtgtctaaatttagtctcagcatcgctccctgccgtgcccgaaatacaccccgaggggt

SEQ ID NO: 6480 - DNA, 121 bp, Artificial Sequence
  Synthesized
  misc_feature (61): n=t or c
ttcagtgctgcccccagggcatggcagagctgctgggtgtgtttctgaggtgggcagtaangtgatggggaaggatgaaactccttttgctgcaagatgaggtggaggggcctgcttgctg

SEQ ID NO: 6481 - DNA, 121 bp, Artificial Sequence
  Synthesized
  misc_feature (61): n=a or g
acaccgaaagcagtgagtttctgcaggggtttgcagaggtttaattcaattaattttgacntaggtgggatcagcctcaaattggtgctcagggctctgatctcagctatttgaatgattg

SEQ ID NO: 6482 - DNA, 121 bp, Artificial Sequence
  Synthesized
  misc_feature (61): n=t or g
ccagtgcaaataaggaaaaaaattgctactattaaccaggactgttttgcagataaacaancaggagatgtagatattctaagaaggaagacatacacattaacaaataattatttaaatg

SEQ ID NO: 6483 - DNA, 121 bp, Artificial Sequence
  Synthesized
  misc_feature (61): n=t or c
aggtgctaaaggtcaaaagggagcactccgatcagtattggagaagaaactttgcccttanctgctgtttttgttccctttgtcacgcagtcaagtcagcaactaacgcgagaacccgact

SEQ ID NO: 6484 - DNA, 121 bp, Artificial Sequence
  Synthesized
  misc_feature (61): n=a or c
gggccccacagcctgcaaagcactgtgcagaaccaagatcccacatctcatccaaagagcnccacgcagcactcccagtgctttgtccactttgcccatcagcagcacaaaacccacccaa

SEQ ID NO: 6485 - DNA, 121 bp, Artificial Sequence
  Synthesized
  misc_feature (61): n=t or c
cttcctgtgccatttctgaagagtaattgaaactctgactaacagagaataactgcacganagatttgtttaagaagtttgagttattttgtatcattaagagatggttagtattgttagt

SEQ ID NO: 6486 - DNA, 121 bp, Artificial Sequence
  Synthesized
  misc_feature (61): n=a or g
cagtggatttggtgacgtggatttgttgctgaacgtctctgtggcgtcgtggatttgttgncgtcgtctccgtgaatacaaaggaccaaagatgctctgacattccccagcagcccaggag

SEQ ID NO: 6487 - DNA, 121 bp, Artificial Sequence
  Synthesized
  misc_feature (61): n=a or t
cagtctcttgttcatttctggtgaaaatgcatagctaatagtggtgatagggagtacctcnacctctttctttttcttagagcatctttccctgctgaacttctgtgaactatttaaatat

SEQ ID NO: 6488 - DNA, 121 bp, Artificial Sequence
  Synthesized
  misc_feature (61): n=a or g
cagatatctctcaactgcacagcatattaatggtgtgcatcctctggtcatttatactcantaatagaattcacatgtttatatttctggtagtatgttagaaaatggagttctgactgca

SEQ ID NO: 6489 - DNA, 121 bp, Artificial Sequence
  Synthesized
  misc_feature (61): n=t or c
tcccgagcagcattagttctgtcacagcccttcccaggaccagtggctgtgcacacaccangcctgcaggtctgacatttcctcttgaacaagcagatctcgggagctgcactgagctggc

SEQ ID NO: 6490 - DNA, 121 bp, Artificial Sequence
  Synthesized
  misc_feature (61): n=a or g
atactttcttgctgaaacccaaattaatgattaatcaaatatatagtagcaaatttatatntgaagatttttgttgtgtagcaaagtattcagaatcatgagatctctgaggtccttatat

SEQ ID NO: 6491 - DNA, 121 bp, Artificial Sequence
  Synthesized
  misc_feature (61): n=t or c
tttaaagcgatgctattgtggcactcaaacatgactgggagcgttattagaaaaaacaacngagtggaagtagtccaacacaaaaacaccagttgtataccacaaaagaaatgcaaactag

SEQ ID NO: 6492 - DNA, 121 bp, Artificial Sequence
  Synthesized
  misc_feature (61): n=a or g
tcagagatgagcactgctgtacatgtgtctcaccgtttgctgtggcagtggtgacacctcnaggatctcaatgacatacaaatggcacttctgtcgcagccacatatttccattagcatct

SEQ ID NO: 6493 - DNA, 121 bp, Artificial Sequence
  Synthesized
  misc_feature (61): n=a or t
aattctgaagatcaccacacataggatggctgtaccagaggatgcaaaaataatcactgcnttcccagagctctcattgctgccatcccttagcttccctgcacataggcataaaagaggg

SEQ ID NO: 6494 - DNA, 121 bp, Artificial Sequence
  Synthesized
  misc_feature (61): n=a or c
ctgtttagggcttccaatgccacctgcagaattggatgtagccaggaagcgtaacctcccnaaaaagcttatggtttcttcaaataccatttaggtagaatcactcaagaaccactctaaa

SEQ ID NO: 6495 - DNA, 121 bp, Artificial Sequence
  Synthesized
  misc_feature (61): n=a or t
agtaatgttgaagcagtgtcagtaacaactagaaggataggaatttaattttaaaaagganttcttttcaatgtatgtgtgcataactgactcatatgaatatctctggtagtagtcacta

SEQ ID NO: 6496 - DNA, 121 bp, Artificial Sequence
  Synthesized
  misc_feature (61): n=t or c
acagaaaccatttttaagccatcatgtttaacctctagtaaccactcgttatttctaaatngtttattaatgcagactgcattaagcagctaacaacttcttttaggttttgcagcaaaag

SEQ ID NO: 6497 - DNA, 121 bp, Artificial Sequence
  Synthesized
  misc_feature (61): n=a or t
taactaattttaaaacaagggtttttttagtgaaatgtcttcatagtttcattatgtctgntttgtgcttgttgaatttttattctgagagggtgttgctccaataaattgagacagatgg

SEQ ID NO: 6498 - DNA, 121 bp, Artificial Sequence
  Synthesized
  misc_feature (61): n=a or g
atcaaggttcgttttgattactttttcaggatacaattatctgtactgtgcattcaaatcntactgcatatatttctggtgacgctgggagtcaaaaatctaagtatctgtttatgtttgg

SEQ ID NO: 6499 - DNA, 121 bp, Artificial Sequence
  Synthesized
  misc_feature (61): n=a or t
tagagtcagctgcaaatacagaacacttgcaaagtactctagaggaagaaatatgaaaaanttatgtattcttttaacatcagccaactgtcctcttgcaaagatgtgaagggttataaaa

SEQ ID NO: 6500 - DNA, 121 bp, Artificial Sequence
  Synthesized
  misc_feature (61): n=a or g
gcccttgactctaagtacccgtgtgtaatggagcagacagcaaatgcaatcaaattaaacntcaacagcattaaacatcagttcttaactctcaacctaccccatccatcagctcacaatc

SEQ ID NO: 6501 - DNA, 121 bp, Artificial Sequence
  Synthesized
  misc_feature (61): n=a or t
agtcagctgtgccaccacaggctcacaaacagcatcacctgaggagctcaagctttggccnacataggaatcacagagtcctgggatggagtttcttcacccaagacagcaaactcagtaa

SEQ ID NO: 6502 - DNA, 121 bp, Artificial Sequence
  Synthesized
  misc_feature (61): n=c or g
taccaaactatgcagcttttcacattttgtcctagcaatgaagctaccatgacttgatgancacatgctcacaacagccctatttcaatttagggaagcagaaatgtggtaagagtgaaat

SEQ ID NO: 6503 - DNA, 121 bp, Artificial Sequence
  Synthesized
  misc_feature (61): n=a or g
atcacaaattccaaaagcaacagtttcttaaaacatacaatttcaccccttagagataaantaggttggtttccaaacttttcctccaagtttctcaaacaagtgctaaataaaaaaaaac

SEQ ID NO: 6504 - DNA, 121 bp, Artificial Sequence
  Synthesized
  misc_feature (61): n=t or c
tgtctggcaagagatgagatgttgcattgctggctgggtgttcgttggtggtcagtagtantgttagctgggtgctggtcagcaggtgacaagtagttgaactgtgtatatatatatatat

SEQ ID NO: 6505 - DNA, 121 bp, Artificial Sequence
  Synthesized
  misc_feature (61): n=t or c
aaatgcaccataagcagatcccaggttatgtaacaaacaattgcaacaacattcagaacanaggcaacactcagaaaatgtctaccatgctgtggcaaccactgttctttagccaataacc

SEQ ID NO: 6506 - DNA, 121 bp, Artificial Sequence
  Synthesized
  misc_feature (61): n=a or g
acaggatgtacacctacagaaaagatgatcatgtcagggtgatggtgcaggatgagattanccaggagtttggctgcttcacacttgagcagatactttaagaccaggattattgtataat

SEQ ID NO: 6507 - DNA, 121 bp, Artificial Sequence
  Synthesized
  misc_feature (61): n=a or c
tccagaagtataaactccatccttgaagggtgtgggaggatacaatgggatacaggcactntcagcatgagttatttctcgtgttcttctctgagcatccacatctggacacaactggcca

SEQ ID NO: 6508 - DNA, 121 bp, Artificial Sequence
  Synthesized
  misc_feature (61): n=t or c
ctcattcttggtgcgttcactgatttttctttcccagtttcccttaagcactcgatgcaangtaagggtgagctctgtgtggcacttgtctgagggcttagaaaaattcaccgaaggaata

SEQ ID NO: 6509 - DNA, 121 bp, Artificial Sequence
  Synthesized
  misc_feature (61): n=a or c
tgctgactcagaacaacgacccacggagacgctgtgctgcactcagcatgtgttggaagcnaacacttggggacagaacacagatcccagggaagtgctgagtgagacctctcctcccagc

SEQ ID NO: 6510 - DNA, 121 bp, Artificial Sequence
  Synthesized
  misc_feature (61): n=c or g
cagttcttgcttgtttaagaaactgaccttattaacaaataggtgagtcatcaccattctncccaaaatgggcacatgttttactttatggtgtgtgctcattcatggcatgactcatggt

SEQ ID NO: 6511 - DNA, 121 bp, Artificial Sequence
  Synthesized
  misc_feature (61): n=t or g
gaatggaattttccatgctcaaagtcaagttcaaattaggtgagtcctttccaagtcatanctgcatcatgaagcattactgcaggttgataggaggagctcttttctgctggcagataga

SEQ ID NO: 6512 - DNA, 121 bp, Artificial Sequence
  Synthesized
  misc_feature (61): n=a or t
ggatttttttcagttaatgtgaaaatgctgtcgagcctcataatttccttgtggcaactcngtgttctcctggattccctatccgctatggtcagcctctggcatcatttcaatttgacta

SEQ ID NO: 6513 - DNA, 121 bp, Artificial Sequence
  Synthesized
  misc_feature (61): n=a or t
tgcccgctccccactgctgcggcagagcagcatcgagccaacaaggtaagtcccatctgcngtgtcagcacaccagcttctgatgtgagctgcttctttgctgctctgggtttattacttt

SEQ ID NO: 6514 - DNA, 121 bp, Artificial Sequence
  Synthesized
  misc_feature (61): n=a or g
tcccaaagctttggcattttcttgggaggtacctaaataaccaaggcgcacttgcttactnttgtgcaaacgagttattaagaattaaactttttaacaattgggtttttttttttttcat

SEQ ID NO: 6515 - DNA, 121 bp, Artificial Sequence
  Synthesized
  misc_feature (61): n=a or g
tgtgtgcctgccctgtgctgtgcttacaactgcccgtgggcattgtgttgtgaagacagcntggaagaaatcttttcctcttgaaaatgatgcctgtttgggtcatctgcttttctttctg

SEQ ID NO: 6516 - DNA, 121 bp, Artificial Sequence
  Synthesized
  misc_feature (61): n=a or g
ccaaagaatagttcacatgaagacataccaccttaagatctgtaatgtgagtcataatcantttattccttaaataacttaaaagtaggtaactctgagttacctacttttttttcttcta

SEQ ID NO: 6517 - DNA, 121 bp, Artificial Sequence
  Synthesized
  misc_feature (61): n=t or c
tcactgcaggatgctcccattgcacctgaagcatgaagaacaccagcaggaacctcaccangcacctcagcagcataaattccattacccagaacagaggcataaggagctttctggcaga

SEQ ID NO: 6518 - DNA, 121 bp, Artificial Sequence
  Synthesized
  misc_feature (61): n=c or g
gtccaggagctgcatgcagttcctgaagcaaattctggaatcttcagcttcgcactggtgntgtggtatgagattccatatgtgccaccttaaggcatcgaggtggaatttcattggataa

SEQ ID NO: 6519 - DNA, 121 bp, Artificial Sequence
  Synthesized
  misc_feature (61): n=t or c
gaatagatttagatggagctgggcagactgctaaggatggacaagtggctgccaatcagantcatctggagcagagctcttaatctgagacacgcctttttaagaaaggatgccacaacag

SEQ ID NO: 6520 - DNA, 121 bp, Artificial Sequence
  Synthesized
  misc_feature (61): n=t or g
tgcctattcatgagcacgcaatactgttactagatgggattaaatatgcatacagagaaanatacctgttagtactgatactgggaggggatatagtttactgttgcttacaaaatctaaa

SEQ ID NO: 6521 - DNA, 121 bp, Artificial Sequence
  Synthesized
  misc_feature (61): n=a or g
gaaaatacattgattttggactatttggagttcattctggtgcactgagaacaaatatatnagaggctcagtcatagagtggtggccatattgtggacatagattcctgctcttatttctg

SEQ ID NO: 6522 - DNA, 121 bp, Artificial Sequence
  Synthesized
  misc_feature (61): n=t or c
gttaagaatctggaacaactaacttcttccaggcacattcagggacagcgagatgctattntgaaagataccccaaggtgttttcagaagacaaaaaagtcaatggcaagagcaataaccg

SEQ ID NO: 6523 - DNA, 121 bp, Artificial Sequence
  Synthesized
  misc_feature (61): n=t or g
agtgagatgtgaagaaacaccagacttgttgagatgaaggttacgtattttcttaataagngattgaaggagacaggtcattttagacatagcgataaatgtgcctacctttttatcttat

SEQ ID NO: 6524 - DNA, 121 bp, Artificial Sequence
  Synthesized
  misc_feature (61): n=t or c
gctggagggagctgggggactctcctttaactgagatgctaaaattaacacatacttgtangtcttctgaagcagagatttttgaagtatgaatgacatcaggactggtgataaaactgca

SEQ ID NO: 6525 - DNA, 121 bp, Artificial Sequence
  Synthesized
  misc_feature (61): n=c or g
gattgacaggatccccatagggtgactctatgatgggtgcacctgtgcccaagcctgcaanagagtttgtgatataagccgcaagctcagaagacagcgtgagatggtgtttagaactgac

SEQ ID NO: 6526 - DNA, 121 bp, Artificial Sequence
  Synthesized
  misc_feature (61): n=a or g
gaagtagcatttggcttctatagacttgtttcagacctgtctatctagttgtcagtccagntatagacctggaactaagagctccagtggcaatggttcacctgtcaaaactgatttcttg

SEQ ID NO: 6527 - DNA, 121 bp, Artificial Sequence
  Synthesized
  misc_feature (61): n=t or c
agaaccgtacaatgtgacagaactttgagataggtggtatagtggtgttcaaatgagatanagttaagcatctatatgtatgtatgccagcggctctgtctccaggtagtgggatgaagtg

SEQ ID NO: 6528 - DNA, 121 bp, Artificial Sequence
  Synthesized
  misc_feature (61): n=a or t
atgggattcaaactgccatggaatgaaaatctcttgatacaaactcataagccaatctccnatataaacattttttcataacatactcccattttgaaaacaattaaatggtggcattttt

SEQ ID NO: 6529 - DNA, 121 bp, Artificial Sequence
  Synthesized
  misc_feature (61): n=a or g
agtattccttcattcacatttgagacctatgatggcttgaaataagtctcatttattaaangtaaccctgagagcacaaagtaggttaaattataaaatcctcagagttttgggaaggaga

SEQ ID NO: 6530 - DNA, 121 bp, Artificial Sequence
  Synthesized
  misc_feature (61): n=t or c
aaggtgattttcacgaaagtttatggaactaatacttgagagatagtaagttggttgatanctttcaggtaggaatacagtcctttctttttgatcaattctctgttcctttttccttgtt

SEQ ID NO: 6531 - DNA, 121 bp, Artificial Sequence
  Synthesized
  misc_feature (61): n=a or c
agtggagtgctagcaactcaagcagcaggaggcagagtgagcagaacagtgtggaacaatnagaggttactgggcacctggcagtattcaaacacagataaaatataatgtaaagtatcac

SEQ ID NO: 6532 - DNA, 121 bp, Artificial Sequence
  Synthesized
  misc_feature (61): n=c or g
gaacacaaaaaagtctcaagacaagctaaacacatggaatttgaatctgtttatgacacanagggcagatgaacttcaaactcagacgtattgtgtataagtatatataatatacacaata

SEQ ID NO: 6533 - DNA, 121 bp, Artificial Sequence
  Synthesized
  misc_feature (61): n=a or c
acatagatgtagaaaagaaatacacctcccactcctattaaataacattggttgacttgtntggggcaaggtcagcagtcacgttacaagctaagctggccatttgtacataggcatctat

SEQ ID NO: 6534 - DNA, 121 bp, Artificial Sequence
  Synthesized
  misc_feature (61): n=a or g
ggcttcagttgtctcacctcacttaagctctagtgtagatataaaaatggactgaaacagntcaacacagcagtgagctgtctctatactgggaacacatgtaatgcacagcaatttaggt

SEQ ID NO: 6535 - DNA, 121 bp, Artificial Sequence
  Synthesized
  misc_feature (61): n=t or c
tctgattttcaatcaaggtaggctttgatttagctaagaaaaactaattcctacaatctgncctatctactaaatggattaagaaggcaagaaaaagctgagtgcttatggacctgacatc

SEQ ID NO: 6536 - DNA, 121 bp, Artificial Sequence
  Synthesized
  misc_feature (61): n=t or c
ctgtgatatgattgcaagaatacgaacttggtggtacttgatagactgcatagaagtcatnctgagttagcaggattccattttctgtcatgtaagtagcaactgtcaacagtttacggac

SEQ ID NO: 6537 - DNA, 121 bp, Artificial Sequence
  Synthesized
  misc_feature (61): n=t or c
tgaaaacctgcttaattcctatagaactgtactcagctcatctcatgactgtgcagctctntgtggttgcttaaaggactgtcttctgccaggtagaacctcattagataagagctatccg

SEQ ID NO: 6538 - DNA, 121 bp, Artificial Sequence
  Synthesized
  misc_feature (61): n=a or g
caacaggaaaaatgaatgtacttaacatctatactgcacactttatgtgtataatgtagcnaaagaaatagtcagaggcagtatttagctccagattttaattttttgttatgttttacag

SEQ ID NO: 6539 - DNA, 121 bp, Artificial Sequence
  Synthesized
  misc_feature (61): n=a or g
gcagtaccatttaaaagatgaggaagaattcttgacatagtttggccaagtttgttcctgnttggcctctatcagaagaaaggagttagaggtgactattcagtttcatctgcgttttcta

SEQ ID NO: 6540 - DNA, 121 bp, Artificial Sequence
  Synthesized
  misc_feature (61): n=t or c
aaatctctttacatgttcttaatggcacccagaaccaattttgtggaataatgagaagtanggtaaatataacaacattccctatgcatacactgcataaaatacaatttttcaagacctt

SEQ ID NO: 6541 - DNA, 121 bp, Artificial Sequence
  Synthesized
  misc_feature (61): n=a or g
ggaaattgccatgatgtgttagtttcagtcctgtcaatgggataaaatagtacagccttangcttgttgaagaggaactatagttaggttcacagaccagattcagagccagacacagctt

SEQ ID NO: 6542 - DNA, 121 bp, Artificial Sequence
  Synthesized
  misc_feature (61): n=t or c
tagtttcaggatactgaaagatgatgtgttatatctcaagaaagagagcagatctgtactnggaaatcatgatgaatttaatcttcacagtatctcttacaaacaagaataccatatcaga

SEQ ID NO: 6543 - DNA, 121 bp, Artificial Sequence
  Synthesized
  misc_feature (61): n=a or g
tgttaagggtttgtttttgagtgataatcaatgaaactgtcatcttcatcaccacctatcnatataattgctgttgccttcagcttttgccatttgctactttctctaaagatgttggtgc

SEQ ID NO: 6544 - DNA, 121 bp, Artificial Sequence
  Synthesized
  misc_feature (61): n=a or g
gcactccagtagctgtatttgtggaacctgagtggcagcctgggaatccatgtaaacaatntgttaggaggtaaaggaaaaaggacaacattcttccatcaaaccaaaaatgccaatcttg

SEQ ID NO: 6545 - DNA, 121 bp, Artificial Sequence
  Synthesized
  misc_feature (61): n=a or t
ctgtaattgataactgatcacttaaaagttgttttttagcaaactattagttgacttttcngccaccacatcagaataacttaagagtcctgagttttattctcttcacttacagtaattc

SEQ ID NO: 6546 - DNA, 121 bp, Artificial Sequence
  Synthesized
  misc_feature (61): n=t or c
caggagtccacattgtgtaatcagccttagcagttggcagtaactgaccctacttgacagnttttttggtgcggtgtctgcaaatagtatcgatataaaaattacctgtattgttgaccat

SEQ ID NO: 6547 - DNA, 121 bp, Artificial Sequence
  Synthesized
  misc_feature (61): n=t or c
atgcgtctttgccagtgtattattttgtcagttgaatagttgttcagtggtacagttcagnctaagtcattggacactgatttctaactgctgtgtagagtttcggatttcttcctgattg

SEQ ID NO: 6548 - DNA, 121 bp, Artificial Sequence
  Synthesized
  misc_feature (61): n=a or g
aaatatggatctttgaggaggcttttctcatatgaacttgtttctcttctagtcaaaggtntcctaaaatgtggatgttttatgtaaacaagcaaaacccctaagcagggacattaacacg

SEQ ID NO: 6549 - DNA, 121 bp, Artificial Sequence
  Synthesized
  misc_feature (61): n=a or g
acaacattaaataagcaatggctgacaccctttctctacagcccttcatctgcaagaagantcctcacatactcacgtgaaatcctggagaataggatggaaaccaacagcaaagagtgtt

SEQ ID NO: 6550 - DNA, 121 bp, Artificial Sequence
  Synthesized
  misc_feature (61): n=a or g
taattatttgggaagtgtatgtattcctttgtactgaatgcctttagctcatgtcccatcnatttgaaaggtttttaacctactctttagtaggcatcaaactgagtgaagtgtatgttct

SEQ ID NO: 6551 - DNA, 121 bp, Artificial Sequence
  Synthesized
  misc_feature (61): n=a or g
acaagattctctgctgtgtgcaagcactttgtacttcttgggcagctaagatctgcattantgccagcataaggttttgtaggaaaccttgccctggaaaaaaaaaaggtgattgaaaatg

SEQ ID NO: 6552 - DNA, 121 bp, Artificial Sequence
  Synthesized
  misc_feature (61): n=t or c
ggacttcctcacttcctttcagacttttaagtctgaaatgggtcacatcaccttccacatntctgacccaggaaaattgcagcgtccctatgggatgtatctggaattaagataacccaac

SEQ ID NO: 6553 - DNA, 121 bp, Artificial Sequence
  Synthesized
  misc_feature (61): n=a or g
cagtgttgttattttctttctttcctgcatctagagagtgatgaacatgattatttcaccnagaatagggtagaaaatggaaactaagcaaacaactgaaattctacttcataaattatat

SEQ ID NO: 6554 - DNA, 121 bp, Artificial Sequence
  Synthesized
  misc_feature (61): n=a or g
gcaaacacagatttggttgtgtctccacacgcacatgcatgggaggtttctactttgtacnctagcagcccaacagcagccacagtgttcggacatcttgctctgacaccccagtgaagac

SEQ ID NO: 6555 - DNA, 121 bp, Artificial Sequence
  Synthesized
  misc_feature (61): n=a or g
tcacagaaaaaaatgtgactcatcttctttaagtttgtctggtctttaagaagaatctggntaaccctgctgagcactggacacactctcctgaccttgttatctccagaaaaatgaagtg

SEQ ID NO: 6556 - DNA, 121 bp, Artificial Sequence
  Synthesized
  misc_feature (61): n=a or g
accttaaacgtgtgctagggaatgcattcttcctgcagttcctagttgcagaaggaaaatngaaaccacttggaatatttaacccagaagttcccaattcaatgcatagttataacatgga

SEQ ID NO: 6557 - DNA, 121 bp, Artificial Sequence
  Synthesized
  misc_feature (61): n=t or c
ttgggtctacacatcttttctaagcatcaatgacacaaatggttggtggctggggacagancacggcacatcatggtggaggttggagtcaggcagtcactttcatgttacaaaccatgac

SEQ ID NO: 6558 - DNA, 121 bp, Artificial Sequence
  Synthesized
  misc_feature (61): n=t or c
aaatgtgcatttaagtatagatttaagaaaatgttatggccaaaacccatcactaatgtanctgtatgtacccattctcagtaaaagatttctcagtaaaacaaaactgtaccttcaagac

SEQ ID NO: 6559 - DNA, 121 bp, Artificial Sequence
  Synthesized
  misc_feature (61): n=a or g
ctacaataacagttggaacagctttacacgaggaaggaggaaaagtgtttgctctggaacntacctgtgcaccttttgcatttggaaatctgaaatgcgaagagcagatctgcactctgac

SEQ ID NO: 6560 - DNA, 121 bp, Artificial Sequence
  Synthesized
  misc_feature (61): n=t or c
tggacttggcagaaattaagagcagtcatcattccaagtgagatggactcaaaaaaggccngagctcttaggaagatttcactgaaggcccccagcaatgcactgtacacctcctcccacc

SEQ ID NO: 6561 - DNA, 121 bp, Artificial Sequence
  Synthesized
  misc_feature (61): n=a or g
gtaaaccaacatttgttaccaacgtggccaggtattgcaagggtgactatgcaaaagcccntaagtaagcagaggaacagtgaacctttgtgctgatattgctggcaggtacaaaacgagt

SEQ ID NO: 6562 - DNA, 121 bp, Artificial Sequence
  Synthesized
  misc_feature (61): n=a or g
actttctgaaaatgttttgaattgtgacagaaacaaaatgcaaacactgctttttctcatncagttccaaggactgtgcagttttgttcaggctcagcaatgatgaatcctttgtattata

SEQ ID NO: 6563 - DNA, 121 bp, Artificial Sequence
  Synthesized
  misc_feature (61): n=a or g
ctgtggaaaactgctgagccctaacaacagagcaacaggtgtctgggatgtgttagctaangcagtggtttctgagctgtgctccatgtgctgctctgaatgagtctctaaagaataacct

SEQ ID NO: 6564 - DNA, 121 bp, Artificial Sequence
  Synthesized
  misc_feature (61): n=t or c
ggaaaatgctcctgtgagggcaggagtggcagaaacagggaagaagcgtcttagatgaagntagaagtttccacatccagagagcagtttatagcaatattcttctggtgtgattaaagaa

SEQ ID NO: 6565 - DNA, 121 bp, Artificial Sequence
  Synthesized
  misc_feature (61): n=t or g
atttctacagaggaagaatttgggataaatttgctaatttgtaactctctgagggtgatancatggtttactcgcatggaaatattcactggaaaacctgaacttggctttaagttgcaag

SEQ ID NO: 6566 - DNA, 121 bp, Artificial Sequence
  Synthesized
  misc_feature (61): n=a or g
tacatctagcccagctctactttgatgcctcagatcttatttttctagaaatgaagaattncattcacaagccatatttttttctatgctttttgaatacagtggtttagataaacattaa

SEQ ID NO: 6567 - DNA, 121 bp, Artificial Sequence
  Synthesized
  misc_feature (61): n=t or c
gttcagagaccaagactggctggagatcaacagaggtcaccagcttgatgggtgagggagnagcaggggatattattttccgggacatcagtaagacctctgagacagtctgctataggat

SEQ ID NO: 6568 - DNA, 121 bp, Artificial Sequence
  Synthesized
  misc_feature (61): n=t or c
tcctgcaggcaccgttggcacacagcaggtctcacccaccaaccaaaggcacagctcttangaatggatgaggaaaacggtgcaatccacttctacaggtatgagggcagtgaggctatgc

SEQ ID NO: 6569 - DNA, 121 bp, Artificial Sequence
  Synthesized
  misc_feature (61): n=a or g
tctctatgcttttcatgctactgctctccttcctcagcctcgctgagcatcagtggcacancagtgtgctctggtgcttcagtactgtgctgtgaataaaaatgctgagctcagtcatccc

SEQ ID NO: 6570 - DNA, 121 bp, Artificial Sequence
  Synthesized
  misc_feature (61): n=t or c
aataaatgagagctatgtgcacatcttgcacaacaagatatgctagaagagtgtgaaggcntcagacctaagctctccaaagttaggaagtgacagaaatcacactgtcagaggacagttg

SEQ ID NO: 6571 - DNA, 121 bp, Artificial Sequence
  Synthesized
  misc_feature (61): n=c or g
agctgaggaatgagaagtccaaaaattgggtatgttatgaaacacagctccactgcaaggnaatcttccccagttcatctgctgtggctgctcagaggaaaatgtgggcactcaccttagc

SEQ ID NO: 6572 - DNA, 121 bp, Artificial Sequence
  Synthesized
  misc_feature (61): n=a or g
gcaaaaagtcaagttagtgcacgtcactttgttaagactattcttattattgtgcttgcantgacagcaaaatgcttcttagttccaactcctgggatgtataaaaatatgattagagcgc

SEQ ID NO: 6573 - DNA, 121 bp, Artificial Sequence
  Synthesized
  misc_feature (61): n=a or g
tgttactgccataacaaagtgctgttgtttaaactcataccagttaccctcaccttgtgangggaaacaggaagatttaaacggagcaaccccattttccattcaattccaaaaagaagcc

SEQ ID NO: 6574 - DNA, 121 bp, Artificial Sequence
  Synthesized
  misc_feature (61): n=a or g
ccctgcgaccacatacacctaattgctgaggtatgggaaggaactggagagctatggaatnggtgaaagatgaagaacctgtaaagtcacttctacatctaagccataccccagcacgacc

SEQ ID NO: 6575 - DNA, 121 bp, Artificial Sequence
  Synthesized
  misc_feature (61): n=t or c
aaatctattcacccacttctagaataatgcccagaacagactgcccaacttcacctcacanactactaccttccagttttagttctccagagagagaacaagcgtcactatcttgaaaggc

SEQ ID NO: 6576 - DNA, 121 bp, Artificial Sequence
  Synthesized
  misc_feature (61): n=t or c
cagtagctccaggcagcaccaaagatttctgcttttcaatttgccatttatctcagtgaangcatctctttggatgttagcaaattcagcttgaaatccctcatttaaggaatgcaaactt

SEQ ID NO: 6577 - DNA, 121 bp, Artificial Sequence
  Synthesized
  misc_feature (61): n=a or g
gtaataaagaggaagagaggaggctttaggagttaagcatctcttgctcaggaactggctnggcattggtctactcatgggagttggtgagtgattgctcttgcatcacttgtttcatttt

SEQ ID NO: 6578 - DNA, 121 bp, Artificial Sequence
  Synthesized
  misc_feature (61): n=t or c
aatattgagtgtgaagaagctgtgaacacgattctgtcaggttgctcacagaagttcctgnataaggactagaataactgggctgaataaatctaagagtcatcccatctgtagccattat

SEQ ID NO: 6579 - DNA, 121 bp, Artificial Sequence
  Synthesized
  misc_feature (61): n=c or g
cagaggccaattctcaagccaaagtgacatagcagtcatcaaggcactgtattcctgcaantgccaacagaaactgtggcactgagataaggagtgtcaaagcactcactggggagcagta

SEQ ID NO: 6580 - DNA, 121 bp, Artificial Sequence
  Synthesized
  misc_feature (61): n=t or g
aggaaacttggaaaaagaagtggccctgaaaatacttcagcaatcttccacccctttgcgnctggccttgtaccaagcatctacgagtctgtcttggctaaactgaagcagaatctattat

SEQ ID NO: 6581 - DNA, 121 bp, Artificial Sequence
  Synthesized
  misc_feature (61): n=a or g
acagccactcattcacgtgctgagctttgatgctgccacagcatgcctggcacagcacatngtacagtgaggaagtccccggcagccccctcgcattgggctgtggccctccagtagggac

SEQ ID NO: 6582 - DNA, 121 bp, Artificial Sequence
  Synthesized
  misc_feature (61): n=a or g
gtgcttattgagatggtccatatatagtttctggtggaccagggggaaatttctactttgntgccattgtttttccacaggtactgttatcagtgactccttttctctggcctatcagctg

SEQ ID NO: 6583 - DNA, 121 bp, Artificial Sequence
  Synthesized
  misc_feature (61): n=t or c
gttcttaagcagtataatatgccgtggctatgattacaggtagctataccctaaggataanttttgtgcagcaatgattagtttgacaagctctgattcacactgaaaccactcagaatac

SEQ ID NO: 6584 - DNA, 121 bp, Artificial Sequence
  Synthesized
  misc_feature (61): n=t or c
ttctaccaagttacaaagaagcacgtcacgtaggctgtaaccaactcaagttgggggcttnagggaaaatgttagcgtacaaggttggatatgaggaaaaaattcattctctggaagagca

SEQ ID NO: 6585 - DNA, 121 bp, Artificial Sequence
  Synthesized
  misc_feature (61): n=a or g
gactgaggacagcaaattcaaatggtgtagctatagggttctggttacttctaaggaagtntgagtacttttataaaaaatatgtatttgacagaagtgtagaagtggtggtagaaaggct

SEQ ID NO: 6586 - DNA, 121 bp, Artificial Sequence
  Synthesized
  misc_feature (61): n=t or c
ctaatatatacacagtacaggttttggagggtttgctttatactagctccagtttggagcngtggattaaatgcagctgtaatgtgccttctggattagtttcatctgaaaggattggagg

SEQ ID NO: 6587 - DNA, 121 bp, Artificial Sequence
  Synthesized
  misc_feature (61): n=a or c
tttttccaaggctggacaatctataagttcttttgtcagcccattctgggcttagttcaanttgttctacgattagtcctggtttgcaggaccagcagagtaggtttgcattgtatgatat

SEQ ID NO: 6588 - DNA, 121 bp, Artificial Sequence
  Synthesized
  misc_feature (61): n=a or g
tataggaagttgataaatgcatggaaagctttctatttgaagttttagcagtaacaatggntggtacagcctatctattcagaagtgatccttaccagggttggttttgattctgttactt

SEQ ID NO: 6589 - DNA, 121 bp, Artificial Sequence
  Synthesized
  misc_feature (61): n=a or t
tcccatcatgtcccagtgtttcatgtttcaatggttttgaaatcaggcagcatgatattcnggggcatccaatccgtttataggatgctcagaactgcagcaagatcatggtcttatggag

SEQ ID NO: 6590 - DNA, 121 bp, Artificial Sequence
  Synthesized
  misc_feature (61): n=a or g
agaacactaataataatttgctttgcaaaagcgctggatttcatgagagatacattcctanttatattctaaaacaattcaggaggaagtaaatttgtccatagtttggctgctgtggagt

SEQ ID NO: 6591 - DNA, 121 bp, Artificial Sequence
  Synthesized
  misc_feature (61): n=a or g
gatgacagtaaaagttttttatgtctttgaaacagtgtgaggttcatttgatgaagtggtnccctaaagaaggagtgtttagatgagtgatgggagacgagttcatatgaggcagggacat

SEQ ID NO: 6592 - DNA, 121 bp, Artificial Sequence
  Synthesized
  misc_feature (61): n=a or g
acagaacgaacatagcgccagaaactactcaccattaaagccgtatcagaaatactgtgcnctttccaaaatgttgtgtaattaggagggtatctttagtcaataataataaagacatagt

SEQ ID NO: 6593 - DNA, 121 bp, Artificial Sequence
  Synthesized
  misc_feature (61): n=t or c
gcaaatgtaggagcaaaatgcaagtgcaatgtatggcagaaagtacagcatagtgcagctncataggtacctgggctatgagtgcatttaccagctaagagtcttgtccaacagctaccac

SEQ ID NO: 6594 - DNA, 121 bp, Artificial Sequence
  Synthesized
  misc_feature (61): n=t or c
acttttctgacatggctaccatcttgtctaagtcagatggggtgttatatgtgtgctgttngggtttgtttcggagaagggcagcgtgcacaggcaagatttacagtgtgtgtgcaaatct

SEQ ID NO: 6595 - DNA, 121 bp, Artificial Sequence
  Synthesized
  misc_feature (61): n=a or g
acaacttaatttttcattcttctttttgacggtttgatacttccctctttattaatcacanttagcttatttaacccatttttagcattagtggattggttatacttaagcaattcctcta

SEQ ID NO: 6596 - DNA, 121 bp, Artificial Sequence
  Synthesized
  misc_feature (61): n=t or c
gaaaaaaacatgaatccattctttaaacattgcaaaagatggttaagacatgcggaaaccngtctttataccacccaagcctcacagttgctctccatttcccattcttccttactcttct

SEQ ID NO: 6597 - DNA, 121 bp, Artificial Sequence
  Synthesized
  misc_feature (61): n=a or c
tagtgctaatttgaaggctgtagcctgtcctaaaggacttgtttggagtaacagtgatganatagcgatcacctagaacattaattgagattatttacagacattgggatctctctgtaca

SEQ ID NO: 6598 - DNA, 121 bp, Artificial Sequence
  Synthesized
  misc_feature (61): n=a or g
tgtgttgcacacgcacggagaagctgtagacatagacatgtagacatgggtcaacttccanttggagatgagagtgctgacttgatgcctggattgcttcacacgtacctaacttggagca

SEQ ID NO: 6599 - DNA, 121 bp, Artificial Sequence
  Synthesized
  misc_feature (61): n=t or c
aacaactcatcaccctgccagaatcccttcctgagcaggagacccagacccgctgcagtgngaatagctgaacctgcactggcagagagaaaacatctaagtataaaatgttccctccttc

SEQ ID NO: 6600 - DNA, 121 bp, Artificial Sequence
  Synthesized
  misc_feature (61): n=t or c
ggcactttctacctttgctgtccacaaagaatctggatgtccagtgttaagctcttgagcntgaggttacatcagtgacttcattttcaaaatgtttgaaaatccatccgtaaccctgcca

SEQ ID NO: 6601 - DNA, 121 bp, Artificial Sequence
  Synthesized
  misc_feature (61): n=a or g
tttgtggattgtgtatgtggaccatctttatgctgcttagtaatttttctaaagaatgcantctcttctatggaaatgccttaatttataggatttattagtgaggcaagttctctgatta

SEQ ID NO: 6602 - DNA, 121 bp, Artificial Sequence
  Synthesized
  misc_feature (61): n=t or g
tggcaggggtaggcaggtggttcttgccatgcttgcagaattctgctttgtcagatgaaancaagcggctcttgcctggtaaagtactgcaaaaagcaaaagctgtttttaaaaagcaagc

SEQ ID NO: 6603 - DNA, 121 bp, Artificial Sequence
  Synthesized
  misc_feature (61): n=t or c
ttcattttgccagtgataaccgtaaggttttatgtctcttcagctgatctatacagagacnttcgatgatagattttaaaattgtgaagctggcaaagcaaagtgtttgaaaattgacacc

SEQ ID NO: 6604 - DNA, 121 bp, Artificial Sequence
  Synthesized
  misc_feature (61): n=t or c
atttattttccatgatgtcatatgactttttcagcttcttttcccccagtcttttctctgntctggctttaagtatgtcagctgtccatatccttcacatttagtagcagtatattgtaaa

SEQ ID NO: 6605 - DNA, 121 bp, Artificial Sequence
  Synthesized
  misc_feature (61): n=t or c
tgtggcgtggagagcaaacaaccagcttttcttctctcctctctggagaaggttagatttnggcaggatgcagcataccagtaaaattaagtctcaataaaatatccattgtttccaatgt

SEQ ID NO: 6606 - DNA, 121 bp, Artificial Sequence
  Synthesized
  misc_feature (61): n=a or g
gagatacaaaaccagtgcttaaaatgtgctgtatcttcactgggcctgtaaaatgtcatcnggtaggagcaactcagcatactttagactttgttcctaagttggcatctctatttttccc

SEQ ID NO: 6607 - DNA, 121 bp, Artificial Sequence
  Synthesized
  misc_feature (61): n=a or c
gaaaatggagtacagaagtcattttgatctctgatgggtgaaactcattggaatggaaacnaacatctatggaacaaaccaaggctcgccatgtcttacatctgccaagtgcctggggact

SEQ ID NO: 6608 - DNA, 121 bp, Artificial Sequence
  Synthesized
  misc_feature (61): n=a or g
ttacttcacttgctttagcaagcactggcttaagtgctgatatactgatgtgtactgatgnatgctgccaaacgtgactcacattttcttttcatttccctctgcagcagcttctccaatt

SEQ ID NO: 6609 - DNA, 121 bp, Artificial Sequence
  Synthesized
  misc_feature (61): n=a or g
ttccacaatcccaagagagaggtaactgggttgtgcagctgttctgcagcagactggaacngcagaataaatcagcagtgctttgctagggctggggatgcaaactgcagagattggttct

SEQ ID NO: 6610 - DNA, 121 bp, Artificial Sequence
  Synthesized
  misc_feature (61): n=a or t
ataggaagaaggggtaagcttaatgccttaaatacgtagattaatacacagaatacacagnattaagctagctgatgaaacacaggtcttgcaagtgggaaaatccatcagcctggatgag

SEQ ID NO: 6611 - DNA, 121 bp, Artificial Sequence
  Synthesized
  misc_feature (61): n=a or t
agagtttggtctttaaacattttgagacacaaagctgagggtttgggttggtgtttcccanatctaaacatgatcacagcaaaaaacgatagtgaatgattcagtagcggggtcggtaatt

SEQ ID NO: 6612 - DNA, 121 bp, Artificial Sequence
  Synthesized
  misc_feature (61): n=t or c
aaaagctccaaatgtaaaaagtctccagttcacatcactgtctccgactgtgcatgcgtgnatgtcttgtgcatgatatggttgaaaaatactttagtacttgcttggtatgagaaatgta

SEQ ID NO: 6613 - DNA, 121 bp, Artificial Sequence
  Synthesized
  misc_feature (61): n=t or g
ttgagattgaggtatttacttcccttcccagggacttttacttctgtggggaggtaacttngttagcagaagcctgtgttctccctctatgtagtgctgctagaccacaagttaaacggaa

SEQ ID NO: 6614 - DNA, 121 bp, Artificial Sequence
  Synthesized
  misc_feature (61): n=t or c
ttagcagccatattaaaaaaggatgcaagtcattctatctcaaaatttaatatatctgtangtctcccttattcataactccctgaagggcaaattagttcctacaggaacttggaagaat

SEQ ID NO: 6615 - DNA, 121 bp, Artificial Sequence
  Synthesized
  misc_feature (61): n=a or g
aaactctgccccttagaagaaggtcaggaaaggctgacaaccctcttccaaatccagtctnaactgggaaattaaaagcgctgagtttgactccttgttgtgaagttgctgtttactaaag

SEQ ID NO: 6616 - DNA, 121 bp, Artificial Sequence
  Synthesized
  misc_feature (61): n=t or c
cttttaagcaccgacactgagagctgtgcagtaagctctagcatcccgagtgcccaaggantgggctcagtgacacaggatcctcagaaaaaagtctgttgtgaggtgaggcagcatctgg

SEQ ID NO: 6617 - DNA, 121 bp, Artificial Sequence
  Synthesized
  misc_feature (61): n=a or g
tgaatttgagagagataataggaatcacttcttgttccacactacgacaaccatttaaatntacttactaagatattgaattaatcagtgatgactgctaattgaggtaggtaacagtttg

SEQ ID NO: 6618 - DNA, 121 bp, Artificial Sequence
  Synthesized
  misc_feature (61): n=a or t
caagaaaatacatatgatatgttgattgatttcacagtcatcattaatctgatgaaaaaantactatgacccagattccaagtaacatctccaaccagtctaacacaggtggctccaacaa

SEQ ID NO: 6619 - DNA, 121 bp, Artificial Sequence
  Synthesized
  misc_feature (61): n=a or g
gggctacgaaaaagaaggagagaaaccaggccactcctaacaaccctcatctaaagctacnctactttaggtgtaacactgtgacatgatttctggattggtggaataggaaacaatttgc

SEQ ID NO: 6620 - DNA, 121 bp, Artificial Sequence
  Synthesized
  misc_feature (61): n=a or g
agcaataaatcaatagagtagtctatattttaggaatgtgttgattgtaatgcaaaaggangctatataagcttacacagctgtgtcctagaaaatccaggaataggattaagatatacag

SEQ ID NO: 6621 - DNA, 121 bp, Artificial Sequence
  Synthesized
  misc_feature (61): n=a or g
cacagagtagtttaaaaaaaaaaaaaggagttaaacaaagcaaacttacttatgtcattanctgagacacgtctgtttgctttacttcagcgttgtctatccagctcattaatggcacaaa

SEQ ID NO: 6622 - DNA, 121 bp, Artificial Sequence
  Synthesized
  misc_feature (61): n=a or t
aatacagtggctgtattttaaccctactgagacagaacatacgtgactactggagagatanacagtgacaggaagcacacccattaggtggtagctttttctggtccgtttatgtcttttc

SEQ ID NO: 6623 - DNA, 121 bp, Artificial Sequence
  Synthesized
  misc_feature (61): n=a or g
cttttgactactttgggtcaagccttttattgcagctttcacactgaggttaagagtaaantgaagatctcacattttagtgatattaatacagtatgaactgattaacaacaaagatttc

SEQ ID NO: 6624 - DNA, 121 bp, Artificial Sequence
  Synthesized
  misc_feature (61): n=a or g
acgagaacgctttgcctggcagaaataagtacagcattagcaacttcacgtgtgtacagantaacaatggagatggaggaaacaaaaacggtgaaaaagccagcgtgttatttacaagacc

SEQ ID NO: 6625 - DNA, 121 bp, Artificial Sequence
  Synthesized
  misc_feature (61): n=t or c
agctctattgggtaatcaatttattttctggaagatagttgatacatgtggcctcctttgntaactgccaataaccttaagtgttggttatcatcatgctctggtattttgaacaactaat

SEQ ID NO: 6626 - DNA, 121 bp, Artificial Sequence
  Synthesized
  misc_feature (61): n=a or g
tggtatgtaaagcggtatggagttatttcttgactataacacagtggggagtgtgggaaanttgtcagttgttgtacatggtggaaatgatttgctgtgtaactatgtaaaatgttaattg

SEQ ID NO: 6627 - DNA, 121 bp, Artificial Sequence
  Synthesized
  misc_feature (61): n=t or c
ttgcagtgaactaaaagaactttcttgaatggcagtagtgggatgtctgatttgtccatancagggcaaaataataatgcagaagcagaagaggaactgaactatgcctctaggtattcct

SEQ ID NO: 6628 - DNA, 121 bp, Artificial Sequence
  Synthesized
  misc_feature (61): n=a or g
aggatgtgccaggagagtgggctgtgcagcctgggaatgggatttcttctgttcacattcncaatctcaccctccaaaatattccccaaaaatgtagcaggtgcaaaactttacacccttt

SEQ ID NO: 6629 - DNA, 121 bp, Artificial Sequence
  Synthesized
  misc_feature (61): n=t or c
tggaaaattaaaatgaaaatggacatgcatgatacccttaaagtaataaagctgacactantgagtcagcagtgggccaccaacaatgggtcaacaatgatggctgaacacatactggagt

SEQ ID NO: 6630 - DNA, 121 bp, Artificial Sequence
  Synthesized
  misc_feature (61): n=a or g
taggattattaaggtttcattcttcattttccatcacttcatcatctttctgttaactgcntgctgatgagtctgcagaaacacagtgctataacacataccttgaagcaggaatgttaaa

SEQ ID NO: 6631 - DNA, 121 bp, Artificial Sequence
  Synthesized
  misc_feature (61): n=a or g
ccataacaacatgcttctctgtatacacagatgtgcatgatacatgagttttttcttatanacccaagagcctgtagtcacaggaccagatcagtgttcccatctggccatttcatattgg

SEQ ID NO: 6632 - DNA, 121 bp, Artificial Sequence
  Synthesized
  misc_feature (61): n=a or g
tttgaacttccagcctgtggcatgcggagttcctcctgacaacagcagaatgataaagacnaatctcacacaccagaactaacatttcattctcttttctgccccaggatcaggtcttagc

SEQ ID NO: 6633 - DNA, 121 bp, Artificial Sequence
  Synthesized
  misc_feature (61): n=t or g
gtatttagattactgtacagtcagatgctgattgttccatcctaacttttaggtacctcangtaacagtgttcaaatcctccctggaggaagagcttagtaagattaggattatgatcagg

SEQ ID NO: 6634 - DNA, 121 bp, Artificial Sequence
  Synthesized
  misc_feature (61): n=a or g
cctggttgtggctgcggagagagtctggggagatgaacagcaagattttgtctgcaatacncttcaacctgggtgtagaaatgtttgctatgatcactttttccccatctctcacatcaga

SEQ ID NO: 6635 - DNA, 121 bp, Artificial Sequence
  Synthesized
  misc_feature (61): n=a or g
ttgccattgacttacaacagtcaattagatcctaattcttgcaatttacttatctcgaacnttcatctgtaaacctagtcaagcatgcaagggtcaccattttgcaaactgatcagagcat

SEQ ID NO: 6636 - DNA, 121 bp, Artificial Sequence
  Synthesized
  misc_feature (61): n=a or c
gttcttaataacaaacgtgtgcaagacagtattgtaatcacagatgactcaatgtttgctntgaacagtgctgtaactccttgagttgtacgaaatgtaacaaaaatagtcctatcatttt

SEQ ID NO: 6637 - DNA, 121 bp, Artificial Sequence
  Synthesized
  misc_feature (61): n=a or g
tgtggaaaagtggtctgcccacttgttgggaatattggagcattttcatggcatgcagggntgaaacaaggaaggctaatggcccacttggaattaaatctggtgagagagatcaaggaca

SEQ ID NO: 6638 - DNA, 121 bp, Artificial Sequence
  Synthesized
  misc_feature (61): n=a or g
agatccccagttgtttttcagccttgaataggacagagtaaaatgaaatagacatatgtangaagaccagcaatatttgggccttagttaagggtcaaagggatgtagatgggagagagga

SEQ ID NO: 6639 - DNA, 121 bp, Artificial Sequence
  Synthesized
  misc_feature (61): n=a or t
actgcgtcagagcaaaaagcttagtgagagccaaaataattctgtctgctaaatataaatnggatacacataaatggccgaagtgagctcctactgcagtgataatagtggagacgagtgt

SEQ ID NO: 6640 - DNA, 121 bp, Artificial Sequence
  Synthesized
  misc_feature (61): n=t or g
taacacaatcagctcactggtcttacagctacgggctgtggccaagccactgccacaaaanatgccagaattaaaggccaaaattttaacctggaggaagtggaggtgggtctgttgcaga

SEQ ID NO: 6641 - DNA, 121 bp, Artificial Sequence
  Synthesized
  misc_feature (61): n=t or c
aaacaactgtctgatgttggacaagttaactagtttcctatatcttactactaatcaaaangtaaaataaacttcccctttccagatgacctacaataccttcttaatatatttaaaacac

SEQ ID NO: 6642 - DNA, 121 bp, Artificial Sequence
  Synthesized
  misc_feature (61): n=t or c
ctgatttgttgcagggtatttacaacaggagaagcttctggctacctgccgggaattcatnttagaaagctccgatttgaaggagtacgcagagcactgtacagaggatgggttcattccg

SEQ ID NO: 6643 - DNA, 121 bp, Artificial Sequence
  Synthesized
  misc_feature (61): n=t or c
cacgtctcttttaacccctgctccaagctattcaagacttcaatgagaaagaaaaatgaanacaccatttcccaccccatttcagccttccatccagtctctccactgcaggtacattact

SEQ ID NO: 6644 - DNA, 121 bp, Artificial Sequence
  Synthesized
  misc_feature (61): n=t or g
tgccctaaacatgaaggcagagttgcatttcacaaatctcagtcagcacaaggcactctcngcaaaaacctgcaatcaacagctcgctgcaatgggagcacactgagcatcgcagctgggg

SEQ ID NO: 6645 - DNA, 121 bp, Artificial Sequence
  Synthesized
  misc_feature (61): n=t or c
aatgaagaagtattgtcttcattctgaggctgagttggtggactcctttaattccttgccnttgttagaagagattaaaaatataacatgattgtaatctcattgtcactcaaaaaacagg

SEQ ID NO: 6646 - DNA, 121 bp, Artificial Sequence
  Synthesized
  misc_feature (61): n=t or c
gggacactttctgtccccatgccagaaggtgaaatgcagttataatcttagccaaagatangttatgttggaaccacgctttaattttggtatcctgttctgttttcccagtacctatccc

SEQ ID NO: 6647 - DNA, 121 bp, Artificial Sequence
  Synthesized
  misc_feature (61): n=a or g
tgcagtgggttcacagcaactccaagtaaaaagcacagggaactaatgacagtgcaaactngaattggaggttggatatacacggaaataaacttgagatggcagttaatagaggtcagaa

SEQ ID NO: 6648 - DNA, 121 bp, Artificial Sequence
  Synthesized
  misc_feature (61): n=a or g
aattattggtagagtacttctgaagaccaaattcatcattttgtaaacagaaaattaagcnaaattcgttaaataaacttcatgctgcaaattattcacccagctttactgttacagcatt

SEQ ID NO: 6649 - DNA, 121 bp, Artificial Sequence
  Synthesized
  misc_feature (61): n=a or g
tatcagcatgaaagtgtacatatatacgagtgctgcatgacagacctaaaaggctggagcnttatttctgtatttaaatggaactgtggcaacagaaacgcatttcagtaaatgtataaat

SEQ ID NO: 6650 - DNA, 121 bp, Artificial Sequence
  Synthesized
  misc_feature (61): n=t or c
aaaagataatttccatgccagagctgacctgctgctttgagaatataggcaggtgaaacanggaagtgtttacatctgtgttgagtctgtcctaactcttccctcacgtggtgcaaaaata

SEQ ID NO: 6651 - DNA, 121 bp, Artificial Sequence
  Synthesized
  misc_feature (61): n=a or g
aagcaagcaatagaggagctgacattcacagtagtctgtgcagaagaggcattaaggagangcaatcaggatgtttgttcttctctcttgagagcataaggattactacagacatttcact

SEQ ID NO: 6652 - DNA, 121 bp, Artificial Sequence
  Synthesized
  misc_feature (61): n=a or c
gtgtgatagtatggagcactctcaagaaaacatccactacagcattgaaacaaggagttanagaaatataggaacttaaatgacagaggggagaacttggcagttagatcagaaaactaac

SEQ ID NO: 6653 - DNA, 121 bp, Artificial Sequence
  Synthesized
  misc_feature (61): n=a or t
gttgactagtttacaaaaggtattgtgccatttttaaagccagtttacaaatttaagatangaagcaacttactgattcatatttgagtgctataaaatcaatcagtctaaatagcttcaa

SEQ ID NO: 6654 - DNA, 121 bp, Artificial Sequence
  Synthesized
  misc_feature (61): n=a or c
tgtttgtgtacacataacatctttgtttaactgatctcctctcttctcaattcctctcctnttctgtttgtattcaattttccttttccctttttcttcttccctttcttctttcaaagaa

SEQ ID NO: 6655 - DNA, 121 bp, Artificial Sequence
  Synthesized
  misc_feature (61): n=a or g
acatttacaagggctaacgaggaactaagactctcctgtgatgcatatttctagctctccntagcaaactttttacttaggggcattgtacagaatgtaagtgatgagggtcaggtaagag

SEQ ID NO: 6656 - DNA, 121 bp, Artificial Sequence
  Synthesized
  misc_feature (61): n=a or t
actcctaacacttctataaatcttgaacataggacacctgttctggaggactgctttcagnctgccttcctttctagtgtttttatcatgctttgctaattttccacaatggtatctcatt

SEQ ID NO: 6657 - DNA, 121 bp, Artificial Sequence
  Synthesized
  misc_feature (61): n=t or c
gaatagggtggggaggtaatgaaattgttgaacatgagctagatctcacagtgaagaagcngaagcttacacatgtggaagctttatcagttgttctgcttctctttctctgatttaggtt

SEQ ID NO: 6658 - DNA, 121 bp, Artificial Sequence
  Synthesized
  misc_feature (61): n=a or g
gagttgacacaacatttgaccagttctcatcctgactaacgtgaccaaagaagttcaaaangtggggtcacatccaaagactgatatcagtgagaacagtaaaaacttactaggctctgat

SEQ ID NO: 6659 - DNA, 121 bp, Artificial Sequence
  Synthesized
  misc_feature (61): n=a or g
tagaaagggaaaggcatccttaaagcaataactatttaaataaactcttctggtgcagacngagtaccaacaaagctctccataaatcagaactgtttagagataaactagcaatagtaaa

SEQ ID NO: 6660 - DNA, 121 bp, Artificial Sequence
  Synthesized
  misc_feature (61): n=t or c
ctgtgcagttagttcatcagcgtgaatcccaccttccctttgactccgttttgaaagaatnagtataaaagaaatgagcttcctcatagcctttcaaataagtaactatggctcagttact

SEQ ID NO: 6661 - DNA, 121 bp, Artificial Sequence
  Synthesized
  misc_feature (61): n=a or t
cagagaactgggagatatcacatctctgaattctcccctttagtattagcctaagtcagcnggcactgtcgtgtgtgagcattcagttctgtgagtgatggtggtggtacagatggcagca

SEQ ID NO: 6662 - DNA, 121 bp, Artificial Sequence
  Synthesized
  misc_feature (61): n=a or t
tcttcaagctgatccataaaaatgtggttttcatacagattcaccataaattgcgtgttanagtaattcataggatgattacttgtaattatataatgagaataggctaccaaactattca

SEQ ID NO: 6663 - DNA, 121 bp, Artificial Sequence
  Synthesized
  misc_feature (61): n=a or g
aaattaacattctgaggtatataatctgataagagactaaagctcttccaaaagaataatnatttataggaaacgtgcttttattccaagaataagaacatctcaagaatgaatgataagc

SEQ ID NO: 6664 - DNA, 121 bp, Artificial Sequence
  Synthesized
  misc_feature (61): n=t or c
atattttacagatttccttccctgactgacaacataatcacaacccaaagtggcagattancaacgttactattgtaaaaagagaaaacattgtgatatgtacttgctttatggaagaact

SEQ ID NO: 6665 - DNA, 121 bp, Artificial Sequence
  Synthesized
  misc_feature (61): n=t or c
atccaaccatcagtttaatagtgtctgccagctgtgctgatctttgctttctttctagatngtttcggtaatttttagacatcatctaataaaatctttaagctttagaaaaccctcactc

SEQ ID NO: 6666 - DNA, 121 bp, Artificial Sequence
  Synthesized
  misc_feature (61): n=t or c
ggacttctggaggttatgtggtccaaactacagcagagttacctgaagcttttgagtatcncaaattaaagggactctacaacatgtctggcaggactgtatgagaagctgaaacatcatt

SEQ ID NO: 6667 - DNA, 121 bp, Artificial Sequence
  Synthesized
  misc_feature (61): n=a or g
agtctatgggttgttggttttttttcagtgttgatttgaaaatatggcacttctaactttngcattctttgtgttcatgaaacttattattttactgacttctgtacttcccatttaatac

SEQ ID NO: 6668 - DNA, 121 bp, Artificial Sequence
  Synthesized
  misc_feature (61): n=t or c
taccctttgatattcagggcttaggttcatccagcctaaattcaatttaatttacaatcanagaattgttccagttgggagggacccttagaggtcattgagtccaactcccctacaatga

SEQ ID NO: 6669 - DNA, 121 bp, Artificial Sequence
  Synthesized
  misc_feature (61): n=a or g
gattgctgtgcattgtaactgtggaatgatacaaatttctaaaagaaacacacgggtttcnaatagaaacacaatgggggaaaagaaaaagatttataataacttttcagcttccactttg

SEQ ID NO: 6670 - DNA, 121 bp, Artificial Sequence
  Synthesized
  misc_feature (61): n=a or c
caatcaggaagaaatatagaagaacaggatggatccaacagactaaatatgaacagttaanatgttctacagatatgtaactttcccacagaataactgaaatcctatatttaacatatac

SEQ ID NO: 6671 - DNA, 121 bp, Artificial Sequence
  Synthesized
  misc_feature (61): n=a or g
ctaaccacattcgagagtatgggtatctgatctgggacaagtttggttctcagagactgcnaaagtgcatgttcctagctggccatttaaatgcctttacaggatccagttccaccagccc

SEQ ID NO: 6672 - DNA, 121 bp, Artificial Sequence
  Synthesized
  misc_feature (61): n=t or g
tgcactagttcatgaccaaagactactaacagtgtatcccataacaacagaacccaagatntccgtagctagagtaggacaagccgttgtcttttgactgcagtttgctcattcgtgcatc

SEQ ID NO: 6673 - DNA, 121 bp, Artificial Sequence
  Synthesized
  misc_feature (61): n=t or g
cttttcaattattctacctagagccacaggtagcactgggatagcagtggtggtggtgctnggtaaccagttcttaaaagccagtgaatttcttggtatgcctgtagaccctaaattgaat

SEQ ID NO: 6674 - DNA, 121 bp, Artificial Sequence
  Synthesized
  misc_feature (61): n=a or g
taattgccattattccacacctgtcaatagctcttgaaaaaaatcagcccttcagctaganaagtaagttttaagagttcacagaagaggcatcctgcttccttaacctatgggtaacaaa

SEQ ID NO: 6675 - DNA, 121 bp, Artificial Sequence
  Synthesized
  misc_feature (61): n=t or c
gtttcccatggtctctgtgtgtcccaagctgagatccaatcacccacagcatggctgctcnctgggagacataaggggtgacaatctacagcaggcacgcagtgtcctgagcccagagcac

SEQ ID NO: 6676 - DNA, 121 bp, Artificial Sequence
  Synthesized
  misc_feature (61): n=t or c
agcagtgtgaaacataggagttggattcaatgatcattgtaggtatcttccaactcgaganattctatggttctgtagaagaggcagcttttgtggggagatctgaagaccaatgatgcgt

SEQ ID NO: 6677 - DNA, 121 bp, Artificial Sequence
  Synthesized
  misc_feature (61): n=a or g
catgaaacaaatagcagcaatgcagaaagctagaaagcccactgatacaaggagaggaggnaatgagcagaaacagtgatggcaggagagacagaaggaactcaggtgaatgccattttaa

SEQ ID NO: 6678 - DNA, 121 bp, Artificial Sequence
  Synthesized
  misc_feature (61): n=t or c
gaactttcaatcagatgggctgagaatgacaagcacagcatggagagtgcatttcccattncattccccccttaccaacctgcttccagagtgaaacacagcctggaactgcaacacataa

SEQ ID NO: 6679 - DNA, 121 bp, Artificial Sequence
  Synthesized
  misc_feature (61): n=t or c
attgtagcacattttgcccacagaaagagaaaatgaaatcccttctggaaaactgctgatncccaacctgaataccctcttgaatcttctgcttgtggcaccgtgacgctgtactcaccca

SEQ ID NO: 6680 - DNA, 121 bp, Artificial Sequence
  Synthesized
  misc_feature (61): n=a or g
cagccagtagcagtaggctcaggggcgggtagtattgtgggtagcatttaaaatggtgacntttacattgcagcaccatttaaaggctgcagtcagaggagaagcccctttgggcagtccc

SEQ ID NO: 6681 - DNA, 121 bp, Artificial Sequence
  Synthesized
  misc_feature (61): n=a or g
acattcttcacaagttagaacctattgtgttgacctagggcttcccgatccaggatctccnttccttcttatgtgggtagcagcaatagccctgtgtgtacgtaagcatcccattccttgc

SEQ ID NO: 6682 - DNA, 121 bp, Artificial Sequence
  Synthesized
  misc_feature (61): n=t or c
cacttgtctggctgtgaatgaaatgaaattggaaatgagcgtgttctttatggcagggagngttagtatgggaagtgcttgtagttttgaggcttcagcaagcactatgaagagtgatcaa

SEQ ID NO: 6683 - DNA, 121 bp, Artificial Sequence
  Synthesized
  misc_feature (61): n=a or c
tttattaaatctatgaaatgtacgtagatgttttaaaggtaataaacaatgaaggagttangagctgtttgcaaatacatgcttgtgggaccagatcctcagctagtgttacagtactgct

SEQ ID NO: 6684 - DNA, 121 bp, Artificial Sequence
  Synthesized
  misc_feature (61): n=a or c
gagcaagacaaagcaaatattcactgccaacccagttcaaaaatactctgagaggagaganaacaaccaattgaacaaaccaagaaatgcagcagttatacaatagagttctgtgatcttt

SEQ ID NO: 6685 - DNA, 121 bp, Artificial Sequence
  Synthesized
  misc_feature (61): n=t or g
tataaacttttttcatgggaagataaggagccagagttccaaagatgcttatataataaanagaaatggtaaatgttacctagctgaattttaaatctgtagtcacttaattgattctggt

SEQ ID NO: 6686 - DNA, 121 bp, Artificial Sequence
  Synthesized
  misc_feature (61): n=a or g
aagtcctttgtgacatttgcacgagctgggaataattctcggggtatgagggatgtgtacntgtgggtgtttgctcatttataactgactgaaaaaagttgatctcctttataatatcacc

SEQ ID NO: 6687 - DNA, 121 bp, Artificial Sequence
  Synthesized
  misc_feature (61): n=c or g
ccatgtatgaagatgatcacatgagatgtgacctgcagtttattgatgcagaatcatgggnagttatgtgcatttcactgtgctcttactggtctttcagatgctcataatattgggaaaa

SEQ ID NO: 6688 - DNA, 121 bp, Artificial Sequence
  Synthesized
  misc_feature (61): n=a or t
ctttggctcttgtaatcgagtatctgtcaaacaggtcagtcagaaaagctaaatacactanatatacagatatttctccaggtggaaccacacaccttgtggcgtataactgtggaacaga

SEQ ID NO: 6689 - DNA, 121 bp, Artificial Sequence
  Synthesized
  misc_feature (61): n=a or g
tcgtcgctggcttatagttaaaaatctgagctcagttttttctgtgcctcagaaatgtgcnctgttagtctaaaatctttataactaaaaatgtatctcagagaaggaaaatactgttatt

SEQ ID NO: 6690 - DNA, 121 bp, Artificial Sequence
  Synthesized
  misc_feature (61): n=t or c
aagagacctattcatatactgtgtgcacaatcacatccacgcactgctttaaaacacttanactgaaagatggcacataaatgggggaagttacattgttatggataagcactaaaactga

SEQ ID NO: 6691 - DNA, 121 bp, Artificial Sequence
  Synthesized
  misc_feature (61): n=t or c
tgcttatggtgaggagcaggcaggtaacagcactacttacaagaaccaaggagcactgtangggggagaaatttcttggtcattcctatcccatccagataaccatgtataggagagagag

SEQ ID NO: 6692 - DNA, 121 bp, Artificial Sequence
  Synthesized
  misc_feature (61): n=a or c
actgctgaaaccatgccatgagccagtgctgcagaaaaagcaaacagcactccaccacgcngagctggttgaactgccttgttagacagccacacactgcaagctattttgaatccctgct

SEQ ID NO: 6693 - DNA, 121 bp, Artificial Sequence
  Synthesized
  misc_feature (61): n=a or g
gccagaccatcccttgtcttccaaatgagtgccatggagctgtagagatagacaatggagnaaagacatcctttatcttctcctttcaggttaataatgctctcctggagaattcatactg

SEQ ID NO: 6694 - DNA, 121 bp, Artificial Sequence
  Synthesized
  misc_feature (61): n=a or g
ggcacttaatttttctttcctctttacctcctgtttcaatattgtggaccatttattgtgnttttgtgaaaatcccttgctaaaaaagattaagaacattcttgcatggcatcagagaaaa

SEQ ID NO: 6695 - DNA, 121 bp, Artificial Sequence
  Synthesized
  misc_feature (61): n=t or c
gcaaataatgattaagtatcataccctttttattttcattacgactgagccttggagcccngtcacttgcaaggtatcccactagcagagggaaaacagctctggaaggaaaacaacactc

SEQ ID NO: 6696 - DNA, 121 bp, Artificial Sequence
  Synthesized
  misc_feature (61): n=c or g
ccttttcttgagagttgagaaagccaatccagtgggatctgggagccaaagtcacatgggntattttgataggaggccaagaatttgggctttgcctcaggaatctgccctgtgcttgtct

SEQ ID NO: 6697 - DNA, 121 bp, Artificial Sequence
  Synthesized
  misc_feature (61): n=a or g
atcatttattttcatcttaactttgctagtacctcttgaagcagaaaatgggatttacttnttgtagtgttcaaggtgagagattaagaaacattagccaccataaccattagatacaaaa

SEQ ID NO: 6698 - DNA, 121 bp, Artificial Sequence
  Synthesized
  misc_feature (61): n=a or g
ttttttttttttgctaaatcaaaaattatttgatgggaatgatgatgatggagaacaatcnattcagggtacgtattgaatttcagcactactacattaaataaatatgtttactttgaga

SEQ ID NO: 6699 - DNA, 121 bp, Artificial Sequence
  Synthesized
  misc_feature (61): n=a or g
tcactaagccaataccatgccagagaaggaaaaaatcatggctttgagctactgaaaactntaaaaggttctgcttaggtgtgtcatagaatcatagaatggcctgggttgaaaaggacca

SEQ ID NO: 6700 - DNA, 121 bp, Artificial Sequence
  Synthesized
  misc_feature (61): n=a or g
cctggctatgcacccattgctcacaacaatcacacaccaatgtgagatcaaaaccatctgngctaaaaccagggcacagggacggcacagtgtggtactgactcaagttatagcaaataat

SEQ ID NO: 6701 - DNA, 121 bp, Artificial Sequence
  Synthesized
  misc_feature (61): n=a or g
tttaaacagaaaatgagtgcaattgaagtagtgtagaaaccttgttttattcctactatgncagaggaaattacagctcggattacttttactaggaaatgttatcttgcagaagaagaga

SEQ ID NO: 6702 - DNA, 121 bp, Artificial Sequence
  Synthesized
  misc_feature (61): n=a or t
atttagggtgattatcttctgatgttagcttatttacaggataaacttgctttattcatcntagattcatgaagctcttgggaataaagaatctgaagaagctggaactggagctatgact

SEQ ID NO: 6703 - DNA, 121 bp, Artificial Sequence
  Synthesized
  misc_feature (61): n=t or g
ttggcgctgcaaagttttgcaggagtaaattttgaggagggacttgaaactgaaaagtgtnattattaggtgaatgaggaaataatggactgagtgtaaaaagcaacagatgaatccggat

SEQ ID NO: 6704 - DNA, 121 bp, Artificial Sequence
  Synthesized
  misc_feature (61): n=a or c
tgatattattaatgttatcttcacaaccacaaggaaaactgaaaattgtttctgaaacagnactcatttctggagactgagaaagtatattctggctggactttcagaagctgatcagtta

SEQ ID NO: 6705 - DNA, 121 bp, Artificial Sequence
  Synthesized
  misc_feature (61): n=t or g
tgaagtttgagaaaaaaaggatcacattacagttcatgacatagaaaatggtgaactgtgnaggaaagttggacaggaaagggaataagacagatttgtgcaggaaggaaaagaaaaaaac

SEQ ID NO: 6706 - DNA, 121 bp, Artificial Sequence
  Synthesized
  misc_feature (61): n=t or g
ctacatgtaactataatttcatttttttcttccacacaagtaaacattcctggaacaaatngagaaaaactaagaggttagccagagcaactgtgtaaaggtaatgggtttaggggtagtt

SEQ ID NO: 6707 - DNA, 121 bp, Artificial Sequence
  Synthesized
  misc_feature (61): n=t or c
ttagttctgagaagttccctatcacatcctgtgtaacattcagggtttcagtgcataaggngaaatccctcagaggtctggtagcattcacaccctgacatgagaagcaagctttatggtt

SEQ ID NO: 6708 - DNA, 121 bp, Artificial Sequence
  Synthesized
  misc_feature (61): n=c or g
atgtgaattgtctaatttatacagctaaagggttattgataaaatgtgatgacagtttcantgttaatactgtgtgctctacctctgtgatcagaagaatgtttatcttaaagcatgtttt

SEQ ID NO: 6709 - DNA, 121 bp, Artificial Sequence
  Synthesized
  misc_feature (61): n=a or g
aggcctattcactgggacaaaaaattgatttcaatatgaaaacgttaactcacctttagtntagctttagcacagtaatctagtactattaagttttaattactccagcaggctaatcata

SEQ ID NO: 6710 - DNA, 121 bp, Artificial Sequence
  Synthesized
  misc_feature (61): n=a or g
gtttgttcagaaattgggttgaaaagatctttctgatatttatctttagcagctgaaatgngaaaactagcatttgtggttgagtagatagattgtacatctcctcattttttcttcttaa

SEQ ID NO: 6711 - DNA, 121 bp, Artificial Sequence
  Synthesized
  misc_feature (61): n=t or c
gtgcttgttatttctattcacttgctgacagacgtactttgattaactgccattttcagangataaagtactgtggaaagaatcagctcattttccagtgaaaacagtataaaattctcaa

SEQ ID NO: 6712 - DNA, 121 bp, Artificial Sequence
  Synthesized
  misc_feature (61): n=a or g
aatagggttaggaatgaaacactgactgcttaatgctaaacctctcccatgaggaagaacncatagaaattccatgataaacccccagagcctgggaagagcattcaccaatggtccagcg

SEQ ID NO: 6713 - DNA, 121 bp, Artificial Sequence
  Synthesized
  misc_feature (61): n=a or g
attttaggaaaccttcctttttcagttgtgcataaaagcttttctatctctacctcatccnttgctctcatctctttcaagtatgcacaagctggaaatagggagtatcagaaagcaccaa

SEQ ID NO: 6714 - DNA, 121 bp, Artificial Sequence
  Synthesized
  misc_feature (61): n=c or g
catctggttgtgtgaataatgctataaaaggctccacactatctgggaaaaggggctgcgnggagtgcaatgctgcaggagtgtccattgtgagaagcgtggagatgtggcactgggggat

SEQ ID NO: 6715 - DNA, 121 bp, Artificial Sequence
  Synthesized
  misc_feature (61): n=t or c
agtaggtttatgttctaagaatttaaaacctagatgtctggtgggcagaaagttttttatngtgtcagatggattccatcagaagtggaggctataaatgtttcactcctttcagcttatt

SEQ ID NO: 6716 - DNA, 121 bp, Artificial Sequence
  Synthesized
  misc_feature (61): n=a or t
ggagcacagtctgttggaaatacattactcagaacgaaagacaactgcactttagaacacnttctgctcagagaagtgggtttgttttagcaaagaggagaacattcagcctatcagtagg

SEQ ID NO: 6717 - DNA, 121 bp, Artificial Sequence
  Synthesized
  misc_feature (61): n=t or g
tcccgggtggttcctccagctcttcttgacctgcaaatttatcccgtgaaagctggaaatnagggtgaaaatccacctcactcctcgttctgttactggtctaagccagagagagaacctg

SEQ ID NO: 6718 - DNA, 121 bp, Artificial Sequence
  Synthesized
  misc_feature (61): n=t or c
actgcttctggagcttgctcttctctgcagttttctgaaagcagcgctactcatttttccntctccttcaagaagttcacctgaagagaaacatttcctggaggttcaaaacaggtctcct

SEQ ID NO: 6719 - DNA, 121 bp, Artificial Sequence
  Synthesized
  misc_feature (61): n=t or c
caaccaccacaccacagaacataattataataaccttaggctggctttcattaagtaagcntttacctcaggataattactacaagcaaaatgcatgtggtaacaactagcttcagttttt

SEQ ID NO: 6720 - DNA, 121 bp, Artificial Sequence
  Synthesized
  misc_feature (61): n=t or c
atcttcacaccgagcagtcccaccttgcatccagctgggtatctacagggttatcttttcngtgctgaaacgcctctgctggtcaactgctcgagttcatcaatcactggagaaatgggct

SEQ ID NO: 6721 - DNA, 121 bp, Artificial Sequence
  Synthesized
  misc_feature (61): n=a or g
tttgccagctggatcggctgtcctcaagctgaagggaaagaggaaacctgcagagctcccntcctgaatgatcagcacgagtccagcggccgctggatggctttaagtcactcaaggcaaa

SEQ ID NO: 6722 - DNA, 121 bp, Artificial Sequence
  Synthesized
  misc_feature (61): n=a or g
attctaggtgggcaaaattaggcacataaaagcgaaaagccacttgcatgggaatcttcanaagaagttttggaccaaatctggggatgccggttgttctaactactgtccatgggttgca

SEQ ID NO: 6723 - DNA, 121 bp, Artificial Sequence
  Synthesized
  misc_feature (61): n=a or g
taatcaaagatcactaaatgaaatacatgaatgttgatctggcatatttcatatgaaaccntaactatggctcttctgcaagtctgaagcaaaaagtgttttaccaaagagcacacactgt

SEQ ID NO: 6724 - DNA, 121 bp, Artificial Sequence
  Synthesized
  misc_feature (61): n=a or c
aggactgtgaatcaaaaaataaattttatttttttgtatctccagacttgccagtgaaagnagagcttgcatctgcttgatgtctttggatcaagtaatctgccagccaaagcagtctctt

SEQ ID NO: 6725 - DNA, 121 bp, Artificial Sequence
  Synthesized
  misc_feature (61): n=a or g
ccattgatgtgcaatgttatttttctggcttgtatcttgtgattataaaagcttttagacntgtgccccttattcaaggaataagcgtgaaggtgaccgaatagaatgcggaacatggaac

SEQ ID NO: 6726 - DNA, 121 bp, Artificial Sequence
  Synthesized
  misc_feature (61): n=a or c
tgcttccagcagttttgcatctttctactctactgagtgtcctaatactccaagactgagngcgttcatcccattttctgcacactattattttgtctcctacccacttcttctcccctgt

SEQ ID NO: 6727 - DNA, 121 bp, Artificial Sequence
  Synthesized
  misc_feature (61): n=a or t
tcaaatgcaccgaacagaagtgctgccataaaacacggctaccttatgctgaataaaaggnagcacctgccctggttttgagacttgtgctgtgttggaggcatgaatttgaatttgggag

SEQ ID NO: 6728 - DNA, 121 bp, Artificial Sequence
  Synthesized
  misc_feature (61): n=c or g
tcatcgttctcactgttcatggaggaatatgtttattgaaaggcctatcttctccgaggantttttcttctaccacagcttcaggcagaagctgtgtgggaatgcactttccattctcaca

SEQ ID NO: 6729 - DNA, 121 bp, Artificial Sequence
  Synthesized
  misc_feature (61): n=a or g
caggcagcacgacaactcccttttcagtggtgttccaggaaacatggagagcccagcagcnaagtaaatattccaggaagtttttccatcctgataatttcaggtgtgacactattgtcct

SEQ ID NO: 6730 - DNA, 121 bp, Artificial Sequence
  Synthesized
  misc_feature (61): n=a or g
tgttatagagacatattaatgtgagttgttttgcgcaggtcataggtcctattcaaagaangtacagctgccttactcaggctgactgccaggatgagcaagctacattgtaaattgaagt

SEQ ID NO: 6731 - DNA, 121 bp, Artificial Sequence
  Synthesized
  misc_feature (61): n=t or g
catggccaaaatgggaagatagaaactggataagaaaactaacaggtgagtgaaaaaactncccggaccatcaagctttcacaggtagattcaacagcctagtctagatgctatctggcca

SEQ ID NO: 6732 - DNA, 121 bp, Artificial Sequence
  Synthesized
  misc_feature (61): n=t or g
caggctggagataatagcagtgcgtgcaaaggtgaagctggtcagaagaggggtgaaaatnctttcttctccatcaggcaagggccttgctgcttgtttaggcaaacaggaggcgttgttc

SEQ ID NO: 6733 - DNA, 121 bp, Artificial Sequence
  Synthesized
  misc_feature (61): n=a or g
caggctgcccgcatgtgggtgaaatcgggtatatatatataccccaatgttggagaaatgnggtaggtgggcactttgtagtatgttttgggatggcagcccgagtttcactcatgccctg

SEQ ID NO: 6734 - DNA, 121 bp, Artificial Sequence
  Synthesized
  misc_feature (61): n=a or g
tgtgctttcactccagcctcctctaactggtgtccaaacaatgtgcagtgcaacaggacanacagctaccttctttcaggaggttcgttacttttgtcttttcaagatcaagagatgagct

SEQ ID NO: 6735 - DNA, 121 bp, Artificial Sequence
  Synthesized
  misc_feature (61): n=t or g
atcagtcagaagcttgcaataaaaggctgcggagccctggcaaagctgtccgagcagagangagcgaagggctccctcacaccaaaggttctgctatccctggatgggggttaaagggaac

SEQ ID NO: 6736 - DNA, 121 bp, Artificial Sequence
  Synthesized
  misc_feature (61): n=a or g
tttcactcctctccctgtctcccatacgtacggaaaaacacttctaaaccccaaactcaanacaaatgaatcaagaatcttcagaaatcctaaaccaagaaaaaataatgttcttctcctg

SEQ ID NO: 6737 - DNA, 121 bp, Artificial Sequence
  Synthesized
  misc_feature (61): n=t or c
ggcaactttattaactacatagaaaataaaactgatctgtgctttcatatagataacatcnttctgggatgctagaaggaaaacaaaaggccttattcttatgttagctttacagtcttta

SEQ ID NO: 6738 - DNA, 121 bp, Artificial Sequence
  Synthesized
  misc_feature (61): n=t or c
tgctttttagttgatttgactgtaagcaagaagttaggagctgtgtcacataagcactgangctgatttctctgggctggctgcacgctggttggttgatctcaccagatataagaagaaa

SEQ ID NO: 6739 - DNA, 121 bp, Artificial Sequence
  Synthesized
  misc_feature (61): n=a or g
agtttaagagacaccaaattttaaagctggggatgtaagtgctgttcttctactttccaanccttaatacagatatgctatcttaaagagcaataacaatatcccattactttcagcctgc

SEQ ID NO: 6740 - DNA, 121 bp, Artificial Sequence
  Synthesized
  misc_feature (61): n=t or c
ataatgcagttctttccagacaacctgctctggtttcgttactacagtaccttttccctancatgctatcaagtatttaacacccagttccttgccagatgctgcctatgtcttggtcagt

SEQ ID NO: 6741 - DNA, 121 bp, Artificial Sequence
  Synthesized
  misc_feature (61): n=c or g
ctctaaactgtttcacagtctgctatgattgaatgacatgaagcagataaatgatttttgnaaagctgtaaattgatcagatgagcttggagactgcactgaaataagtagtgctcctact

SEQ ID NO: 6742 - DNA, 121 bp, Artificial Sequence
  Synthesized
  misc_feature (61): n=t or c
caaggaatagcgggtggtggcagagatagggaaggaattgtgtgtttttcataaacagaanaagattagagcatactaacaacatgccacatgtctcctatacaccatgtgcctgtgtata

SEQ ID NO: 6743 - DNA, 121 bp, Artificial Sequence
  Synthesized
  misc_feature (61): n=a or g
tcttggaccctcctcatcttcttcatatgcttctcctccactgttacggtaggtttgctcncttgggtcgaagtcttcaaggtctacttgatccatctcatccgtaatcataacatcttct

SEQ ID NO: 6744 - DNA, 121 bp, Artificial Sequence
  Synthesized
  misc_feature (61): n=a or g
tacccataacacaaggctgatccactgatctttttctttcccatcatagtactcactgganacaggaaactaagaatgctgcttttcttcagtcctttcgttctcatactttaggaaattc

SEQ ID NO: 6745 - DNA, 121 bp, Artificial Sequence
  Synthesized
  misc_feature (61): n=t or c
atgagcagtgccaggtccagctccagacactgcttgtagattccactgtgtttagaataangtggagtatgtgttgtccaatgcagtttggttaaacaaaaaaaactttaatcacgtaagg

SEQ ID NO: 6746 - DNA, 121 bp, Artificial Sequence
  Synthesized
  misc_feature (61): n=t or c
gttggtttttttttgatgttgagtccagttccatgtgatgcaattctctgtaaatattagntttatgaaatgctgtggctattccttttctgaacagcagtgagttcactgtgcattaagt

SEQ ID NO: 6747 - DNA, 121 bp, Artificial Sequence
  Synthesized
  misc_feature (61): n=t or c
tccaggccataagctgaagaagtgactagcttacatttttatgtattacaccaacgcagcnatataaggcttgatccagtaataccctcctctcagcctttattcctggtttgcaactttt

SEQ ID NO: 6748 - DNA, 121 bp, Artificial Sequence
  Synthesized
  misc_feature (61): n=t or c
tcttttgacaggtatgaactctgttctttttcccctggtgttcctcaaagtaatttccttncaatgtattcatggcaagcttttgtatatccgtttagatctatttctttgttcctttact

SEQ ID NO: 6749 - DNA, 121 bp, Artificial Sequence
  Synthesized
  misc_feature (61): n=c or g
tgcctaagcacacacacacaaaaaaaaaaagcttggctggctgcaagtaagggaacacagnaagctttcagcctcctaagcactaagtaagcacaacacttacaggaagcgggcagaacac

SEQ ID NO: 6750 - DNA, 121 bp, Artificial Sequence
  Synthesized
  misc_feature (61): n=a or g
gtgagcaatcctgtatgcagaaacatttgtggaaatctgtcttcagaagcagtcattgtgnactgaagggatttgtggccaaaactagctttttgaaaaacagctgggcctgacccaagaa

SEQ ID NO: 6751 - DNA, 121 bp, Artificial Sequence
  Synthesized
  misc_feature (61): n=a or g
ttatccactctcaggatcgaatacacttgtgcttaactgttacgaatttcaaacttattancttagcttaaatgatcacagtacagctccactactgaacaactagaatatttcacagagt

SEQ ID NO: 6752 - DNA, 121 bp, Artificial Sequence
  Synthesized
  misc_feature (61): n=t or c
ttcgtttaaggaaagctgtaggagttagagaagggacaccttcattatagaggaaaaagantgaggaagttaaagattttaaaataataactcaagttcaacacttctttgaatcagttta

SEQ ID NO: 6753 - DNA, 121 bp, Artificial Sequence
  Synthesized
  misc_feature (61): n=t or c
tttcagtaacgctcacagaacattagagtaattcttaaaagtgttcactgacaggtaactntctcatttttgaaagttgttaattacctgtagcaatttgggccacattactagcacaaga

SEQ ID NO: 6754 - DNA, 121 bp, Artificial Sequence
  Synthesized
  misc_feature (61): n=a or g
gagtgacatgctgtattttatctgcgagcctgcaaagcagctgatgtggatgacagatccntatgctgcatctggctgtggctgctgtgctgtggcatagggtcttcttgacctgaccact

SEQ ID NO: 6755 - DNA, 121 bp, Artificial Sequence
  Synthesized
  misc_feature (61): n=a or g
tttgaaacaattagctaaacaaagacagcagtcatgtaccaaaagtgcatgccacgttganctgaaaatctgttgtatattttatgcagagatattgaattaggcaaactatttttgctcc

SEQ ID NO: 6756 - DNA, 121 bp, Artificial Sequence
  Synthesized
  misc_feature (61): n=t or c
atgtttagatggagagagcgtaagggccagcagtgacaacacaaagtcggtcagcagttangtatgatatgaagcacaactttgttacacactcctcaactaaaggtcagccaaaatcata

SEQ ID NO: 6757 - DNA, 121 bp, Artificial Sequence
  Synthesized
  misc_feature (61): n=a or g
atcttcatgtcacataattcagctggacctgctcctgctgccctgaagccaaaaggagtantgccctgcaattcagcaggagtacaacaggatcgaaaggtgttactgtttatgttagtgc

SEQ ID NO: 6758 - DNA, 121 bp, Artificial Sequence
  Synthesized
  misc_feature (61): n=t or c
ggggaggtatgtcttaacattcttgatgtaggatgttttgagatcctacataaaacactangtttttcataaaagagagaaattattgaaaattacataaataatattttggtcatacttt

SEQ ID NO: 6759 - DNA, 121 bp, Artificial Sequence
  Synthesized
  misc_feature (61): n=t or c
tgtatgtacataggtgtatttgtatacatatacgtgcatatgtatatatttaataaacctnttctatgattctgccaaaatcagaaagactataacttatcttttaacacgtggatgatga

SEQ ID NO: 6760 - DNA, 121 bp, Artificial Sequence
  Synthesized
  misc_feature (61): n=t or c
atgtaaatagattccagtgggaagagggttatcctcctgtgtgatgtgtgtcaaacagtangtgatcgcaataattgcatcctattgcacgcatccccacatcttttctttttgaaacatt

SEQ ID NO: 6761 - DNA, 121 bp, Artificial Sequence
  Synthesized
  misc_feature (61): n=a or g
acactgaggcaaatgtactttgtgccatcaccaacacatttacaaatcagcctgaaggctntgtaattgcacggctgtaacctggagtttgaagcagccctcaaatctctattattttata

SEQ ID NO: 6762 - DNA, 121 bp, Artificial Sequence
  Synthesized
  misc_feature (61): n=a or g
agaagactctgaatctgcaaagttcagtcaaagcttttggcaaactttcctgcagaacaantatcgtatgtttctagctttgcacttgctatcaacatttcctcccaccaacataaaattg

SEQ ID NO: 6763 - DNA, 121 bp, Artificial Sequence
  Synthesized
  misc_feature (61): n=t or c
aatgatttacagaaggcacagctgcaacaccataaatgtaactagccaaaggttagcaaangcctctcactccataaatttatgaagaaaagaattctaggacaattggaagagggaaaac

SEQ ID NO: 6764 - DNA, 121 bp, Artificial Sequence
  Synthesized
  misc_feature (61): n=a or g
cagtatgactcaatgtaagtacacatagggcaaaacagccatgaactaaaatcagttctcnctaaagaatgtgcgggcgttattctggaaatcaacaaaccttctaatgatcattctggcc

SEQ ID NO: 6765 - DNA, 121 bp, Artificial Sequence
  Synthesized
  misc_feature (61): n=c or g
ggaaatgcgacatttaatttaacaagtccatagaaggctgtactatccagtttgaaggctnttcccttggtatctgtatcctaaagtgtcgctgtcctctagcttagcagtttccccaagt

SEQ ID NO: 6766 - DNA, 121 bp, Artificial Sequence
  Synthesized
  misc_feature (61): n=a or c
aaatgacaaatttcattggtggctactgatatgctcagttcagggcagtttctgttcaatnagtggtaccatagaagagtaatagcctttattcatctccctaaaggtagtattaccaagg

SEQ ID NO: 6767 - DNA, 121 bp, Artificial Sequence
  Synthesized
  misc_feature (61): n=t or c
aactgccagagaagggagatctgccaagcaaaatcttaacatccctgtgctggtatctganggagttaggagcaggtctgggcttccagcagagggactgggaaggcctagggggaggtaa

SEQ ID NO: 6768 - DNA, 121 bp, Artificial Sequence
  Synthesized
  misc_feature (61): n=t or g
attcttgcaggcattcacaattttgttcagtaccccaaagctttatgtaggtatgcaccgntctcaactctctaaatcctcctgtatttctaggatgtttggaggaagtgcctgaattcag

SEQ ID NO: 6769 - DNA, 121 bp, Artificial Sequence
  Synthesized
  misc_feature (61): n=t or g
ctctttggaaccagaagtaaggaaaggtctgttttcttgttttgatgcagtatcacatgantttctaagcctttgcattatactggatctgtcctacacatgtgtagtgttatctaccaaa

SEQ ID NO: 6770 - DNA, 121 bp, Artificial Sequence
  Synthesized
  misc_feature (61): n=t or c
tgtgactgccttgcacactgttcattaagctcagaagattagtcagagagattatccagcntccactatctatatgctgtctaagctgcatcagctactggagcagcagcaggaagctttg

SEQ ID NO: 6771 - DNA, 121 bp, Artificial Sequence
  Synthesized
  misc_feature (61): n=a or g
aattatactgttttatgtatttaattatatgtattatatattgttgtcctattgctgtttngcttctggtctgactttatagatttctgggtacttattaccagaacagcctattttggta

SEQ ID NO: 6772 - DNA, 121 bp, Artificial Sequence
  Synthesized
  misc_feature (61): n=t or c
agatgctgaagcataatgttcttatgaaaaatgtactggaagagagagttagaagacaggntcgaggaaaggtaagattgagaagtatgtgatcagtggctttaagccaggcctgagggta

SEQ ID NO: 6773 - DNA, 121 bp, Artificial Sequence
  Synthesized
  misc_feature (61): n=a or c
ctgttactaatgcataactattcatccacaatccaatatgcaacgtacaacttcagctctnggattgttctatgagagctgttaaaaaccagcttctatacttggggcacttacagaagta

SEQ ID NO: 6774 - DNA, 121 bp, Artificial Sequence
  Synthesized
  misc_feature (61): n=t or c
tacagccttattttacaaacttataatcacctgttggtgaggttgacagactccttcagcnctgttaaaataaactggaactagataagtgcaaagatcacaggattagatgctagcaagc

SEQ ID NO: 6775 - DNA, 121 bp, Artificial Sequence
  Synthesized
  misc_feature (61): n=a or g
ctaaaatgtcttgctaatgtattgttgtgtcttattaaaaactaaatgccatatcaaaatntgtgggaaaatgattgcattatgtgtgatgtcatggagggcacatttttgcttttttctt

SEQ ID NO: 6776 - DNA, 121 bp, Artificial Sequence
  Synthesized
  misc_feature (61): n=c or g
tgaagggatggaaaagaacagtcacaagagtgctacacaggaaaatacagggtacacaatnctcaataaagggctattttgtacatattctgtttttatcactcttcaattaacaaagtgc

SEQ ID NO: 6777 - DNA, 121 bp, Artificial Sequence
  Synthesized
  misc_feature (61): n=a or g
gatggaactactgaagaattaatttgcactcattcctgccttcctttgaccaagtactgcnctgccatactgtacagaaatcaagtcagcagggcaggtttgatctttgccaataccatga

SEQ ID NO: 6778 - DNA, 121 bp, Artificial Sequence
  Synthesized
  misc_feature (61): n=a or g
cgtatttcagttaaatatatgtatacacacatatataaatctcagaaaacaggcattatcnggaggaaagagattacaaatttgtgggaaaaaatcagagttcttccaaccctttgttcac

SEQ ID NO: 6779 - DNA, 121 bp, Artificial Sequence
  Synthesized
  misc_feature (61): n=t or c
ttaatacacgcacatcaaaaccttttctgcatacttgagaaaatgaaatctagtcagcacngtgaggtctggctgacacatatccactatatttcatttactgttcatttgcagaagagca

SEQ ID NO: 6780 - DNA, 121 bp, Artificial Sequence
  Synthesized
  misc_feature (61): n=t or c
ctctgcttgtattattctgctgctggtaaataactgctacctccctacattcataaaatcngtaggagtagatggatctaaaataccaggcactgggacgagaggtgagaatgactgcaga

SEQ ID NO: 6781 - DNA, 121 bp, Artificial Sequence
  Synthesized
  misc_feature (61): n=a or g
gttgtttcaagtataaattagttttctaaatgtattgatcctattaattttgtgagtttcnacttgtcctgctgaatgtattgctttatagctgtacagagtgcttttctaggaaaaaatg

SEQ ID NO: 6782 - DNA, 121 bp, Artificial Sequence
  Synthesized
  misc_feature (61): n=t or c
atttcagtagtttcttcatctaaaggtaagactggattaatccgtatctgcagacagtaangcaatctgctagtttaggaatttggagaggccagattttgccagtccacacagtcatgtc

SEQ ID NO: 6783 - DNA, 121 bp, Artificial Sequence
  Synthesized
  misc_feature (61): n=a or g
tggtttagggcagtctgattctgcgagctcagcagtcctagaccaggctgatgcttggctngaagccacctgggaaccctgggtactgtaggcacaacccaagaggtcaagatcaaactcc

SEQ ID NO: 6784 - DNA, 121 bp, Artificial Sequence
  Synthesized
  misc_feature (61): n=a or g
gattgattggaagtccattagtgaccctagttcataagctgtgctggaaaattcatacacnctgtgaatttggtcattttagctctgaatcgttcatggtccggactcgcgtgggtctctg

SEQ ID NO: 6785 - DNA, 121 bp, Artificial Sequence
  Synthesized
  misc_feature (61): n=c or g
caggaatgctcgctcaaacatgtgaagcaatgatgtcagtggaaacatcacccagagtggnccagcccagtgtggtgggatggcacttggagggatcccatcacgttacaagggaagcttg

SEQ ID NO: 6786 - DNA, 121 bp, Artificial Sequence
  Synthesized
  misc_feature (61): n=a or g
ccaaagaatttgataagaaaatatcacttaccattgccaagtgtcttcttacttaggttcnttattatcatcccctcttaggcatggaatacacagcagagtcagctcccagcgtgttaaa

SEQ ID NO: 6787 - DNA, 121 bp, Artificial Sequence
  Synthesized
  misc_feature (61): n=a or g
agctcaaacctcattaaaaactgaacttcaaatacaaaatacacatttgtgttattaacantaattcacaaaaatctcctacatgttgttttgattgtttaagcatacccaaaaacttaaa

SEQ ID NO: 6788 - DNA, 121 bp, Artificial Sequence
  Synthesized
  misc_feature (61): n=t or c
gatctaaactgaaatataaagttcagtttccttcttatttttttaagccagacccagagantgaaaagtttcagactaatggctaccttaaggtaataaaagggggaaaagtttttgaatt

SEQ ID NO: 6789 - DNA, 121 bp, Artificial Sequence
  Synthesized
  misc_feature (61): n=t or c
gagcttctcctacaccggatagagccagcaggagctgagttgggatgcctactaggtatcntacatgtgatttttaggcgaagatcccagtaattcttatgttgctggctaaaattgttat

SEQ ID NO: 6790 - DNA, 121 bp, Artificial Sequence
  Synthesized
  misc_feature (61): n=t or c
attaattttttagatgtagaaactactgaagcttgctctgtagccctttcgcagttaaagntgtaacttcagtttttcgactgaaggccgttttcagctacttttggtattcacatctcag

SEQ ID NO: 6791 - DNA, 121 bp, Artificial Sequence
  Synthesized
  misc_feature (61): n=t or c
gaactgggaattgtcacacactcctaaacatgcctcagtctgcttgcaagtgagggagctnagtgagtgacccagtgccattggcagcccaatagctgcttctctgagggccagtggtgta

SEQ ID NO: 6792 - DNA, 121 bp, Artificial Sequence
  Synthesized
  misc_feature (61): n=a or g
tctgacagagtgctgtcatagctttcaacgcacgtatcaaataagccaaacaaccaccgantttaaaccaaagctattcaactgtgcatgccgtccccttgcatgctgtcccatgagactt

SEQ ID NO: 6793 - DNA, 121 bp, Artificial Sequence
  Synthesized
  misc_feature (61): n=t or g
attattatatggaatattttagattatttaaggtcggaaaaaaaacactatcattctattncttcctttagcatatccaagagtaagctaaactaatctgttctcaagcatcattctcatc

SEQ ID NO: 6794 - DNA, 121 bp, Artificial Sequence
  Synthesized
  misc_feature (61): n=t or c
tcagctacatcgagaaatcaccctctggaaacaacctgttttggaagccttaagaatcacnactgccccgggatattgtcagggtggaaatgtaagggctgggagctcatgagtggtatca

SEQ ID NO: 6795 - DNA, 121 bp, Artificial Sequence
  Synthesized
  misc_feature (61): n=a or t
attggagaccacagggtcaacattcaagtctcaagccagtacttacaattacaaaaagcanaacaatgaagatttctcagagcattttctgttttgctgtatcctgtaggataggctgcta

SEQ ID NO: 6796 - DNA, 121 bp, Artificial Sequence
  Synthesized
  misc_feature (61): n=a or g
atattttttccgtgcaacttaagctcagcttttcattttcatttctgatgactttatgacnctattcagcaatatctgttcttaaacagagcttattttttccttcttcatctttttttcc

SEQ ID NO: 6797 - DNA, 121 bp, Artificial Sequence
  Synthesized
  misc_feature (61): n=a or g
tctacggccatttcttcatgctgtaggcttgtaggcttcctgccgtcaaggaggaatccanctgctgacaaagacacgtgcaggcaaagccttcaattttgttaaaaactaaaagatattg

SEQ ID NO: 6798 - DNA, 121 bp, Artificial Sequence
  Synthesized
  misc_feature (61): n=t or c
ctggagtggctctgtagacgattcagttgatgcctgttctgctcacagttagctggtaggncggactttgcgcgtgctctcaaaagtgtgacaccctattggagatgcagaggattcttct

SEQ ID NO: 6799 - DNA, 121 bp, Artificial Sequence
  Synthesized
  misc_feature (61): n=a or g
ttactgcacaagaagctgagccacagagcggtgtgtgcttagagctaatctgctgtgccantgatataatcaacgtgccttgcttgtttacctggacacgctaggacatcctggcacttct

SEQ ID NO: 6800 - DNA, 121 bp, Artificial Sequence
  Synthesized
  misc_feature (61): n=a or g
tatcagcaatttcttatgaacatacggcaactctgcttggtgctgctctccctaattccancatttctgcaaatggatggcttttccctctcatcaagtccggtgatagaaggtggggcct

SEQ ID NO: 6801 - DNA, 121 bp, Artificial Sequence
  Synthesized
  misc_feature (61): n=c or g
tttggtccctccagttctcaaaatgaccactaactaatgagtttttgtggacgtttagaanaccgatgatactgttatctccaagggcaaataatagtacagcacttccataggatatgga

SEQ ID NO: 6802 - DNA, 121 bp, Artificial Sequence
  Synthesized
  misc_feature (61): n=t or c
ggatgagtttaaatttcatgtattttcatgacaaaagacagttgttaacaatgaaataaangtgatatatgcagtcagactgtatcagtgactatttggaaaaaaataatacagcttgaac

SEQ ID NO: 6803 - DNA, 121 bp, Artificial Sequence
  Synthesized
  misc_feature (61): n=t or c
tgcatgttatttcagtcctacttgtaatcattctgaaagtttaattaccgttgccacttanacatttatttgctctgcagtgttaaataataaataaaattgatttcctttggacaattcc

SEQ ID NO: 6804 - DNA, 121 bp, Artificial Sequence
  Synthesized
  misc_feature (61): n=a or g
gctaacagatactgcaggcaaagacccttggtttgatgacccaaaataatggctggtgcantgcagcagctggtcccactacaaaataaccacaaaactcttacctcccagttcttaagtc

SEQ ID NO: 6805 - DNA, 121 bp, Artificial Sequence
  Synthesized
  misc_feature (61): n=a or g
ctatcttggacacgaacccctctttgaaagttgccagacaagattttctgtggaagagacngagagcaccctccagcatgcaggactggtgggcagggtgtgggaacgatggctctgaact

SEQ ID NO: 6806 - DNA, 121 bp, Artificial Sequence
  Synthesized
  misc_feature (61): n=a or g
gcagaaagcgtaaaggccaaaaggctggaattatggctgagtaggaacactgtgacgtgcnctcacaagaactgtgttggcaggaaacggtcatacagagaggggaggaaaaaaaaataca

SEQ ID NO: 6807 - DNA, 121 bp, Artificial Sequence
  Synthesized
  misc_feature (61): n=t or c
acagattttatgggaggctgttgcagactttcccataggcattaattattctccattactngtggaatagcctgcaaataatggcttattcagagttaccgttaactctggagctggatct

SEQ ID NO: 6808 - DNA, 121 bp, Artificial Sequence
  Synthesized
  misc_feature (61): n=a or g
tttctacatatttgtgtattttaaacagattttatttctcattttctacctctgggttgcncttccttgcatctgtccatacaacacactttgatctttagattaaggacacagaaaatat

SEQ ID NO: 6809 - DNA, 121 bp, Artificial Sequence
  Synthesized
  misc_feature (61): n=a or g
atacaacggaagcatttagctgcagataagagctgacttggaaggagatgctccttgttcntagaatttgtggtctcatcattacaacgctgctttttagcttgtgacggtgggatttcta

SEQ ID NO: 6810 - DNA, 121 bp, Artificial Sequence
  Synthesized
  misc_feature (61): n=a or c
tataaaataatctagtaaatttccaggagtttgcatcacggctcaaaaagaaattttcgtncagtctaggtaacctgtgatctgggaggagttctgttcaaacccagcttcccctttcctg

SEQ ID NO: 6811 - DNA, 121 bp, Artificial Sequence
  Synthesized
  misc_feature (61): n=a or g
gcatttctttccctttctcctttggttcccattggagaaccaatttcttccagtgaaattngacagcccttcctgtctcaaaggaagggatgaggataacagctgtaaacctgtttgttcc

SEQ ID NO: 6812 - DNA, 121 bp, Artificial Sequence
  Synthesized
  misc_feature (61): n=t or c
aaataaggggcaggaaaaatcacatttgaatgggagaaagggaagggaagacattttatancccacattataatccctgctggctctctggagttatgcccatgtccttggctttcccaca

SEQ ID NO: 6813 - DNA, 121 bp, Artificial Sequence
  Synthesized
  misc_feature (61): n=a or g
ctatagcaaaaccttcttaaagttgcagtcaggctgtattttatataaacactgtgttcgntatctataataaatttcacaaagaatgaataacctgcatgagtaggactgacacaaggga

SEQ ID NO: 6814 - DNA, 121 bp, Artificial Sequence
  Synthesized
  misc_feature (61): n=t or c
tttctgaattatttattcttttaggtttgggccttcatccaaaacacctcaggccaaatcngtatttgctatgactcaatttactttattttggatgcaccagagaaagattaaacatcag

SEQ ID NO: 6815 - DNA, 121 bp, Artificial Sequence
  Synthesized
  misc_feature (61): n=a or g
cctatgtttgttccccagtgggtgatgggtaatatgcttggaggcagataaaatcatggcncagcctttcatgactggcagtgtctggtaacacagcaatgagtgctggatgtgtagataa

SEQ ID NO: 6816 - DNA, 121 bp, Artificial Sequence
  Synthesized
  misc_feature (61): n=t or c
attcattcatttcctttggtagtagaagtatttcatttaaaatgaattcataatacatganagtttctgtatcttctgcagccagatctgccccttggactcatttgttgcctgtgctctt

SEQ ID NO: 6817 - DNA, 121 bp, Artificial Sequence
  Synthesized
  misc_feature (61): n=a or t
ctccacccgcgtacagcatgctgcgtacagcacaccactctcccagtagaaaggcaagagncttgtcagttcagagctcctaaataacacgtggggaaaaatgagatttctgggagcattg

SEQ ID NO: 6818 - DNA, 121 bp, Artificial Sequence
  Synthesized
  misc_feature (61): n=a or g
gtgcacccctttcagactcagcagtcacagtactttaatagccagctgattgagtgccaanccattacagtgaactgcaaacccagatatcttatcctgtgtgatttcttactgttgatcc

SEQ ID NO: 6819 - DNA, 121 bp, Artificial Sequence
  Synthesized
  misc_feature (61): n=t or g
agatctcacaggttatataaagaatgggctgtaggagagcatagacaattacttctgattncttcagctgggagtgtccagggcaaagtcaaatgtttaaaaagcatcctcaccgaaatca

SEQ ID NO: 6820 - DNA, 121 bp, Artificial Sequence
  Synthesized
  misc_feature (61): n=t or c
atttggagttcattgtttgcccaaaagcagtggggtttcttgcttctgcacagtttcccancccttgcatcccctgacatcactgcagtagaagatttccattcagttttcaagactcaaa

SEQ ID NO: 6821 - DNA, 121 bp, Artificial Sequence
  Synthesized
  misc_feature (61): n=a or c
cagaaagctgtacttggtatttattcctttcgggcactctgctcaatcagctacctttttnttttctaagcacagatttctcatggtgtacattcaaaccttcacaaaaagtgattcaaac

SEQ ID NO: 6822 - DNA, 121 bp, Artificial Sequence
  Synthesized
  misc_feature (61): n=a or g
attttctcctcctccaacacaccgaacactctttcacccatcaccacgcacacatgtgggnctttctggtcccatcctggggtttcctttgctcctctgcttctgacccataggactgctc

SEQ ID NO: 6823 - DNA, 121 bp, Artificial Sequence
  Synthesized
  misc_feature (61): n=c or g
ctttgctatgctatggaagacatcaagctgaaccatttggcaaaggaaaatgcagcatcantacccttcatttcagttgaaatctggtgttgttaaagcatacatgtgagcaaacttcagc

SEQ ID NO: 6824 - DNA, 121 bp, Artificial Sequence
  Synthesized
  misc_feature (61): n=c or g
gacatcactttcagtcaaaagtaatctatgccatacatttccagacattacacatattcantgacccagacaatgtatttcttccttgtacatggataaggttaagtctagggtggtatga

SEQ ID NO: 6825 - DNA, 121 bp, Artificial Sequence
  Synthesized
  misc_feature (61): n=t or c
aaccattaactttgctgaaactattcatagcaattgtttttgaaaacatcagtgttaatanactgatgcaaaaaatccttttgactttgcttcttgtcgtattctcttaatcaccataata

SEQ ID NO: 6826 - DNA, 121 bp, Artificial Sequence
  Synthesized
  misc_feature (61): n=a or g
aaagccaagggcaggtgctccgctctaatcaaaaccaatagttagaactccctaatgaacncagacatttctggttatgccacaaggtccccatccccaaccccaagcaacacccagcctc

SEQ ID NO: 6827 - DNA, 121 bp, Artificial Sequence
  Synthesized
  misc_feature (61): n=a or c
agaagggaaagtgagcagggatgtgaagggaggcaccacggggagctgctcgggacaaagngcaaaatgtttatttgaagtttgagttataacacacagcggcaacctgaaactcacagag

SEQ ID NO: 6828 - DNA, 121 bp, Artificial Sequence
  Synthesized
  misc_feature (61): n=c or g
atttcaagaggaatgactgtacagtgaagtgcttttcagaaaacaacaggagtttctagcnatttctgccacctggaaagacattcatttcctcaccagtcagcagcaagtgcccaattaa

SEQ ID NO: 6829 - DNA, 121 bp, Artificial Sequence
  Synthesized
  misc_feature (61): n=a or g
gccatctttgtcgccatcttcacctttcccttggtttccatggcatgtcttgggcagcagngagatgcctgtgctgcagcaatccatgtcacctctgctttgttggcggggaaagctcagg

SEQ ID NO: 6830 - DNA, 121 bp, Artificial Sequence
  Synthesized
  misc_feature (61): n=t or c
agaggcattaacacctttttaaatgaggctgatctgatgagaactggatagtgccctgggnctaagctgttaatccctaacatggagggtcacaggctctgcttgggtcggtgctcacagc

SEQ ID NO: 6831 - DNA, 121 bp, Artificial Sequence
  Synthesized
  misc_feature (61): n=a or c
tgaagtaattaataaattactaacaccaattttcagtgattctctgagatgtactctttcnaaacagtatccatagactgtatcattatcagcagaagcagtaggtggacagactgagtcc

SEQ ID NO: 6832 - DNA, 121 bp, Artificial Sequence
  Synthesized
  misc_feature (61): n=a or g
agtgctcagaaaaaaataaaaaataaacaattattattccactatttcctggcagaaaccngctttcataggcaaaactatttcagttacttaagtaagcaatctagggcttaatctgccc

SEQ ID NO: 6833 - DNA, 121 bp, Artificial Sequence
  Synthesized
  misc_feature (61): n=a or g
attccaaaaagaccggaaccaagacagggatccctagcacacagccatagtcggaataggngatttgactgcgttattgtgacttacatttccacagttaatagcatttttgtctttagcc

SEQ ID NO: 6834 - DNA, 121 bp, Artificial Sequence
  Synthesized
  misc_feature (61): n=t or c
ggcaaacaataaagcgaatgaacttactaaacctaggaagatgtgctttaagatggattangttagaacctttttgaaattagggatagaatttccccttggtatagctgtaatcctgtat

SEQ ID NO: 6835 - DNA, 121 bp, Artificial Sequence
  Synthesized
  misc_feature (61): n=a or c
ctgtgccagctgtcagtaagcatggactcattaactttcgttgtaacactttgttcctacnctgctgtaaatagatggttatctgacagtctagttttcaatcatacatttttaatagttt

SEQ ID NO: 6836 - DNA, 121 bp, Artificial Sequence
  Synthesized
  misc_feature (61): n=a or c
atgccttcagtgagaaaatgctgttgctgtgtgcctgatgactgcagtttctgttgcctgnatcacaaccttctggaaagccaactccagaaacgactagcaagtcagtctcatttcacca

SEQ ID NO: 6837 - DNA, 121 bp, Artificial Sequence
  Synthesized
  misc_feature (61): n=a or g
ttaaatcaatttattaataccatgagatgcacacagaaataacgagcatctaaaaataacngaagggttctctttattaggtgatggtgccagactcttttccaaaaatatattgtaggag

SEQ ID NO: 6838 - DNA, 121 bp, Artificial Sequence
  Synthesized
  misc_feature (61): n=t or c
agagacactgctgcccagttttacaaaaccatgactgaagaacttgtagtgcctctaaatncagggagatttattttgtcacagaatggaagtgactgtagtaccctgattgtttaaaatt

SEQ ID NO: 6839 - DNA, 121 bp, Artificial Sequence
  Synthesized
  misc_feature (61): n=t or c
ggtggatcctggtcctccctcaaagtggcaaaatatttctgttttgtgcccaaagctctgnggtgggactccttacaccaggagggatatttccaacctgcctgacccactggtgagagct

SEQ ID NO: 6840 - DNA, 121 bp, Artificial Sequence
  Synthesized
  misc_feature (61): n=a or t
tctgcttcattagtcactcttctttcagtgctgtcagttaagtggtatggggtccctcacngtgtagcaattttgtcatctgtcactcagatacaccagtgcagccccaccacacagtttc

SEQ ID NO: 6841 - DNA, 121 bp, Artificial Sequence
  Synthesized
  misc_feature (61): n=c or g
ggagaggcttccagggcagacctggtcttggttcatgaatcactcgaatcacccatttaanacaatgcagaaggactgacctgctgccgaggtttgaagggaagctttagaaagaccactg

SEQ ID NO: 6842 - DNA, 121 bp, Artificial Sequence
  Synthesized
  misc_feature (61): n=a or g
aaattctctcaattttttgctactcaaatgttcttcagtggaactgtggcagaaatagaantgtctccattgctggtttccatggctggctatcaactgaaggggcgatttctgttactga

SEQ ID NO: 6843 - DNA, 121 bp, Artificial Sequence
  Synthesized
  misc_feature (61): n=a or c
tatggtattcttaacatagccatgcatactgcaagactcaaacctatttctaggccaagtncaggcagtcacgcgtaagcagtgactgaatttcatggcagccctagcaagaggatcccca

SEQ ID NO: 6844 - DNA, 121 bp, Artificial Sequence
  Synthesized
  misc_feature (61): n=t or c
ttttgcaggcttgagaatttttattcatgttgctagtctctgccaggtcttccctggagtngatatccccacttgtaaaaagcttattagcagaatacctgcacataccaatctcacattt

SEQ ID NO: 6845 - DNA, 121 bp, Artificial Sequence
  Synthesized
  misc_feature (61): n=a or g
cggctcaggctcagcgctgtccccagaccaaaggcagcagcatacttaaagaagaggtgcnaagactgctatagtgaagtcctcacaatagtgatttttattaaattagttgctttataaa

SEQ ID NO: 6846 - DNA, 121 bp, Artificial Sequence
  Synthesized
  misc_feature (61): n=a or t
ctctgtatggagatcagtgctctaaaatgaacccgaaagtgcacgcctggcaccacacgangtatgcaccacaagttaaagccaagaaatggcgcaggaacctcattttagttacctgtat

SEQ ID NO: 6847 - DNA, 121 bp, Artificial Sequence
  Synthesized
  misc_feature (61): n=a or t
gaattgaaagttttaacaattgggtttttaagaggaaaggctattcttatgtccattcttntcttgggacaaaaatgttttaccaagagcaacttaagaggaaaatacaaacaagcacaac

SEQ ID NO: 6848 - DNA, 121 bp, Artificial Sequence
  Synthesized
  misc_feature (61): n=t or c
tttccaaatgtattattttaaaatggaaaaaatatctactttcagaaactttgtgcagttnctccatgctgtgcatctgaataagcatgaagaacagaacattggtcatcgacgtacacca

SEQ ID NO: 6849 - DNA, 121 bp, Artificial Sequence
  Synthesized
  misc_feature (61): n=a or g
aagatgtgttttctgtagctgaaaaagaacagcacttcttattgtcaaggtttcctccagnagacagtataataaattgcacttcaacatgaataactacaagccagagtttttgagcctt

SEQ ID NO: 6850 - DNA, 121 bp, Artificial Sequence
  Synthesized
  misc_feature (61): n=a or g
gagtacttgcttttgcacaatgtggaacagctacagccttgtcatgaaaccaaaggtgctnaatgtgtaagttcctttcttgtaggcaactacactgaaaaaaaccccactttttgtaatt

SEQ ID NO: 6851 - DNA, 121 bp, Artificial Sequence
  Synthesized
  misc_feature (61): n=t or c
gaaaatgtggcctaaccgtccctgcttccgtgcacaccatgctggagagaccaaccactgntcctgccagggcataggcagaagaataatcttctctgagacgatagaagaaaagttgaca

SEQ ID NO: 6852 - DNA, 121 bp, Artificial Sequence
  Synthesized
  misc_feature (61): n=a or g
gatgctatttaatttggatgatatcaaacaaactagtcagaactacaggcacaaaattaangttttgtatttgtgattaatgattttgcaaatcagtgcctggaagaggttactcaacaaa

SEQ ID NO: 6853 - DNA, 121 bp, Artificial Sequence
  Synthesized
  misc_feature (61): n=t or c
cagaagagccaccaagggaagctgagaatgtggtggtattgacacactctcatcagttttngaaaagttactgttttccctaagtctaaaagagtgttgagaaatcttaatatgagagttt

SEQ ID NO: 6854 - DNA, 121 bp, Artificial Sequence
  Synthesized
  misc_feature (61): n=c or g
agtgccttgagatttcacagtcacttcagaattatgttaataattggtcaccaaaagcatntctcaaaaaaatcctctcagcaccacttccacaagagaaatgagtatctcttttaacact

SEQ ID NO: 6855 - DNA, 121 bp, Artificial Sequence
  Synthesized
  misc_feature (61): n=t or c
cttttgctcttaaaaacaaattgcttcccaataaagcaagattgataattcaacaagtggntgagttgaaacaagcaacgatcaagtaaatgtcacaactgcttaacagtaatgaggttat

SEQ ID NO: 6856 - DNA, 121 bp, Artificial Sequence
  Synthesized
  misc_feature (61): n=a or t
aagtagctgcaactgttttgctttctttccatttattctttccctgttctcatctgcttgnatacttaattgagtatctgcagaaacacattatttctactatcgtttctaatgttttgtg

SEQ ID NO: 6857 - DNA, 121 bp, Artificial Sequence
  Synthesized
  misc_feature (61): n=t or c
attttgattttaatgaatctttctccttctctggagcattttactgcttctgtgcctctgnttaaaacctgtgtgctgcctaccagtcgtctgatcatggcaaggtttccctatcactcct

SEQ ID NO: 6858 - DNA, 121 bp, Artificial Sequence
  Synthesized
  misc_feature (61): n=t or c
cccctggacatatgtgacctaactagggctgtcagctgcttgcacagcactatctgattcngcacatccctgcatcaaccagacctgcgagcaaccggcagagaacctaaatacaccccgt

SEQ ID NO: 6859 - DNA, 121 bp, Artificial Sequence
  Synthesized
  misc_feature (61): n=t or c
actatttaggacatcttgtaaagctggcagcatcctaaactgatacagccatagctatcantggtattgtctgccttttcctagcattgaattcctcttgctgtaggtggctcacttgtct

SEQ ID NO: 6860 - DNA, 121 bp, Artificial Sequence
  Synthesized
  misc_feature (61): n=t or c
ttttgccataagaaagcagaaacgggcacgtaagagaacacaggaagctgaagagcagaanagtgacttacttctgcagcatggcctgccactcgcctagcctgtctcctatgggaaacct

SEQ ID NO: 6861 - DNA, 121 bp, Artificial Sequence
  Synthesized
  misc_feature (61): n=a or g
aaacagaaattttaagcaacgttgctactatcaaagcattctctacacagcaaaactcaancaactacaacaggccctaaagacccaacaacacccactcccctaccacttttctgcttta

SEQ ID NO: 6862 - DNA, 121 bp, Artificial Sequence
  Synthesized
  misc_feature (61): n=a or g
cccctccgtgagccagcacgcatgatggcagtgctgctacaggctcggctcaaccagaacntgagacaaatgaacctgacctacatctgaagagacccacggctctctgctctgtgtgccc

SEQ ID NO: 6863 - DNA, 121 bp, Artificial Sequence
  Synthesized
  misc_feature (61): n=a or g
cccgtacctgctgggtgtttctctgcacgtgttggtagtaggagattctgtctgtccttgncacatctatgactgcagccagaatttgagctcaccctgagggcagctggtgctgtttcct

SEQ ID NO: 6864 - DNA, 121 bp, Artificial Sequence
  Synthesized
  misc_feature (61): n=t or c
atttgacctgggtattgtttttcctttacacctccagtgccactgaagctgcctctgctcnctttctagcagtctaaattaggaagcaagagccttaagtttcagctttcatctaccaaag

SEQ ID NO: 6865 - DNA, 121 bp, Artificial Sequence
  Synthesized
  misc_feature (61): n=a or g
tgctccaactcaaaagatggaggccggttacaaaccactgtgctaacccacacggagctgncagagcagccacgccaagtgttcagtcgcatcctgcatccctgacaaagcattgcactgc

SEQ ID NO: 6866 - DNA, 121 bp, Artificial Sequence
  Synthesized
  misc_feature (61): n=a or g
gcttttggaaaccgtgctcacctttgccatgtgcagggcaggttttgccaccttgggaccntctgccccaaaaaatgcccctgttttgtcaggttacgtggtctctaggtcccccagcccc

SEQ ID NO: 6867 - DNA, 121 bp, Artificial Sequence
  Synthesized
  misc_feature (61): n=t or c
ctttttatcagttgttaagacctgatctgttcgtcgttgtaagcagggaatatacttccanaggccttgtcaggaaagataaggtaggacctggaagccttcctgtgcaaacaggaggcga

SEQ ID NO: 6868 - DNA, 121 bp, Artificial Sequence
  Synthesized
  misc_feature (61): n=a or c
gcgggtgtgtaacacagcttcacataggtctgtgccttttccctaaagtctcctcatcccnaaaactactgcttactggggaaaaaacatctgctatttaatgtacagacagcttcaaagt

SEQ ID NO: 6869 - DNA, 121 bp, Artificial Sequence
  Synthesized
  misc_feature (61): n=t or c
cttcctttctttctttttaacagggttgtttgaaaattcactgcagttttgaaagtttctncaatttttgaacccaactgagtcagcagcatgcttgctccagcccctgacctgtggagct

SEQ ID NO: 6870 - DNA, 121 bp, Artificial Sequence
  Synthesized
  misc_feature (61): n=a or c
tgttttatagtatgtagggattttatgattattacctagttgtgtaattcacctactgcanacggaagagtttgaaaggaaggtaggagttagaagtttctgctttgtgtttgtcactgtt

SEQ ID NO: 6871 - DNA, 121 bp, Artificial Sequence
  Synthesized
  misc_feature (61): n=a or g
ctatataattattttattttgatgcttgtaatataggaaaagacaccaagaaaataatttntagggctttggaaaaaaacctggcaaagaggttgggatcaattgggatcaatcaaactgg

SEQ ID NO: 6872 - DNA, 121 bp, Artificial Sequence
  Synthesized
  misc_feature (61): n=t or g
ttgtttctacaacataaaactgctatatgtgcaagtctgaatagatcttagtgttgctggnacactgaggtatataaattccattagtcaacctgtctgataaaccatggttctcaaatct

SEQ ID NO: 6873 - DNA, 121 bp, Artificial Sequence
  Synthesized
  misc_feature (61): n=a or g
cggctgtagctgtagcacagtggcttattactctacatttcaggttgttcaaagctagtcncatccacctgtcaaaggcacaaagactgtctgaaatgctttcaaatgtttatcttaaaaa

SEQ ID NO: 6874 - DNA, 121 bp, Artificial Sequence
  Synthesized
  misc_feature (61): n=t or c
tgatttctgtgttctcctggacaagcactgagtccttctgtcagctggagatgcatccagngcgtttggccctgctgccaaataacaactactgacaatcctatagagcagtgctattttt

SEQ ID NO: 6875 - DNA, 121 bp, Artificial Sequence
  Synthesized
  misc_feature (61): n=a or g
tgagagcatttgttaccacagaaatgatactcgtgattactctctcctttctcaactgcancacgctcctttatctgactaagtgcaaatactgaagtgttcattagctctcctgatacac

SEQ ID NO: 6876 - DNA, 121 bp, Artificial Sequence
  Synthesized
  misc_feature (61): n=a or g
aaaatccatgtggttttaatgccatgttctgagatgggggggcaggggatgatttgttgcntttctttatttgggctgctcgcactgaacgtgaactcctttgaaatgtgtgtgtgtcaca

SEQ ID NO: 6877 - DNA, 121 bp, Artificial Sequence
  Synthesized
  misc_feature (61): n=a or c
gtgcaaaatggtgagcaagcttagaactgcagcattaggatacactggaccgcagctctgnatcgcagggccataacgctccctttggtagctggaaatgcaaagccagaggagccagtgc

SEQ ID NO: 6878 - DNA, 121 bp, Artificial Sequence
  Synthesized
  misc_feature (61): n=c or g
tgaagagatgagtttttccttacacgtgatattcatgaatttataacagctatataataancgactagaactgcaaccggaagggttgggcagaatattgatctctccccatctgctaatg

SEQ ID NO: 6879 - DNA, 121 bp, Artificial Sequence
  Synthesized
  misc_feature (61): n=a or c
ttaaaatgggagggatccaggagatggactaattttgctgtccttgaaaatttctttttancaacaatcacattcgcagtgtgtactaaaaagacacagagacacttacaggacaggaaag

SEQ ID NO: 6880 - DNA, 121 bp, Artificial Sequence
  Synthesized
  misc_feature (61): n=t or g
gtgaagttattcttgtgctttgatatttacagggcctcattcatgtatctggagtgtaaanaacctatcttctcatgttctcgttggtgcctcaatcatccctggtgtgatggggacgatt

SEQ ID NO: 6881 - DNA, 121 bp, Artificial Sequence
  Synthesized
  misc_feature (61): n=t or c
gcctctaattgtttgttttcaaaacagaactgtcaccagcatcccttgaaatcagagctcngggctataagtatgttgtagaggtcacttgatattgctgctaaaatgagagtgcgtgtta

SEQ ID NO: 6882 - DNA, 121 bp, Artificial Sequence
  Synthesized
  misc_feature (61): n=t or c
gcagtacagtgagaggaaacgcaaagctaactcatctttggcacacagacctgcagaagcnctgctgaagcagacttacactgctgtaaagctgtgtgaggactgcagctctgtgatcaac

SEQ ID NO: 6883 - DNA, 121 bp, Artificial Sequence
  Synthesized
  misc_feature (61): n=t or g
ttattagagaaaactgacgtttacatattcatacaaaagaaacaaattaattcaaactctnttgtatgcacacacatacctatatcaaagattctccaaaacatgcatatgcattcttttt

SEQ ID NO: 6884 - DNA, 121 bp, Artificial Sequence
  Synthesized
  misc_feature (61): n=c or g
agagaagtgaactgagggagaagatggcattacaaataaaagaggtcaagaattatggacntaatcttgttttgactcaagtggctctattggcatgacttaacaaaatgagtagttgcga

SEQ ID NO: 6885 - DNA, 121 bp, Artificial Sequence
  Synthesized
  misc_feature (61): n=t or c
tgtaagaagttggttgttttcccaattaactaaccgtaggcacactcaaaatctttttctnatctttcacaacccaatacaatgctggtggcaaggttaaaatacctttttttagtccatt

SEQ ID NO: 6886 - DNA, 121 bp, Artificial Sequence
  Synthesized
  misc_feature (61): n=t or c
tgatttagataatctccaattgctttcttctgctagtgaaaaggttgttttcaacaagtgnaaaacagactattaagcacttagtcaatgacacataagcaattaatagacaagcatctgc

SEQ ID NO: 6887 - DNA, 121 bp, Artificial Sequence
  Synthesized
  misc_feature (61): n=a or g
attttatacagcagacttgttccaagtagtacatctaagagtttacagtctttccacaganctccagtttgtttggggttcttttaagaaattatttttttaagctggttaagtctttagt

SEQ ID NO: 6888 - DNA, 121 bp, Artificial Sequence
  Synthesized
  misc_feature (61): n=t or c
cttatcatactctcattcttcactttatcagaattgaaggatatattgccaacagctgggntgctcttcgtggtagccttccatacaactgtggtggtggcttttgatgcactgcacaatg

SEQ ID NO: 6889 - DNA, 121 bp, Artificial Sequence
  Synthesized
  misc_feature (61): n=t or c
tagtggaaatctgtcaatctaattgcagcatccaaccaggctatattttcaccatgatcantgtacttgtatgtcagtttggcaaaagcttctccatggagtctcagctacgttagcaaag

SEQ ID NO: 6890 - DNA, 121 bp, Artificial Sequence
  Synthesized
  misc_feature (61): n=a or t
gtaagtggaagaagttgaatagttaggatgaacgggtgaaagtagacttctaaaataaatntattttctttgtctcttaaggcactgcttccacctagatcttccttccaaaatttgaaat

SEQ ID NO: 6891 - DNA, 121 bp, Artificial Sequence
  Synthesized
  misc_feature (61): n=t or c
gttttgttctaataatatttcatactttttctgactgtggaattgtcaagttctttgcatngtgggcatgtctgttttgttgcattggacagtcatgtacctggctgcaaaatttgatatg

SEQ ID NO: 6892 - DNA, 121 bp, Artificial Sequence
  Synthesized
  misc_feature (61): n=t or g
ctggtttgaagtggattttaaaagtggtttttgtaatagagagctttatttctgaacgacntgatttgttgctgttaacactcagtgttagaaaagaagtaacagaaggtgtagccccaag

SEQ ID NO: 6893 - DNA, 121 bp, Artificial Sequence
  Synthesized
  misc_feature (61): n=a or t
ttgtgaaattaattcagatataagaatattggtggcctgtatttgactcctgcacagttcntaaggttcttgcacagaaaacctagttttgtagtttttttgcttctaattctgccgtctt

SEQ ID NO: 6894 - DNA, 121 bp, Artificial Sequence
  Synthesized
  misc_feature (61): n=a or g
actgactttaatagagctaagtggaagtattgtaattatagcttgttttcttgcacaccantgcactttttggcaactagttacagcttggagaaaagttcacaagtttcaggaagcagaa

SEQ ID NO: 6895 - DNA, 121 bp, Artificial Sequence
  Synthesized
  misc_feature (61): n=t or c
atagcttaccttactaggaaagttgcccacaaaaagaattggcgaagagcttttgtttgangtccttattttcgttctgtcacgaattacttacagaactgttacctccaagtgagattta

SEQ ID NO: 6896 - DNA, 121 bp, Artificial Sequence
  Synthesized
  misc_feature (61): n=t or c
tcatgtcttggagtcttgactatgaaatccatgaagatggaaggttcctctaaagcttttnctcttctggaacgactagaggagaacacatgctgagcagaggccatctagctcataagat

SEQ ID NO: 6897 - DNA, 121 bp, Artificial Sequence
  Synthesized
  misc_feature (61): n=a or c
tgtgcaacaaaatacgttttctagctgttttctggctttttgcaggctactaatttacacncagttcctacgccctgaagtgtactagtggataaggtactatatgtgcaaatgattacaa

SEQ ID NO: 6898 - DNA, 121 bp, Artificial Sequence
  Synthesized
  misc_feature (61): n=a or t
ataagaaagtccaatttttgaggcttattgtttaaaagaaaacctaaattaacattacaanttttcagcaattgttctcagaactgactgattcctaactgaaatcaaagtattctaagtt

SEQ ID NO: 6899 - DNA, 121 bp, Artificial Sequence
  Synthesized
  misc_feature (61): n=a or g
tcagatctctaagatatatcttgaccactcattgcagataagtacactgggagcaatacantatcacattaatcgaagtggtagagaacagcaaaccagtctagaaatgtgttaatatttc

SEQ ID NO: 6900 - DNA, 121 bp, Artificial Sequence
  Synthesized
  misc_feature (61): n=a or g
tactgacaaatatctctcttgtgaatagcacctctgcttggcaacacctattctcacaatntgcactttttcaagcatatcgtagattttgctggacaagcaacagaaaagacaaatcaaa

SEQ ID NO: 6901 - DNA, 121 bp, Artificial Sequence
  Synthesized
  misc_feature (61): n=t or c
gtcctggtaactaaaggaatgaagtttattttgggcaaattcaatcaccatttttaagtgntaccaaaacttttcccagatcagctgggtataaacctgctcagatgctacctcagctgat

SEQ ID NO: 6902 - DNA, 121 bp, Artificial Sequence
  Synthesized
  misc_feature (61): n=c or g
aacaaaacgctagggagattttaacagcagtttttgtaattgagaatttttctgtatcctntccaaccggataattaacaggaaaacggggaacgacttctgcgttccggggagctgtacg

SEQ ID NO: 6903 - DNA, 121 bp, Artificial Sequence
  Synthesized
  misc_feature (61): n=a or g
ctgggtattcactcagctctactgaatatctactgcagcaaagaaaaccataaatactacntgtacaaaagtttgtagcaatatttgtcacacaggttcataaatctcctttttttttttt

SEQ ID NO: 6904 - DNA, 121 bp, Artificial Sequence
  Synthesized
  misc_feature (61): n=a or g
atgtagaagttcagttgatatggtttccaagctattccacagaaagatcctctcatttganaaaatttgattctcattgcctatatatacatcctatagacttccaatgaaaaagtgttgg

SEQ ID NO: 6905 - DNA, 121 bp, Artificial Sequence
  Synthesized
  misc_feature (61): n=t or c
aggttctgctagctgcacctactggatgaattgtattcctaaactgaaaaatgttttgttnttctatatctgaacgttcagacatataacttcccttaaaaaaaaaccaaacaagtgtagt

SEQ ID NO: 6906 - DNA, 121 bp, Artificial Sequence
  Synthesized
  misc_feature (61): n=a or g
tgttaaaagtcaaaacgctgtgcttggtatttctaaattctggatgaagtttgggaaccantagggactgctttcaaagattagttttgtagaatatcaaaaatagattcttgtttgttta

SEQ ID NO: 6907 - DNA, 121 bp, Artificial Sequence
  Synthesized
  misc_feature (61): n=a or t
cgtctttgaatctgatttccaaataaacagccacattaatcctgtcttcttagcagaaagngggtttggtttttatttccaagtttttgttagaatcttacatttaaaatgcagcaattag

SEQ ID NO: 6908 - DNA, 121 bp, Artificial Sequence
  Synthesized
  misc_feature (61): n=t or g
taggagaccaaggcactgaagtgtttacctaacctctccctccaaccctaggtaccctcancaggtacaataaaccagggatggcaggtaaaagtgagggcttcctgtcttctttgggttg

SEQ ID NO: 6909 - DNA, 121 bp, Artificial Sequence
  Synthesized
  misc_feature (61): n=a or g
ttctcaccagttagatatatggagactattcttaaacattataatgttcccttgtccgttnttacaatttttaaagctaatgtttctgtagtataattttagcttagtattttctgtgaag

SEQ ID NO: 6910 - DNA, 121 bp, Artificial Sequence
  Synthesized
  misc_feature (61): n=a or g
ctagtttgtcatttctcaggaattgtcaagtacctccaggaagagttatgttatctatctnctcagtctgacagaagcaagaacagaggtgtgtgttttggttgtttctttccaactgcac

SEQ ID NO: 6911 - DNA, 121 bp, Artificial Sequence
  Synthesized
  misc_feature (61): n=a or g
aattctaaaataaaagcatactttaaaaacagagagtggacattttcaaaaccaatttctntatcagctgcagcaatataattaacaattaaatgtgctgtgctgccatagttgatctgga

SEQ ID NO: 6912 - DNA, 121 bp, Artificial Sequence
  Synthesized
  misc_feature (61): n=a or g
tttttaaaggcgatgaactcagtttggtttaagtctacagtaaacaaacaagtgaagagcntctgttgctttcattccattaaatacttaagtatgtccttcattttagtttgaattatgg

SEQ ID NO: 6913 - DNA, 121 bp, Artificial Sequence
  Synthesized
  misc_feature (61): n=t or g
tttgatttgcaaaagattcagctcttgtcttaaataaaaagcagacaagcactgttttccnagagtgagggaggactactttgatcagagtaacaagtaaagtttctcctttcagtatggg

SEQ ID NO: 6914 - DNA, 121 bp, Artificial Sequence
  Synthesized
  misc_feature (61): n=c or g
atgataacatagtcatctgtgcaattcaaagcaagttctgctcatagcagttatctgtctntgctctgatgatttctattgctgtgttctctcagcataagtctagcaagatctaatgatg

SEQ ID NO: 6915 - DNA, 121 bp, Artificial Sequence
  Synthesized
  misc_feature (61): n=a or g
agagacaggaaacaaatgcaatcactacatgtggtggcaaatgtttctgagaatgatatgngagttatataaaggaaatagaatgggttggcacatcccaccttctcacatttacctgtga

SEQ ID NO: 6916 - DNA, 121 bp, Artificial Sequence
  Synthesized
  misc_feature (61): n=c or g
aagttacaactgaaaaaaaaaaataccacttcactgcatacacgtgacttcattcacatgncacacagtgggtcaaaatacagattctcctatatatttacacagatgtgcaaaaagtaat

SEQ ID NO: 6917 - DNA, 121 bp, Artificial Sequence
  Synthesized
  misc_feature (61): n=a or g
gaaactttagtcaagcagctcataatagaactggttcatagtctagagcagctgtcctcanccaaatacttccctccaggtgatgatagcttgtaaaaacactggaatactttgagagtag

SEQ ID NO: 6918 - DNA, 121 bp, Artificial Sequence
  Synthesized
  misc_feature (61): n=t or c
aacaaaaaggtagtggggctccagtgagaaagaggtgacactggatttcccctagatacanttgaaaaaagactacatcatctgtgcttgtgtgagcttgatcacagagaaaagattattg

SEQ ID NO: 6919 - DNA, 121 bp, Artificial Sequence
  Synthesized
  misc_feature (61): n=c or g
cttaaccacagccatttcagtcatctggtctaagataaagttattttgaagtggtgaactncaggtattttctgaaggtgacacgttccattgtacgtttctatatgtgaggcttttacac

SEQ ID NO: 6920 - DNA, 121 bp, Artificial Sequence
  Synthesized
  misc_feature (61): n=a or c
ttgaatttactttttccaagttgagtcttgtgcctgtgacaatacttggtaagtgatctcnctgcattaatcttgacttgtgagttttttaatcttgatccaggaatttttctgtctcgtt

SEQ ID NO: 6921 - DNA, 121 bp, Artificial Sequence
  Synthesized
  misc_feature (61): n=t or c
aattctctctacttggaattcatttgattcaatatgcaggcttgatttgtaacagatgtgngatgcattgtgctacaaacaaaaacaatcctatcaatgatggagagctttttttaaggag

SEQ ID NO: 6922 - DNA, 121 bp, Artificial Sequence
  Synthesized
  misc_feature (61): n=a or g
tttttttcaaatctttcatggaatgaattaaagaggttatagtcatagtataatagttatnctagtcatagtaaaaaataatgacgaatgcaaatcatacagtgtaaaggatgatttcctt

SEQ ID NO: 6923 - DNA, 121 bp, Artificial Sequence
  Synthesized
  misc_feature (61): n=a or g
tagcataaaggctataatttgcagcccggtgtctctctcaggttttctgctgacatgccantgaaattcagctgaactccaacacactgaagtgtgactttgcttgctttaggtgtgacct

SEQ ID NO: 6924 - DNA, 121 bp, Artificial Sequence
  Synthesized
  misc_feature (61): n=t or g
tgtctccataagtaaacatcactttattgcttcagcttcctcttctactaaatgtgtgtangctggatcttgctattccagtaagaataacttcaagacctgttatctttgtcaccatact

SEQ ID NO: 6925 - DNA, 121 bp, Artificial Sequence
  Synthesized
  misc_feature (61): n=a or t
gaccattagctgaaaatctgtccccaaactcactgacagaagtcaattatggatagacaangtgagaatatggtgttgaaaaatcatagactataaaaaaaaaaatgaaatcaggtgctag

SEQ ID NO: 6926 - DNA, 121 bp, Artificial Sequence
  Synthesized
  misc_feature (61): n=a or g
tgtagctattaacaccggtgtgagaaatgctgcagggaaacttggttttgggtcaaacaantgaccctccctttgcctgcctttcatgctgtagcatgttcccttccttccctgcacacaa

SEQ ID NO: 6927 - DNA, 121 bp, Artificial Sequence
  Synthesized
  misc_feature (61): n=a or g
ttgataactgctatggtgtgataaagcagcttatgtgagagtatcatctcatcccagctcncttcctaggctgctgcatttatctctggtcaaacttatcatccgtttcccttggtgtgaa

SEQ ID NO: 6928 - DNA, 121 bp, Artificial Sequence
  Synthesized
  misc_feature (61): n=a or g
cttcttgggtctgtggaggacagaggaacagaaaggttccagtgctggtcaggaagacagngagatcagcagccctatttgtgctgggctgcaccaccagccttttgtttcccacatcaaa

SEQ ID NO: 6929 - DNA, 121 bp, Artificial Sequence
  Synthesized
  misc_feature (61): n=a or g
ctgataagatttaatttcctaagttgcagtcttgcaaaactgggccgcaagtctgaaagcngagagccccttaggttgcacccggagtgtaagtctgatggctgtaacccagcggataact

SEQ ID NO: 6930 - DNA, 121 bp, Artificial Sequence
  Synthesized
  misc_feature (61): n=c or g
taaagaactgttttctgctcagtactatctctgattgaagaagtttgcttggattcccatnagggctacgtaaccaagatgaagactagcaagcagcaggtatgagcaggctacagatact

SEQ ID NO: 6931 - DNA, 121 bp, Artificial Sequence
  Synthesized
  misc_feature (61): n=a or g
tgctttgtgggtggtgggtgctcaattgcaccagtggagagctgtgcaatcaaacttgcantgagacagtagtccctgattgtcatcagctgcagcttattattctctcaaggattccttg

SEQ ID NO: 6932 - DNA, 121 bp, Artificial Sequence
  Synthesized
  misc_feature (61): n=t or c
tttatttatttattttgcctgggatagagaagaagaaggcaatcttgaaggatgctaactngaaggctatacagttagaagtaaataataataatcattttcacatagtagttttataaaa

SEQ ID NO: 6933 - DNA, 121 bp, Artificial Sequence
  Synthesized
  misc_feature (61): n=t or c
tacatgcacacatgcatggacttccatatttcagtgaaagataaaactgctattgaactcngcattaggatcatactattgagaataacggtgtaccttagtgaagacatgtatgagtttg

SEQ ID NO: 6934 - DNA, 121 bp, Artificial Sequence
  Synthesized
  misc_feature (61): n=a or g
gaaaaaagaaaaaaaaagggggaaaagaaacctctaggtaattaaatggattccctcaatnagtaagtcagaaatgttattattcaaaaatatgcaaccttgcatgagaggtacctgaact

SEQ ID NO: 6935 - DNA, 121 bp, Artificial Sequence
  Synthesized
  misc_feature (61): n=t or c
gagacaaccaggttgaagtccttgtttggacaagagaacagggtcttacctcccttctctnatctgctggcgtactttaatgcaagtgttttattctgtggccttagatgtaggaagccat

SEQ ID NO: 6936 - DNA, 121 bp, Artificial Sequence
  Synthesized
  misc_feature (61): n=t or c
gcgagagaaaaatagttttcctgaatttggcagatgtcaatacatgtttccatacatacangaagtcaagaaaacagtccagtttgtttctgtaaaagtctctctttagttgcaagtacta

SEQ ID NO: 6937 - DNA, 121 bp, Artificial Sequence
  Synthesized
  misc_feature (61): n=c or g
gagagggtggagaggagaggacagaagtggaaataccttaaacgactggatgcaattctanacaagatattctcagaaagatttacatagcaagataataactagaaataaaactctaatc

SEQ ID NO: 6938 - DNA, 121 bp, Artificial Sequence
  Synthesized
  misc_feature (61): n=a or g
atttttttaacctgaaatggcttttttcttatttgcagacctgttcacattttgtaacagnagtgaagatttgagtaagaaactagcctttcctcgtttacttttccttcttaccttccac

SEQ ID NO: 6939 - DNA, 121 bp, Artificial Sequence
  Synthesized
  misc_feature (61): n=a or g
ttcttggaaaagaacaaacttgaggtagcaagcaggaaatcataagcctcagtaaactgcnagtctgcaaatggaaactgaagatttatataatataatatataaaatgccttatgtaagg

SEQ ID NO: 6940 - DNA, 121 bp, Artificial Sequence
  Synthesized
  misc_feature (61): n=a or t
ctagaaagaaaacttgtgtctattatttaagcaagaagagtataaatagtttttctattgngtgtaagatacctgtaggttcatgtatggatagtcaaaatatatattcacatatataggc

SEQ ID NO: 6941 - DNA, 121 bp, Artificial Sequence
  Synthesized
  misc_feature (61): n=t or c
tattgtctgtaatcacagcttgggcagggggtggattcctgcaatgagatccttctgcagnctttttgtttttccctcggtctttcacacaaattgcacgactctgggaacgctctccgca

SEQ ID NO: 6942 - DNA, 121 bp, Artificial Sequence
  Synthesized
  misc_feature (61): n=a or c
tctaaatagctgttggaaagtcttttagaagtgacctaactcttactagtaacactgcttnattgtcactgttgaagttctactgaaggaaattctgacatggcaaagggtcactcttgaa

SEQ ID NO: 6943 - DNA, 121 bp, Artificial Sequence
  Synthesized
  misc_feature (61): n=a or g
atattgaacaactttcctaaagtactgatctaaatcatcaaaagcaagccttaattccccntgcctcacattctgggtgttcaaactcagagttgatcttgacaagctggctcccttccct

SEQ ID NO: 6944 - DNA, 121 bp, Artificial Sequence
  Synthesized
  misc_feature (61): n=t or c
gagatctccatgatcttcaatcccaaatccaagccacctcactgtgccagctgaccacganctccagtgccacatccaagttccttgaacacccccagggacagtgattccctctcctttc

SEQ ID NO: 6945 - DNA, 121 bp, Artificial Sequence
  Synthesized
  misc_feature (61): n=t or c
tgaatcattagacagttaatgctaatttcctttatacatacaagcttcatgcattaagtgntcacagtgcttatcttgccataccttctacatttttccttcttaaaacctagatataagt

SEQ ID NO: 6946 - DNA, 121 bp, Artificial Sequence
  Synthesized
  misc_feature (61): n=t or g
gaactgagatgaaaggaaaaggagaggtttctggagtcctaaggggaaaaaggtgtgaatnttattccctaaaataagagtaagtaatgaaaggattcagggtgcttgtggtggacactgt

SEQ ID NO: 6947 - DNA, 121 bp, Artificial Sequence
  Synthesized
  misc_feature (61): n=t or c
actatttaatggaaacttaatccagttgtgcaacagattgacaaaagcttggatggaaagngaagttcagcccgccgtcgctccatcctatgccatgatgggagctgtaaggacagaccat

SEQ ID NO: 6948 - DNA, 121 bp, Artificial Sequence
  Synthesized
  misc_feature (61): n=t or c
atgggattcacccgtagtgccccacagtgagcatggagagtctgtgtgctgtgaccaaagngtcgcttgggtttgagtggtggcctcttgagagttctgtggagccagctctcattttgca

SEQ ID NO: 6949 - DNA, 121 bp, Artificial Sequence
  Synthesized
  misc_feature (61): n=t or c
gaagcaaaaatctttcttcccctctttccactgcagaaggttttaaggacaggcactcgcnctgctcaggctctcagtctcaacaaagcaagtcacaagactgatctggcttattaaggcc

SEQ ID NO: 6950 - DNA, 121 bp, Artificial Sequence
  Synthesized
  misc_feature (61): n=a or g
gtgaagtatgcagctatctggagttataatgtcatagaataatatcttattggcatggccntgtgcttgcactgagcatgacactgatgctgggaacaggaacacctttctgctacagcac

SEQ ID NO: 6951 - DNA, 121 bp, Artificial Sequence
  Synthesized
  misc_feature (61): n=a or g
aattcagcgtgtcctttagtattgtcaggaatcagatctgggttgagttaggctgaatgtnttaagaaacatacgtgcatttggggccagaaagaaacctgactgttgtaaatgcatttaa

SEQ ID NO: 6952 - DNA, 121 bp, Artificial Sequence
  Synthesized
  misc_feature (61): n=t or c
taaatcaaggaaggtaaatatgtttgccaggaagtcaccttactgcttatacatggcaaanagacctgtgaaattaaggggtaaagacttgtgcagacagatgaagaggctgctgggcaaa

SEQ ID NO: 6953 - DNA, 121 bp, Artificial Sequence
  Synthesized
  misc_feature (61): n=a or g
gtgtacctgccagcaggtggcttgatggctaggtgggcattcaccaatcttgaactgttgncctattagtccactcaattaaatgaaaatgtaattacatatctggcttatttaaatagcc

SEQ ID NO: 6954 - DNA, 121 bp, Artificial Sequence
  Synthesized
  misc_feature (61): n=t or c
tgccaccctttgtttaaatgttcctcaaacagtccttcacgtgcgtatgtttatgtgttanggaacagtcctctccaacctctgttctttatgtgcattttgctaggtgcagaatagcgtg

SEQ ID NO: 6955 - DNA, 121 bp, Artificial Sequence
  Synthesized
  misc_feature (61): n=t or c
gctattttgaaacaccgcttccgctcagtgtttgctgctgggagatctgtgagtgacctcnactacttcaggctgaccaaatacaatgtgaagaatgacctgaattagttctccctgtgtg

SEQ ID NO: 6956 - DNA, 121 bp, Artificial Sequence
  Synthesized
  misc_feature (61): n=a or c
atttgaattggtctgatttggtatgttctattcccacagtgtatgtattaaaccttgaagntcccacagctttaaagggaatagtaaaatctgctgcttggctcagatatgtttcattggg

SEQ ID NO: 6957 - DNA, 121 bp, Artificial Sequence
  Synthesized
  misc_feature (61): n=t or c
aacataagccatcctgtggtaactacaatttctacaattctatgacattctgtgcttctangataaccatcttcttttataaaaccggtcatctgagtaacagtaatgaacgtgttcagtg

SEQ ID NO: 6958 - DNA, 121 bp, Artificial Sequence
  Synthesized
  misc_feature (61): n=a or g
attgtaacaacactaggcagacacctgtttttgtgttcccacaaagctgcctgcttgttgnttggtgctacacctgctgaagtatgctgctggagaaagctggaaggaccaacaacacaaa

SEQ ID NO: 6959 - DNA, 121 bp, Artificial Sequence
  Synthesized
  misc_feature (61): n=t or g
tccccgcgggctttgacgttaaactcgcagcacgtcctgcagatcgttccgactaccagantctcgtttgaaatcacgctgttcgaggaggaaaaccgggagcgggaacgcatcttcatcg

SEQ ID NO: 6960 - DNA, 121 bp, Artificial Sequence
  Synthesized
  misc_feature (61): n=t or c
gagagttcttgtatcctttagagaatataaatgcatatatccaggtaatctgctgcaaaanattgcaaaaagaaggtgatagaggattctgtgcttcataggacattgttataccaaaaca

SEQ ID NO: 6961 - DNA, 121 bp, Artificial Sequence
  Synthesized
  misc_feature (61): n=t or g
tgttgtttgtgggattgattcagctggagtaattctgatttgctgccagctgagctgaagntggtgctaacagattccttctgttcataatattctagtttgcacctaatgtcttcataat

SEQ ID NO: 6962 - DNA, 121 bp, Artificial Sequence
  Synthesized
  misc_feature (61): n=a or c
agaatttggctttaaaattacagcaagccaagcagagacaatttcaaaaaatcagagtgtncaactgactttgcctggctccatatgggtagtcactgagccacacaccttaaatcctgga

SEQ ID NO: 6963 - DNA, 121 bp, Artificial Sequence
  Synthesized
  misc_feature (61): n=t or c
cccagccatcaggacctgaccgtgatgcctgtccattgtggggctgagtaaaacccgtggngagggatctgcttggtgttctgtttgcatatttgcctaacattcatctccgcgtcgcagc

SEQ ID NO: 6964 - DNA, 121 bp, Artificial Sequence
  Synthesized
  misc_feature (61): n=t or c
ccagtttccagatctaagagattctgagtgagtaaccaggcttttctggggaggtattcangcaagtagttcatgtgagactaacaacaactcctcgttttattccaaactggagaggaat

SEQ ID NO: 6965 - DNA, 121 bp, Artificial Sequence
  Synthesized
  misc_feature (61): n=a or g
atatagtttgaaaaccaaagtcaaactgagcagttaggattcatatccaagcagacagacnaaggtcaatcctcccatttctctgtgcaacaaagtagtgtcacctacttcaccaaggagc

SEQ ID NO: 6966 - DNA, 121 bp, Artificial Sequence
  Synthesized
  misc_feature (61): n=c or g
agaagatcttgcagaatagaagaaaataatgataggtggtaagactcaggtaaggagaagntgaacagagatttgcagcaaagcctagtagattttaactcctgcaggatggcagtgtggg

SEQ ID NO: 6967 - DNA, 121 bp, Artificial Sequence
  Synthesized
  misc_feature (61): n=t or c
attctacaattctattcaatgattgtacttttaaatctagcatctggtgcaactcacaacngtggtgacacaaatctaaatgggctttccatggctctgttttctacttcatcttttgttt

SEQ ID NO: 6968 - DNA, 121 bp, Artificial Sequence
  Synthesized
  misc_feature (61): n=a or g
tcttacagcttaacacatgtgacagtgcaagacttcaagcgaagtttgccataagcagccntccacatcaactccttaaagacaggcaagccctagactttaagttaaacttaagatttct

SEQ ID NO: 6969 - DNA, 121 bp, Artificial Sequence
  Synthesized
  misc_feature (61): n=a or g
acacaccactactgccccactgtaagcctgctgtgctcaaacagatacataaccttggagngcaaacaaacaaaaagttgtcacaaagaccaactaggtttgaacaagaatctaacctata

SEQ ID NO: 6970 - DNA, 121 bp, Artificial Sequence
  Synthesized
  misc_feature (61): n=a or g
tggattaaacattaattgcaaactgttgttcaggaatggtccttgctgtttatagattgcngtgttctcacatttccagtcgctctgaatagtgttagacagcacagtatgttggaaagct

SEQ ID NO: 6971 - DNA, 121 bp, Artificial Sequence
  Synthesized
  misc_feature (61): n=a or g
gcctgcaggtcgggggctgccctgggctggtgggaagggctctgggtaaactctggcacangaaacatggaaggagcccaaccaggagagcacacagcagtcaaaccatctccaggctcct

SEQ ID NO: 6972 - DNA, 121 bp, Artificial Sequence
  Synthesized
  misc_feature (61): n=a or g
gcaagcagagtgctagtcctccttccttcctcccctcagtctcctacagagacgcaatacngtaacaagaacctgtccttttgaatagggtatgctaacctgatctgacatccaattaagc

SEQ ID NO: 6973 - DNA, 121 bp, Artificial Sequence
  Synthesized
  misc_feature (61): n=t or c
ttaatttctgtgccttatgttaagaagtgcacgttgtttaactattggtgttcactgatgncattgttcatttggttaattttttttcttctaattaagtgattagcaagaaattacttcc

SEQ ID NO: 6974 - DNA, 121 bp, Artificial Sequence
  Synthesized
  misc_feature (61): n=a or g
gcccacctaactccagtgcctgtaggaggcttcatttagtacagaaatgtcagcagccccncgcagccggacacgagtaccaggttgttctgcttgctttgctccctgctgctccttggca

SEQ ID NO: 6975 - DNA, 121 bp, Artificial Sequence
  Synthesized
  misc_feature (61): n=a or g
ccttcctcttttactattacaataggtgatacgctgcaagaatgagtaaaccaggaacagnccagctggaaggaaaagcacatcacagccatccagaacagatattttaagaacgactgtc

SEQ ID NO: 6976 - DNA, 121 bp, Artificial Sequence
  Synthesized
  misc_feature (61): n=t or c
gtaacggacatggggcagtactgaagttttacaagttttccttgtgatgtgaagtcatagngaaagtgctagaccagaagcattgctgcctatgtttctcattcatactatgaataccgca

SEQ ID NO: 6977 - DNA, 121 bp, Artificial Sequence
  Synthesized
  misc_feature (61): n=t or g
tatctgcctgggggtagaacagccgcagtgtcttcacaaactctgcccctctgttgactgngtgacggaggagggtctgggaacgtctccggctggacatgacaaggatggccaacactag

SEQ ID NO: 6978 - DNA, 121 bp, Artificial Sequence
  Synthesized
  misc_feature (61): n=a or t
gtgcttttattgctaaaaatgtgactgaactgtaatgtcagtagctgtaatgctctcttcnatcagaatgcattgaattctgtttgtgaaaatctgtgaaggtcctacattgttgtatacc

SEQ ID NO: 6979 - DNA, 121 bp, Artificial Sequence
  Synthesized
  misc_feature (61): n=t or c
aaaacactttttcttaatttgaaatcatcccctttaaggcacatccataatcaaattaaanggagttttccaatattgctgctaaactctccttaaagcacatggcactccagtgcctgtc

SEQ ID NO: 6980 - DNA, 121 bp, Artificial Sequence
  Synthesized
  misc_feature (61): n=a or g
aggtaagctttaaatggatgatcgttgtatggttcagtttgattctgaaagtgctgtgggnctccccattatcctctcgtgtaactgaatgcattggtcaattagctaaaaattaatgcct

SEQ ID NO: 6981 - DNA, 121 bp, Artificial Sequence
  Synthesized
  misc_feature (61): n=a or g
tgtcaacaacacaagaatggaaaaattatgtaggaagagcttgaacaacacgaaccactcnaaataaagtgacactgctggagttaatgtcagatcagcaggaggtaggatgacagagatt

SEQ ID NO: 6982 - DNA, 121 bp, Artificial Sequence
  Synthesized
  misc_feature (61): n=t or c
tagaaaaactttcccaaagaccatgcagactctgactatgtgggaaaataaatcaaacganggtgccatctctaatgggaaacagaggggcaatcgcaccacagactcaaaaaaaagacag

SEQ ID NO: 6983 - DNA, 121 bp, Artificial Sequence
  Synthesized
  misc_feature (61): n=a or c
tcaattcaagcagtcaacctccgcaggaagtactgctggagctggtcacatgaaagataanatcttaaggtcaagataggggcctatactctactccacttcaccaggactttaccagggt

SEQ ID NO: 6984 - DNA, 121 bp, Artificial Sequence
  Synthesized
  misc_feature (61): n=c or g
aaaaagctcttttcttccctattaattcatacatgctcaaaggttgcaaaggtaaaagtantgactcaaatataatttataaattaaatcatggtttttctatatagaatttactggactg

SEQ ID NO: 6985 - DNA, 121 bp, Artificial Sequence
  Synthesized
  misc_feature (61): n=t or c
aatggtaatgtggatccagcttacctaaattcactttaatactacaacatcttgcttggcnctgttctttacaccatgaatgtctgcctcgtgttcttggcttggaacagtttcacaggga

SEQ ID NO: 6986 - DNA, 121 bp, Artificial Sequence
  Synthesized
  misc_feature (61): n=a or c
ctccctccgcttccagtcaccattcagacttccctctttatctcataccttttcatgcagncatttcagcctcttcaagtctaggacactgcttttctctctcatgggtgctgtgatgcac

SEQ ID NO: 6987 - DNA, 121 bp, Artificial Sequence
  Synthesized
  misc_feature (61): n=a or g
taaacataaaaagagaggcaaatgagctgtcagaaaggtttcctggggaacttcatcttgnagaatatatttctgctcttacgcttttcagatcctgctgacccatgtggggctgtggccc

SEQ ID NO: 6988 - DNA, 121 bp, Artificial Sequence
  Synthesized
  misc_feature (61): n=a or g
atccacaacctccttgggcaacctgttccagtgaattgccaccatgcagtcctacttggtncttctgccacatttactttattcaaagtacctccataagcacaggtatccatgctttaca

SEQ ID NO: 6989 - DNA, 121 bp, Artificial Sequence
  Synthesized
  misc_feature (61): n=t or c
cactgttgaaaccatatttataatttgttaagtaatttggtgtatttgtgctgggaaaacngaaggagcaaaccagcaacaaataaaagtacaattaggtgatactgttaaatgtttcaac

SEQ ID NO: 6990 - DNA, 121 bp, Artificial Sequence
  Synthesized
  misc_feature (61): n=t or c
tctaaaatacacaagttgggacaagaaacacaagtgaattaattgctaaatacaagttacnattacataatgaatcttaaaatctgcattgctcagggtgtgatgtcagtgtttcacaata

SEQ ID NO: 6991 - DNA, 121 bp, Artificial Sequence
  Synthesized
  misc_feature (61): n=a or c
actggagacatgctgccaaattccaggttaggtcacctgaatcatcatcaggaaatgctcnttttatccatccctccagattaaccagctctgggtttgccctgcagtaggttgttttttt

SEQ ID NO: 6992 - DNA, 121 bp, Artificial Sequence
  Synthesized
  misc_feature (61): n=t or c
ctacttgaaatatgtaagctaaaaccatatattagatcacttatccatctccacaaaacantaaacacctaagaaagtcttcgattacaataaactgctcagatgccccatactaacttat

SEQ ID NO: 6993 - DNA, 121 bp, Artificial Sequence
  Synthesized
  misc_feature (61): n=a or g
aaatcccagccctttgcaaagacgtctcctctgcagtaattttgtttcaactgctgagacngagcattttaaacatcttagctatgcatttacatctccttccagctgaaaatttatcccc

SEQ ID NO: 6994 - DNA, 121 bp, Artificial Sequence
  Synthesized
  misc_feature (61): n=t or g
tcatccagctgtgaagagctgtaactgtcaatggttcttaggctagaacaaccccaagtgnttttatcagcaaagccagataagccccagcactaacctgcaagtgaaatttaaggtcata

SEQ ID NO: 6995 - DNA, 121 bp, Artificial Sequence
  Synthesized
  misc_feature (61): n=a or g
acaacttaaaaagggaattggacttatgctttctccctctgtcaggaaagtctgtgggctngccaaagtataaagtcacatctttaatcatgtctatctggaagaagtcttatatttggag

SEQ ID NO: 6996 - DNA, 121 bp, Artificial Sequence
  Synthesized
  misc_feature (61): n=a or g
cttcatggaaaaccagaggggctaaaaagtgacaggtgacagggaaatgataatttgctgncattggcttattccatcacagaaagccttgcactaattaacattaactgtatttagaaat

SEQ ID NO: 6997 - DNA, 121 bp, Artificial Sequence
  Synthesized
  misc_feature (61): n=a or g
ggagtgtttagtatctttgcattctgtgtcccgttacaaagataccctcattctttagtgnacccacatcatccctagtcttcattttactactgacatacctaaaaaagcctttcttgtt

SEQ ID NO: 6998 - DNA, 121 bp, Artificial Sequence
  Synthesized
  misc_feature (61): n=t or c
acaggactatgaattttgctggtgtgttacagcggtataaagaacatggagaaccatgttnacacaacgtggttttgatctcccttagatatcaaaggtgtctgaagttagaatggtgcta

SEQ ID NO: 6999 - DNA, 121 bp, Artificial Sequence
  Synthesized
  misc_feature (61): n=a or c
aagggaaacggaacagtatgtgttctttactcagtgctgattctgtgtggaatggtttgantgctttcagtgagttacgctggggagaatgcagcctagctggtgttgctctctgatttta

SEQ ID NO: 7000 - DNA, 121 bp, Artificial Sequence
  Synthesized
  misc_feature (61): n=t or c
tcagtgatattatttgattatgtcaccttttcagaagtgaaagttaaagaagttttttttncttttttttttcacacaaagtgttcttttcttcttcacagaggttagtggccatgaatat

SEQ ID NO: 7001 - DNA, 121 bp, Artificial Sequence
  Synthesized
  misc_feature (61): n=a or t
tccacagcaaaggctctggagattcatcagtgttctctgaccatgcctgtgactttctatnacaacacttgatatttcatatgtccatgttttttttctgccttcatggagaaagcagatt

SEQ ID NO: 7002 - DNA, 121 bp, Artificial Sequence
  Synthesized
  misc_feature (61): n=t or c
gcaatatgattctttgggatgtctctcaaatatacgcagccccttgctgaggaggagtganccagatgctttctttgagcactggtgagcgctactgatcagtatagattggcttgtatgt

SEQ ID NO: 7003 - DNA, 121 bp, Artificial Sequence
  Synthesized
  misc_feature (61): n=a or t
gatgaataaacccaccaaacttttttttttttttttgagaattctgcctatatatattgantctgtttaattgctttgtatcccatttgagtgggaaacatctggagggtcttgtttccat

SEQ ID NO: 7004 - DNA, 121 bp, Artificial Sequence
  Synthesized
  misc_feature (61): n=t or c
ttgaattcaacaaagagcttctcaatactcagcagttccatgtcagcattgccacgttaangtatctgattccccctggtgtctttgtggctcagcctcccgtagtacagaccagaccttg

SEQ ID NO: 7005 - DNA, 121 bp, Artificial Sequence
  Synthesized
  misc_feature (61): n=a or t
tttgtgatctagattatttctgtcatttctagaaggactgtcaaagatggaagagcaagtntgtgagaagagttgaatgaatatgtgcatatgaaccgaacttctgatgttggttcttttc

SEQ ID NO: 7006 - DNA, 121 bp, Artificial Sequence
  Synthesized
  misc_feature (61): n=a or g
accttgtaacaatagtagcccttctcatgaccgttggttatattacaggaggtattagctntgctgctgctgtattatgatagcccctttttcatgcttttttagttctcttcagaatctc

SEQ ID NO: 7007 - DNA, 121 bp, Artificial Sequence
  Synthesized
  misc_feature (61): n=a or g
tctgtccttcaaaaggagacaaaccaggagaaaactcggtgaactttgctgtgtgcagccntaagaacctgccagctctggtagcaccacctgcctgccctgctaatgaggcgaataggcc

SEQ ID NO: 7008 - DNA, 121 bp, Artificial Sequence
  Synthesized
  misc_feature (61): n=t or c
atgctccccgcccccaccttaaatttacagagagaatagttgaggctaaagagatacatcnagatttatagaagagaagactgggtgacttaccagaagtctcaaaagtgaaatggggatc

SEQ ID NO: 7009 - DNA, 121 bp, Artificial Sequence
  Synthesized
  misc_feature (61): n=a or g
tcacggggcttccacccttccacttctcccactgggagaccactccacaacacaacacatnttcacatattttcctgagagcaaatccaaatttttcttcattttgccttgtgaccttcct

SEQ ID NO: 7010 - DNA, 121 bp, Artificial Sequence
  Synthesized
  misc_feature (61): n=a or g
gtagctcatgtgcaggcctttggactgtaaagatggaattaacagtatagacaacccacancgtatattctacaattaatgcccttttcattatgaaaaatactttcagaaaataaaccag

SEQ ID NO: 7011 - DNA, 121 bp, Artificial Sequence
  Synthesized
  misc_feature (61): n=a or g
taaacctacactctgagcagagcagttttctaaccccctgatatcaccaagaatccacacnttgtctgtgcatacatttcatatctctgactgcaccaaagtaaaatgtagactgtgattt

SEQ ID NO: 7012 - DNA, 121 bp, Artificial Sequence
  Synthesized
  misc_feature (61): n=a or g
acaaagatacttttcctgaccgtctgtggggcacgcagcagcacatgggttaattcagcantgcctcacacagagcatatccaaatgttccactggttgctcttgagttgctatgtgtctc

SEQ ID NO: 7013 - DNA, 121 bp, Artificial Sequence
  Synthesized
  misc_feature (61): n=t or c
aaagaacagagtaggattatctccaaaggagtattttaaggctttaagacttcatggtctnttataaagaccacagtcaacacaggaagaggtaacagtaatgtcacttgtagcaaacttt

SEQ ID NO: 7014 - DNA, 121 bp, Artificial Sequence
  Synthesized
  misc_feature (61): n=a or g
gtgtgctctgagggcctgtgctgcagcaaagcgtggtcatgtgaggatagggaagtaacgncctggcttgtgggcagcacttacctacagtggggactaaaacctgtggtctggtgaaatg

SEQ ID NO: 7015 - DNA, 121 bp, Artificial Sequence
  Synthesized
  misc_feature (61): n=a or g
gctaaggtgcccatgttgtttgtttgcaggtttgtcaggtgagtggaaatactgctcagcnctgggagcatacaagagccagttttggctggcgctggccgtggctgtgtttctctggcca

SEQ ID NO: 7016 - DNA, 121 bp, Artificial Sequence
  Synthesized
  misc_feature (61): n=a or g
ttaaccagaggtggtccaaaggaatgaaggttaacacagactgggcaatgtttctgtggcntttggctccagggcagcgatttgggtctgcctctgcttccaatgcccacaactgcttgaa

SEQ ID NO: 7017 - DNA, 121 bp, Artificial Sequence
  Synthesized
  misc_feature (61): n=a or g
tttaaattaattaaagcaaacaaattctaaaatgcttctatttacgttagtgggctttgcnagactgatttccaaaaacactcattgatggacaggagagaggaagggaggaggtgagaca

SEQ ID NO: 7018 - DNA, 121 bp, Artificial Sequence
  Synthesized
  misc_feature (61): n=a or g
agtatcccattaggtctgctctctgctaaaagtctaggcaacgtaaatgctatcagaagantattttcgaagaagataaaagcaagaattctcaactgaaaacgcacctcactgtaacact

SEQ ID NO: 7019 - DNA, 121 bp, Artificial Sequence
  Synthesized
  misc_feature (61): n=a or g
agcctctgtcaccatgaatgaacctcgaactgagtcttttctgtgccaggtttttgccatncaagtttacagctggggcagagaccgtgtgcgatagcagcagaataagatgtcagcatca

SEQ ID NO: 7020 - DNA, 121 bp, Artificial Sequence
  Synthesized
  misc_feature (61): n=t or c
catgttatgagcagccataaatgcgtgtttttttctaaagcaatgccaatttttcttttgnggtatataactaaaaccccctttagggcatttaatacaaatggcactgaaagaggaagaa

SEQ ID NO: 7021 - DNA, 121 bp, Artificial Sequence
  Synthesized
  misc_feature (61): n=a or g
ttagtagctaaaagcacacgttcattaggtaatcaataaaattaccacaaatctggagaantccagtggtgtgctgttgcacaggcatttcttggcttcctgagccaagaaatacatagat

SEQ ID NO: 7022 - DNA, 121 bp, Artificial Sequence
  Synthesized
  misc_feature (61): n=t or c
attcaaacagaactaaattcatgcaccagatgctcaagtttacactgtttgtgaatggccnttaacattttcagactcttgagggagggaaccagactcccatttccttcttggggacttt

SEQ ID NO: 7023 - DNA, 121 bp, Artificial Sequence
  Synthesized
  misc_feature (61): n=a or g
aagaagtgcttgttccaggcagtattttttttttagcagctagctcaggtttaacaactgncttcagtgtactggaccacactttactccaacaccgatttgcctacaaataaatctatga

SEQ ID NO: 7024 - DNA, 121 bp, Artificial Sequence
  Synthesized
  misc_feature (61): n=a or g
ttgaagtcaggtgtggggctcctgcctggagtgtggggaaaagtagcagctttgctctttngactaaattgtcagggaaagactggattcttctggtagtgtatgaggatccccagagtat

SEQ ID NO: 7025 - DNA, 121 bp, Artificial Sequence
  Synthesized
  misc_feature (61): n=t or g
ctcaggaccacttatctctgctcaccttttgaattctacttgatatgggttacattgaaanaaggcatctttcagtggttacaataagaaacatagcctgaaatgaatgaaggtatttgtc

SEQ ID NO: 7026 - DNA, 121 bp, Artificial Sequence
  Synthesized
  misc_feature (61): n=t or g
gagtaaattaaaagctgcatgggtgtcctctaattttgtgttgaatgttccattctgctgngcgattgaatattgttttaggaagttaaatgtctttgctaaggttctgggcagccctgtc

SEQ ID NO: 7027 - DNA, 121 bp, Artificial Sequence
  Synthesized
  misc_feature (61): n=t or g
ggtttgctaatactactgaatgttcagacattactcagcaacatagcagaaaggactaaanaaaggaaagcagaaagatgacaaaaatagaagtgacattaccaaatctacagaaaaaagt

SEQ ID NO: 7028 - DNA, 121 bp, Artificial Sequence
  Synthesized
  misc_feature (61): n=a or g
aattaagagaatagcactactggaataccaaagtttgaaatggtagggtagtttccacttnttctgaaaaaagaatactcttcttccactatttcccatgggctgtttgcacaagcagtat

SEQ ID NO: 7029 - DNA, 121 bp, Artificial Sequence
  Synthesized
  misc_feature (61): n=t or c
gtcctaatgatggaacctgtgcaggacagagcagagctgtcccttcttgctgctcctatanagccaatgtggcttcagcctgctggcatgaccaggcagaggaagcacatccgctctgctg

SEQ ID NO: 7030 - DNA, 121 bp, Artificial Sequence
  Synthesized
  misc_feature (61): n=c or g
atatgcaaccctgtcatcagaaatgcacagagaaacattggaggcagaacctttggatgcnttaaccatcacccttatgctctatctcctgatatgtgtgtgcttggcatgaagagattct

SEQ ID NO: 7031 - DNA, 121 bp, Artificial Sequence
  Synthesized
  misc_feature (61): n=t or c
gagacacccaatgcagatccaacaatcagctcaccctgcctcctgtctttaacatacgttnaggaacatatgttcaggagtaatgttcaggaaactgccttaagaagcaggtaggcagata

SEQ ID NO: 7032 - DNA, 121 bp, Artificial Sequence
  Synthesized
  misc_feature (61): n=a or g
ccaaaaaatgaaaacacccacaaaaaaccactggcctctaggtgtcctttgttctcacaantgccctctagcattgggatagctcataggagtgatatctgaagctgaaagtgaagctatt

SEQ ID NO: 7033 - DNA, 121 bp, Artificial Sequence
  Synthesized
  misc_feature (61): n=a or t
aataactagcaaatcatcggtgtgatttccttctgcagcagctttctcaggcagtcttctntaacattatgtacccaacagcatattttagcactaacacctggtatgactgtttctagtc

SEQ ID NO: 7034 - DNA, 121 bp, Artificial Sequence
  Synthesized
  misc_feature (61): n=a or g
tttgtgcagttaatgcgcttacacttacgtaaggtgtgtaagaggggcttcgtgccatgcntgatgggagctttgccccaaagcactgacagcgtgagtttagatttggcacaaggaagga

SEQ ID NO: 7035 - DNA, 121 bp, Artificial Sequence
  Synthesized
  misc_feature (61): n=a or g
ctagagaaagtcctgagagtatttctgggtatcatcattctaagtattccatctgcaagcnagagtaattacagctaactaaggatgcttttgaatttacaaatacagtgcctgtaaagta

SEQ ID NO: 7036 - DNA, 121 bp, Artificial Sequence
  Synthesized
  misc_feature (61): n=a or g
gatgttcttttcctgtactcttccttctgagttctgtaaatcacaggttgcttgagcagcnttcctgctgaaaaacatctgcagggcttttgatgcagaccttttgcttcattgtctgctc

SEQ ID NO: 7037 - DNA, 121 bp, Artificial Sequence
  Synthesized
  misc_feature (61): n=a or g
tgacagaaccagcactcagcaaaggagctggatctgcgcagggctctatgtgcaaaagcangaaaggaggcacaggcatacacaagaagcacaaggaattggccttttcctgcagtagttt

SEQ ID NO: 7038 - DNA, 121 bp, Artificial Sequence
  Synthesized
  misc_feature (61): n=t or g
ggctgtcagcattaaacttagaacatttcagcattaaacttaagaaaacaggggaagaggntcacaggctatcagcaaagagcaaggcactgtattataaaacctgtcacttcagtggctg

SEQ ID NO: 7039 - DNA, 121 bp, Artificial Sequence
  Synthesized
  misc_feature (61): n=t or c
agtagagattgcatgtatgagggtgtaaagctctgaatacctgtctttggtcttagagcanagacaaaatgccatggaagaaacacacaagtcccttcaatttaacctgcagaacatgaat

SEQ ID NO: 7040 - DNA, 121 bp, Artificial Sequence
  Synthesized
  misc_feature (61): n=a or c
cacagtgagcatacagtgctcattggagtcttcaccattgccaagttttggtggagattgnagagaaacaattttgagaaggctttagagagaagatggagagttcttttttttaatcttc

SEQ ID NO: 7041 - DNA, 121 bp, Artificial Sequence
  Synthesized
  misc_feature (61): n=a or g
gtatgctgggaacagagcataagtggaaggtagagcaggcaagtaactaactctgttgtgncagatagtgggaggagatgaacgaggaaaaaactagggaaaacaaggctggaaccagctt

SEQ ID NO: 7042 - DNA, 121 bp, Artificial Sequence
  Synthesized
  misc_feature (61): n=a or g
caaaacagatggcgatgcaacgaaacattaaacccaatcccaatacctgtgctgtaccacnaatatctcactgaggcagagggtaggaaagacaacaaaatgatcttttctagcatcttaa

SEQ ID NO: 7043 - DNA, 121 bp, Artificial Sequence
  Synthesized
  misc_feature (61): n=a or t
aagccctggagtatttaaagtatttaattcaatcagaaatatccaagatgctgcaggttanaatatgaagaaacgtagaattttatgtgacacaatacttcagacacatcaaaagcactgc

SEQ ID NO: 7044 - DNA, 121 bp, Artificial Sequence
  Synthesized
  misc_feature (61): n=a or c
ttccttgaaagagaaatatgattaaacaaaagagctttaacatccttgcaactcacagatnataaactcctcaccaaagtctttggaacatgcctgtgccaaaggcctcctgtgtgaccat

SEQ ID NO: 7045 - DNA, 121 bp, Artificial Sequence
  Synthesized
  misc_feature (61): n=a or g
ctgccataagcagtctatgtagtctggcatcacttccacaaatccattgctggggaacacngctctgattgagagccctgacatttgctgtgtttgtgggaaagtttctatgtaatgtgct

SEQ ID NO: 7046 - DNA, 121 bp, Artificial Sequence
  Synthesized
  misc_feature (61): n=t or c
gtgctatttgtcttattattaaactgtaaccataaattccagaacagttgccctctaattncagattagagatttttgttgttatgatggacttgtgtgtactgaaaaacagtgagattgg

SEQ ID NO: 7047 - DNA, 121 bp, Artificial Sequence
  Synthesized
  misc_feature (61): n=a or g
tgatttgtagacacattaagtgatgaagattctgatactagaaaggaggcataaagagctnttctgtattttaatttattctcagtcctggggaaaaaaagtgtttttggctttgtcttga

SEQ ID NO: 7048 - DNA, 121 bp, Artificial Sequence
  Synthesized
  misc_feature (61): n=a or c
acagctattgctctgtggagggaaaggagcacagagaggtgtgatctgtctgaggcacccnctgcagaagcgtggcctccccccagcaacaccaactgctgtcgtggagcagctgcattga

SEQ ID NO: 7049 - DNA, 121 bp, Artificial Sequence
  Synthesized
  misc_feature (61): n=t or c
tgtacatgaagcaaataacgaagcagcagatgatttagctccactgaaaattcttgcaganttctgttctgtagctctgtatctggggcaaaatgaagtgcctcactgtgcaaaacacaaa

SEQ ID NO: 7050 - DNA, 121 bp, Artificial Sequence
  Synthesized
  misc_feature (61): n=a or g
cttcctctcctgagctgtctcactgctgcactaatggcagcaaaagccccaccaaagatcncttaagaacatggaaatgaagtgcataaatacagtaggtgcaaaatgaacctggatgggt

SEQ ID NO: 7051 - DNA, 121 bp, Artificial Sequence
  Synthesized
  misc_feature (61): n=t or c
cttacagcttcacgtgtcttttcacactgaaagacatttttattaaaaacaatgcctgatnaaagaaataactacaaaaatgtgatcattgatgaggaagagtatccccaataatcaactc

SEQ ID NO: 7052 - DNA, 121 bp, Artificial Sequence
  Synthesized
  misc_feature (61): n=t or c
acttattctctaaataacagcatctatggagtttggactcaaagctgaagcaaggtctggngtttccagaagttagggactctacaaccatcaggaactggttcttgggaaggaattcatt

SEQ ID NO: 7053 - DNA, 121 bp, Artificial Sequence
  Synthesized
  misc_feature (61): n=t or c
cggtaacattttcttttcagaatgacagctgcctgtgtgttgggaagtttttaaagaaacntctctcttttggaagatctgcaggtgagcatcctgcaacgtgctgatgatacgctgctgt

SEQ ID NO: 7054 - DNA, 121 bp, Artificial Sequence
  Synthesized
  misc_feature (61): n=a or g
tgtctgaagctgcatagaatgacaggaaattgaacttctaggacccaaaatgaaaagaatntattctgatatgcaccctttctgacctaacatgaaggaaagtttgcactgagctttaagt

SEQ ID NO: 7055 - DNA, 121 bp, Artificial Sequence
  Synthesized
  misc_feature (61): n=a or g
tttctttctaaaaccagctccacagccaacattaatattgctagggagatgaagaacagcnttgtgtaccaagcgataaacatcaatgccaaaacattcagtttcagagaattttccctct

SEQ ID NO: 7056 - DNA, 121 bp, Artificial Sequence
  Synthesized
  misc_feature (61): n=a or t
tctgcaactcggagctcttctgcaagccttcactgctctgctggccaagtcaccataacantggcatctccaaactgcaggatcctcctcttcccagtgcccatatggatctgcctaacgc

SEQ ID NO: 7057 - DNA, 121 bp, Artificial Sequence
  Synthesized
  misc_feature (61): n=a or g
gcatcgtttttatacttatggtatcttgaatacaggatctgtatgattcaggagtctccangtctgattacttgcgtaactttattaagaaagcagaataagctcgtgaatttcttttgat

SEQ ID NO: 7058 - DNA, 121 bp, Artificial Sequence
  Synthesized
  misc_feature (61): n=t or c
tttcctcacctctgttaatcctgttcagaccaagaggttccccacggggagaaaggtattngtgttggtattggagagcagctgcctgtcgctgccggtgatggcaggtggtgttttattc

SEQ ID NO: 7059 - DNA, 121 bp, Artificial Sequence
  Synthesized
  misc_feature (61): n=t or c
aagacagtgagtaaattaccaccatgtgctaaatagctttgggataaagctccatttcccngaatgagaatgactaacagattccagcaggattagtacggtcgtttgcttcccacgtgtt

SEQ ID NO: 7060 - DNA, 121 bp, Artificial Sequence
  Synthesized
  misc_feature (61): n=t or g
ttgaagaggagtgaagaaactgaagaactgatttttttcacaagacattaatagctataantaataaatggctttaatagctgaagagtttgctagcagatacacacctgtggcctcttat

SEQ ID NO: 7061 - DNA, 121 bp, Artificial Sequence
  Synthesized
  misc_feature (61): n=t or c
ggtagtacgtatttacatgtgtagcacttttaaagcaagagccacttctgagtaacttgangagtgttcgtgctggaacctgaaaagcgggcaatatattagctcgttaaggtagttagct

SEQ ID NO: 7062 - DNA, 121 bp, Artificial Sequence
  Synthesized
  misc_feature (61): n=t or c
ttgttattgcaatgaatcgcattcatatattgttttacattcacaactgatgtcacatcanatagcctgagatctgtagagagccttatatttgtattgaaacttcctctgttttaattga

SEQ ID NO: 7063 - DNA, 121 bp, Artificial Sequence
  Synthesized
  misc_feature (61): n=t or g
ccctagcacaattgtcctttgccccaccaagatagttcaggtggtaagctttgcctcaatnataccattgcttgaaaatgggattaaggggaaagaaacaacaattgcagagccagtgcta

SEQ ID NO: 7064 - DNA, 121 bp, Artificial Sequence
  Synthesized
  misc_feature (61): n=a or g
cattaacggtggagagagttacgtaaattaatgaatgggtaaaatagatatagtagacagnagctttcattctcagcttcagtgaatgctttccaaagaagattattttaattggccagcc

SEQ ID NO: 7065 - DNA, 121 bp, Artificial Sequence
  Synthesized
  misc_feature (61): n=a or g
gcctgttgcaacaaaaggtaccaaactgaggaggagaacagtatctataattactactccngtgataaaacaagcatcatgcagcagatggatttaatgcgggatcactattaaataaaac

SEQ ID NO: 7066 - DNA, 121 bp, Artificial Sequence
  Synthesized
  misc_feature (61): n=t or c
ccagggcactgggaatcaatttcccctcagtccaacatgaaagcagacacaattgattcanaccaggagcagaatttgtactgggaagcccgaaggagcagtaggttaattgtgagattgc

SEQ ID NO: 7067 - DNA, 121 bp, Artificial Sequence
  Synthesized
  misc_feature (61): n=t or g
ctgccagcagctatgaataggaaagtcatggtttgctgcacttcccaaacaggaattgttnttcatagtaaccccagcatctaccagagaggaacattctgcatcgtgtttctgtacaagc

SEQ ID NO: 7068 - DNA, 121 bp, Artificial Sequence
  Synthesized
  misc_feature (61): n=t or c
ttggatgaaagaaagcagaatttagcactgctcactttttagcaggagtcttacccaatanatactttactggctgtgcttacactgacacaaaaaaccttttgattaacagtgcctataa

SEQ ID NO: 7069 - DNA, 121 bp, Artificial Sequence
  Synthesized
  misc_feature (61): n=t or c
actgactcgcaagaaagctgcatgtccaaagagtgtaagttattccagaaaagcatcttangggtttgaagaattatgattccctatttatttatttataagatgaaaatcattttctgct

SEQ ID NO: 7070 - DNA, 121 bp, Artificial Sequence
  Synthesized
  misc_feature (61): n=a or g
agtgctttagtagggatggttcgcatatctggtgggttttcccaaataatgatctatgttnggatggatcgatcccttacaaagcaaaatattattatgaaaataaatgcatttgcatggt

SEQ ID NO: 7071 - DNA, 121 bp, Artificial Sequence
  Synthesized
  misc_feature (61): n=t or c
atccttttctaacaacaaatcaaatttaaaaacacattttactgaacctgtgtgttctttntactgtaaatacacaatttctttttttatctcaagctctgaacagcccgaagaggggaag

SEQ ID NO: 7072 - DNA, 121 bp, Artificial Sequence
  Synthesized
  misc_feature (61): n=a or g
gcctaactgtatgtttctacaaattcctttaaagccatcagcttctcctctgagaccagantagcagtgctttaattcccctttgcattcgggaaatacactgcaacacttgctgccagcc

SEQ ID NO: 7073 - DNA, 121 bp, Artificial Sequence
  Synthesized
  misc_feature (61): n=a or c
agagaaatcaaagtttctctgtatttcttaatttaatttcttggcttaaaaatttaagccnagatttgcattttcagacttcatcactctgcactaatgtctactcttactctaaagacta

SEQ ID NO: 7074 - DNA, 121 bp, Artificial Sequence
  Synthesized
  misc_feature (61): n=a or c
gccaacattctcaatcacagacttataaacatgtaaacctgtgttttgtcacttaaaaatnaatcagtatgactgttcaattttctccctcggctaacagtggagcagaaaggttttgctc

SEQ ID NO: 7075 - DNA, 121 bp, Artificial Sequence
  Synthesized
  misc_feature (61): n=a or g
tcaagaaacctgggtaagcaatccattttgaagttggttttagatgtgtttctaagcatcnccctactcaggatgcaaggagggaatgatgcagacagacagggaaagggataccccaaca

SEQ ID NO: 7076 - DNA, 121 bp, Artificial Sequence
  Synthesized
  misc_feature (61): n=t or c
gcctcggaaagaagtgcaaagctttacacctcagccctgccctcaattcccacaagcacangagaacatctgctggctgtgtttctattctgaagagctatttaactgcttgtctttacca

SEQ ID NO: 7077 - DNA, 121 bp, Artificial Sequence
  Synthesized
  misc_feature (61): n=t or c
gtacaggacacttcagctgcctggagctatactgggcattcagaacaggagccagacatcncttgctacttttcttcatgcctacctgagcaaacagctcccgtgctccacagaagcacct

SEQ ID NO: 7078 - DNA, 121 bp, Artificial Sequence
  Synthesized
  misc_feature (61): n=t or c
ttgccctgaaacaacgccttcattttcaggacggtgctgaacaaaaagttatcggggctangtgggatcattaccactcacacacagccactgcacacgtggatggaagagagatgaggtg

SEQ ID NO: 7079 - DNA, 121 bp, Artificial Sequence
  Synthesized
  misc_feature (61): n=t or c
aaggggattcatcccatgcctattcataacactgctctcccggactcattacgagctgaangcagtccaggccccgcgcgtgatggatgatgcctgcttcaggctctgctttcagcctgct

SEQ ID NO: 7080 - DNA, 121 bp, Artificial Sequence
  Synthesized
  misc_feature (61): n=t or g
tgcaaagtgttaagagacctcagctgacctctacctgacagtgatattttccttcagaagntcccactggttccaatttcacccagagaccaaacccagatgcttccaaactgggagagcg

SEQ ID NO: 7081 - DNA, 121 bp, Artificial Sequence
  Synthesized
  misc_feature (61): n=a or c
tatggtgctgaactgaaactctcatgacaattttcaggactaataggggtatttgaaaganatgtatcaattcagagtccttgcagaaacgtgctttctgtagataaaagaagagagaatt

SEQ ID NO: 7082 - DNA, 121 bp, Artificial Sequence
  Synthesized
  misc_feature (61): n=a or g
ttctaactgggaaaactgtttatctaactctcataattcgcaggaatgcaagaaatacagntgaaaatgatattttcagcacaagcaacgttgcaaaaactatgcttgctgtaccagtgta

SEQ ID NO: 7083 - DNA, 121 bp, Artificial Sequence
  Synthesized
  misc_feature (61): n=t or c
aagtgtagctctgcaatctaccttactcatccatgaagagacagaaaagggtctacgaggntagaaacaattgtttccttcttggcaaaactttacattttcatcccatccaatggatttt

SEQ ID NO: 7084 - DNA, 121 bp, Artificial Sequence
  Synthesized
  misc_feature (61): n=t or c
gcgtgctaaggattggagagaagctgaatttggaagtgttgtatgtaagctgttttgtatnttctaaaaccaatacttcacagattaagttaagttgcatagaacagcaaaactgctgaga

SEQ ID NO: 7085 - DNA, 121 bp, Artificial Sequence
  Synthesized
  misc_feature (61): n=a or g
ggacgtgggcaccagacacagctggtaacaccttagctaagttgctcccttttctgcggtncatgcattcgggctactggcaagacgcttgtattccttctccttttcacaacaatttgtt

SEQ ID NO: 7086 - DNA, 121 bp, Artificial Sequence
  Synthesized
  misc_feature (61): n=t or g
tagcattgctgtttctgctccctgtcttcttgagtatggccaaagaatgaaaaagatctcnaagaagtcattcttaacaagtgcgctccatcattaagctaaaaatggaaaagctcacagc

SEQ ID NO: 7087 - DNA, 121 bp, Artificial Sequence
  Synthesized
  misc_feature (61): n=t or c
ctctgaagaatggcagctctcctttgtctgagccaatgatcgcacaaaatctaaaggcacngattgcaaaggcaactggggcatccttacaattaccctgacaaaatacagcagtttcaca

SEQ ID NO: 7088 - DNA, 121 bp, Artificial Sequence
  Synthesized
  misc_feature (61): n=a or g
tacgcatctcttacacatagcttgctgtatctgaggtcctgaaagctgttaacctttaatnccttgcaggtagattgttcctacattagggcttcacacagtgaagcctttggttggcaca

SEQ ID NO: 7089 - DNA, 121 bp, Artificial Sequence
  Synthesized
  misc_feature (61): n=a or g
atacatattaacctgtgaaaataccaatagcggtgtagtggtggggaaaaaatcatgtttnttcctatgcagtgaccgggacagaagggaacatgagtctgaaggtctgtcccacatccca

SEQ ID NO: 7090 - DNA, 121 bp, Artificial Sequence
  Synthesized
  misc_feature (61): n=t or c
atatgtggttataacctctgcaggtgcggttcgaactacgaaaagcagcattctgtcttcncatcaaataaaaggaggatgctgcgctacaggatggttccggatattgctctgctttgct

SEQ ID NO: 7091 - DNA, 121 bp, Artificial Sequence
  Synthesized
  misc_feature (61): n=t or c
tgattaatatgtgagaacgcacgttcagccttgtacttcatgaatcgtctggggatacagngactattacaaatttcctatagaagtagctcaggtaaaaagactgagcacaagagaatgg

SEQ ID NO: 7092 - DNA, 121 bp, Artificial Sequence
  Synthesized
  misc_feature (61): n=a or g
cattgatggccctataccactcctcaaactatttttttctagtagtagtacttctagtagnggtactactgcaaggaagctgtcaaaaatgtgctaatgagaatatgagcagattcttatt

SEQ ID NO: 7093 - DNA, 121 bp, Artificial Sequence
  Synthesized
  misc_feature (61): n=t or c
agatattatcaaagacaatgctgtaagattatacttcctcttctgatagtctttgatccangtaggatgctttatctattgtggcttaacacttttgctgtggtggaactatttatgaaac

SEQ ID NO: 7094 - DNA, 121 bp, Artificial Sequence
  Synthesized
  misc_feature (61): n=c or g
cggaagcacatttagacaaaaccataaagacagattttatattcagcataaaggatttagntacggttcagttgtcaaaatagttcgactgaaagtaatttaaaaaaggaaagtgtatttt

SEQ ID NO: 7095 - DNA, 121 bp, Artificial Sequence
  Synthesized
  misc_feature (61): n=t or c
caccactgagcagagcctgactccactctctttgatccttctttcaggtatttatgaacantagtaagatccccctgaaccgcctccaaactaaacaccctcagctttctcagcctctcct

SEQ ID NO: 7096 - DNA, 121 bp, Artificial Sequence
  Synthesized
  misc_feature (61): n=a or g
cattttaatctatagaaatcccattagcatgtgtcaagtgctatccagaaccagcttctgnaatgccacacttctggtcatgtactgcaggagagaatggatgctctgtgagcaacaaaag

SEQ ID NO: 7097 - DNA, 121 bp, Artificial Sequence
  Synthesized
  misc_feature (61): n=a or g
aacgctctctctgcccatccctggctcctttggttgccacccaagaagatcaaagctacangaagcttcctctgttgaatccagtgcagccagacgtgctgttagaaagtgccagtgattc

SEQ ID NO: 7098 - DNA, 121 bp, Artificial Sequence
  Synthesized
  misc_feature (61): n=c or g
atcatttgtgtatctggcaaaactatgctaatgaatcatgccttgtatcctttactcattntctttccaagaattcccttactgtagaaactaacagaacaaaaagccaatacaatcacca

SEQ ID NO: 7099 - DNA, 121 bp, Artificial Sequence
  Synthesized
  misc_feature (61): n=a or c
cagcagctatgatgcagcttcacacctgcaattgaaatgctgcagtccgcacagcctcagnaaaggctttagaatatctcactcctacaaatctcccagtgcagcgagctcaccccaggct

SEQ ID NO: 7100 - DNA, 121 bp, Artificial Sequence
  Synthesized
  misc_feature (61): n=t or c
aacatagtagggggcattacttttggagcagtcctcctagattgctggcagccactgtcanccatttttaaacctcagccaagatgaagacaggagtctcctgtacaaagggactgtagaa

SEQ ID NO: 7101 - DNA, 121 bp, Artificial Sequence
  Synthesized
  misc_feature (61): n=c or g
gtaagtcagctgctggcagcactgagcatgcgccaggatgctctttccaaaagagagtcangtacctgaaatttacagtcctttcaaaaacttctcagaagtctgcaaagcttttaattgc

SEQ ID NO: 7102 - DNA, 121 bp, Artificial Sequence
  Synthesized
  misc_feature (61): n=a or c
actccttgcaagccttttttcctggactgcaggtaaagcaaactctgtttcttttaaagantgagtgatgcagtgggcaggttctcagagaggctcattctaatcctagcctgtcagcgag

SEQ ID NO: 7103 - DNA, 121 bp, Artificial Sequence
  Synthesized
  misc_feature (61): n=a or g
agtagttaatgtgatgccaaacatctttggcaaataatgactccttctgatgtttattgantggatttccttcagctctttagatcttgtggtcagccagatatgctgttccaatgggatt

SEQ ID NO: 7104 - DNA, 121 bp, Artificial Sequence
  Synthesized
  misc_feature (61): n=t or c
ctctgctctcaggtttaatgttgcaatagttgaaagcaaactacagcccagcccttcatangaccagcacaccgacttcccaagctaatggagaacctcgtgacagctcacaaaggactct

SEQ ID NO: 7105 - DNA, 121 bp, Artificial Sequence
  Synthesized
  misc_feature (61): n=t or c
ttggttggagttgttttctaatagtattatatactttttctccttgctgttcctaccttcngttattaatagatcaatacataattctgtgataaccatttatatctctaaaggactttat

SEQ ID NO: 7106 - DNA, 121 bp, Artificial Sequence
  Synthesized
  misc_feature (61): n=a or g
tgataaccaggccccaggttggtgcttaagtgagctatcttgaacctgaaccttgatgcanatgcattcagcaaagatctgctgctgggagtgtggcagtcagaacaatctgactgtgaga

SEQ ID NO: 7107 - DNA, 121 bp, Artificial Sequence
  Synthesized
  misc_feature (61): n=a or c
agccatctggttctgatcctcctgagatgcagtcctttgctctggcaccaccagagtgcanactcatggccataagcctgttttcaaatgatcttcagattaaagttgaaggaagtaatct

SEQ ID NO: 7108 - DNA, 121 bp, Artificial Sequence
  Synthesized
  misc_feature (61): n=a or g
caggttttgatgcatttgtgccttaatgcagggatggttccaagccaggtcatagaagttnaataataataatttactttaacattttcaaaaaaaaaaaaagtttaaataaactggcaag

SEQ ID NO: 7109 - DNA, 121 bp, Artificial Sequence
  Synthesized
  misc_feature (61): n=a or g
gccctacacacagaccatgctgatgctacatgtgattggacctctcatccacgcctgcacntgcaggccccatactggctctcacacacacataacccataagcaaacacaccacccagcc

SEQ ID NO: 7110 - DNA, 121 bp, Artificial Sequence
  Synthesized
  misc_feature (61): n=a or t
atgatgtaacaatttatgtacatttagatattacatttcagttttgtcaggtttgggctgngcatgtattcagcaagtattcagggctgttgctctcagttcctgctcatgtattccctgg

SEQ ID NO: 7111 - DNA, 121 bp, Artificial Sequence
  Synthesized
  misc_feature (61): n=a or g
acatggctttgggtctatccctgccacaggacacggctatcagggttactgtgctctgccnccatgcagcctaaggagcacacacactagactgagttaagggtcactgtaacaagcagaa

SEQ ID NO: 7112 - DNA, 121 bp, Artificial Sequence
  Synthesized
  misc_feature (61): n=t or c
aggagcagcagccccccatgcaaggaagttgttgagtgccaatccagtggattaaagatgnatgatcttcagcatgaggcacaagtcagcaggaaaagaacacgtttccattgcgtgtgag

SEQ ID NO: 7113 - DNA, 121 bp, Artificial Sequence
  Synthesized
  misc_feature (61): n=a or g
gggagaccgtgccatcaagatgtgaatgtgccataactgacttggtttaacaggctgaccnggcatcctagaacagagattgtgaaggcctcagagcaggttttttatggtctgtgttttt

SEQ ID NO: 7114 - DNA, 121 bp, Artificial Sequence
  Synthesized
  misc_feature (61): n=t or c
tttttgctgactgaaaagtaccagagaaattcacctactgcagagatcagagcaccacacnttgaacaaacagctgtatccagaaagggaaggtggcagaacatgaccagaattaaagaca

SEQ ID NO: 7115 - DNA, 121 bp, Artificial Sequence
  Synthesized
  misc_feature (61): n=a or g
gcagctccaggaacaaaaggctgcagcgatacctgaggatgtctggatttcttagcctgcntccctgctctcttgacaactccgggctcaaaagttccttctttgccctgatggcaccttg

SEQ ID NO: 7116 - DNA, 121 bp, Artificial Sequence
  Synthesized
  misc_feature (61): n=a or g
ggagagaaggctgtagtttgaggccatagtttgaaaggcggttatgtgtgaggtggggaangtcttacagaagagaggtacatttactgacccgtgttccctgtgtgctgtgcattctcca

SEQ ID NO: 7117 - DNA, 121 bp, Artificial Sequence
  Synthesized
  misc_feature (61): n=t or g
ctgctctgtgtactagcatgaagtgctttacctaggccctctgaaacatatcaaacagctnaggaacctcattccacagtataagttaaaagactacggttttgaagaaaacctacataga

SEQ ID NO: 7118 - DNA, 121 bp, Artificial Sequence
  Synthesized
  misc_feature (61): n=a or g
taaacttcaaattctgagagcaggatggaatctgcttgtgttaatttgagtaggagttaantactgcatctaacaattagactcaagtttttaatatgggaatgagtatttggttgattga

SEQ ID NO: 7119 - DNA, 121 bp, Artificial Sequence
  Synthesized
  misc_feature (61): n=t or c
acagtggaaaaataccatattgatttcattactgtctgcagtgggaacacaaccaccaatncctctgacaaaatcttatagccaaaggaaaagatttaaaactatgtctctgctgagacat

SEQ ID NO: 7120 - DNA, 121 bp, Artificial Sequence
  Synthesized
  misc_feature (61): n=a or c
ccatttggatgttcttaatgaactcctatcttcacctgtgcaatcccccattattttcagnatggatctcactgtcatgtaggtgtacatgcagccccattaatatgagttacaacatgcc

SEQ ID NO: 7121 - DNA, 121 bp, Artificial Sequence
  Synthesized
  misc_feature (61): n=t or c
gtttgatacagctgtccttttcttaaggtattctggcttctgctagatggatcaactctgngagctcacgtagggttaaaaaaaacccctagcattctaataagagttgattgtcaacact

SEQ ID NO: 7122 - DNA, 121 bp, Artificial Sequence
  Synthesized
  misc_feature (61): n=a or g
tctctccactgctttctgcaccacaagatcaacatcccacttgtttcagctggaagcctancagagcagtgtctgggaactaagcagaaactctgctgtagttaagctgcttttgtgatgt

SEQ ID NO: 7123 - DNA, 121 bp, Artificial Sequence
  Synthesized
  misc_feature (61): n=t or c
aaagatctgaagacttgcaggtagattaaaggcgcccatttggcacctccacattgtaatnggcagtgtaacatcattcctcccaacattccagatgccaagtgcagctgactggctgctc

SEQ ID NO: 7124 - DNA, 121 bp, Artificial Sequence
  Synthesized
  misc_feature (61): n=t or c
tcaatgaaacttaaactgagaatcgcaactgtttcagcttcctaaagctcagaaggatttnacacctcatcatttggttaggcccattttcacttaagatactttgtaatgtctgactgct

SEQ ID NO: 7125 - DNA, 121 bp, Artificial Sequence
  Synthesized
  misc_feature (61): n=a or g
aactcttcaaaaccccacctatgaagtgatctgtggctaatgaagaggaccactagtgaancctggtgaaagacagtagttttgtagtacatcatatagtcttcaatattaaaatagtctg

SEQ ID NO: 7126 - DNA, 121 bp, Artificial Sequence
  Synthesized
  misc_feature (61): n=a or g
tgaaccacagtgaattctactgtctgctcagtgatatggaaaatgctacctaaaaagggcnggaatttccaataaataatttgcaggtgaaaacatgatcctgcctgtgctgagaactaat

SEQ ID NO: 7127 - DNA, 121 bp, Artificial Sequence
  Synthesized
  misc_feature (61): n=t or g
gttgagtttaagaaggctttcttctctcaaggctggtggtttggtgggactgctacacttnctgctgtaacacgtcagaaaactttccactcttgaaaagagctaagatctaagatcctcc

SEQ ID NO: 7128 - DNA, 121 bp, Artificial Sequence
  Synthesized
  misc_feature (61): n=t or c
ttaaggcaaacacagtatctctagggcaactttgaggatacctcactctgctgttggtganaaaggactaaaagtataatcagctgtttcagaagtctcattaagcaagctgaatgagagc

SEQ ID NO: 7129 - DNA, 121 bp, Artificial Sequence
  Synthesized
  misc_feature (61): n=t or c
tgactcctgcagacagtgctttgataagccccgatgtatccaatcagtcctataaaaatcnacagaacagaaagtgtttcttgtctccataaacatgcggccatatgctgatacctcaagc

SEQ ID NO: 7130 - DNA, 121 bp, Artificial Sequence
  Synthesized
  misc_feature (61): n=a or c
ctttcatccttcagctgagatatctcttcatcttgttttttcacgcaacggatgttttcantagaggtaattatattccctaacttaatctgtgctcaataagttttagtctcattctatg

SEQ ID NO: 7131 - DNA, 121 bp, Artificial Sequence
  Synthesized
  misc_feature (61): n=a or c
acgactgaaaaatgcaagtaatcctatcacaaagattaatgcaagtcagagttggaagacngatattaaacctgctacttcttgggcagcttgatcaactgaaagggaataaataaattcc

SEQ ID NO: 7132 - DNA, 121 bp, Artificial Sequence
  Synthesized
  misc_feature (61): n=t or c
ccaatgacacaaccacagtccttcttactgaaaaattcataaagcagtagttatcagcagngtaaataaaacaggtcctgtgactctcaacacaagttctggagacctggtaacaatttga

SEQ ID NO: 7133 - DNA, 121 bp, Artificial Sequence
  Synthesized
  misc_feature (61): n=t or g
agtcatcactaccctttgtcactgtagtgtgtccctggagggagtcaaatatacaataatnaacaagtgtctccagtagctggattagaatggtggactgtgcactgcgttactttttcca

SEQ ID NO: 7134 - DNA, 121 bp, Artificial Sequence
  Synthesized
  misc_feature (61): n=a or c
tatttctatgtaagaactacctgattgtatcttctggttagcctgaatgtaggatgcacantaccacacacctgaactttaaccaagtagagtgtgtgattgattcttggactggttactc

SEQ ID NO: 7135 - DNA, 121 bp, Artificial Sequence
  Synthesized
  misc_feature (61): n=t or c
ttaagcatgtcttgctgaccagccagcttccagcccgtccctgtcattgcagcactccatncctgtcccttctccccaacatcagtgggatactgcattgaattgcatcatcactaataat

SEQ ID NO: 7136 - DNA, 121 bp, Artificial Sequence
  Synthesized
  misc_feature (61): n=a or g
gcagtcgcctgctaatatcataactgaccaactccactgccaacctcctgattattctttnaggagtgcatttgagacggtgctcaccagagtgtaaggcttttctatttacacagctgtg

SEQ ID NO: 7137 - DNA, 121 bp, Artificial Sequence
  Synthesized
  misc_feature (61): n=a or c
ggctcgtagaggaagcaggggtagtcttgagctgtttcgttggccccgctctcaattttcncctatttgaaagtgaaactcagctgtgtttggaaagatgtcaggaaatgcagaaaattct

SEQ ID NO: 7138 - DNA, 121 bp, Artificial Sequence
  Synthesized
  misc_feature (61): n=t or c
taatacattatacagacttcagaaagctcctgtctgattctagctctttcctgatgtcagnggaacttgagctttctcttggggcaagctaatccaaaaaggtgtttctccacttaagttt

SEQ ID NO: 7139 - DNA, 121 bp, Artificial Sequence
  Synthesized
  misc_feature (61): n=a or t
gaggctcctcatttcttttccatcaacctgcacgaatgctgcagtgttcaacatcaaaaanatgtcacagaaaattcctcctcagggccatatttacaaaaggaccactaaattctgcaaa

SEQ ID NO: 7140 - DNA, 121 bp, Artificial Sequence
  Synthesized
  misc_feature (61): n=t or c
accattgataactatcagcttctaggaaacaatacttagtagatattccttgaaacataantaaactctattatattttattccatttctattacactattccttttggacaagattttac

SEQ ID NO: 7141 - DNA, 121 bp, Artificial Sequence
  Synthesized
  misc_feature (61): n=a or c
atcttctactgtccataagcatctttccaatatatgggggccctttttatttccagtatgntctccttgactttgccaactgtatttctttgcttttcaactagagtatattttcttttat

SEQ ID NO: 7142 - DNA, 121 bp, Artificial Sequence
  Synthesized
  misc_feature (61): n=a or g
tttttcttgcacataatcgcagcaggtatccacatcatagattgtatcttgcactgtaccnaacatgtaagattaagaagaatggaggatacaatagtataaaaattacatctatggtaat

SEQ ID NO: 7143 - DNA, 121 bp, Artificial Sequence
  Synthesized
  misc_feature (61): n=a or g
tctggtgatgctataaactcagcaaagtgattaaaggtcagcaagtattttccaactacanaagtatgtactgtggaaaaaaatttacagcttttacagttagcagtcatatacagaatcc

SEQ ID NO: 7144 - DNA, 121 bp, Artificial Sequence
  Synthesized
  misc_feature (61): n=t or c
ctcaagtgatcgtagaaggctgaaggtagtaaaatatgatggcaaaaatacagaaggaagntgagaacagctttagcatcttgtaaaattgtggggtttcagctttgctcctactagaagg

SEQ ID NO: 7145 - DNA, 121 bp, Artificial Sequence
  Synthesized
  misc_feature (61): n=a or g
catcagggaaggaaaaaaaaaaaaaaaggaaagaccaagaaaaaggattaattctgaaagngactctctacacaggaagtgacatgacttcagcacaaaagcacagtacagtgcaaacact

SEQ ID NO: 7146 - DNA, 121 bp, Artificial Sequence
  Synthesized
  misc_feature (61): n=t or c
gcagtgatgagtgttgatgaagcagtaaacctatttctatgtaaaaacatcctcaaagaanggatagctaacaaataataaaatcactcttacatttaatcaaatgcaccagaaacatgca

SEQ ID NO: 7147 - DNA, 121 bp, Artificial Sequence
  Synthesized
  misc_feature (61): n=a or g
gcgtgcccctccagacacattgctggcactcggatctgcagctactgacagcagtactacntgacagactaataacgggggtgcatttctacatacattatctgcacaaaattaatattca

SEQ ID NO: 7148 - DNA, 121 bp, Artificial Sequence
  Synthesized
  misc_feature (61): n=a or c
atcactagcattcctgcattcctggctttcccacgcatatgaaagatacagttgacacttnactataacaacttaagttgaatatggatttaaaaataaagacctgcctctctgttattct

SEQ ID NO: 7149 - DNA, 121 bp, Artificial Sequence
  Synthesized
  misc_feature (61): n=t or c
agcacagtgctgaacatctgcagggcatgagtaaacttcacttgtattccattacttttgnaaaaggaacttcaatattccaagttcaattgcaaatccactgccatctgaatttgcttca

SEQ ID NO: 7150 - DNA, 121 bp, Artificial Sequence
  Synthesized
  misc_feature (61): n=t or c
gtttgctatcagctggtgatggagggctggtctgtgggtatccccagtgactgtgttcacngtttcttaatacatcctcaccccaggagccatgcaggcagatggctgccagtttctgaaa

SEQ ID NO: 7151 - DNA, 121 bp, Artificial Sequence
  Synthesized
  misc_feature (61): n=a or c
agctgcgctcgtgatacccttttggccaaatagtctgtaagcagacgctgtacgacagccngaggctcttctcaatagaactgctgagtcggtattttcctcttagaggaagcgatcggag

SEQ ID NO: 7152 - DNA, 121 bp, Artificial Sequence
  Synthesized
  misc_feature (61): n=c or g
tccctacattttgtattgatgtgtcattcctatgtgaatagatagcccagtgcttcctgtnttgtagctgaaatagatcttaaggagttaactgaatagacagcatttgctttgcaaacag

SEQ ID NO: 7153 - DNA, 121 bp, Artificial Sequence
  Synthesized
  misc_feature (61): n=t or c
gcaagcaaactgttctttcctattgcttttcctagtatacagctctttatctttatactcntgcaagctggttggcattgaagtgagtttgcgaggagttgcttggctttcatttactgaa

SEQ ID NO: 7154 - DNA, 121 bp, Artificial Sequence
  Synthesized
  misc_feature (61): n=t or c
aaggctacaaataggtcacaaacaagaataatatatacaccttaagtcagaatcaaactgngtctttctgatttcctataagaaatgctaatagtttcctaataaccaaaccaagctctcc

SEQ ID NO: 7155 - DNA, 121 bp, Artificial Sequence
  Synthesized
  misc_feature (61): n=t or g
tgttgaatgcctttcagtacctggggaaaaagtctgcctgtgcgcgagactgcttctccancactagcaggacgtgtattaactttaagtagagttagctttctggttttgtcatgaagat

SEQ ID NO: 7156 - DNA, 121 bp, Artificial Sequence
  Synthesized
  misc_feature (61): n=c or g
ttgtttgtgtggcattttgctttttgcattttacttattattaacatcaggaatttagttnccagtttcagggtggccttctgagtatgagagtacacttttatgttcactatgtgtccca

SEQ ID NO: 7157 - DNA, 121 bp, Artificial Sequence
  Synthesized
  misc_feature (61): n=t or c
aaggctgagagagatactaaggcatctttctacagataggaaaaacctgcaggacctacanggatcatttttctcatctttacatgctgataacactgcattgataaagaactgttttgca

SEQ ID NO: 7158 - DNA, 121 bp, Artificial Sequence
  Synthesized
  misc_feature (61): n=a or g
tcaaacacaggacaggagggccccgggtcaccttcctgcagcaccgccatgaacaaagccnattgtcccaccctgcctccattctctatgcaaggagtgggtgaggtgagcacatggcagc

SEQ ID NO: 7159 - DNA, 121 bp, Artificial Sequence
  Synthesized
  misc_feature (61): n=a or g
aaacatagactgtacctttctaagcactgcaatttaccatttcattcctctttaaaagacnggctcatcacagcttatcgctaaagaagacactgaatgtttcacaaacatcagttagcaa

SEQ ID NO: 7160 - DNA, 121 bp, Artificial Sequence
  Synthesized
  misc_feature (61): n=a or g
tctaggagaaaaaaagaacaccctataacatacacaatacagatatgttcaataacaaacntgaacacacaagtccactagaaccatctttgtaaaaaaaacacttaactgaaaaaatcca

SEQ ID NO: 7161 - DNA, 121 bp, Artificial Sequence
  Synthesized
  misc_feature (61): n=t or c
agaagtgtgcgtggctgtgtcagcatagagagtacaaagtggcttcccatatggtcagttnttaggatttctcctgtttcaaatctgcataagtggcccactcaaggaggcccaactatta

SEQ ID NO: 7162 - DNA, 121 bp, Artificial Sequence
  Synthesized
  misc_feature (61): n=a or g
tcccccatgctaggctcagtaggatgagccgcaagagagatatctagctcaggaacccagngtgaaggaacatgtttcagctgaagcttgtgtcaaccccactttttttatttttctctta

SEQ ID NO: 7163 - DNA, 121 bp, Artificial Sequence
  Synthesized
  misc_feature (61): n=a or t
gaacaggtttcaacagtgagattgctggctggagatctgtaaactgcttggggatgtaagntaacaatgaagtaatctaatgactaagtgttatagcatgacattagcaaactgtaatacc

SEQ ID NO: 7164 - DNA, 121 bp, Artificial Sequence
  Synthesized
  misc_feature (61): n=t or c
gtaatgctttgcactttcagaaaacaatgtggcagtgccaaggtgtacagtggttctttgnaggtggctctgtgacatggcattgtcccagccagcaaggctcttccctgcatgtgttttg

SEQ ID NO: 7165 - DNA, 121 bp, Artificial Sequence
  Synthesized
  misc_feature (61): n=t or c
ggcttaagtctcaatgcctgatagtttttgttggttatgtcttgcacactttcttagtganctaaaattgcattatatactttgtagtacctccaaatggtctggttgtttactgtggaac

SEQ ID NO: 7166 - DNA, 121 bp, Artificial Sequence
  Synthesized
  misc_feature (61): n=a or g
ctaagagttgagcgtgagtttattcagtgtgtcctttccatgtactgctgtttctctgtcncctttccttgagcatctctcctctttttttgggtaggactgttggcttattcagggaaaa

SEQ ID NO: 7167 - DNA, 121 bp, Artificial Sequence
  Synthesized
  misc_feature (61): n=a or g
atgccagtgaaggatgatggaagatgatagtcaacattttctgcctttttccacctatgcngttttcctttaaacttaatgtggatgccaatatcagtccctttgcagtgctgggtgactc

SEQ ID NO: 7168 - DNA, 121 bp, Artificial Sequence
  Synthesized
  misc_feature (61): n=a or g
taaactcttgcattaaatcccaaagtttgcacttctgcttcttgtcctactaggtcctccntggactatttctttccttctcttctaataatgacagttgatttctatcactaagactaag

SEQ ID NO: 7169 - DNA, 121 bp, Artificial Sequence
  Synthesized
  misc_feature (61): n=a or g
aggtgattttacagcaggcccagtgtcctgcctgacatccagtgtctgcagacttgcatgnctgccccatcgccccacctggccaagcctaagtcactccccaaccacagcagcccagctc

SEQ ID NO: 7170 - DNA, 121 bp, Artificial Sequence
  Synthesized
  misc_feature (61): n=t or c
tgcgctgtgcacccaacacccatctgtcctgcaggactgatatgcacctctgatgctgaangtgacaaaagaacatttaaagaatgagtaaatccagcccgctcccatctccaaagcttct

SEQ ID NO: 7171 - DNA, 121 bp, Artificial Sequence
  Synthesized
  misc_feature (61): n=c or g
catctgcaatacgtaaggaccatataagcagaagaaaaaagacagctctgacctaaagatntcctcttcataagaacctccatttagaagtctgttagctgctgatgattattccccactt

SEQ ID NO: 7172 - DNA, 121 bp, Artificial Sequence
  Synthesized
  misc_feature (61): n=c or g
tagagctgatgtttatcccatgccaattcttgaacttctggttatgagagatgctcagagnagcaaaggagctaaacagtactcaaatgcatgctgaatgactctgaataccaaacatcct

SEQ ID NO: 7173 - DNA, 121 bp, Artificial Sequence
  Synthesized
  misc_feature (61): n=t or c
gtggactgatactggatacagtagtattgccttgtcctcactgcatatttaatccttcatnatattagcatacaggtgtagcccaggtcagaatgggtctgggatacatttctatcagctg

SEQ ID NO: 7174 - DNA, 121 bp, Artificial Sequence
  Synthesized
  misc_feature (61): n=c or g
ttgatgtataacacaaaatgctcacattctcagtctcagaatttctaaacagttcagccantacctttcactggtactgagctgcactcacaaaaacactttgatgggcatacagggccct

SEQ ID NO: 7175 - DNA, 121 bp, Artificial Sequence
  Synthesized
  misc_feature (61): n=t or c
aaaaataaggcagcagtgttggctgttgttcaccattgctagtgcatatcccagcccattnccatggcaggtgctctccgatcaggatgggtgagaggggagcacaggttcttccaatcac

SEQ ID NO: 7176 - DNA, 121 bp, Artificial Sequence
  Synthesized
  misc_feature (61): n=t or c
atctcttgccttgttgccacaacctgctcccagcacgtgatgtgaaccctgttcaacctancccttagctctggagggaattagcagcgcattcccagcccacatcatgtactccacctag

SEQ ID NO: 7177 - DNA, 121 bp, Artificial Sequence
  Synthesized
  misc_feature (61): n=a or g
agtgcgcccattttgctgatcaaacagcagagttaaaggcagcccactgtcaacacgaagnagcctccagccaaggaaaaaaaaacccgaagccatcatttctaacaaggagcagttgggt

SEQ ID NO: 7178 - DNA, 121 bp, Artificial Sequence
  Synthesized
  misc_feature (61): n=c or g
gtatttttaagttgtttgttagaataccttttactcttattctggtataccacagagaganacatctctttttttccttggatagaatatgccggttctgattgagctacgtttaaagaat

SEQ ID NO: 7179 - DNA, 121 bp, Artificial Sequence
  Synthesized
  misc_feature (61): n=a or g
aatgaaggggctgcgtggacagacacattggttatacactgtgggtttggtggtgggatcngaaacctctgcagggacagaaagagacgtaggtagaggagatggcagaaggaacttgtgg

SEQ ID NO: 7180 - DNA, 121 bp, Artificial Sequence
  Synthesized
  misc_feature (61): n=a or g
cacatccactgagctgacagttcccaacctgcatatccctacacagctgcttgcctggcanaaagtctctttgctttatgcactttttttcctactttaataaagttatttacctcttttt

SEQ ID NO: 7181 - DNA, 121 bp, Artificial Sequence
  Synthesized
  misc_feature (61): n=a or c
aaccaacaacaaaaagaaactaaggcaacccactccctttcatgcttgggatgtctctganagcacgtggttattttagttccctacaggataatctagaagtttaggtcttttggactga

SEQ ID NO: 7182 - DNA, 121 bp, Artificial Sequence
  Synthesized
  misc_feature (61): n=t or c
atgtttccctgaccacatcttgcttgggcaaggcaaggagtgagaacaaagctttgtcacngtgagtaataacccttagatgctaagaaattaaatattaagggctttgcagtgttactca

SEQ ID NO: 7183 - DNA, 121 bp, Artificial Sequence
  Synthesized
  misc_feature (61): n=a or g
cttaataatccacatgtcaattcggtctagcttttgcaacattacaggtaattgactagcngttcagtgagaggtgtcattccaagtttgaatttgcaataataattatgaaaatgataaa

SEQ ID NO: 7184 - DNA, 121 bp, Artificial Sequence
  Synthesized
  misc_feature (61): n=a or g
gtaaataccactctcaccaaggaaatcatatgggaagaacatggtctactttttgcgcatnggtagattatccttaaatacaacaattgtacttggaatttcatagaacttcttcattgtg

SEQ ID NO: 7185 - DNA, 121 bp, Artificial Sequence
  Synthesized
  misc_feature (61): n=a or g
ttcaaataaattaacccttgtggaaaggttagattttaatagattatcatcagaaatctcncgtgtaaggtaaggtagaaaaagaatggtgctttctaacacaatcagttcagattagtct

SEQ ID NO: 7186 - DNA, 121 bp, Artificial Sequence
  Synthesized
  misc_feature (61): n=a or t
caatattttcaatttgttaattaaaattaatatctcttcatgtgaaaggtagcttaaaaanaaggactttctctgtgtcagagacagtatggggggggggggaggacatgcaatatatttt

SEQ ID NO: 7187 - DNA, 121 bp, Artificial Sequence
  Synthesized
  misc_feature (61): n=a or g
tgctgctgggagctgtggcatggctttgctgaggactcctgaccagtcctccctttcccantggaagcccagccacactgacaacctgtaattgcactaaaactcattggcccaattagca

SEQ ID NO: 7188 - DNA, 121 bp, Artificial Sequence
  Synthesized
  misc_feature (61): n=t or c
agaatgatgtcactttctcatttcataatggacattttgcacaatttcagttacgttctcntaagcatttatttgcatctccactaaccatactggttgcatagatatccaccaggataaa

SEQ ID NO: 7189 - DNA, 121 bp, Artificial Sequence
  Synthesized
  misc_feature (61): n=t or c
atttgcccatcagttaaaggatttttggttactgctgccaatttttagctgcttcaaagcntggacaattcttttgtctcttcttcatcacggtatgtttgctgtgagtattggctaatcc

SEQ ID NO: 7190 - DNA, 121 bp, Artificial Sequence
  Synthesized
  misc_feature (61): n=t or c
atcattttccaagtaattctcttgttggacaccaggggtggggtgaggaggtctccattcnttaccatggagtcagcataagcctctctgtattttaatgcatctctgtattaactgtgtt

SEQ ID NO: 7191 - DNA, 121 bp, Artificial Sequence
  Synthesized
  misc_feature (61): n=t or c
gttccaaaatggctgtgattatcatgaagactctattcttttatatttaaatatacacctnttatggcggatgtgtttaggtgaagatctttaaggaatttgacttttctcttgttgtaag

SEQ ID NO: 7192 - DNA, 121 bp, Artificial Sequence
  Synthesized
  misc_feature (61): n=a or g
tgttttagtaaatggatcgttttcattaatttggttaactggctttcctcaaggtgagttntgaatgctgagatccaccttttctattggttaatttttccacacagcacctccattgatg

SEQ ID NO: 7193 - DNA, 121 bp, Artificial Sequence
  Synthesized
  misc_feature (61): n=a or g
tctggttttctttgttgaaaaaaaagttcagtatctgcaatttcttcttatttggttgacncttgtaagcaatagctgcattaccttaaaatcaccatgcacgtccctgttgtgaatgcta

SEQ ID NO: 7194 - DNA, 121 bp, Artificial Sequence
  Synthesized
  misc_feature (61): n=a or g
gatcctgtgtgacttcaggcacgctggtgctgtgaagccactgtaaccaccctgccatgantgcattcacccaaaggctttgatacgcttaaaaaaatacagagaaaaaaaaaacgaggtg

SEQ ID NO: 7195 - DNA, 121 bp, Artificial Sequence
  Synthesized
  misc_feature (61): n=a or c
tttacccaaccaataattgaactgccttagagtggtcctgtatccaagtggaagaaaaggntttttccagcctcacctctgactttcataggcttccactgctccttcagcataccttgtc

SEQ ID NO: 7196 - DNA, 121 bp, Artificial Sequence
  Synthesized
  misc_feature (61): n=t or c
tatgctttccttaagctgtaggtgctttttcacgtgcgaactgagtaggaaagaaatgcantgacggtactagcgggtcgttctgtgtgtgctcttcactctgggagttgttaccccagga

SEQ ID NO: 7197 - DNA, 121 bp, Artificial Sequence
  Synthesized
  misc_feature (61): n=t or c
ttttcaatatgataagtggcttaaagacaatagagaagagagatctgaaagcttgtacacngagatggaagcacagctgcacgagccttggttcttcaagaaagccaaaccaccaaaatat

SEQ ID NO: 7198 - DNA, 121 bp, Artificial Sequence
  Synthesized
  misc_feature (61): n=t or c
tctttcttacagtctgactctgagtgcattgaaaatgtccacacagcaataagtattctgngaaccaaaaagatttgtagttcttttcacttctcttcttccactagagtttccaaaatca

SEQ ID NO: 7199 - DNA, 121 bp, Artificial Sequence
  Synthesized
  misc_feature (61): n=a or g
aaaatttgtctccagcagcagcagcagaagcaccctcctgctgctccttttgcctactgcnaaaggacaaaaaatatataggcttgacctctgactgaagtgtttttacacttaaaaaaaa

SEQ ID NO: 7200 - DNA, 121 bp, Artificial Sequence
  Synthesized
  misc_feature (61): n=a or g
cattgctctacctacatgttacaatgaggacaaatgccctctcctctactacagaggcacncgtacgtgcaggtacattttagtggggagcccataaaacctcagaagaatgagcaaatga

SEQ ID NO: 7201 - DNA, 121 bp, Artificial Sequence
  Synthesized
  misc_feature (61): n=t or g
gatgaaaccttgtagcacagaacaatcagaggacttctcaactccagccctgcctgttttncagtttcacagctgcctaaaggaaaacacctttattggaagaaataccatgcagccatag

SEQ ID NO: 7202 - DNA, 121 bp, Artificial Sequence
  Synthesized
  misc_feature (61): n=t or c
gcatcatgttttatgatttatttcttaagagaaaattactggattttcttatggaatgacntttacttccctagttttattactgccaggaaatcttttaatcagaaacatgtaccttttt

SEQ ID NO: 7203 - DNA, 121 bp, Artificial Sequence
  Synthesized
  misc_feature (61): n=a or g
taactgaggatatccagattcaatacccattttcaaagaagcattctaattcgttctgtgngagaacaagactttcagggggggattctgtactctatggggctctccaccagcactaaca

SEQ ID NO: 7204 - DNA, 121 bp, Artificial Sequence
  Synthesized
  misc_feature (61): n=a or g
tagtgctatgaaagaggaatctgactattctttcctcttgctctgctcacaatgaggcccnatttgaatcttgctctccaggcttgctccctgaggggcgcaggacagccctgccaagcct

SEQ ID NO: 7205 - DNA, 121 bp, Artificial Sequence
  Synthesized
  misc_feature (61): n=t or c
atctcctcaagcaaaacaaccgaagtgtatccctttttctgagagtggcataaggttttcntaaaatgcaaatgtcatctaaaaaatgacatcctcctcccatgcactccttaacaatgtt

SEQ ID NO: 7206 - DNA, 121 bp, Artificial Sequence
  Synthesized
  misc_feature (61): n=t or c
tgtatacagtgacaagttcagtattcaaaagtagatacaggggaaaaagtgagaacacaangttactaattcttaaaagaaagaagatacaaagaatggattatgtcaactaaatcacaat

SEQ ID NO: 7207 - DNA, 121 bp, Artificial Sequence
  Synthesized
  misc_feature (61): n=a or t
atttcagcagcctttattattttaaggatgactctccctctgggatgaatggggtcatatntgacaaatcaaggctcgggtaccaggtgagattgtaatcacatgatgactgttatgcatg

SEQ ID NO: 7208 - DNA, 121 bp, Artificial Sequence
  Synthesized
  misc_feature (61): n=t or c
gaaatcatttaataaatatttctcgtattcatacttcagttttcatccatctcatgcttgngcctttctggactaatgtaagggacgcgtaaagtgaaagaactgcagctgatatttgcac

SEQ ID NO: 7209 - DNA, 121 bp, Artificial Sequence
  Synthesized
  misc_feature (61): n=a or g
aagcaaatctctgtctgacaagttaaactatatcctagcatgtgaaaactttgacacttcngaatataccctattaactcacagcatgaagataaagaaggagagttctccctaatgcagt

SEQ ID NO: 7210 - DNA, 121 bp, Artificial Sequence
  Synthesized
  misc_feature (61): n=a or t
ggaacacaggacaacattcagcccttcaactctgagaaggcatcaacagctcacagcctgntatctttaagacatggagtttgaaagtatttggattgctttctgcctcccaagataagct

SEQ ID NO: 7211 - DNA, 121 bp, Artificial Sequence
  Synthesized
  misc_feature (61): n=t or c
tgtttgggaaggaaacgtctcctgtccctgagtgtcccagcctcttccaagagcaatgaancagccccgccagcactctgactccacagtggggacgtccccgagccctgtggtcctggga

SEQ ID NO: 7212 - DNA, 121 bp, Artificial Sequence
  Synthesized
  misc_feature (61): n=a or c
tttatcagaatacctaatagaagcttcagtggaggtcagaactagtgaacacatgaataantataatacactagggaaaagtcaaagctgtctttgtgaaaagaaggtctgctttacaaaa

SEQ ID NO: 7213 - DNA, 121 bp, Artificial Sequence
  Synthesized
  misc_feature (61): n=a or g
tatcacagatgtaagaagcagatagactcctttgtggagtaaaaccatttgagatagtagnagctactgaccacaatgcaggaaccacatgggttgcattggaatataaatttctcaaatg

SEQ ID NO: 7214 - DNA, 121 bp, Artificial Sequence
  Synthesized
  misc_feature (61): n=a or g
atttttggagacaggaggaccttcctatgctgtgctaccccgtgctgtcaggtggtggccntcacttcccaacccaacactgccacaagcagttgcaaacttgcagtgcagcaagagatta

SEQ ID NO: 7215 - DNA, 121 bp, Artificial Sequence
  Synthesized
  misc_feature (61): n=a or c
cccttctggcagtctgcacttgtggtcatcctgggaggactcacggtccttctctcttcanccccggggctttcaccactgaactgaatatggcttgaggtttccaggaggtcaggacgtg

SEQ ID NO: 7216 - DNA, 121 bp, Artificial Sequence
  Synthesized
  misc_feature (61): n=a or g
aaggtcagaagggttctggttgcattgcagcctgtttcttacactaaataaacacctgcangttatgtcaggcaggacttagctgctctgcaaggaaatgctgcaggatttcaacaccatg

SEQ ID NO: 7217 - DNA, 121 bp, Artificial Sequence
  Synthesized
  misc_feature (61): n=a or t
tttctattgtgttcttttttaatcttagaagttggttaggctcagtattgctgttgaaagngtgtgacacttgagagaagtgtttgtgaaaggctgcggttggtgaagtacagctcatcca

SEQ ID NO: 7218 - DNA, 121 bp, Artificial Sequence
  Synthesized
  misc_feature (61): n=a or g
ttattggcttattggagagcgtatagagtaaagcttgatcaaattgtttgtgtataaagantggcagggcatgtaggaaatggagttgtactgaagaaaaagtatgttggtgtgggaaaac

SEQ ID NO: 7219 - DNA, 121 bp, Artificial Sequence
  Synthesized
  misc_feature (61): n=t or c
gctgtgataagaagtctgcttgtgtttttgtacctttgggtttacaagggagttgatgtcnttctcctggcaggtgtgtgtgcttttctggaagaaatcgctggagaggattggtaactac

SEQ ID NO: 7220 - DNA, 121 bp, Artificial Sequence
  Synthesized
  misc_feature (61): n=a or t
tttgcttttatacccagcaactctcatgcaggagcacctggcataatctcagacaggaaangttacacctgagaatccaaattctttatgggcttttcgttttttttttttcaattgcact

SEQ ID NO: 7221 - DNA, 121 bp, Artificial Sequence
  Synthesized
  misc_feature (61): n=a or g
atatatattttcatacacacatccttcagttaccaaataaaggaaatcattcatagaaatnagtaacaataatcatagcttgcagaacagcagcgaatacccttagaatggcctacaaata

SEQ ID NO: 7222 - DNA, 121 bp, Artificial Sequence
  Synthesized
  misc_feature (61): n=a or g
tttgctaactgttaagacagcctcctagggaggaagaagatggcataatgaacctcctcantcaaactaaactcaggagcacaggatcttccttggtaagtgctctcaccactggtttgga

SEQ ID NO: 7223 - DNA, 121 bp, Artificial Sequence
  Synthesized
  misc_feature (61): n=t or c
ccccatctgctgcctcctggaaatgcagaggtggggcccttgaaatcctgcctcttcccangagtcagtcatcctcccctattgccagttgcccaggaatggggcagtgctcaggcagttt

SEQ ID NO: 7224 - DNA, 121 bp, Artificial Sequence
  Synthesized
  misc_feature (61): n=a or g
ctgtctctgaccagtggtcaaggctttccttacgggtagtttctggcaccccacgctcatncctctttcccttttcctgacagataaaagaactctttgtgagttttgaggacacgccttt

SEQ ID NO: 7225 - DNA, 121 bp, Artificial Sequence
  Synthesized
  misc_feature (61): n=a or g
ttgtctttcatcagtgattgcctgatccctcatatgaggcttcagaggctacatgctacancagtttgggtgtgacagaagaattaatttaagattgcatatctctactattttgttgatg

SEQ ID NO: 7226 - DNA, 121 bp, Artificial Sequence
  Synthesized
  misc_feature (61): n=t or c
ccaaccctttaaatatgaaaagcactctctaatgcaagtatcctacgagtgtctcatcacnagattacaaaatcatgtttgttattctttctttaatccaatgaatcttaattctttcctt

SEQ ID NO: 7227 - DNA, 121 bp, Artificial Sequence
  Synthesized
  misc_feature (61): n=a or c
ctagtacatcagtgtatcttgaataccttgtaaaagaccttatagtactagctggactcantaatcctcctgggtctgttccaacacaggatctactatgattctacctggggatgtctca

SEQ ID NO: 7228 - DNA, 121 bp, Artificial Sequence
  Synthesized
  misc_feature (61): n=t or g
gtgtcttcttgcatgtagtgacttgcattttcctcttcctgttaagctatcaaagccattntaaaaatatgacgtagagtttacagacttccctagcctggggctgtatgtagccttgcaa

SEQ ID NO: 7229 - DNA, 121 bp, Artificial Sequence
  Synthesized
  misc_feature (61): n=a or g
agaatcagtctttgctgaaatgcacactccacttgttgtaagcaagcaataacgcttgtantaggaaggttactggttttatctagagatgtatttttgttttgcatgtgtgtactggttc

SEQ ID NO: 7230 - DNA, 121 bp, Artificial Sequence
  Synthesized
  misc_feature (61): n=a or c
attcaactaaatgtggggatggaaaaagctctctctaatcatctcttggttgaaaactatntgcaactttggttttgtttctcttgaccagaagacagaactcgctgtagttctgcctgca

SEQ ID NO: 7231 - DNA, 121 bp, Artificial Sequence
  Synthesized
  misc_feature (61): n=t or c
tgttcactacctgaactaactcatttcactacctgaaatgcctcaagatgagtctgaaggngctatgctggaccttgtccacaccaacaagaaggggctggtgattaatgtgagtttcaag

SEQ ID NO: 7232 - DNA, 121 bp, Artificial Sequence
  Synthesized
  misc_feature (61): n=a or g
taacttgaacatcagagaaaaaaaaatggacaaccatcttcatttccagaactaaatcacngagaacaataatctgagtattttacttctttcaaatccagaactgccattctggctgcta

SEQ ID NO: 7233 - DNA, 121 bp, Artificial Sequence
  Synthesized
  misc_feature (61): n=a or t
aaaatatgagattgtttgataccctcaggactggatccctgatcactaattcttgctagtntatattttcttgctgtagttattataggtgtacacttttagaaaattgtgtctactctcc

SEQ ID NO: 7234 - DNA, 121 bp, Artificial Sequence
  Synthesized
  misc_feature (61): n=a or g
attcaaagatgcttatcctttaaagatacatcatccaaacagcctgcagtgctcctaatgnctggaacatgcatgtatgcttataactaaaaggactggttttaatgctcattgaagatgt

SEQ ID NO: 7235 - DNA, 121 bp, Artificial Sequence
  Synthesized
  misc_feature (61): n=a or g
aactgaagtaatttacaaatgaccaagagctgataactcatggaagatgcccagacagccntgtggttagtgtgctatacaaggtttcattttcaggacgattactcttcttgattttcag

SEQ ID NO: 7236 - DNA, 121 bp, Artificial Sequence
  Synthesized
  misc_feature (61): n=c or g
ggaaggatacttcataggtatgctctgagagcatctttgcatttgagcaacaagaggactntatggggctcatcatttggaaaaccaaagacagcagtcgtggcatgtgcctaattttatt

SEQ ID NO: 7237 - DNA, 121 bp, Artificial Sequence
  Synthesized
  misc_feature (61): n=a or g
ctatccagtgatctaaccaacattcccagaaaatcatcaaaatctgcaaaaatatcctgcntatgtgaaacgaataatttctgttattttacatttcctgataatatttctcctcctgctg

SEQ ID NO: 7238 - DNA, 121 bp, Artificial Sequence
  Synthesized
  misc_feature (61): n=a or g
tactagatttataccaatatatgcttggtttcacaatgtgaccataacgatctttcctacntccaacattggctcatttcaatggaatgctttcttcctcaatatctcaagtctactccat

SEQ ID NO: 7239 - DNA, 121 bp, Artificial Sequence
  Synthesized
  misc_feature (61): n=t or c
gttattactcttttaacataattcttctttggaatccctcaattggttatggtgaaataanagctttacctttcagccaggcaccaaactccttcatgtctccagtgatgtacccaacagc

SEQ ID NO: 7240 - DNA, 121 bp, Artificial Sequence
  Synthesized
  misc_feature (61): n=a or g
gccaacagatgtcatggggaccacgacggctgtctgcctggacactgcctggtacaaacgncccaaagcacatgcccttaggtgctgacacaatttctagagcaggagcttttcagatttt

SEQ ID NO: 7241 - DNA, 121 bp, Artificial Sequence
  Synthesized
  misc_feature (61): n=t or c
caggaaatgcaaaaatgttctggaccaaagcattgcactttgcacagctccacaggagcgngggcagttgcatgcccaggggacttcttcattacatgctacacacagtgtcactccaatg

SEQ ID NO: 7242 - DNA, 121 bp, Artificial Sequence
  Synthesized
  misc_feature (61): n=a or g
gttgtgaactgcagggagtcagtctgccaacctgagctgtgttagaagtatggaacagctntatgttatcttactgctggcaccaaactgtccctgctgtgtcagctgcccccatggagag

SEQ ID NO: 7243 - DNA, 121 bp, Artificial Sequence
  Synthesized
  misc_feature (61): n=a or g
cagagtgaaagagcagccgggtgggtgtctggcatctcaccacagctataatccagatccnaactgatctgggcttctgacctaaaggtgctgatgtttgttgctgttggtaatgtttagc

SEQ ID NO: 7244 - DNA, 121 bp, Artificial Sequence
  Synthesized
  misc_feature (61): n=a or g
aaacataacacacttggtaaaatttatcctcacaggcttaagtgagaaaagagcccagganttggtaaaacgagagctctccccagggaaacactccagacaggacaggacagatttagct

SEQ ID NO: 7245 - DNA, 121 bp, Artificial Sequence
  Synthesized
  misc_feature (61): n=t or c
aaggaagcctgaaaactcataggataaagcagcgatgttgacgatagttgaatgtttgggntcatcctgccacagttctcaaggggagaacgttaggaggatctcttgtggagctccagta

SEQ ID NO: 7246 - DNA, 121 bp, Artificial Sequence
  Synthesized
  misc_feature (61): n=a or g
tgtattttcttcaataaagactactgtgtatttattttgtggagctgtcttttaaattccntcaggaatagctgatctactgcacaaagtaactctgccagagagatcattttgtctttct

SEQ ID NO: 7247 - DNA, 121 bp, Artificial Sequence
  Synthesized
  misc_feature (61): n=t or g
gggggctcagggatggagaaaaacaagttctgccgtctgtgggccagagagtgcaccaatntgatgcccttaaagctggcttgtgagctcatggggtgccagcagcagtgccgtggggtga

SEQ ID NO: 7248 - DNA, 121 bp, Artificial Sequence
  Synthesized
  misc_feature (61): n=a or c
ccacagtagaatcaacttgttgaacagattatgactcaataggtttcactatttgaaatgngtacccattcattaatccacatcaaaaatacccccaaaccaacacttgctgaccaagtgt

SEQ ID NO: 7249 - DNA, 121 bp, Artificial Sequence
  Synthesized
  misc_feature (61): n=a or g
aaagtgagagctggtacagttgcctacaattttccacagctttctggcctattgtttttgnaagctgatgatgtgaacaggaacacaaaggtgtgatgtcaacacctctgcaatggcacat

SEQ ID NO: 7250 - DNA, 121 bp, Artificial Sequence
  Synthesized
  misc_feature (61): n=a or g
cagagaatttaggacttgataattggaatacctttcaactcaggacttctacctgactgcnaaaacttttgctgttgattgtagctaatttcccaagagctgaaataccatcttacgacta

SEQ ID NO: 7251 - DNA, 121 bp, Artificial Sequence
  Synthesized
  misc_feature (61): n=a or g
aattatgtgatgtgtttgcagtatcattgtggacatctgcactcagattccaaacatttgngtaagccactgccttgttcaagacgaatgctcttttctctctctgcttgttaaaatacat

SEQ ID NO: 7252 - DNA, 121 bp, Artificial Sequence
  Synthesized
  misc_feature (61): n=a or t
atgagagggcacgagaacctgggaatggacagaacctaaaccgatcaacgggatattccanatcacaggacatcatgcaaaaaacaaaaacaaaaacgccataaaaaacagcaaggaagtg

SEQ ID NO: 7253 - DNA, 121 bp, Artificial Sequence
  Synthesized
  misc_feature (61): n=a or c
tcctgaagttgaagcaatagcaagcagcccactttaccaaaagaattgcttagaaaagccntgcctgtgccccttgcagcacaattatcatatgagcaggtgtgcttgtgtaaaccagaga

SEQ ID NO: 7254 - DNA, 121 bp, Artificial Sequence
  Synthesized
  misc_feature (61): n=a or t
ggcactgtatcttccattgcaagacataacttcccaaaggtcacagtccttcaaatttgcncactaagttgttccagcaccaccctttggcttcaataaactgcctgcctccttaagcgct

SEQ ID NO: 7255 - DNA, 121 bp, Artificial Sequence
  Synthesized
  misc_feature (61): n=a or g
atgttcacaaacggccatgaatatcaacgggagccattgtttctgcaaggcggctttctcnaaagcaaaccgtggcactgtttgctattacacagcctccacttaccaggaatacctgcaa

SEQ ID NO: 7256 - DNA, 121 bp, Artificial Sequence
  Synthesized
  misc_feature (61): n=a or c
tgtggtgaaagaacagtgctaaaggctattgccagttttgttttcctgtgtcaatccttantactttccttttcctgtctatatggaagtaagcagtgacatctactctgcttgcctttgc

SEQ ID NO: 7257 - DNA, 121 bp, Artificial Sequence
  Synthesized
  misc_feature (61): n=a or c
caacacaccagctgcagagataggattacagaatgttgatccctttctccaccatttcaantgtttatttaccaaaattctctcactaatcctctttgctgtgtttactttgcacttcact

SEQ ID NO: 7258 - DNA, 121 bp, Artificial Sequence
  Synthesized
  misc_feature (61): n=a or c
agatgggactgggtgaaaaggcccttctcattcctttctgggagaacagttctgtttcagnagctctatcacatggaacattcttattctgaagacatactcagtgggtttctgaaacggt

SEQ ID NO: 7259 - DNA, 121 bp, Artificial Sequence
  Synthesized
  misc_feature (61): n=t or c
gcttctagagagtgaacatcctgtgttgtgcagcagcacccggaggctgagggtgggattngggttcaccttcacacgcagtgtgtgctgtgccagcagtccgccatcactggaagggctg

SEQ ID NO: 7260 - DNA, 121 bp, Artificial Sequence
  Synthesized
  misc_feature (61): n=a or g
tctatagttcttaagtcccaagagcttcagtgcacctttgaaatcttcagggagcttactnatttgtcagatatgtatgacataccaagttcaataatgaaacaagtcagaattcatacac

SEQ ID NO: 7261 - DNA, 121 bp, Artificial Sequence
  Synthesized
  misc_feature (61): n=a or g
cagcactgtgggggaggaacattagggtctgtgctaatgtgagactgaagagtataacaantcagtgcatagctgagcacctcacatccagcaggagcatcccaatggcaagtggggggtc

SEQ ID NO: 7262 - DNA, 121 bp, Artificial Sequence
  Synthesized
  misc_feature (61): n=a or g
aagcaattcttgagaattctgacaaatgggcctctgatggcttttgtgaaaaatagtctgnaaataaccatttgtgcactgtgtcagagtacattttctgactgagatctgcatgagcagt

SEQ ID NO: 7263 - DNA, 121 bp, Artificial Sequence
  Synthesized
  misc_feature (61): n=a or g
attgtgttctttggtggcaattcattttctcaaacagctattggacttcacacacaacttncagaatatgcccaaactgtacagacaatacagaaagtggggctttctaagttctcttaag

SEQ ID NO: 7264 - DNA, 121 bp, Artificial Sequence
  Synthesized
  misc_feature (61): n=a or g
atctgcggagtttaatccatttaattaagcagcaaaacaatggaaaggtgatttaataccntgtttgtgcgtgcgaaagaaagcagtgggtatcaaaggaaccgttcattaagtgaagcaa

SEQ ID NO: 7265 - DNA, 121 bp, Artificial Sequence
  Synthesized
  misc_feature (61): n=t or c
tgggagagagggctgattaatgctaagtaactcataccattatttcattatttacgatccngaatacaaatactgtaaacagattttaaataggagatcaagccaattttttgattactag

SEQ ID NO: 7266 - DNA, 121 bp, Artificial Sequence
  Synthesized
  misc_feature (61): n=a or c
tacagaaggcagattcactctcttctttgccttatgttttatcttaatgttcttgactttnttctacagacaaaccagcagaagcagtattaagacaggcagtaaatgactgcattattca

SEQ ID NO: 7267 - DNA, 121 bp, Artificial Sequence
  Synthesized
  misc_feature (61): n=t or c
acatgagatctggatctactaggatataagttctgctactttaacctatgtgaacattatngtaatctttcagcaaagtaccttgccttccaggtatcccatactttacagaaaccagata

SEQ ID NO: 7268 - DNA, 121 bp, Artificial Sequence
  Synthesized
  misc_feature (61): n=c or g
tgtgactgcagatgcccaaacctgaaggggataaagccacaggaccacctccttcccacanatcaggggtctttaagatctctattgtttcccaccgtttagtaccagcagtacaattctt

SEQ ID NO: 7269 - DNA, 121 bp, Artificial Sequence
  Synthesized
  misc_feature (61): n=c or g
aatttcttgtcatcgcaacagcttgacttacctttgtcatcttaatgcattgcactcagangttggtaggtttaaaaaaacccaaggtgctctccccctcccggcctttcagacataattt

SEQ ID NO: 7270 - DNA, 121 bp, Artificial Sequence
  Synthesized
  misc_feature (61): n=a or g
tttgtttctctctacgtatcaaagcatggatagctcattcatttctttctcaaaataagcncattaggatatctgaagaaactttttaatgattcccacagtatgcactctcccactcaga

SEQ ID NO: 7271 - DNA, 121 bp, Artificial Sequence
  Synthesized
  misc_feature (61): n=a or t
tggtcgtgacaggcaaaggcaggacattccatcaccacctggacacggaggtgctatgtgngaagcccagattgctttacagtactgtatgcagacaaaaaaaagagaaaccagacgtccc

SEQ ID NO: 7272 - DNA, 121 bp, Artificial Sequence
  Synthesized
  misc_feature (61): n=t or c
tcccagtgcagcagtcctactggcttcacatctctgcaaaacaggatggggagcgagtggncacagctgccacactctatcctttcagggcagcagcaaaatcatttaaaggtatagatct

SEQ ID NO: 7273 - DNA, 121 bp, Artificial Sequence
  Synthesized
  misc_feature (61): n=c or g
acaatccaagtcatagagacacaagcttactttggaacatcccaccacattcagggcacanacactgactccagtcatgccagtccaaacccccatgctgtttttgcacacacacagggaa

SEQ ID NO: 7274 - DNA, 121 bp, Artificial Sequence
  Synthesized
  misc_feature (61): n=a or g
gtggcctactgcagttgagccaacccctttgatatatagggatatatgtttgcacatggcnatgcatccacctacaaagaccgaggagcaggaccacagcctcattctcctctctcctctg

SEQ ID NO: 7275 - DNA, 121 bp, Artificial Sequence
  Synthesized
  misc_feature (61): n=a or g
agatgtgcaacctgttacagtgtttttctctagaaacacagcacctgtttggtttaggagntgaggacatgggcagggttgtacaggacctattttgatctagggaaggagaagagggtcc

SEQ ID NO: 7276 - DNA, 121 bp, Artificial Sequence
  Synthesized
  misc_feature (61): n=a or g
aatgctaaactatagctacaaacctagaggtgctgggtaatttaatggcatcgtgtgctgntgcgtgggtttaaggtggacagcagaaaatagttgggagacagcaatcaggctgagggag

SEQ ID NO: 7277 - DNA, 121 bp, Artificial Sequence
  Synthesized
  misc_feature (61): n=t or c
catcgcgccttcccagtccaagcttagacaaggcttaagaaaaggcaaattcctaaactgngttatgtttacaaacgtttattctcaaacctcaacaaaaacagcggaattttctatcgaa

SEQ ID NO: 7278 - DNA, 121 bp, Artificial Sequence
  Synthesized
  misc_feature (61): n=t or c
agctctcaccaggacctgagtggtaaaatctgatcctgattgggggccatccttttatttnctagctggcagctgctcacgcacacagcacagagcagcagcatggttgattgttttgcct

SEQ ID NO: 7279 - DNA, 121 bp, Artificial Sequence
  Synthesized
  misc_feature (61): n=t or c
ttaccctgtggatcagatgtagcatgctgaaagcagagcaggcattggttaaatgttatgnatgatatactacctaaccttgaagggtactaagatcagtggatccattcttcttgttaag

SEQ ID NO: 7280 - DNA, 121 bp, Artificial Sequence
  Synthesized
  misc_feature (61): n=c or g
cactgggtttgtgaattgcagcacaaagactgtgagaacagttctgtggcagttactttgntgcatagtttcttctgtacgatttataaataacagtaccaaagctgggcttttgcttttc

SEQ ID NO: 7281 - DNA, 121 bp, Artificial Sequence
  Synthesized
  misc_feature (61): n=t or c
agcacacagcaccacgtgaactgcagctctgtcacttccagagcaagttctaactctttcnttaagccctgacctcccatgaatgccaaccagaggccgttccctctgagcagcaccgtta

SEQ ID NO: 7282 - DNA, 121 bp, Artificial Sequence
  Synthesized
  misc_feature (61): n=t or c
agcactcttttcttacattttacatctaaaaactattctttctaatcctgaatgaagattnattgctatgagtaatttatcagtaaatacttccgctgaatacgtggaaattaacatctca

SEQ ID NO: 7283 - DNA, 121 bp, Artificial Sequence
  Synthesized
  misc_feature (61): n=t or c
cctgatagcataattaatggatttgccttaccattaaaagaagagcacaaaatattcttantgaaggttttgttaccactgcacaaagtgaaatcactcagtgtttaccatccacaggtaa

SEQ ID NO: 7284 - DNA, 121 bp, Artificial Sequence
  Synthesized
  misc_feature (61): n=t or c
tccatcagcacaacactgtgattgtcttgcaatcaagatcctaaggatggctgcccagggngctgctctctgtttgcacacatgcacccaaagccaaatggagaacctcgagtcccagctc

SEQ ID NO: 7285 - DNA, 121 bp, Artificial Sequence
  Synthesized
  misc_feature (61): n=t or c
tacgttcagctttccctacttctacagaggcgcatcgttcaccaaggagcaaagggatccnacaacctttctcacccttacaggcccaaagcacaaattcaaggcttcagaaagacctctt

SEQ ID NO: 7286 - DNA, 121 bp, Artificial Sequence
  Synthesized
  misc_feature (61): n=a or t
atctataactgagccgctgaaatagaattggattatttcttgtcaacagaaaaggcgtttncccagctttgcaggaatggccatttaaggtgctccaagtctttctgtggaaaacacagaa

SEQ ID NO: 7287 - DNA, 121 bp, Artificial Sequence
  Synthesized
  misc_feature (61): n=a or g
aagcagttgtagacataggaacatgctcaactttttaattcccactgcagtggctgttccngtcagtacaaccccagtgcacagcttccagagagggcatcattgcaaacagtggttcgct

SEQ ID NO: 7288 - DNA, 121 bp, Artificial Sequence
  Synthesized
  misc_feature (61): n=a or g
ggggtgaatttcctcttggtgctcttgagggctctcctggagacgtggccaagcctgagtnccaccaaggacatgtagcatctccctgagggtgctggaagggacagtggtggaaagtctg

SEQ ID NO: 7289 - DNA, 121 bp, Artificial Sequence
  Synthesized
  misc_feature (61): n=t or g
ctcccactgtctgcaatatatttgaaaacactgctcagcatagctgataaactctatttanttcaaattactgcccttttttaaggcatgcattggatgattattttttttcttcttttct

SEQ ID NO: 7290 - DNA, 121 bp, Artificial Sequence
  Synthesized
  misc_feature (61): n=a or g
gctcaaaggagtggggcagagccggctcacctggctacccaacagttcagtgaacaaagtnggcagaaagcaggcaggaggctcagcaaccctgcatggcagccccagacacacctccatc

SEQ ID NO: 7291 - DNA, 121 bp, Artificial Sequence
  Synthesized
  misc_feature (61): n=a or g
aatagggctgtgagtgactccagctgctgtccctttgcaggcaaagccttcctgagaacanttcttctggttcaacatgcaccaatctctgaagcatcattagctcccctgctgtagggct

SEQ ID NO: 7292 - DNA, 121 bp, Artificial Sequence
  Synthesized
  misc_feature (61): n=a or g
cctcagttgttgctaaaacaaaaatagcactgtgtttagtatacttagcaaggtataacantgtgggagtgctataaataaatctgtttatttaaagttttagtgccatccgtatttctta

SEQ ID NO: 7293 - DNA, 121 bp, Artificial Sequence
  Synthesized
  misc_feature (61): n=t or c
ttgctttattctctcccaaactcccactgacttcactggggttccgcggagatatttcgcnctctgaatgcaacaagtgaattcgagttgtattccaccctgcactctcccttcactgtta

SEQ ID NO: 7294 - DNA, 121 bp, Artificial Sequence
  Synthesized
  misc_feature (61): n=t or c
gctttagagaccttgtagtggttattttttgaagtcacaaattgctctggtcatcccctanggggaaaaggatggcaaacagcagatattgctttaaatgtgcctaatcttgcttagtttt

SEQ ID NO: 7295 - DNA, 121 bp, Artificial Sequence
  Synthesized
  misc_feature (61): n=a or g
taacaatagcaagacagagccttttagactgtgagtgaatttgcaatctgatcacgtactntatgcctttgaaaagaaggaaatacagagacaaagacagaatgtgatagaattttattta

SEQ ID NO: 7296 - DNA, 121 bp, Artificial Sequence
  Synthesized
  misc_feature (61): n=c or g
tcagcaggcagcggtttgtgtactgagcagcaaacaggaataagagccgtcaccaatgaanctcacaaacatccagccgagggccaagaaagttctttcacggcaaacccaatccaaccac

SEQ ID NO: 7297 - DNA, 121 bp, Artificial Sequence
  Synthesized
  misc_feature (61): n=a or g
agccttgcccctgacagcaatgtccagggataacaaataaatcgccatcattcaggtgacnccagtaggacttactttctcaaacagaagttaggttcctaaatacacttagaggtgggag

SEQ ID NO: 7298 - DNA, 121 bp, Artificial Sequence
  Synthesized
  misc_feature (61): n=t or c
aagtccaggctgaggggactgccaggcagagccagccagggtgcatcgaccctgctggcancgaccttgctcggctgcttgggtggtgacgctgagcattgggttggaattgctgggtttt

SEQ ID NO: 7299 - DNA, 121 bp, Artificial Sequence
  Synthesized
  misc_feature (61): n=a or g
ttattcacatttttgttggcagtcttctataacgaggtagaaactctgggatattctggtntatttgcctacagatgccttgaaacagaaacaggagaggaccagaattatatatgttaca

SEQ ID NO: 7300 - DNA, 121 bp, Artificial Sequence
  Synthesized
  misc_feature (61): n=c or g
gaaagacctctacagtcatcagtgccagagagaagggtccaacacaaacccatcttgaaangatcgctgagagaataaatgggagctatgaagagctttgggtgtggatcccagctgctcg

SEQ ID NO: 7301 - DNA, 121 bp, Artificial Sequence
  Synthesized
  misc_feature (61): n=t or c
cctggctactcaggggctggaggcacacagacaccctgaacatttaagtcaaggctaaggngatttcttcttataattgtttcagactaaaccagcaaacaacataaaatacttatcctaa

SEQ ID NO: 7302 - DNA, 121 bp, Artificial Sequence
  Synthesized
  misc_feature (61): n=a or g
atgtaaagttagcactgtcgtaacttaaagaaatagtaatgaatgctgactgtagaggtcngaaggtagctgctctccacataaatggcacagtgataataggaatgaactggaagacttg

SEQ ID NO: 7303 - DNA, 121 bp, Artificial Sequence
  Synthesized
  misc_feature (61): n=t or c
ggtggggagaatttccacacctggctcagagtcttgatcagcccctcattcttggtttagngctgtaggcagctgctgtgaaagccagcactgcactggctgtcgtttgccctgaaatgag

SEQ ID NO: 7304 - DNA, 121 bp, Artificial Sequence
  Synthesized
  misc_feature (61): n=t or g
aaaggaaaaaattagtagtcagatgcagatggtatacataacctttgtgttgctagatgtnatatacaacgtttcccagagttttcaaggacagatttttttttttttctgttagacttca

SEQ ID NO: 7305 - DNA, 121 bp, Artificial Sequence
  Synthesized
  misc_feature (61): n=a or g
ccataattgtatagtaatcttcaagcaagtagaagtatgtataaccttccctacataacancagaaggttagcatacctttcagcttctaagtagcattcatgcttggcagctgtgttgag

SEQ ID NO: 7306 - DNA, 121 bp, Artificial Sequence
  Synthesized
  misc_feature (61): n=t or c
taaattcacttgagagttgctctgcttttctttttactttcactgctggccaagccttgcnggtgtttctgaggctgaacttgtgggcacagaggatgctgtgcagggtggggctcctggg

SEQ ID NO: 7307 - DNA, 121 bp, Artificial Sequence
  Synthesized
  misc_feature (61): n=t or c
atacaagtgaggctgaaggctgcagtgctcctatcttcctttcagacagcacaattgatgngctggcctttctgaaagcaccacaagatggctgtgttttatacatcaattttgcaaggac

SEQ ID NO: 7308 - DNA, 121 bp, Artificial Sequence
  Synthesized
  misc_feature (61): n=t or c
agagaaataaagagcagtcaaaacctggcctctcactgtttgctcaatgcagaatttcagnatgttcctctgcgtacgttaaggagaaacttcaaatatacctactcaactacttacacgg

SEQ ID NO: 7309 - DNA, 121 bp, Artificial Sequence
  Synthesized
  misc_feature (61): n=t or c
caccagcagggtcccacctccacccatcactcccaagcacacgtaggagaacatccatcanttatgcagggaaagcatcttcagttccagtgctgggttcccacttgctgtagtccctcca

SEQ ID NO: 7310 - DNA, 121 bp, Artificial Sequence
  Synthesized
  misc_feature (61): n=a or g
cctgttgtctgcaaaccagagccatattttagttaaaagctacctaaattggctcagcaancctctgctctacaaatgcaggaagatcttgtatgaattacctactgaagctaaatgagca

SEQ ID NO: 7311 - DNA, 121 bp, Artificial Sequence
  Synthesized
  misc_feature (61): n=a or c
tccaaccaggtaatggagtagctctggggaatgcagtcattcagtgtcatattttgctggnagcttctgggtcatggtaaatacaaagaacactcaaaaggatcacttgcattagaagtca

SEQ ID NO: 7312 - DNA, 121 bp, Artificial Sequence
  Synthesized
  misc_feature (61): n=a or g
tttttaataacagtaatccactgcttgggtatatttttgtagtgcacgtgctctgtggctnttaagccacttccattgcctagaatgtctgaagatgcagtaatccaattggagtaaccat

SEQ ID NO: 7313 - DNA, 121 bp, Artificial Sequence
  Synthesized
  misc_feature (61): n=a or g
gtatttttcacttagctgatattttggtgggagttctgacaaaatatttcagaagcaagcnagtaataggggcagatagctcaccagaaagtcaaagctagtcaatctgtagcactaagaa

SEQ ID NO: 7314 - DNA, 121 bp, Artificial Sequence
  Synthesized
  misc_feature (61): n=a or g
gttgttcttctgagagaagtactgtgaatcccaggagatagagccaagcaagcgatgcacntagcaagcactgttggtcttagtgatacactgaacagtgactgcacctgtgcctttctct

SEQ ID NO: 7315 - DNA, 121 bp, Artificial Sequence
  Synthesized
  misc_feature (61): n=a or g
attttaaaattccagtccagcaagaggtttgtgcacctcctgtagcttgcatgttttaccncttgggcattcagagagcattaggagtttaaattattgtaattcagacatttattccagt

SEQ ID NO: 7316 - DNA, 121 bp, Artificial Sequence
  Synthesized
  misc_feature (61): n=a or t
gtgcctggagaatgaagtgtactctccgagttgagggaagcagtatggtaacatcttgagngagagaacactgcattttttgaattgttacgcattggatttttctctggactcacacaga

SEQ ID NO: 7317 - DNA, 121 bp, Artificial Sequence
  Synthesized
  misc_feature (61): n=a or g
agcagaagcttttagaaatttgctagagagaacacataggagtgcaggaaatgaagtgccntagtgctcctcccaccaatccggattttcctcaaatcacagacagtcctgcttaagagac

SEQ ID NO: 7318 - DNA, 121 bp, Artificial Sequence
  Synthesized
  misc_feature (61): n=t or c
atgtctacagaaaagtttctttcattttctcagtgtctctttcctactactgagaagtccntaacgagacttcctgcacagacaaggaacagtcaagcttcacctttaagagatttaccca

SEQ ID NO: 7319 - DNA, 121 bp, Artificial Sequence
  Synthesized
  misc_feature (61): n=t or c
ccgatgtgtttgcccatcactgcctgtgctggtagggtggctgggagcaaacctacccaanggagccccgccaacccctgaagctttgcaactagataatattactgcatgcttgttgaat

SEQ ID NO: 7320 - DNA, 121 bp, Artificial Sequence
  Synthesized
  misc_feature (61): n=a or g
taatccaaaatgcttgatttttttgatacacaggaattctctttaaacctatcttcacatngttgttctttcaggcatcacacattcgtggaaatatttttaaatattaaatatttattta

SEQ ID NO: 7321 - DNA, 121 bp, Artificial Sequence
  Synthesized
  misc_feature (61): n=a or t
cttcagagcacaaattgtgccaggcttcaaaagctgtatgagcgtgcttagtgcaagcctngtaaatggataaagagaggtatgccatggaagttagtgactttggaggccaacttgatga

SEQ ID NO: 7322 - DNA, 121 bp, Artificial Sequence
  Synthesized
  misc_feature (61): n=a or g
agtgatttttttttttttttttgaggtttggtagttgtaacagttaaagttgaattgcccntagtgtttgaagctgatggaacttagactgctgaagcaatcttttcaccacattgctgta

SEQ ID NO: 7323 - DNA, 121 bp, Artificial Sequence
  Synthesized
  misc_feature (61): n=a or g
ctgtgctaattgcagtggaagatctcagggcagaaggctgcgggcatgctgacttgtttgnccagatcctctgcccctgctttgggtgtgccttttctgtgcacgggctgtgggtgactgg

SEQ ID NO: 7324 - DNA, 121 bp, Artificial Sequence
  Synthesized
  misc_feature (61): n=a or t
agctattccggatctttcatatgcaacaagtgctttttaggttgttgtacagatattagtnataaggcagcttcagtagttcacccattctttcatcttcctggggaagtgtttctcagca

SEQ ID NO: 7325 - DNA, 121 bp, Artificial Sequence
  Synthesized
  misc_feature (61): n=a or g
gcatccttacctttgtaggctgcttggcatgctgaactccctctggctccagctgggaggngacttacaattgagtcgcattatggatattggaagagatctgctgctgcctgtacagagg

SEQ ID NO: 7326 - DNA, 121 bp, Artificial Sequence
  Synthesized
  misc_feature (61): n=t or c
caaatgctctctctcttacaaaaaaagaaacatctaaataaacagcaaaacaaaataaccntattagttgtcatggaaaattcgactgctgtatgaataaaattacttctgcatgagttag

SEQ ID NO: 7327 - DNA, 121 bp, Artificial Sequence
  Synthesized
  misc_feature (61): n=c or g
actgaatgcttataaactgactagtttatcatagatttactacagtatgtactggacactntgaatgaagcacttgatgctgcaagtgaatcaatatcagtgtatacagccactggagcag

SEQ ID NO: 7328 - DNA, 121 bp, Artificial Sequence
  Synthesized
  misc_feature (61): n=t or c
tgcatctagtcatcaccacactgttatctagagaaggggaatgccattttgttatttaacntaccagcttgtatccccccaggtacacttcttagtgttaaaaacaatagtgcttcagttt

SEQ ID NO: 7329 - DNA, 121 bp, Artificial Sequence
  Synthesized
  misc_feature (61): n=a or c
tttggatcactgaatctaatttggggtaccactaccaaaccaattatcattttttccatanatgtaaagctacatgcccaggtcaacagccactgaccactttcattaagtgtggacatca

SEQ ID NO: 7330 - DNA, 121 bp, Artificial Sequence
  Synthesized
  misc_feature (61): n=c or g
aaataagtactggatgaacccacaccagcgggatgccctgaaattcagagggaaatcactnaaatgcagtgcagcaaagggtgatgagggtttcactgcagtcgcatgccgcggttccttc

SEQ ID NO: 7331 - DNA, 121 bp, Artificial Sequence
  Synthesized
  misc_feature (61): n=c or g
gaggaactcctgcaccgccatgggcaggccttgctggctcacttgcattggcttatagaanacccgcaaataccagaaatctcacttgaaaaactaaaacacataatagaaaacaaacact

SEQ ID NO: 7332 - DNA, 121 bp, Artificial Sequence
  Synthesized
  misc_feature (61): n=t or c
aggtacagccccactctcagtcccaccgcccaggtcctgcagtgaatggctcagccaatgngtttaaatccaccaattttaggactggccaccgacattcacagctatgtgggagtgttgg

SEQ ID NO: 7333 - DNA, 121 bp, Artificial Sequence
  Synthesized
  misc_feature (61): n=t or c
agatagtgcagaagagtaatgttcctaggagaaaggaacagctaggttagcgtggtcctcnacatcagccatgaccgccattgagtagctcagaaaggaatgcccccactcatctccatgc

SEQ ID NO: 7334 - DNA, 121 bp, Artificial Sequence
  Synthesized
  misc_feature (61): n=a or g
gtgacagggacatcgaggacttgcacagaagtaataaacatcaactccagcactgagtccntcagtaagacaagagaaagtaattcagccttcagttcccacctacaggcaagcaacaccg

SEQ ID NO: 7335 - DNA, 121 bp, Artificial Sequence
  Synthesized
  misc_feature (61): n=t or g
tcctgaatgcttcaatcttaagggcatattctttcacaagatctttctgcaaataactgtntccatgttcaagctatattgaccttgtctggttacagaaaaacaaggggggagattgaga

SEQ ID NO: 7336 - DNA, 121 bp, Artificial Sequence
  Synthesized
  misc_feature (61): n=a or g
aagctcgtttgataagcacattctcccacaagaagaagggctatacgtgcttcaaacgcanccaaccctcactgagagggatagtcatgcgtggcaattaatcatttgtacttcggtagta

SEQ ID NO: 7337 - DNA, 121 bp, Artificial Sequence
  Synthesized
  misc_feature (61): n=t or c
gagtgtgtcccaaatatcctggaaaatttagctcagtggctgactgactacttttgtaaanctgcctagaagagaagacaccttctggcttaatcaaataaaggcttcataagaaactgct

SEQ ID NO: 7338 - DNA, 121 bp, Artificial Sequence
  Synthesized
  misc_feature (61): n=t or c
tcaccggatggagccaaccacatggagaatcctttcgctatctaaaggatagtccacatcnggaggcggcaaaggacgctagaaacaaaaatatatatgcattgtgttcaaggccagcacg

SEQ ID NO: 7339 - DNA, 121 bp, Artificial Sequence
  Synthesized
  misc_feature (61): n=a or g
aaaacaaagaaaatctacattagaggccaagaacacacatgacagggggggttttttgggnggaggggggaagaattttacacctgggtgtatgtgcatatgtacaggtctgaatatatac

SEQ ID NO: 7340 - DNA, 121 bp, Artificial Sequence
  Synthesized
  misc_feature (61): n=a or g
tgtgccatcattatttatgggcgctcacatcaggtgtcattaatccacctccggaacatcnctgccttgtccaacaaggcttcccacgctttttaggaagtcggtgttgggcccaaaggat

SEQ ID NO: 7341 - DNA, 121 bp, Artificial Sequence
  Synthesized
  misc_feature (61): n=t or g
aagctgtgtcaaggccaagggcatctcaggcattaaattcgtaacagcagagtgaccaagnattgctgacacatcgttatgcatcctctctaacaaggaacatgaacttttagccaaggct

SEQ ID NO: 7342 - DNA, 121 bp, Artificial Sequence
  Synthesized
  misc_feature (61): n=a or c
ccttggtgaccttatattcgggctctgtaaccttcaggtgctttgcatcagattatctttnccttatgcaaactttgtgttttaattgatggctgtggaatacagcagcttgcaaaactca

SEQ ID NO: 7343 - DNA, 121 bp, Artificial Sequence
  Synthesized
  misc_feature (61): n=a or g
tcttctgggaacagtgaaggatgggaaagtgaatttgaagctggagccagcataccaggcntgctttgccttgcgtggtgcaggatttggctggcactgtggcacacaagcccttggtctt

SEQ ID NO: 7344 - DNA, 121 bp, Artificial Sequence
  Synthesized
  misc_feature (61): n=t or c
tcacagacagaaagcaggacttcgctcatcaaaagaacggggaaattattttctgtgggtntccttatgctttgcagtactgcagctcttgaacatattctgaatacccagactgaagcaa

SEQ ID NO: 7345 - DNA, 121 bp, Artificial Sequence
  Synthesized
  misc_feature (61): n=t or c
caaacacacggcgtctgtgcaaagcttcccaatccgaggacacattctgaaacaaccagtngttactattacctaacagaactggatgaagacttcactgcacccctccagagccagccct

SEQ ID NO: 7346 - DNA, 121 bp, Artificial Sequence
  Synthesized
  misc_feature (61): n=t or c
ctcgctggggccaacaaggagcaaagctagaaggaaagcagacaaaatggagggctgcagngtaatggaggggcaaaggagagcatagcagcacccccctatattggcttacacttccaaa

SEQ ID NO: 7347 - DNA, 121 bp, Artificial Sequence
  Synthesized
  misc_feature (61): n=a or g
aaacacctatagtgctctacaggagcagcttgatgtttggcacacatttttacatcagtcnttggcccccctggcctacggaagggaagcttcaggatgtgccttttaaaaaaaattatta

SEQ ID NO: 7348 - DNA, 121 bp, Artificial Sequence
  Synthesized
  misc_feature (61): n=a or g
ggatccctctgcgttggcgttgaccccaaccgcaactgggacgcaggatttggaggtcagnactctccctttcacctgacacgttgtgttctgccctccaagtggaggctctgatgatgct

SEQ ID NO: 7349 - DNA, 121 bp, Artificial Sequence
  Synthesized
  misc_feature (61): n=a or g
accctatctgaaactgctcaattctgaaaggtggtgagcaggtttagttgtgtggctgcancgtggccattcccgaagggattcagcggtggctcatccatgctgccttaattcacctgct

SEQ ID NO: 7350 - DNA, 121 bp, Artificial Sequence
  Synthesized
  misc_feature (61): n=c or g
agaagaacagggagcttcatgctgtgtgttttgttcaagctttgcatattcctggaagtgntgtttgatgcacacgttggtaccgagcgcatccccccacaaagaattggtggctttctgc

SEQ ID NO: 7351 - DNA, 121 bp, Artificial Sequence
  Synthesized
  misc_feature (61): n=t or c
catcctgagaagaataaaaatcactgcaaacttcatcgtgggatcaatttacctctgccangggaacacccagctgcttctgagccggttccctaaaaagctgggctgatcccagcagcca

SEQ ID NO: 7352 - DNA, 121 bp, Artificial Sequence
  Synthesized
  misc_feature (61): n=a or g
aggaggaaggactgggccattcagacagcagctcagaactgacaacctggaagcaaaacanttggtgcactgctagcatgggaggctcattcaagctgcacttttccagatatatttgcct

SEQ ID NO: 7353 - DNA, 121 bp, Artificial Sequence
  Synthesized
  misc_feature (61): n=c or g
gtaggattttgctgtgaaccctctatgtgattttggcttcagaaaaggaggatcttccatnttccaattccctgattgaggtttctactgcctatgaatgaagtcacctactgggacagag

SEQ ID NO: 7354 - DNA, 121 bp, Artificial Sequence
  Synthesized
  misc_feature (61): n=a or t
agtccactggctgggctgccccaacaaaaatggaccatgcacatcaattacagtgattcantaactgatgccttatcctataatctggccatgctgtggcgatggcatcaggcagtataag

SEQ ID NO: 7355 - DNA, 121 bp, Artificial Sequence
  Synthesized
  misc_feature (61): n=a or g
tcaccaccatgcccactaaatcagtgcaggctttgcccttgcaaggtctcagttcctcaanctcaagattatatgcttttacctagggctcaatctgtcacatcgtctcccagagtaccct

SEQ ID NO: 7356 - DNA, 121 bp, Artificial Sequence
  Synthesized
  misc_feature (61): n=t or c
tcagtaccttcaacagttcactgagttgttcaaatggttgtgtgccatctgttgggatccngtgtgagcatctttagttcttgctagtgaaaaataggaagcagccatgtaaactttgtca

SEQ ID NO: 7357 - DNA, 121 bp, Artificial Sequence
  Synthesized
  misc_feature (61): n=t or c
gtcagttgggtagggttgagttggattgggtaaggctgggtagggctgagtagggttgggntggattgggtacagttgagctggattgagtacggttggatggggtagggctgagtagggt

SEQ ID NO: 7358 - DNA, 121 bp, Artificial Sequence
  Synthesized
  misc_feature (61): n=a or t
acaacttcaacactgtggaaagctttaccgtgagacagtatgcatggggatacacacacanacatacacacaaagtcttgagggtctgcagtactagataaaagcttagatacttttgcca

SEQ ID NO: 7359 - DNA, 121 bp, Artificial Sequence
  Synthesized
  misc_feature (61): n=a or g
agaggtggattaaaatgacatcctgcagagttgggtgcctagggtctgtattttaccttcngaccaggcttgtgaacatctgaaaacaagctgtccttgtagcttgagcaggagagtttgg

SEQ ID NO: 7360 - DNA, 121 bp, Artificial Sequence
  Synthesized
  misc_feature (61): n=a or g
gctctgctccacctgtgggctgggggcacagcactgcagttaccgagggtactgaccactnggaatttgtccccaagctatagttactcctttgtttctcttccgagactttccaggatca

SEQ ID NO: 7361 - DNA, 121 bp, Artificial Sequence
  Synthesized
  misc_feature (61): n=t or g
tcaaatgtaacattttaaatgccttgcaaacatacattggagccaagatttccaccctganccgtgcaagacttgatcacaagcacctgtctgatcttcagaagcattgagctcctactga

SEQ ID NO: 7362 - DNA, 121 bp, Artificial Sequence
  Synthesized
  misc_feature (61): n=t or c
gggctgtgcccctctgcacacacagcctgctggagagggggccatacagacagacaacccngggcatccatgcgtgagaccacagggcagctttgagtggttgccttggttgtcctgctgc

SEQ ID NO: 7363 - DNA, 121 bp, Artificial Sequence
  Synthesized
  misc_feature (61): n=c or g
ctgtactaggaatgtaggtgaatgtaggctacgtgatcctcaggataactgaatctctctntatttgatagtgaggtggaaatcttatgtttactgccagaatatccaaactaatgggagg

SEQ ID NO: 7364 - DNA, 121 bp, Artificial Sequence
  Synthesized
  misc_feature (61): n=t or c
ttagaaagaaacagagcaattgcttccaacaagcaagttgataatgctgtgagactctatnttaaatagggaaagcaaaagagatactcacagtagaaggtgacgcagctcacatctcagt

SEQ ID NO: 7365 - DNA, 121 bp, Artificial Sequence
  Synthesized
  misc_feature (61): n=t or c
gtcaaggtccaaaatcctaaaccaaggctaaagagcttaaacaaacattggtcttctttcnctccgcagcccaaggacacttgtcaggcttctgtggtgagccagggtaacagcattagtg

SEQ ID NO: 7366 - DNA, 121 bp, Artificial Sequence
  Synthesized
  misc_feature (61): n=a or g
gtgtatccattctagaaccaggggtttgagtactcatttcagcagcgtgtcactggggaanaacatatcagaatgattaaccttaacttggtgttcttggtagtgagctgtaggaagaaga

SEQ ID NO: 7367 - DNA, 121 bp, Artificial Sequence
  Synthesized
  misc_feature (61): n=c or g
ggacggtcaccagcaaacatcttcatgatctctgcttttcttggagactttcagacacganagtcactctgtttttttccattgccatcctaaacccaattctgatctccaacaaaacgta

SEQ ID NO: 7368 - DNA, 121 bp, Artificial Sequence
  Synthesized
  misc_feature (61): n=a or g
atggctggacaagtaaaccatgttttcttaagggctggatttttccagagagaaatagcanagttctgtgatttattatctgaaagagatccaaacaccttgggaaagaaaagaaaaagct

SEQ ID NO: 7369 - DNA, 121 bp, Artificial Sequence
  Synthesized
  misc_feature (61): n=a or c
gaaaagataggaaatattgtggctttcttctttcccagagtagagagtatttctttcccgnattttccttttccttctgacattaatctgacgtgtaaagaaatcgttctaatttgttgct

SEQ ID NO: 7370 - DNA, 121 bp, Artificial Sequence
  Synthesized
  misc_feature (61): n=a or g
attaagattagctgatgaaactgcactttgctggaaaatgatggatctgttcctaagagcngtttctttgggagtcttgatattaaaatcttggtgtttaaagttccaagttcagttctta

SEQ ID NO: 7371 - DNA, 121 bp, Artificial Sequence
  Synthesized
  misc_feature (61): n=t or g
tagtgtactaaattaaattgtaaatttttaacaaaagcttctcataagttgttctgtgagnaaaatgtcaaaaagttcacgagtcctctcaaaagaatctgagaatatctcaagctactca

SEQ ID NO: 7372 - DNA, 121 bp, Artificial Sequence
  Synthesized
  misc_feature (61): n=t or c
aattgtaggggacagcatgtccaacctctctcccctcctgccaaagcaacacctttgaagntgttaatgtgaacactgattgctactccgtcccattgcaccttttaaaggtgcattttgg

SEQ ID NO: 7373 - DNA, 121 bp, Artificial Sequence
  Synthesized
  misc_feature (61): n=c or g
tcgcataaaaatacagtaaattgtgaataatcccagctcgtctattcaaggtattactcantcaccaggcagagaagtttcagtttctggatagagaatagaccacagacaaattattccc

SEQ ID NO: 7374 - DNA, 121 bp, Artificial Sequence
  Synthesized
  misc_feature (61): n=a or g
tcgcatttcaccagctatggagtgatcggatagatggctgcttataagcagaagtttgtcntgtttttcaagtataacattaacccattctgacacttgtccttccttaagcatagtctga

SEQ ID NO: 7375 - DNA, 121 bp, Artificial Sequence
  Synthesized
  misc_feature (61): n=a or c
gtttttctctagtctgatccaacattgtcagatacctctttaagggcaaggtgcatgaaanatttattgaagatgcactctcatattttgctgtagtattcaaatgcttttcaggcactta

SEQ ID NO: 7376 - DNA, 121 bp, Artificial Sequence
  Synthesized
  misc_feature (61): n=t or g
ttactggaagccggtgacatgaataagcaagcaggtaaatactacatgggaaatggcaganagcatggcaattaaagaagagtaagtaacactgaaccaggaggaattatgacagaaagat

SEQ ID NO: 7377 - DNA, 121 bp, Artificial Sequence
  Synthesized
  misc_feature (61): n=a or g
ttttgcactcagctttgctggtttatcaagcaaaaaggaagtaccacctgaaggcagcaanttgaaccatttaatggtctccatgtttggattttataacctgcagtcctcagtcttgtct

SEQ ID NO: 7378 - DNA, 121 bp, Artificial Sequence
  Synthesized
  misc_feature (61): n=a or g
cagctcttagctccttggctaagagagatatgtggtactgcaggtgttaaatggggccgcnagagaaacacaagctctgcaggaaatatgtttcacaggggaaactaattcctttaaccaa

SEQ ID NO: 7379 - DNA, 121 bp, Artificial Sequence
  Synthesized
  misc_feature (61): n=a or g
cacaaattcacaccagcatgatttcagtaatatgagcttttagcacttcatgcttacacantatgcttcagaaatattattctgaaatacaaacctttttttttcctcctcactagttatc

SEQ ID NO: 7380 - DNA, 121 bp, Artificial Sequence
  Synthesized
  misc_feature (61): n=a or g
tggaggtcctattcactgcccttagtcctcttcatacaagactgaaagccaccctattcanaaaaccagatgaaggcccatctttagtagtctgtcatcaaagccatttaccctaaatgtt

SEQ ID NO: 7381 - DNA, 121 bp, Artificial Sequence
  Synthesized
  misc_feature (61): n=a or g
gtgttttatagaagggactagtctggccagatgaacacatttgatctgtaaccaggatgtngtattgcttctggagaacaaaatgttaaattgggccctttagaaaccccatcctactcaa

SEQ ID NO: 7382 - DNA, 121 bp, Artificial Sequence
  Synthesized
  misc_feature (61): n=a or c
ccatccgcttagaaccttcccaaatgatcctatttaagctcaaattttcactatcgaattntctcagggaccatttccatcacatgtaccatgcagaactgaaaaatctttcacctctaag

SEQ ID NO: 7383 - DNA, 121 bp, Artificial Sequence
  Synthesized
  misc_feature (61): n=a or t
accaaccccttgcaaacagaattcaggtgggggtggacaatgcccaacaattacacagagnagataaatacctgggcaggattaaaatggattggctgttcacatgctcttcaaagcattc

SEQ ID NO: 7384 - DNA, 121 bp, Artificial Sequence
  Synthesized
  misc_feature (61): n=a or t
gttccattgccagcacagtcctgccctgtcccaggtaaggactacaagttcctccttttgnggtaaacgatacttcccacctaaatccaaactgatgccagcaggcttaagacagctggaa

SEQ ID NO: 7385 - DNA, 121 bp, Artificial Sequence
  Synthesized
  misc_feature (61): n=t or c
gagagaatcagccaaggcagggggcatgggaaggagcagcttcctcttgggaagcctactngtactggaatgaaagcattacttatcaacagaaaaataccagtgaatagccaaaagcctc

SEQ ID NO: 7386 - DNA, 121 bp, Artificial Sequence
  Synthesized
  misc_feature (61): n=a or c
aatttccacttcaatttcacatgatgaggaagtcttcttttaactatcaacaggatgatgntgtcagctgacagcaagtttgcacgtatgaatgtacaattgaatatggaatacatgcatt

SEQ ID NO: 7387 - DNA, 121 bp, Artificial Sequence
  Synthesized
  misc_feature (61): n=t or c
tattatttccattcatgtttattacatcgagaccactataacctcaacgtggaaagaaacngatgtctgtttgaactggagactaatacagtatgcagaagaaatgaaagactggaggttg

SEQ ID NO: 7388 - DNA, 121 bp, Artificial Sequence
  Synthesized
  misc_feature (61): n=c or g
agacaaaagaaatcacacactaatcctaggctcctcagaggacatcagctgataagcaacngagtcattccaaagaagaagcctgcaggtaggtttgcagttacctgtcttcctgctccaa

SEQ ID NO: 7389 - DNA, 121 bp, Artificial Sequence
  Synthesized
  misc_feature (61): n=t or c
ctttttcagaggaaatgaaaaggaagaatcgacatcaaaaggaaacagtgagtaggaaagnatgagacttaaaggatcattgcttaggcttgtcacgcctctctcttttctgttcataaat

SEQ ID NO: 7390 - DNA, 121 bp, Artificial Sequence
  Synthesized
  misc_feature (61): n=a or t
cactccataggatttaatattacctttggcagattttctttctagagagcagagtctagtnttagctgaacagtattttgcatttctatagtcccttcaatcctcacactgccttccaagc

SEQ ID NO: 7391 - DNA, 121 bp, Artificial Sequence
  Synthesized
  misc_feature (61): n=t or c
caaaaaaaatctgcaaaaaataacaactgcactgggatttctacatggccacaactttcanttttttcagctcgctgccaacttgagtttacaaatgatagaattttgattatttccctcc

SEQ ID NO: 7392 - DNA, 121 bp, Artificial Sequence
  Synthesized
  misc_feature (61): n=a or g
cttcctttctttagcgctaagggaagagggaggggtcgttaagcatttagaaatccacgtnaaataaatctatgtgtttctgtcatccacatttcaattcagtgccattgttttcacggag

SEQ ID NO: 7393 - DNA, 121 bp, Artificial Sequence
  Synthesized
  misc_feature (61): n=a or g
tgagattaaaaaaagtcattgtatttctccttatataaagtataaaagatatttctgtgtntgtgtgcttatcagcctatttaagagatctttcttttagttgagtccagctcctttacaa

SEQ ID NO: 7394 - DNA, 121 bp, Artificial Sequence
  Synthesized
  misc_feature (61): n=t or c
tctgaaagccatggagcctccttatcagagtgcagttaaaaacactttctcctttatgctngtctcactactgtgcatcagagatgatttttttcatgattagataaaattattttcctgg

SEQ ID NO: 7395 - DNA, 121 bp, Artificial Sequence
  Synthesized
  misc_feature (61): n=a or g
catgtaggaaagaccatcagatcagtacattaaagcactaaaaagccttctaggatgagangcactacttaacattactcagataacccactaactttgaagagatgaaacctgcagcatt

SEQ ID NO: 7396 - DNA, 121 bp, Artificial Sequence
  Synthesized
  misc_feature (61): n=t or c
atacagagctgatttggtaaggcttaaactcagttcgctcacccctttcaatccacaatcntcatagcttacctgtcccagaggaacaaacttgccccaataaaagcttggctttatttag

SEQ ID NO: 7397 - DNA, 121 bp, Artificial Sequence
  Synthesized
  misc_feature (61): n=a or c
gagctgtttggaacaaccttccctcaccatttcacaacattcagagaagagcagaaagagnggacttacacgaaatcctacatcgctcacataaccactatggtcagcttcaacatcctgg

SEQ ID NO: 7398 - DNA, 121 bp, Artificial Sequence
  Synthesized
  misc_feature (61): n=a or g
gcacttgcaggtcactaaggatcccttacaagctagcaaaaaagtgaccttggatgcaatnccacatgctgctgagaatcactgtatccataaggatattcatggcttgcactctaaaact

SEQ ID NO: 7399 - DNA, 121 bp, Artificial Sequence
  Synthesized
  misc_feature (61): n=t or c
ttagtcatttagctgccccatacctcaacttctcctctggtaaaactgagataatacctanggacgtcgcaccagattttcaagatccaatgctgaaaatattatagggcaaagccagtta

SEQ ID NO: 7400 - DNA, 121 bp, Artificial Sequence
  Synthesized
  misc_feature (61): n=t or c
tctaaacatcattgttgttgcttacattgaagacacagagaagcaagtagcaaaaggcttnaatttagtgttgagtgactctgggctccccatactgagcttgtgtgagccacagcagagg

SEQ ID NO: 7401 - DNA, 121 bp, Artificial Sequence
  Synthesized
  misc_feature (61): n=a or g
gtcacagtaatgaacatgataagttgaaaaactatgtcattaatgtatttttcatcttgtncttgcttgctttcagccctctgtgcttcccacaggactcttaactatttcacactactaa

SEQ ID NO: 7402 - DNA, 121 bp, Artificial Sequence
  Synthesized
  misc_feature (61): n=a or g
ataccttacctcatgattataacacactgagggcaagggcagtacaaattatctgtcaatngcattgctatagcttcttgaagcttcagttgcccaaccacatgctacatccaagaagcac

SEQ ID NO: 7403 - DNA, 121 bp, Artificial Sequence
  Synthesized
  misc_feature (61): n=a or t
tcaataaatcagagggcaagtccctgctattccataagcaatcatgagcaaggctgagagnacagccaaggccctttgcaaagggcaacaaataccatagacattgttatagatttaattt

SEQ ID NO: 7404 - DNA, 121 bp, Artificial Sequence
  Synthesized
  misc_feature (61): n=a or c
ccaacatcagcagcagatgcaggttcgtagatgtctgcttgttaccacaatccaccacagntgagacttaaatagtctctgttatgcaaatctggagagggagtggaattgagggaaactg

SEQ ID NO: 7405 - DNA, 121 bp, Artificial Sequence
  Synthesized
  misc_feature (61): n=t or c
gaaaataagccaggtgccctaagtggtcctgagaacatgacaagtacccctgctctaaccnttgcaagcccatggcaccgccactatctctttggcttcaggctcatcaggcaggctgtgc

SEQ ID NO: 7406 - DNA, 121 bp, Artificial Sequence
  Synthesized
  misc_feature (61): n=t or c
ggccctcagtagaaagagctgagaaaccacacgtgtgggcacctgtgctgggtctatacanaagggtaggcacccctaggcacaaaacagacaggtgttacttggtgactaaagaaccagt

SEQ ID NO: 7407 - DNA, 121 bp, Artificial Sequence
  Synthesized
  misc_feature (61): n=a or g
aaataacacaaaagatgtcttaaccaactcattcacacatctgcacttgagttaggcaccngagagctcaagcgctgcagttttgccataactctgtcttgtttgcacacatggggacgtt

SEQ ID NO: 7408 - DNA, 121 bp, Artificial Sequence
  Synthesized
  misc_feature (61): n=t or c
cacagttgcagtcttgccaggctctccaagtaagaggaaagttatgcagttaactgtgttntaaaacccttttatgatttagccatttggttttccagtgtggagtatatctgaaagcttg

SEQ ID NO: 7409 - DNA, 121 bp, Artificial Sequence
  Synthesized
  misc_feature (61): n=a or c
cctttttcaagataatttacattcttatcctaataatttttgtctctgcagcaaaaaggtnaaaataagattgtcccttacacaaggcccccttctcatcactacttttcttagtaattct

SEQ ID NO: 7410 - DNA, 121 bp, Artificial Sequence
  Synthesized
  misc_feature (61): n=a or c
tagaactttgatagttaaacaactttgtgctacgtttgagctgagaggtttattccagtcntgtgttaatttaatggaggatttctgaatctttcacaacataattttaccgaaaatggca

SEQ ID NO: 7411 - DNA, 121 bp, Artificial Sequence
  Synthesized
  misc_feature (61): n=c or g
accaagaatctgcccttcgtatgaatgaggaagctaagactcagcacagcgatttatcttngtgagctggggaaaaattcccttctttatggtgggtccaaccttttaaagcctctgtgaa

SEQ ID NO: 7412 - DNA, 121 bp, Artificial Sequence
  Synthesized
  misc_feature (61): n=a or g
ctgggaatcctatgtcccttatttctactaagggacattcattatctctagctgggcaaanctgttaggctcaggcttggatgccctgctgtcagggctgcttgcagcacaatggtgacca

SEQ ID NO: 7413 - DNA, 121 bp, Artificial Sequence
  Synthesized
  misc_feature (61): n=a or g
atcagcaatatttaagcaaatactaaattaatactgtgaaggaaaaccagtttttcattangctaaaatacgtgcgtttgcgtgcctttcccctcgtaggggctggagtggcagcactggc

SEQ ID NO: 7414 - DNA, 121 bp, Artificial Sequence
  Synthesized
  misc_feature (61): n=t or c
tttcattttagctgtgccctgaaatgcaggagattgagctcttctcctttaggttcccctngcagctgcagccttcccatccctcacccactgtgcctcagtgactgccactcgcccggtt

SEQ ID NO: 7415 - DNA, 121 bp, Artificial Sequence
  Synthesized
  misc_feature (61): n=t or g
tacagctaacattttacttgatacttgaggatgagaagggcaatatttaaatcttgaatgnggagctagcagtagttgcctacaacttatcttcattctttgtgtccgaaatcatactgtg

SEQ ID NO: 7416 - DNA, 121 bp, Artificial Sequence
  Synthesized
  misc_feature (61): n=a or g
gccctcttggggacacatggcccagcctgcggcacagctgggtggcgcctgagagggctgntgtagctgcagcagcaggtgtatgggacacatggctcttagcagactaagggctctgtgg

SEQ ID NO: 7417 - DNA, 121 bp, Artificial Sequence
  Synthesized
  misc_feature (61): n=a or g
acatacatcatacagagaacagatctaattagaaaatgatttaatggacttgcttgtaacntgtttcccccggcccccaagagttgacaaattatatcagctatgtttctgaggacatttg

SEQ ID NO: 7418 - DNA, 121 bp, Artificial Sequence
  Synthesized
  misc_feature (61): n=t or c
ttttggggataacagccttcactgctgccagctgcagcacataatacaggtctgtgctccngtaacaaaagatcacactcaaaccttcccaaccatgcatgaagatagaggtgccacagct

SEQ ID NO: 7419 - DNA, 121 bp, Artificial Sequence
  Synthesized
  misc_feature (61): n=t or c
tgtctcaggtatgcattactcttcagactttaattggggtgaatgttcaatgtacaaagcnatgcttgcttttaaagagtaaacaagaagtttatatatttataagaaaaagtaggtagcc

SEQ ID NO: 7420 - DNA, 121 bp, Artificial Sequence
  Synthesized
  misc_feature (61): n=t or c
aagaattcctttgatgagtcaataaagtcctgactttactttctatatactctatttctanctcttctctccttaaacattttacagatttacctgaccttcttgtgtgttgcagctactt

SEQ ID NO: 7421 - DNA, 121 bp, Artificial Sequence
  Synthesized
  misc_feature (61): n=t or c
tttttttaagaaagatataatggaggggatggggaggaacaaatttggatcacactgaaanagatgctgctctttacctggtagagtgaaaatctcacctgaagtgagatttttctgccta

SEQ ID NO: 7422 - DNA, 121 bp, Artificial Sequence
  Synthesized
  misc_feature (61): n=t or c
acagcaccagcatcttctccaggtgatttctttacatgtctcgaggaagcagcttgccttnagctgattttaccctttctccccattctgttaagtcttacaagaggtgagaggaataacc

SEQ ID NO: 7423 - DNA, 121 bp, Artificial Sequence
  Synthesized
  misc_feature (61): n=t or c
gttccaacttttaagagctgcaccttcagagaatttccaatgactcttcatatagtgaaanaaatttgtggaatgaaaacaaggatgttagaacagtgcaatgctgcattgaatgctttca

SEQ ID NO: 7424 - DNA, 121 bp, Artificial Sequence
  Synthesized
  misc_feature (61): n=a or t
tacttttttaggaactactgctgacaatggatagaaacaacataaatggatttttcttcgnctgtcttaacttgaagaggtttaactacaccttaatctcctcgaggcaggtagaagctct

SEQ ID NO: 7425 - DNA, 121 bp, Artificial Sequence
  Synthesized
  misc_feature (61): n=t or c
aaagagatctgagaagggcttgtgctgcagtctctttactgatatcactgaatctcttgtncattcgttagaaagcatttttatagcagatatagccatagaatgcttgtcatccaagact

SEQ ID NO: 7426 - DNA, 121 bp, Artificial Sequence
  Synthesized
  misc_feature (61): n=t or c
ctagttagaggtgatggatagaggattacagtacgaaagtacaaatgccttagcaaatatncagcaataacagctacaaacttcttaggctgaccttggtactgtgcagagtaattataat

SEQ ID NO: 7427 - DNA, 121 bp, Artificial Sequence
  Synthesized
  misc_feature (61): n=a or g
ttgatttcctccttctccctttgatcctggtttgaaagtaggaaaatagagacagacgacnatagattttacagctgatccattactctccaagcaaatgatacagtgatggaccttcact

SEQ ID NO: 7428 - DNA, 121 bp, Artificial Sequence
  Synthesized
  misc_feature (61): n=a or t
gagtgtctggaaaaggtcagttgcagctggatatcttgttcagtaggttatacactaaaanttgttttgtctgtatatagatcagaaaacctacttctttatgtaatattaacaagcaacc

SEQ ID NO: 7429 - DNA, 121 bp, Artificial Sequence
  Synthesized
  misc_feature (61): n=t or c
ccatatagttgtggagatatgcttcttagcacaatcacaatgttcatatacaatcccttanaatatgtctgatgctcagttaaacacaaaacactcagaaatcccactagggatttgaatt

SEQ ID NO: 7430 - DNA, 121 bp, Artificial Sequence
  Synthesized
  misc_feature (61): n=t or c
attaggtacatctgatagcaaaacacatgtaagcactttgaagtatgctcatacctaaagnatctcggcacaattaaaatgattgattttaactttttcagtgttttgcgatggttgatat

SEQ ID NO: 7431 - DNA, 121 bp, Artificial Sequence
  Synthesized
  misc_feature (61): n=t or c
ctcctccagccaagacaagtcactctgaaacagcagctgttaaccacaaacttccagggcngggaagacagcataacttatttcataagtctgtctcgtatgatttagcaaagaggggaaa

SEQ ID NO: 7432 - DNA, 121 bp, Artificial Sequence
  Synthesized
  misc_feature (61): n=t or c
cacataagcaaagtacacaaagggcaggaaaaaagactattgtatcaatgagagaaggtantgtacagacatcagaaacttagtgcagttaaaaagatgacagtgtgacacacaggtaaat

SEQ ID NO: 7433 - DNA, 121 bp, Artificial Sequence
  Synthesized
  misc_feature (61): n=a or g
gaacatgaaaacaattcaagttccttgtgtatgtgctgtcatgaatgaggagtgatagtcngcccaaaggaactgcaaccaatctgacagtttccatcttaaataatgagacccataagca

SEQ ID NO: 7434 - DNA, 121 bp, Artificial Sequence
  Synthesized
  misc_feature (61): n=t or c
taagtatatttgcacaacaacttaaaagcaggaaatctcccagaggtaaagctgataaaangtatgtatactatggtagtttagcttttggtctgtggcatagattccttcatagatacac

SEQ ID NO: 7435 - DNA, 121 bp, Artificial Sequence
  Synthesized
  misc_feature (61): n=a or g
tagaaattgttactaagctgaaaagcctttagtttatatgacctcatggaaagtagcactnttttacgtgcagtccaaacttacagcaaatagcatttctctacctttggacgaaacacag

SEQ ID NO: 7436 - DNA, 121 bp, Artificial Sequence
  Synthesized
  misc_feature (61): n=t or c
aaaatgtgttagcatgtctcaatgtgaataatgaagcaaatggatgatctcaaatgcacantgaaatgggaagtatttgccctttttaacctgtttttctttctacagataatccctgaaa

SEQ ID NO: 7437 - DNA, 121 bp, Artificial Sequence
  Synthesized
  misc_feature (61): n=t or c
atgtggccttgagaccagcacagcctgtatccccatcctgcaataagctgtccatagagcngttgaggaggctgctgcagtatcagagaggactgggtaagagataggcttcccaaataag

SEQ ID NO: 7438 - DNA, 121 bp, Artificial Sequence
  Synthesized
  misc_feature (61): n=a or c
aaagatataagaactatcagagtaaatgagggaaagaatggaaaaatccagaccaattttnttttcccccctgtgctttctcatacattccatgatacattcttgacttggaagggaaaga

SEQ ID NO: 7439 - DNA, 121 bp, Artificial Sequence
  Synthesized
  misc_feature (61): n=t or c
tgaacgcctctgtagcccttggcagatccagaagagagttttacaccaggtccgcgcctcngtccttgcagctacacaccccgagccctgctaagtgctctgccgtgcttcttatccctgt

SEQ ID NO: 7440 - DNA, 121 bp, Artificial Sequence
  Synthesized
  misc_feature (61): n=t or c
cgttagcagggccctataattagaagcagcagccagccatctgcttttatctcgtcacatngcacagtgcatccctgctgccctttatgaccggccatcgctttagatcaacatttccact

SEQ ID NO: 7441 - DNA, 121 bp, Artificial Sequence
  Synthesized
  misc_feature (61): n=a or c
catacattaatgtgcttaaagcaactattcaccagtatgctatccgcagtagaactgggcnaaaacagcttcctaaattcttgggatactttctccaatatgtaaaaatgagtactgaaat

SEQ ID NO: 7442 - DNA, 121 bp, Artificial Sequence
  Synthesized
  misc_feature (61): n=a or c
tgactctgaaactgtgaagaactgtgaggtacttgttaaggtttattgaaatagaaatgantgtattaatgtatcagctctgcattttggaagacagatcttatagtggtagtgtttagca

SEQ ID NO: 7443 - DNA, 121 bp, Artificial Sequence
  Synthesized
  misc_feature (61): n=a or c
tattaagaatatggcatatttaaggatcctcgtttccttttgttgtccattaaattaaganacaaagttatcacctgaaggtgctcatagctccagttcaaagttcaggtggttgattcaa

SEQ ID NO: 7444 - DNA, 121 bp, Artificial Sequence
  Synthesized
  misc_feature (61): n=t or c
gtcattcatcaaaatttatttagcctttaaattaaagaagaggctgagtaaactacaatanataatctgggacaattccagttcaccgcttttacccttctgaattgccttacatattctg

SEQ ID NO: 7445 - DNA, 121 bp, Artificial Sequence
  Synthesized
  misc_feature (61): n=a or g
aaatttagttacagaaatgcatcccatggctctgagatcctccagaggaggcagaagaacnaacggcagcaagagtccagctggacacttccacacacctccgtgtgcccatggtggtact

SEQ ID NO: 7446 - DNA, 121 bp, Artificial Sequence
  Synthesized
  misc_feature (61): n=t or c
tacaaatccatagcagaaagtaacactgtttgctgctcttaaatacatgacctacgtgaangtcagacaaaaccaaaaggctacaactccctcatttgagaaatgtaattgcttacgtgct

SEQ ID NO: 7447 - DNA, 121 bp, Artificial Sequence
  Synthesized
  misc_feature (61): n=a or g
ttgcaagcacagctgaaaaacagcaccaggacgtgagcaatccattccaaaaaggctgacntaaatgatgcttccctccccccaaaaaagagaatatttttgcaggggtacatacagtcag

SEQ ID NO: 7448 - DNA, 121 bp, Artificial Sequence
  Synthesized
  misc_feature (61): n=t or c
tctgggtcatctgagcatcagtaagcctcccctgttcaattttccttataaaaccagcaangtgttttagctagacccttccattaaggtctctgtggcttgtactgaggattgatgctgc

SEQ ID NO: 7449 - DNA, 121 bp, Artificial Sequence
  Synthesized
  misc_feature (61): n=a or g
acagtctggggaaaaatctgggagtctcacagtgcatggccctggagatacctgacagccnctgctgtcacttgtgctctgcactgggctgttgtgatgtgctgaatgctgtgctgggtgc

SEQ ID NO: 7450 - DNA, 121 bp, Artificial Sequence
  Synthesized
  misc_feature (61): n=a or g
ttttttttttaatcccaaaaggaactcctgccattattaacgtcactgcttttaattctcnagccatcagatttccttggaaaacattactgtttctgaacaagctgtgacacttaggtta

SEQ ID NO: 7451 - DNA, 121 bp, Artificial Sequence
  Synthesized
  misc_feature (61): n=t or g
tttttcctaggaaattaggatgccttccagcagaagctgatacgtagactcagcttttccngagaaatagcttccactgttccctgaagctaaggatctgcagtttgcaggatcagggcct

SEQ ID NO: 7452 - DNA, 121 bp, Artificial Sequence
  Synthesized
  misc_feature (61): n=t or g
cttcatgctttgcaaagtcagagattgcattgaagaggaagtgttccatactgttcttgancaatctggcatttgtattagatgacagagcatgttactaagtagacttcttgaaaaggat

SEQ ID NO: 7453 - DNA, 121 bp, Artificial Sequence
  Synthesized
  misc_feature (61): n=a or g
agggaggagatggatgttctcaagagataaggttttggtatagatacaaactgcaagcaanccatcacaaatgctctttactacaggatcccaaaaagctgttctacaaacaaggtgggga

SEQ ID NO: 7454 - DNA, 121 bp, Artificial Sequence
  Synthesized
  misc_feature (61): n=a or g
tcaatagatgttggaaaatgctggatgtggccatgagcagccaggattttccttcccttgnctacaagcaagcagaggctggaggctcagcaaaatccctattttgttccgtgacattaat

SEQ ID NO: 7455 - DNA, 121 bp, Artificial Sequence
  Synthesized
  misc_feature (61): n=a or t
ctcagccatggggatgcttaggattcagcatctccttcttgtgcatccgtgtcccctttgngcacaggacgtcctcgtaccctgcaggaaccagactcccgtgttcagcaagctgtgaggt

SEQ ID NO: 7456 - DNA, 121 bp, Artificial Sequence
  Synthesized
  misc_feature (61): n=a or g
tttttaattgctttcttacacattagcatttgagcattgcacaacagtttgtgtctgaatnttcacagaagccatgcaaggaaaaggaagccctgttagctctgttttatagatgtgaaag

SEQ ID NO: 7457 - DNA, 121 bp, Artificial Sequence
  Synthesized
  misc_feature (61): n=a or t
ggagagtctgacaaggaaggaaggcaacaacgatttactgtcttcccttttaaaagggacngggagggaaagaaatcacaactacatccataaattcaatagcagatgcagcagcagaggc

SEQ ID NO: 7458 - DNA, 121 bp, Artificial Sequence
  Synthesized
  misc_feature (61): n=a or g
gtggtgtcaatgaaatctgctttgggagttagtaagatgggttcgtctgatggaaacttcnctgtatatatccggccctgaatgttttctgtgataattcaaggatacttttatatggggt

SEQ ID NO: 7459 - DNA, 121 bp, Artificial Sequence
  Synthesized
  misc_feature (61): n=t or c
ttcctgaagggtaacacagccactgtcctgaaaacaccagctccacctccagcctcaaagnaaatcaagcattgggagttatggggaaaacacagcacccaaggaagggtgccagatgctg

SEQ ID NO: 7460 - DNA, 121 bp, Artificial Sequence
  Synthesized
  misc_feature (61): n=t or g
cacagagaccaacagcagggtgtgtgacatggcggaaccacaaggcatgctgagcccacangaggactccctgctctcctcctctcaggctgaacagcccctgaatacagctgctggaaac

SEQ ID NO: 7461 - DNA, 121 bp, Artificial Sequence
  Synthesized
  misc_feature (61): n=a or g
aaagcaaagtatttgttggggcatattattaacagctacctagaaactattagaacatccntgttgacacatacctttctcactgggatttcctatcatgagagagatctgtttacgcaag

SEQ ID NO: 7462 - DNA, 121 bp, Artificial Sequence
  Synthesized
  misc_feature (61): n=t or c
tcccttgcacagaatccttctatcaagctatcacctttaatgcagaaacaaatgatgcttnaccacagaaaataattgtttggttctcccaccttatctggttcacaaccaaagaaaaaac

SEQ ID NO: 7463 - DNA, 121 bp, Artificial Sequence
  Synthesized
  misc_feature (61): n=a or g
tcctatgttaatctgctttaatttccctgaatgtccctatgactgcccatggagcagcacnttgtttctggtgcttgatggttctgaagactctctcctacttactctttccaatatcgtg

SEQ ID NO: 7464 - DNA, 121 bp, Artificial Sequence
  Synthesized
  misc_feature (61): n=t or c
acttgcagaactcttagccactgtagtctgtgtaagtcaagtcatgttactatgggaatgnatcactgtttgcttttctggcactgacaccaactgtgatttttgtccctcagagctccat

SEQ ID NO: 7465 - DNA, 121 bp, Artificial Sequence
  Synthesized
  misc_feature (61): n=a or t
tgatgatttgtttttcacttagtttatcatcttcaatcatgtttatcaacttcaatcatgntgatttataaatcccctagaacatgcgtttgccctatagatggttttttgtgtctttagt

SEQ ID NO: 7466 - DNA, 121 bp, Artificial Sequence
  Synthesized
  misc_feature (61): n=a or g
tttgtttacaaaaataaagggagttagcttctcccctttacatacctccaagtacctccanggctgtgaatgtagtggaggtaagctcacagtgcactcacaggagctttatttctacaga

SEQ ID NO: 7467 - DNA, 121 bp, Artificial Sequence
  Synthesized
  misc_feature (61): n=a or c
tgaaaactcacacactttgagggttaggagaaattgaaatggcttttcatttcaagcagcnccatctttatgctcctcatagtaaatgaactgaaagacctgggcaagagattagtgatta

SEQ ID NO: 7468 - DNA, 121 bp, Artificial Sequence
  Synthesized
  misc_feature (61): n=t or c
ctctgatactgtgggaattattacaatttcttttgaggcacgcattaggtacaccgacatncctatggctcaaagaagattatttagaatcacaagataatctgtcacagaacaaaaattt

SEQ ID NO: 7469 - DNA, 121 bp, Artificial Sequence
  Synthesized
  misc_feature (61): n=a or g
gtaactaagcatgttttctggagtcctaaggagtttagataaagatgtccaaaagtaatcngaaacattcagtattctgctataggccaataggtgttgttttctagaaattctaggctcc

SEQ ID NO: 7470 - DNA, 121 bp, Artificial Sequence
  Synthesized
  misc_feature (61): n=a or g
actacttatatgcgtacatataaatataaagggagggaagatggaagacaacataaaggangtttcatgggtacttcacacctataatgttttgctgttttattctcaactgggtggtgca

SEQ ID NO: 7471 - DNA, 121 bp, Artificial Sequence
  Synthesized
  misc_feature (61): n=a or g
tattaaagcagcctatttgcaacatgaatcagccctctgaggcaaatgctcattaatgggnaaaacagaatgtttcctcaaccagttgttgttttaaacaaaaaagaaagttagtttgtca

SEQ ID NO: 7472 - DNA, 121 bp, Artificial Sequence
  Synthesized
  misc_feature (61): n=t or c
gctaatccccacgagagaccaatgtttctgaagaaatgttaggtttttttcttaatcaacngtgtttattctactgagatcaagaatatttttagttggcactaaacaaggttgcaatatg

SEQ ID NO: 7473 - DNA, 121 bp, Artificial Sequence
  Synthesized
  misc_feature (61): n=a or g
acatccacaagtccttacagtcttacagctgggctttgagaaagaagtgactgttatggcnctgtttggttttatgcagggtagacatccccttgagttggctgtgaaaaccgaaggcaag

SEQ ID NO: 7474 - DNA, 121 bp, Artificial Sequence
  Synthesized
  misc_feature (61): n=a or g
gctaaccagagtgctctgggaggaaaggaaatgtgtgttatggcatgatgcttgcctcacntgggttgcaagtggctttctgatctgcaaagccttatgtgggctgtccccactgcagaat

SEQ ID NO: 7475 - DNA, 121 bp, Artificial Sequence
  Synthesized
  misc_feature (61): n=a or t
tattttaaattccccattatatgggacaatttataaaataaaaatgtgaatttatgtatgnctaagagaagccttttaacaagaactgctctctctaccttttctaaaacgtgaaatttat

SEQ ID NO: 7476 - DNA, 121 bp, Artificial Sequence
  Synthesized
  misc_feature (61): n=t or c
ctgaactttttcagagcgttctgactgtccaccaaaccaaatccatctgacacactccatnctctgagtatgatccaactgctctcagggtatgccaaacacagaatgtagatcattagca

SEQ ID NO: 7477 - DNA, 121 bp, Artificial Sequence
  Synthesized
  misc_feature (61): n=t or c
attaattttcaggaaagcatttcactttcattaatcattcatcttcaaagttctaatatancttattcttctttgactcctcttgtgaaaaggatttgctgtcatttctaatgtatcctct

SEQ ID NO: 7478 - DNA, 121 bp, Artificial Sequence
  Synthesized
  misc_feature (61): n=a or g
gtaattctatattgcattttagtagcatatttgtttgcctttacatttccttcaacatacngccccactctgaaaatggtgcaacctactccaccacttctatataggtcagatcccgaga

SEQ ID NO: 7479 - DNA, 121 bp, Artificial Sequence
  Synthesized
  misc_feature (61): n=a or g
gtgggccgttggcgtagctgagatgttggactggatttgtctcacctacttcggacttgtntaatgtatacacttacagtagagtgtgtgtagagtgtgcttcacttagactcatttagaa

SEQ ID NO: 7480 - DNA, 121 bp, Artificial Sequence
  Synthesized
  misc_feature (61): n=a or g
tcagagcagccctcctagtttcaaatatggtagaaggaaggtgtgaaggtgtaagatttanatagatatttatatagataaatggcttattaatgctgatatcctagcaattccatattta

SEQ ID NO: 7481 - DNA, 121 bp, Artificial Sequence
  Synthesized
  misc_feature (61): n=a or c
tcaactctagcattcacttctgtgtccatttgttttaagaaccacgaccactgttatggtngaaatgggcaatcatgttaattgcccaagagaaaatgaaagctcatgtatttttttttaa

SEQ ID NO: 7482 - DNA, 121 bp, Artificial Sequence
  Synthesized
  misc_feature (61): n=a or c
tgcttaagtgctgatacccatctcccctccttctcaccctaaagccactcagctgcacatnacaaaggttatgaaccagccatcctctgcagcagagggacgaggcagcagaagtggggga

SEQ ID NO: 7483 - DNA, 121 bp, Artificial Sequence
  Synthesized
  misc_feature (61): n=a or t
caaagataaaattcctgtatgcttattccaggtctgactgttagcataaacagcagacccngatacagatctccgggtgctgataaggccttcacctgaattttttagcaatgtgacagta

SEQ ID NO: 7484 - DNA, 121 bp, Artificial Sequence
  Synthesized
  misc_feature (61): n=t or c
gggatccagcagtaaagcaaaacaagcctgttctctgcttcgtaaagactcaggagctcancttcatgagttgccaagtctggcacttttcaacactgaattcaactccacttaaacaaac

SEQ ID NO: 7485 - DNA, 121 bp, Artificial Sequence
  Synthesized
  misc_feature (61): n=a or g
taatgtaaatactaaacactgcacgatttaaacaggaaaaatcccagtggaaagaacactnaatttagtcctcctattaggtcattgccttacttcctgctaatgaagttctgtgcacacc

SEQ ID NO: 7486 - DNA, 121 bp, Artificial Sequence
  Synthesized
  misc_feature (61): n=a or c
aaaatctacagattttctgatgtttactgcaaacaccgaacattttcttggcacaggcagnctgcttattgtcaagaggtcaccagagaaatctttacttttcaagtagatttattccttg

SEQ ID NO: 7487 - DNA, 121 bp, Artificial Sequence
  Synthesized
  misc_feature (61): n=a or g
taggcttttcatgtggattcctccctttccaaaatgaaagcacttccagcagaatgaagcntgtgctcctcctgaagcacaacctctgcaggtaacctgctggaaaaatcagggttctcaa

SEQ ID NO: 7488 - DNA, 121 bp, Artificial Sequence
  Synthesized
  misc_feature (61): n=a or g
atcagaaagcaaacgtgagcagagctctgctcagagccaggcagccccacacaaaaaaggnttctggcacttctactgccaccacaccttgtgttaaactggtctctattgaaacaatgag

SEQ ID NO: 7489 - DNA, 121 bp, Artificial Sequence
  Synthesized
  misc_feature (61): n=a or t
aatcccgctgccggacggcagcgtgcagagcagagctctgccgttaccgacgcggcacgcnatctgcatttccacgtctctgatttcaagagcgatcgctaaaacctgctacaacgctgtc

SEQ ID NO: 7490 - DNA, 121 bp, Artificial Sequence
  Synthesized
  misc_feature (61): n=a or g
ccaggtttggctcctgggggagattgggatccaagtgccaaccccctcccaaactcatggngatggatcagagatgctgacaggcaatgggtttctgagtgcaggaggaaatgtagcaggg

SEQ ID NO: 7491 - DNA, 121 bp, Artificial Sequence
  Synthesized
  misc_feature (61): n=t or c
aaaggaaatataacagttttaagtggaacatcttacgtactttgtcttacaccagattcantctagctgctcattctggtattagaagaggcaatattacagttaaagatgataaaatgaa

SEQ ID NO: 7492 - DNA, 121 bp, Artificial Sequence
  Synthesized
  misc_feature (61): n=a or c
tttgaggagtcctgggttccctatggtattatccagcagaactgtgagccccctatgaaancaggagccacacaacagctcagggctgcctgagatccagtggggaaaaccatccgccatc

SEQ ID NO: 7493 - DNA, 121 bp, Artificial Sequence
  Synthesized
  misc_feature (61): n=a or g
ccttttgatcattttgtggccctgtcttctatgttcttgatactctgaagagtggtcatantgctgggaattgctcagcctgcaattcaggggcctgcatcttgttgaactttagcaaaga

SEQ ID NO: 7494 - DNA, 121 bp, Artificial Sequence
  Synthesized
  misc_feature (61): n=a or c
tttacaaacttacagtgatccttgagctcacctgacctgctgctgctgaatcaggtcatgntatctcgaaggagtgcccaaaaatttcccatggaacagaagaaatgtagaataatacacc

SEQ ID NO: 7495 - DNA, 121 bp, Artificial Sequence
  Synthesized
  misc_feature (61): n=t or c
aactgatattaaacatcagatcaaggaagagaatcaggatgctggggatcctgcatttcanctctaccattcttggttcaaagccaggtttggaaggaaagctacctatcctatgctgagg

SEQ ID NO: 7496 - DNA, 121 bp, Artificial Sequence
  Synthesized
  misc_feature (61): n=t or c
ccttattatctagttcaaacttttccttccttagccttaagctattgctccttcttccatntgagactaagcaattccctcttttcatttatcttactatcttgatgataataatagacta

SEQ ID NO: 7497 - DNA, 121 bp, Artificial Sequence
  Synthesized
  misc_feature (61): n=a or g
tgttcttggggtttttttggtcttttttatttatttttacaaaatatgcagtaggtttttntataatagcatgttgtgatacgtggtgttgtcttgaagtccttataatgatagtgtttag

SEQ ID NO: 7498 - DNA, 121 bp, Artificial Sequence
  Synthesized
  misc_feature (61): n=a or c
agcctgtatttctccagctgatatcatggcaaatttaggtacatggaacacgtgacaggtnttttttcccccgtactaatgctactgtagtcactggcatcttaacctccagtccaaacta

SEQ ID NO: 7499 - DNA, 121 bp, Artificial Sequence
  Synthesized
  misc_feature (61): n=a or g
gatacactgtaataactttatttaagaggctggaggaaatccatgcagatgtgagagttgnggtgcaacagtgtgcatcttgttgggaaggcatgcacagaagtttctgtgtcaggttttc

SEQ ID NO: 7500 - DNA, 121 bp, Artificial Sequence
  Synthesized
  misc_feature (61): n=t or c
atatgttaggatacatttactctaaattagccaaggtaaataactttaccagagatgacanggtaggccagcctctaatacatcctagtagcaagctggtaatctccctagaaacccaact

SEQ ID NO: 7501 - DNA, 121 bp, Artificial Sequence
  Synthesized
  misc_feature (61): n=t or c
gaaatcactgagtccttttatgtttgaggcgccacttggtgctttgctgactgataataantggtatgatgtgatcttctgccttggtggaaatgttattaaaatcgtgtacatgtacaat

SEQ ID NO: 7502 - DNA, 121 bp, Artificial Sequence
  Synthesized
  misc_feature (61): n=a or g
cccaccttcttaaggacctcagacactggctgtgcccttgatctcggcagctccttccctntggcagacaggttcttgtggcctttggtctccccactgaacccttgggcttgtcctgggg

SEQ ID NO: 7503 - DNA, 121 bp, Artificial Sequence
  Synthesized
  misc_feature (61): n=a or g
gcattatgctctattgtcagatattgtaccccatgtttttcgatatcatgtcccattttcnatatcataccctgtattttcagaaatcattccccattttcagataccacgccctattttc

SEQ ID NO: 7504 - DNA, 121 bp, Artificial Sequence
  Synthesized
  misc_feature (61): n=a or g
cttactttaatcatcccagccccttgagatgaagaatcaaaataaacttctgttttatgtncttcctacatttggcacacacagcccaaccatgaagctgtccttaagtctgcaagccctc

SEQ ID NO: 7505 - DNA, 121 bp, Artificial Sequence
  Synthesized
  misc_feature (61): n=a or c
gcagatccctcgccttgataaatatccatttcccataaacaaatatggtgagcggcttganctcattcattatccctgccttcagatttcagctctgttttttaaaccatggggttggctg

SEQ ID NO: 7506 - DNA, 121 bp, Artificial Sequence
  Synthesized
  misc_feature (61): n=a or c
aaacctgaggtttgtgcggctgttcttgcaaagggcagagctgtgtgttctgtttgaggtntctgagcccagagagcagcttcatattttgttaactctgattaaatgaaatctgatgaag

SEQ ID NO: 7507 - DNA, 121 bp, Artificial Sequence
  Synthesized
  misc_feature (61): n=a or g
aatgcagcccgctgaatagaacgcatgaattaacacagaagttagagtgagacagaaagcntgcctcattggagctggcaaacaggagcaaacaggtacccccatgttattgaacatttac

SEQ ID NO: 7508 - DNA, 121 bp, Artificial Sequence
  Synthesized
  misc_feature (61): n=a or g
gttttcctaactatggaatttgaattttcttaactgtggctttccaataacttcctggctngtgatctagttagatgccccagcagtggtgcttaaaatatgctccagtcagatgtatgga

SEQ ID NO: 7509 - DNA, 121 bp, Artificial Sequence
  Synthesized
  misc_feature (61): n=a or g
tctttaatgggaaaggtaaacaattacctaagccaaaatattttccatgatacgtacgcantagccataaaaacacagaggaataaaatggtgttgcactgacatgactgataaaaaccaa

SEQ ID NO: 7510 - DNA, 121 bp, Artificial Sequence
  Synthesized
  misc_feature (61): n=a or g
agatcagtctatttacttgggatatctttgaggtggagcatggagatgttgagctgttaangctgcagagctataaatattttactacctctaagaagcaccttctcctcttggtagttta

SEQ ID NO: 7511 - DNA, 121 bp, Artificial Sequence
  Synthesized
  misc_feature (61): n=a or g
aatatttgtaatttcttcaataatcagcacggtgttctgtaaaacttgcttaaagactgcnacctgacacaagactgtaacctcgtgctcgtttgtaggtgctgcatatgccagcagctat

SEQ ID NO: 7512 - DNA, 121 bp, Artificial Sequence
  Synthesized
  misc_feature (61): n=t or g
cctttgggaagaaagcagataattcatgagagcaagtagttatcttccatgcaatgaaganagagtaaattctagatggattattttttctcagctatttttgcagagcactcatttgtta

SEQ ID NO: 7513 - DNA, 121 bp, Artificial Sequence
  Synthesized
  misc_feature (61): n=a or g
tacaccccagaactaaaacacgagtggaggtttttccatgatcgtggtgttttctttctcntgcttttatttctgaaggaaaactgggagtgaaatccttccacgagtcacagctcagagc

SEQ ID NO: 7514 - DNA, 121 bp, Artificial Sequence
  Synthesized
  misc_feature (61): n=c or g
ttagaaggttatcttccttatctcaggaaaaatacaacgtctcaatcggtatgtatttgtnctcctatttgtatgttgatctctgttcagaacatccttctgaaggcaacgaaaggcatca

SEQ ID NO: 7515 - DNA, 121 bp, Artificial Sequence
  Synthesized
  misc_feature (61): n=t or g
catgtaaaaaactatatagcatcttcccaaaacctgaatacgaggtcattgagttgagaangacactttttacagaatgtaaatttgttggctaactggttcaggaggcagcctgtatttc

SEQ ID NO: 7516 - DNA, 121 bp, Artificial Sequence
  Synthesized
  misc_feature (61): n=a or g
cgttggtaggggttgaattacagtgagctgtgtctgatttcatgtcaggtgagcttaaaanttgggcagtaataacgttaattcccacctcctgtggccagagctgtggcaggcttcaaga

SEQ ID NO: 7517 - DNA, 121 bp, Artificial Sequence
  Synthesized
  misc_feature (61): n=t or c
gtgtcatcacatgtcctcccaaaaaacatcatgagcttccacccgattcagataatctacngtaaccaagaaacaccgaaattatgggagtgcatggtgtagcaatggatgtttttttttt

SEQ ID NO: 7518 - DNA, 121 bp, Artificial Sequence
  Synthesized
  misc_feature (61): n=c or g
ttgggtttttgcattgttcctcggtcatggagcaggaggtatgcctcttgctggaactggntgggatgtgtgcagtgtgttagctctaccaggcgtcctagcactgcgagacaggcaagat

SEQ ID NO: 7519 - DNA, 121 bp, Artificial Sequence
  Synthesized
  misc_feature (61): n=t or c
gcagtgtaattaattggccaggcttcggctctttttctgtgcctcctgcatgtcagaagangtagaaatatctgaataaccagcttgaatgctgtgggaatttgtaatgaaaagtgcatgt

SEQ ID NO: 7520 - DNA, 121 bp, Artificial Sequence
  Synthesized
  misc_feature (61): n=t or c
ttcaattaattcctttttgatgttcattcacccactaagacaggctttgcacctttccctngtgattccctgctgatgttcaagctctctgaaatgtaaagaaatctaaatgtaatataat

SEQ ID NO: 7521 - DNA, 121 bp, Artificial Sequence
  Synthesized
  misc_feature (61): n=c or g
aaaaaaaacttagtcaaattaggcaaacagtgttgagccatctcctaatgtataaagttgntttgaggttatccagctaccttatgattctgtttgcatgtctctattttctggggaaaca

SEQ ID NO: 7522 - DNA, 121 bp, Artificial Sequence
  Synthesized
  misc_feature (61): n=a or g
ccagcactgagtggacagaaagggttggaggggatggttggatatcggggctggtcagacnttgggctactatggggatgcagagttttcagctcagaaagtggtaaatgaggatgccata

SEQ ID NO: 7523 - DNA, 121 bp, Artificial Sequence
  Synthesized
  misc_feature (61): n=t or c
cagactgtgggcacacactgcaaacgcctgcactttgctctgcacgttacacccaggacanggatgattcttttccatttcttgccctcagctgttaatgtcagttttattttaactgtct

SEQ ID NO: 7524 - DNA, 121 bp, Artificial Sequence
  Synthesized
  misc_feature (61): n=t or c
aagcatctgtagatttgttctgataagggtgaactgtttaacaagttacccacactgatcncatgatcagtattcaaaaagatgtacagttaggaaatgatgacttacaacagtcagaaca

SEQ ID NO: 7525 - DNA, 121 bp, Artificial Sequence
  Synthesized
  misc_feature (61): n=a or g
cacctctaaggggagaaacagcgttagagaaacactatcaaatgtcttcataggatctgcngctttgaaatgacacaggtcagcactggcaacttacattttccctggaaaagcttagagt

SEQ ID NO: 7526 - DNA, 121 bp, Artificial Sequence
  Synthesized
  misc_feature (61): n=t or g
ttttactttggaaaaagactgcccacttgccaagtggactgagctaattagaagccaaacnagaaatgaaaggaaatacttgggataattctcctatttacgggaagctgtttctcagaga

SEQ ID NO: 7527 - DNA, 121 bp, Artificial Sequence
  Synthesized
  misc_feature (61): n=t or g
caagatcagaacagctcagagttgttaagtatgcagcagccacctaaatcaggacacttcnggaagtggaagtgcccacgtatttttagaacgatacagtatcttatttatagcctctcca

SEQ ID NO: 7528 - DNA, 121 bp, Artificial Sequence
  Synthesized
  misc_feature (61): n=t or c
cccgtgaaaggaagagtgctgttgtggtagtgggagctgcacagcaatgggctttattganattttaatatatttacctgctccacggctggccacagcttcctcagcactctccagcgct

SEQ ID NO: 7529 - DNA, 121 bp, Artificial Sequence
  Synthesized
  misc_feature (61): n=t or c
gattacttttagcaagactcttaaactttgtttccctatcgagtagaacgtttctctctcnggatggtaagctttagaatgagcacaattatatctagcagtatgtattgatgcagtgtca

SEQ ID NO: 7530 - DNA, 121 bp, Artificial Sequence
  Synthesized
  misc_feature (61): n=a or g
tatacatacatacatacatacaataccaaaacttatcatcaagaaacttaactcccttcanctcacagccacagcccatcctactcaagacaaggagtgaagcactgaggttagttttagc

SEQ ID NO: 7531 - DNA, 121 bp, Artificial Sequence
  Synthesized
  misc_feature (61): n=t or c
agctcatttcattttcctcctagctgctgctcaccttggcttcaggttcctgccttcagtnattttgttgtgctgtttctatgtaaagttagcagtggatcagagttggagccaggctgac

SEQ ID NO: 7532 - DNA, 121 bp, Artificial Sequence
  Synthesized
  misc_feature (61): n=c or g
gggagctgctgatgctgctgccacccaaaagttaacatcagtggggctctgtgctgcagcnctcacctctctgttggaggaacgctcagaaaccattggggttggggtggatgcccggaca

SEQ ID NO: 7533 - DNA, 121 bp, Artificial Sequence
  Synthesized
  misc_feature (61): n=t or c
agccaggtctcgtttatctgtagatttcccattctgcactacgggagtgcagctctggccnttgctggccttagtagtgagcctgcaaagactccacggtttggctgaggtgtagagcaga

SEQ ID NO: 7534 - DNA, 121 bp, Artificial Sequence
  Synthesized
  misc_feature (61): n=a or g
tgggagaaggcaggatgcctacaatccatgaggtcaggcagggatggtttggttgttaggntagttgttagagctgggcagtcaccatcttttgtctcgttcactcttggggttataacat

SEQ ID NO: 7535 - DNA, 121 bp, Artificial Sequence
  Synthesized
  misc_feature (61): n=t or c
gtggcctctgctgtgagtcagcttctccaggtctgccatcagctttgtcttcttttcctgngtttctgcccaagtttgctgaactcttttctgtgttggtgttatccaaatctatctgcag

SEQ ID NO: 7536 - DNA, 121 bp, Artificial Sequence
  Synthesized
  misc_feature (61): n=a or g
tgtggtcttgaataaccttggttaagtatggaggacacttcttgagtcctcagtcttttgncttctagatttgtgcttgaacgcactgtcggtttgctttgttacgggataaagccaatca

SEQ ID NO: 7537 - DNA, 121 bp, Artificial Sequence
  Synthesized
  misc_feature (61): n=t or g
tcttagccaggctgaaagctcgagccagcccaaagtctgcaagcttcaggactccatcccncgtgatcagaacgtttgcagctttcatatctcgatgcaagatctgtacaaggacagacat

SEQ ID NO: 7538 - DNA, 121 bp, Artificial Sequence
  Synthesized
  misc_feature (61): n=a or g
gtccccctaggcatatcaatgggcttataaccaagctgggaacagcatccctggtccccanagtccttgggcacagggcactgagccacatccccacgggatggtggcactggggctggaa

SEQ ID NO: 7539 - DNA, 121 bp, Artificial Sequence
  Synthesized
  misc_feature (61): n=a or g
cagcgttccctccctcccgaggataacctggagctgccgtcagccagcaccgtactacacngccagcagagaactgagctgcttttgttcacctccccccagacaaagcctcaccggttat

SEQ ID NO: 7540 - DNA, 121 bp, Artificial Sequence
  Synthesized
  misc_feature (61): n=t or c
tggagttgcttttctaacgcattggctccctgatgctcttattacttttggcactgggctngcatcccgattaagcacattggctcctgttttctctatttccgcattggcccactctcag

SEQ ID NO: 7541 - DNA, 121 bp, Artificial Sequence
  Synthesized
  misc_feature (61): n=a or g
gatgtggatgatgtgatggttttttatagagaactgaaagtgatgaaaaaagcaggggatncaaggaggtgattatccagtgtagacactgtgtggatgcccaagtttgaaacaatagcct

SEQ ID NO: 7542 - DNA, 121 bp, Artificial Sequence
  Synthesized
  misc_feature (61): n=t or c
taaagtaacattcatgggcatgccagaaaaacagagacaacttcccaaagataaaaccttnccaatactggggttactttcaaggtaatgaacacaacttatttcatatatccaattttga

SEQ ID NO: 7543 - DNA, 121 bp, Artificial Sequence
  Synthesized
  misc_feature (61): n=t or c
acaacagagcagtcttttcctttcagttgaatttcttttattacctcaagatccctgaaanatgggtgcacaaaccaacaacctcttctctctgctgatgcagatagagaagacacagagg

SEQ ID NO: 7544 - DNA, 121 bp, Artificial Sequence
  Synthesized
  misc_feature (61): n=a or g
agagggggaatgataggggagatttgtgggggtggggggggaaacaccacctattgcaaanagcttttgtactgtaaagcaattcaagtatttaaagaaaagggtacaagttcacagaaaa

SEQ ID NO: 7545 - DNA, 121 bp, Artificial Sequence
  Synthesized
  misc_feature (61): n=a or g
tgtatggtgatgtatctgaatttcagcagcctaatttgaggcttagaaaaacttctaaacnaagttccttgttatcttcagtgtattttagatcagcctttagcaccaaagcatcagatca

SEQ ID NO: 7546 - DNA, 121 bp, Artificial Sequence
  Synthesized
  misc_feature (61): n=t or c
gcctgctggtgtcattccattgtggctgctcccgggagctggtctttaggacagaagcagnctttggcagccaacccagcagtagcagatggagatatgaagagcaggaagaaagctacaa

SEQ ID NO: 7547 - DNA, 121 bp, Artificial Sequence
  Synthesized
  misc_feature (61): n=t or c
aaagaaccccgaaatcctccatgccaatctgctcaatggaaaacctctgcacatttgctgngcctctgagaagcccctggaacctcgcttttcttccttcagcagcttctcagatgtgagt

SEQ ID NO: 7548 - DNA, 121 bp, Artificial Sequence
  Synthesized
  misc_feature (61): n=a or g
ggaaacattactagaaagctggtttcccagcagggatacaccactccagcacatctaagangtgtgcaggtgtatataggcacagctcagatgtaacttgcagaatgattgttttacgtgc

SEQ ID NO: 7549 - DNA, 121 bp, Artificial Sequence
  Synthesized
  misc_feature (61): n=t or g
actccagctctctgggtttggatgaatccatcattggagacagtgccttgtttgtctgaanctgacttcagcccagaagtgtaagttgtagctttattgtctaggacgtatcccttaaaat

SEQ ID NO: 7550 - DNA, 121 bp, Artificial Sequence
  Synthesized
  misc_feature (61): n=a or g
gtgcaaattacagcacttctgtgaatgacttcactttgcctaagttaggaatttgggggancttccttcacacatctgtgcattactagatacatcaagaatgatgaaaggctctcctctg

SEQ ID NO: 7551 - DNA, 121 bp, Artificial Sequence
  Synthesized
  misc_feature (61): n=a or g
ggagaaacatggcatcctctgctaggtcattccctagagcagaaggtgtgtttacacagcntaggtaataaatacagctcttggaagcaacagaaatcactgttcggagtctggttgctaa

SEQ ID NO: 7552 - DNA, 121 bp, Artificial Sequence
  Synthesized
  misc_feature (61): n=t or c
ctctcatcctaaagccagcagacattgagacgtgagggctcgcacagaaggagtggatttncctgtccattgctggccccatttcatactgagagctcacactgtgcctttttgtggtgcc

SEQ ID NO: 7553 - DNA, 121 bp, Artificial Sequence
  Synthesized
  misc_feature (61): n=a or g
tctcactgctggttccttaggtctccatcatcaggaaaattcaggtactgcaactgctgcnaaatcctccccacccgctctgcagagatgacttcttgtaggaaactccctggtgtgcttt

SEQ ID NO: 7554 - DNA, 121 bp, Artificial Sequence
  Synthesized
  misc_feature (61): n=c or g
gcaaaataaagcataatttatttctgtgtttatgagggtaatacatgttataatcttggangacaacaacaaattatttcagtctgttatttatgcagtgatgttcttgtcgcactgcgca

SEQ ID NO: 7555 - DNA, 121 bp, Artificial Sequence
  Synthesized
  misc_feature (61): n=t or g
aaagaatttggaagatgaatcataacagaaatagctagaagagaggtctgcagtatataanaggacctggttaattctttctgtgtcagtttgcaaccctgacatctctcaccagatattc

SEQ ID NO: 7556 - DNA, 121 bp, Artificial Sequence
  Synthesized
  misc_feature (61): n=a or t
aaaagaattgatgaagcaacagttccggattagttgattagaccagcactccaactactcntattatcttattagtagtgaaataagatggattcaagacatctcagctaattttacagca

SEQ ID NO: 7557 - DNA, 121 bp, Artificial Sequence
  Synthesized
  misc_feature (61): n=t or c
cacatacaacaccagcacattgaaaacagtagagaccatttccacaacagactctgcaacngctaataatcatcattgctttataaacatgtgtttgtcacatcgcaattgctgatcactt

SEQ ID NO: 7558 - DNA, 121 bp, Artificial Sequence
  Synthesized
  misc_feature (61): n=t or c
aaagcagtacttgcagcaagacaagcactgaataaaaacaacacagctgaagacaaaattngaccgaggacattcagcagttagccccaaagaggctcaaaacagaatgaaatttggtgtc

SEQ ID NO: 7559 - DNA, 121 bp, Artificial Sequence
  Synthesized
  misc_feature (61): n=a or g
tgttgttgttgttgttaagagcttggacacctgagcatcaattttttgaaacaagagctcnaaaaagagaagcaaaacaagcaggtcagtggggtgcctttgagctgcactcagtttcgtg

SEQ ID NO: 7560 - DNA, 121 bp, Artificial Sequence
  Synthesized
  misc_feature (61): n=a or g
taggagctgccctggatgctcccacaggactcagcaattctgaggtgcctgggacagaganccctgctacagctctaactcagtgtgacagcttgtaattaggtttcccttctgtctccag

SEQ ID NO: 7561 - DNA, 121 bp, Artificial Sequence
  Synthesized
  misc_feature (61): n=t or c
aggatctgtccttggtgcttctgactatccgagactgggcatggcccagccaacacttacnggttttgttggaattgtttccaaacagttgcactgaagttattgtggatgatcccaggtt

SEQ ID NO: 7562 - DNA, 121 bp, Artificial Sequence
  Synthesized
  misc_feature (61): n=t or c
gataaaaaacagaaattctgcttgtctcactgcccaaaataatgcaacagtttagcaagcnagaagtacgcatcttaattaaagagaaaatgtctaaattcggtctggctgcaaaagaagc

SEQ ID NO: 7563 - DNA, 121 bp, Artificial Sequence
  Synthesized
  misc_feature (61): n=t or c
cactgcttcactcgctgtaattgcatggttcacattcacaacagtggttttttcaaggtgntccataaaaacagatggattccctcttactttctgctggagaaatgctttggcgtacaaa

SEQ ID NO: 7564 - DNA, 121 bp, Artificial Sequence
  Synthesized
  misc_feature (61): n=a or g
aagtaaacaaatctaagaaatgtcttaatctgaagatgggtgagctttaccttctgtctgngtctgcacccgggagcttcctgggtaaccagcaatggcagcgtgtgcagccctgctgact

SEQ ID NO: 7565 - DNA, 121 bp, Artificial Sequence
  Synthesized
  misc_feature (61): n=t or c
ctttggtcaagttcattcggccaggagtgcagacaaacaaggggaccataagagatgcaanagagaaaaaacagaacaacactgtaagatggattttacttccataatactctatggctgg

SEQ ID NO: 7566 - DNA, 121 bp, Artificial Sequence
  Synthesized
  misc_feature (61): n=t or c
cgagtgaataaatgtaggaagatacagggtgatacctaggcaagaaatacacctctcccantgaaatgtgttcctggctggtgcagtggttgtgctgcctattttctatacaatttgtaca

SEQ ID NO: 7567 - DNA, 121 bp, Artificial Sequence
  Synthesized
  misc_feature (61): n=t or c
agatatgttaggaagccacagtcactgtttgttttgctggtgtagaagcagctcaaaagcnttcccacttgcagcttgaacacagcaactacatcctgaacgactcctgaacttgtctgtg

SEQ ID NO: 7568 - DNA, 121 bp, Artificial Sequence
  Synthesized
  misc_feature (61): n=a or g
ttgcaacagccctaagccttacaagaagatttgcaagaggataggaaagggtcatcaaacntgctgctgtgaaatctgactggatgtatcctctttgttatcagcaagatcctcaagaagg

SEQ ID NO: 7569 - DNA, 121 bp, Artificial Sequence
  Synthesized
  misc_feature (61): n=a or g
agcatcctcagttctctgtgatcttgggctgcccatgagcagcagccaaaatcaccatcanagcagcaggcatgggacgttcctcctgtgagctccacagatgtctgtggccatggaaata

SEQ ID NO: 7570 - DNA, 121 bp, Artificial Sequence
  Synthesized
  misc_feature (61): n=a or g
tttagatcagtaactccaggtctaccgcaatatcactcattactattttaatagacttggnctagatgaagaaagtatgatcaagtattactggtagccatataaaatattggaaggtatt

SEQ ID NO: 7571 - DNA, 121 bp, Artificial Sequence
  Synthesized
  misc_feature (61): n=a or g
tcagattcttcaaggtaatgtttgcactaaaaagccattctgtccaacaaaatagtagcanagcactatgctaaatacggcatgactaagaacccatttaatgtcatgttaataagcggat

SEQ ID NO: 7572 - DNA, 121 bp, Artificial Sequence
  Synthesized
  misc_feature (61): n=a or g
ttttagaagtacattatgcttgaaaaacattccttcatttttatctgttagacgtaccaanttcttaaaatatgtacagcagccacagcatgccatgaacccaacacctgcagtatgctgg

SEQ ID NO: 7573 - DNA, 121 bp, Artificial Sequence
  Synthesized
  misc_feature (61): n=a or g
ctgtgagatggggcagcaaacagaggcactgcccacacttggggtcagcagatgcagcccnccccactcagtgagacagcacagaaagcaagatgggagaaggcgagtcagtcatccaggc

SEQ ID NO: 7574 - DNA, 121 bp, Artificial Sequence
  Synthesized
  misc_feature (61): n=t or g
caggagacaaggcacttgctcagttacgaattagttggtgaacgctgtgtgtgtttccacntcctgtctgtgcacacttatcccagccctgcagcgaggacagggtgacaccagcatttct

SEQ ID NO: 7575 - DNA, 121 bp, Artificial Sequence
  Synthesized
  misc_feature (61): n=a or g
aattgatactgtgaatacaaaaaattatacttgtctgactttatagaggagaggaagcggncctgaactccagatgaagagtttgtgaggagaccctcaagaatgggtgccttcctctgca

SEQ ID NO: 7576 - DNA, 121 bp, Artificial Sequence
  Synthesized
  misc_feature (61): n=a or g
aatatcaaggaagaaaaatataagagaaataaaaacatcaggtagtgctgccccaatggcntgggttaagacaaataagcacatgcacgtgactggtcattaacagtattttcctttgatt

SEQ ID NO: 7577 - DNA, 121 bp, Artificial Sequence
  Synthesized
  misc_feature (61): n=a or t
ttgtttgtttttttttaatgagatttctccactgacatttctgaactgtttctatcccctnttgaaatgtcttatttaatacaaagttctctgtttcatttctcctataagtacttcaagg

SEQ ID NO: 7578 - DNA, 121 bp, Artificial Sequence
  Synthesized
  misc_feature (61): n=t or c
gaatggtttacactgtttctgtagtgtaaatgtgctaggtggagggaaagatgaataaatntagcttctctgaaagaggaattgtcacatcatatgctagcttggaagagaagtagtaagc

SEQ ID NO: 7579 - DNA, 121 bp, Artificial Sequence
  Synthesized
  misc_feature (61): n=a or g
ccctgcatgccctgaaattgttcctatattcctccaaaatgaccagtctaaagctataaangaggaatgtcaggttcatgattgctgcacaaaattccacagataagtcataggtctccac

SEQ ID NO: 7580 - DNA, 121 bp, Artificial Sequence
  Synthesized
  misc_feature (61): n=a or g
tccagctgaaaatgctgccgtaacagcagtggagctggatactcatgcaattagaagtcancatatgctggttacagtttacagttccttgtgtaaaggctgggcttttaacagcagtttt

SEQ ID NO: 7581 - DNA, 121 bp, Artificial Sequence
  Synthesized
  misc_feature (61): n=t or c
cagctctaggaacacatctgctgaaggcaggggcatactaggaggcaaagcataggctggncttagggcctggtgcctggagctggaggatgcctcagctctccatggctgctgaagaagg

SEQ ID NO: 7582 - DNA, 121 bp, Artificial Sequence
  Synthesized
  misc_feature (61): n=a or g
tcctatcttgaagtagacacctactgtgtggttcacttgtctccatggggatgcttggagngacttaggatgctctgcaatgtcccagctggcttccagctgccagttcagaaacattcaa

SEQ ID NO: 7583 - DNA, 121 bp, Artificial Sequence
  Synthesized
  misc_feature (61): n=a or g
cttataaaatcaagctccttttttaaggcccatgacagctctgtggtgtggatgcacaagnttaggagagaggcacttttctccgtgctgctgtcacagagcatatgaggagagcattcat

SEQ ID NO: 7584 - DNA, 121 bp, Artificial Sequence
  Synthesized
  misc_feature (61): n=a or g
atgtattgtcacttgagatatgtgttgctacatgattgttaaggtttagttatttcctctnaaagaaagtgtcctgctctgaaatcaagatgagacattggaatacatttcagaaaacttt

SEQ ID NO: 7585 - DNA, 121 bp, Artificial Sequence
  Synthesized
  misc_feature (61): n=a or c
ccccttcccaactgacccaatctatcactgtgagctgaatgcaggtttggctttgccattncccaggagctttctccagctgtgagggtgctagtctccttgggagatgtgggccacccac

SEQ ID NO: 7586 - DNA, 121 bp, Artificial Sequence
  Synthesized
  misc_feature (61): n=a or g
tggtatccattaaggcagcatccagatgtctcacagcctgttgcatatttaacaacacaancgacctatgggatgttttccttgtggaaacaaagccctaaattctccagtacgttcaggt

SEQ ID NO: 7587 - DNA, 121 bp, Artificial Sequence
  Synthesized
  misc_feature (61): n=c or g
tgtttggtgcaacaggaaaaggactgagaaatccttcaatgtgaactacaaatcctgactnattctttcttagacataaccaaatccatagaaccggaatggatgcacactgatgtgctga

SEQ ID NO: 7588 - DNA, 121 bp, Artificial Sequence
  Synthesized
  misc_feature (61): n=c or g
tttaggttggttgaactgtgatcacctgttctaaagtctggctgggctctgggtttaacantcctttttgatggatctgatgaaactggagtatgaaatcacaaaaataaaaccctgttct

SEQ ID NO: 7589 - DNA, 121 bp, Artificial Sequence
  Synthesized
  misc_feature (61): n=c or g
gtgcatttgatttcactgcactatggcatgagaagcaggtttgggcagttacacgttcctnttgtgtcacccaccctttggtcaccaatgatcagtgttgcttaaatagcttgttttgctc

SEQ ID NO: 7590 - DNA, 121 bp, Artificial Sequence
  Synthesized
  misc_feature (61): n=a or g
ttaggtctctgctgaaatgtagttgtagtcatgcctgggtagcctgaccctgggagtaganggaacattggctttgcaaatggaagaggaagataaatcaccctgttctggttctccctgg

SEQ ID NO: 7591 - DNA, 121 bp, Artificial Sequence
  Synthesized
  misc_feature (61): n=t or c
tctgttctggaggaactgttttggtttcacctttgtggttttattttgttgtgttggttcnttttcctttgttaaagttgctgcactccctttcaaagccatttgtttactgatggtggat

SEQ ID NO: 7592 - DNA, 121 bp, Artificial Sequence
  Synthesized
  misc_feature (61): n=t or c
aaaacaccagctgagagactgaaggctccagggcaacccaaaatggccaaggcatgataanacttactgacacccaaactgtagggacatgtccccacaggtcagcacatcctctgcctgg

SEQ ID NO: 7593 - DNA, 121 bp, Artificial Sequence
  Synthesized
  misc_feature (61): n=a or g
cagctgccctgggcgcactgcaggttatggagaaggggttatggaggaggggtttggagcnccagagagacttccagcaatgtgattgatctgccagcacctctcttgtgtggggcagaaa

SEQ ID NO: 7594 - DNA, 121 bp, Artificial Sequence
  Synthesized
  misc_feature (61): n=t or c
ccgctggcagctccaggtggggacctcacgtctgcgagggatgcaaccacaatgcagcacngactatgggacatcagctcctgctccaacagctgcacagcgtgctgaagtcagaggaaat

SEQ ID NO: 7595 - DNA, 121 bp, Artificial Sequence
  Synthesized
  misc_feature (61): n=t or c
aattggtataaaagtgagctgtcagcttccatttgtcaatgggaatactgttgtggcaaangctgttaaaaaaggcaagtgaattagattctgcattaaatggagttagggtaatgtactg

SEQ ID NO: 7596 - DNA, 121 bp, Artificial Sequence
  Synthesized
  misc_feature (61): n=a or g
ctgtgaagggagggaggcaaatgggagcttggctttggagcaagaacatgagagtgagcantgttaccgagcaaaggactgcatgcagaagggcccatgagccttggtctcaatggcaaag

SEQ ID NO: 7597 - DNA, 121 bp, Artificial Sequence
  Synthesized
  misc_feature (61): n=c or g
ttaagttataaagttggcaacacaagtgggaagaacacagtgcctggaacagccataatantaccattgatacctagcaccaaaccttcctttggcagagaaacatcagaagctggacgac

SEQ ID NO: 7598 - DNA, 121 bp, Artificial Sequence
  Synthesized
  misc_feature (61): n=a or t
ttttcatcataagaatagaaatatcttgcctaagaacagcaaaggatgaataacagaggcnggacttctcttcagagctgagcacagcgatatcccatcctctggggaccttggcaccctt

SEQ ID NO: 7599 - DNA, 121 bp, Artificial Sequence
  Synthesized
  misc_feature (61): n=t or g
ccttcttggctatagaaagacctgaacatcatctgtaacatgtatcgctatttaccaactnatatttcctcttaaattctactgcatttcatagttaaactaatcttataggcttgcattt

SEQ ID NO: 7600 - DNA, 121 bp, Artificial Sequence
  Synthesized
  misc_feature (61): n=t or c
cattgggctgttgggtaatacgtgcatgcaggtgctgtgcaggcacacagcaaatagtcantgctccaaagagcccatagcagtaggtcaaagagaacattgctttgcacgtggggcagca

SEQ ID NO: 7601 - DNA, 121 bp, Artificial Sequence
  Synthesized
  misc_feature (61): n=a or t
ttatacatattttggtatatttttcacaatagtgatagaaccaaactactcagaaagcccnggaatgtgcagtacattactatacatcttgtctgtggtctgaaaaattcatctgtgaacc

SEQ ID NO: 7602 - DNA, 121 bp, Artificial Sequence
  Synthesized
  misc_feature (61): n=t or c
aggcctgtgggatgcccaggctgatgggaaacctgtagtaaatcctacagcctgcttgtcngtggcctaaagcagggaaggctctgaacagctcccgctgcatgtcgctgctgctgggcca

SEQ ID NO: 7603 - DNA, 121 bp, Artificial Sequence
  Synthesized
  misc_feature (61): n=a or g
attacacgtagcctcttctcccctcattctgtactcaaatgccttcttatttcaaaagatnttcaagttgcaccctttctatgactcaggagcaaaagttctcagaatagcatgaagtgga

SEQ ID NO: 7604 - DNA, 121 bp, Artificial Sequence
  Synthesized
  misc_feature (61): n=a or g
atctatctcatgtcaggtacaccctatacgttttattcttaaaatagtcttctgtcaccangcaccaattgcagttgagaagctctaaatctcagatggattttcatatacttgcacattg

SEQ ID NO: 7605 - DNA, 121 bp, Artificial Sequence
  Synthesized
  misc_feature (61): n=a or g
agataatccctgttagcaacgttgattatgcagaataccaacgcacatctgtaacgtggancaaaacttctgttggtgtagaagtaccccggctgtttgctccagtatgaataacatgtac

SEQ ID NO: 7606 - DNA, 121 bp, Artificial Sequence
  Synthesized
  misc_feature (61): n=a or g
gaactaatcagtgttgacgagaatgcagtgcggtcagtggagcgtcagcgatgggatggantggctacaaagcatcgctgcagagaggatgcctttctgtttaatgctgttgttaccaaac

SEQ ID NO: 7607 - DNA, 121 bp, Artificial Sequence
  Synthesized
  misc_feature (61): n=t or c
gttatcacttgaacagtcaacaaagaaacatttttcttttctaaaatgttaaagtatacangtgcctggatactgcatgactgaaaacctcgttatttactaaggtagccaatattccaca

SEQ ID NO: 7608 - DNA, 121 bp, Artificial Sequence
  Synthesized
  misc_feature (61): n=a or g
tgccttgtcctgtgaggtagggaaattgatcccttttgccatatgctgaaaaaggtggctncttacatggccttcttggatcttttttgcagtgagagggtggaaaatgtgatacaaacta

SEQ ID NO: 7609 - DNA, 121 bp, Artificial Sequence
  Synthesized
  misc_feature (61): n=a or t
taccgtatgcctttgtcctcaacctcttccactttgtgatctgggcgttttcagtgcatcncgtgcccaaggtcttggcttcctgtagcataaacctgatttgggagagtgcccatgtgac

SEQ ID NO: 7610 - DNA, 121 bp, Artificial Sequence
  Synthesized
  misc_feature (61): n=a or t
ctcccatgcagaacagctcaccatgtccagcagcagggaagttgcagagcaggtagaaaancatgtgcaaataagcctcacctacatggttttcaagatgataaataggtgaaggcaaatg

SEQ ID NO: 7611 - DNA, 121 bp, Artificial Sequence
  Synthesized
  misc_feature (61): n=t or c
cattgtgcatagggatgtctctgagccaggtttggagcagctccagctctgtctgtgcctnccagagaacttgggtaggttttgtttggtgcctccatccatctgctggtgcagggctgac

SEQ ID NO: 7612 - DNA, 121 bp, Artificial Sequence
  Synthesized
  misc_feature (61): n=a or g
attattagtaacaatttgattttcacaaaaatgtttatgagtacttctgtagaaggcagcntggaggcacagaatggaatccagctcttgctccaatcttagcacagagaggtttgttaga

SEQ ID NO: 7613 - DNA, 121 bp, Artificial Sequence
  Synthesized
  misc_feature (61): n=a or t
aaaatccctttaatatgaaaactgtgtgtaaaacgttgtctaataagattaagtgcacacngctttaaattgaaggattgagttcccgtttctgcccagaattcttatgcagctctggctg

SEQ ID NO: 7614 - DNA, 121 bp, Artificial Sequence
  Synthesized
  misc_feature (61): n=a or g
atctggaaatagctgtttgtcttggacatttccagggaagtgacatcatgcgctgtgtctnttgggatattagttctgcatttttcagcccagattctggcactaaagttggcaaaattag

SEQ ID NO: 7615 - DNA, 121 bp, Artificial Sequence
  Synthesized
  misc_feature (61): n=t or c
aatgacatagaatgacaaacattctatgctgtgtatacattttaaactatgttgtcccagnagtggctgctgcacattcataatgtttaagtttcctacataagtaagagctggggaagct

SEQ ID NO: 7616 - DNA, 121 bp, Artificial Sequence
  Synthesized
  misc_feature (61): n=a or g
gagccagcaatgagcatcagtgatggctcttgttacgagctggattgctcttcctctttcnctatagtggtgtaaaactcagatggaaaccttcagcttcccttctctactcttgtagttc

SEQ ID NO: 7617 - DNA, 121 bp, Artificial Sequence
  Synthesized
  misc_feature (61): n=a or g
cttttcatgcagtagtttggtcttgatgcactttgcaagaattgcaaattaacaaggagancacagcagcttcttcattgggtaatgctctttttggaaagattctgcaaggaagagaaag

SEQ ID NO: 7618 - DNA, 121 bp, Artificial Sequence
  Synthesized
  misc_feature (61): n=a or g
agttctgttgagctctgtgagccagggcaatgccaagaaggggagcagaggaagatacagntgggctaaagcccatttgctctgggaggctggggaggaccccactgaggaagcaaaaaaa

SEQ ID NO: 7619 - DNA, 121 bp, Artificial Sequence
  Synthesized
  misc_feature (61): n=a or g
tgtcgagcatcagtgttattgctcagaaaagtcagaattttgttcccttgttgaagtttcntatctgtaatgtcctggggaacatgaagtcaacttagaagctccagctaagttaaaattg

SEQ ID NO: 7620 - DNA, 121 bp, Artificial Sequence
  Synthesized
  misc_feature (61): n=a or g
tgaaaattgaggtaacccaggaaagtagaacaaataagtggaggggaggaacttgcaggcnttaactaggttaaattcacatgtctggagagtgaaaacatcccaagctcatgtatggtat

SEQ ID NO: 7621 - DNA, 121 bp, Artificial Sequence
  Synthesized
  misc_feature (61): n=t or c
gggctgctgcacacatggagggcactgagatgttaatggtgttcctggtattgggagcaangccggtgttactgcacatgtggacttcttcatctggggcttctcatcccagaggaaagcc

SEQ ID NO: 7622 - DNA, 121 bp, Artificial Sequence
  Synthesized
  misc_feature (61): n=a or g
tttgctgcctccttgtcatgcctaatgctggtagggtgcttatcaagctgaaaaaggaacntattcttctgtaaagcaatgcaaaaaagcttcttttaaggtttctcttgttcacaataca

SEQ ID NO: 7623 - DNA, 121 bp, Artificial Sequence
  Synthesized
  misc_feature (61): n=a or g
gcatgtgactttggctttgctgatgggagaggcaagtgaactgaacttcaaacttgtctcngggagatttctgtccttggaaaggagctcttgcgtgtcacactaaagctatccgcagaat

SEQ ID NO: 7624 - DNA, 121 bp, Artificial Sequence
  Synthesized
  misc_feature (61): n=c or g
tcttctcaagaaaaggggcccgaaggaaagtttttacttctgtttcattgcgttacagcantgggttatatctacatcatgttacaagttaacatttatttacagaaacctgattaagtct

SEQ ID NO: 7625 - DNA, 121 bp, Artificial Sequence
  Synthesized
  misc_feature (61): n=a or g
gaatcatcctcaccaggtatcgctgctgatcacaacacgttgatcaggagcacctcaatgngcagtgagggatttctttttgtgtaatggaattgcataggaagtgtgaagtcctctgggg

SEQ ID NO: 7626 - DNA, 121 bp, Artificial Sequence
  Synthesized
  misc_feature (61): n=t or c
tctctgctgctgtacttctccgattgccatgtgagaacagcttacacaaggcaagaccctngaggatgcttgccaatgggagccagagccttgtctgtacagattactttgatgtcagata

SEQ ID NO: 7627 - DNA, 121 bp, Artificial Sequence
  Synthesized
  misc_feature (61): n=t or c
gaggtttgtgccatttagctactgacaacctgcagcgggttctgcatgggcctgtcagtanggagggaggctcagctggtcagagcttttcaatggatctgctgagacctcctcttgtaac

SEQ ID NO: 7628 - DNA, 121 bp, Artificial Sequence
  Synthesized
  misc_feature (61): n=a or g
actagctctggtttaagacctgtgtccttgctatattcagagaaaaaaaacaattatatgnggtctctgaaaggccacagaggcagaattttcaagcaacacttagacattttcaaagtta

SEQ ID NO: 7629 - DNA, 121 bp, Artificial Sequence
  Synthesized
  misc_feature (61): n=a or c
ttgaactctttggtgcacagtatgttactacagcattggactttatcaggcccctgagccnctgttcttgcctatcctggaagtgccagctctctattaaggaaaagctgtttgagaaata

SEQ ID NO: 7630 - DNA, 121 bp, Artificial Sequence
  Synthesized
  misc_feature (61): n=t or c
tcttttagcaatgtcaaccttaatctgctgagggacaaagcatggtgtgttagagacttcnttgtaaagagcatggattggttacttcctagtaaaactaggggaaaaaaagttacttgta

SEQ ID NO: 7631 - DNA, 121 bp, Artificial Sequence
  Synthesized
  misc_feature (61): n=t or c
gagtgtagtgtagattttgtcaatagtattctcagccaaatccaagttatgggcaaaattngactaaaattagttttgcacttgatataaatcagaatactctctctgttttaaaggaatg

SEQ ID NO: 7632 - DNA, 121 bp, Artificial Sequence
  Synthesized
  misc_feature (61): n=c or g
aaaaaggaaatcccaggcaggtagatgccttgcagttgtttcctaaaacacttacccgcangtcacgctgccctgcacagcaaaccatcaggggactggtcaggaccaaacactgcgttga

SEQ ID NO: 7633 - DNA, 121 bp, Artificial Sequence
  Synthesized
  misc_feature (61): n=a or g
tccccaaagaggaggagcttgactgctgaaaaagaaagtagttatgtattctgaatctaangggctaagtaaaagccacagatttttatacagaaattctgatttctggtgcccaaatcct

SEQ ID NO: 7634 - DNA, 121 bp, Artificial Sequence
  Synthesized
  misc_feature (61): n=a or g
cagtggggaactgtaccggctcaaagtgggacttggagcaggctctgctggctgtgttacntggggtgtatccctgcacttgtgagagtcatcagggcagagtgcttttctgcccccatat

SEQ ID NO: 7635 - DNA, 121 bp, Artificial Sequence
  Synthesized
  misc_feature (61): n=t or c
tgcaataaaaagcatacctctaaattgccacaggaatgaccagttttgaagaggagaattnttgcagctcctacctttacatatagatacaactttgttgaaggtctaagtggagtttccc

SEQ ID NO: 7636 - DNA, 121 bp, Artificial Sequence
  Synthesized
  misc_feature (61): n=t or g
ttcataaagtgaaatttcacagatgtcaaaagagatcttggagtaatagctcccaaatcanatcacctataaagctgcaacagcccccacaatatagccataaagctgccatcaagtcccc

SEQ ID NO: 7637 - DNA, 121 bp, Artificial Sequence
  Synthesized
  misc_feature (61): n=a or t
caaaacagtgagattaacactcaaccccttgtttgaggctgtgcctaaagtgatgaagatngatctaaccattctgagccgtaattgctgttgtactgactgagatgaatgctaatcccaa

SEQ ID NO: 7638 - DNA, 121 bp, Artificial Sequence
  Synthesized
  misc_feature (61): n=a or g
cttgtactgaatgcttccattccgctgctgaaaaaaaatcacgtcagagagcaagtttgtncaaaatgatgggggaaaggatgaaatcagtctatgcatctcatcttggggaaaagtcttg

SEQ ID NO: 7639 - DNA, 121 bp, Artificial Sequence
  Synthesized
  misc_feature (61): n=a or t
atactgcagcacataatctgctgttacagactaagcaaacacactgtgttgtgaaaggctntattccttggctctctctgctcacttagatattcatgtacccttcatgagcaatgtagca

SEQ ID NO: 7640 - DNA, 121 bp, Artificial Sequence
  Synthesized
  misc_feature (61): n=t or c
tgggatgggacgtaaagctttaaaattgagcatgtgcttaattgctgccttaagtagaganggacttcaacgtgtgcctgtgttttcctgtgctggatctctgtactgtagggctgggacc

SEQ ID NO: 7641 - DNA, 121 bp, Artificial Sequence
  Synthesized
  misc_feature (61): n=a or c
attatgcctctgtaccaagttcagcctaagcagctgtgtcccatcctgaagtcttcaaaantgctgggaacaggaaatgctaccaataccaaacacaacagagaaatttcaagacagtcgg

SEQ ID NO: 7642 - DNA, 121 bp, Artificial Sequence
  Synthesized
  misc_feature (61): n=t or c
agaggggagccatgaccttgtcagacatctcctaacacacgggttgaccaaaagcccttcnacaacatttctccttggaatgacgatgctttctattctcaaccgaactgcagaacagatt

SEQ ID NO: 7643 - DNA, 121 bp, Artificial Sequence
  Synthesized
  misc_feature (61): n=t or c
tgtttattaggcgtgtctcactcaatatattcatatatggcataatttgaaaaaatacttnggtgacaaggaaaaattgtgccaaaacagaccccctccttactttcttgtccatgcaaac

SEQ ID NO: 7644 - DNA, 121 bp, Artificial Sequence
  Synthesized
  misc_feature (61): n=a or g
cggacaacttcaaaacacctatgatataccagttattgacaatactgaataatattagtanttttgaagtcaaaggaaattaatttgtatctatgcttagatactgctcccagatcacaga

SEQ ID NO: 7645 - DNA, 121 bp, Artificial Sequence
  Synthesized
  misc_feature (61): n=t or c
cagaacaaacgtgaacattctgcagccaacacacaaaaatccagtgtagagcaatgctgtncttcccatcctcctaggagattatttgtggcttttgggtaagctcagctttttaaccaac

SEQ ID NO: 7646 - DNA, 121 bp, Artificial Sequence
  Synthesized
  misc_feature (61): n=a or g
ttaagatcttatgcttgcaaaagactgtagcgattctacaaacataagaacacacagaaanggataagttgttttactgtctccctttgtgaaacacacctgtgagttctgccacctatac

SEQ ID NO: 7647 - DNA, 121 bp, Artificial Sequence
  Synthesized
  misc_feature (61): n=a or g
gcaactagctttatgaaatttgactcataaaggtagttagatcagccaaggaagctataanaaggttaagtcaaagggagccagagaacaggaaggagtggaaattgtttgggagaatctg

SEQ ID NO: 7648 - DNA, 121 bp, Artificial Sequence
  Synthesized
  misc_feature (61): n=t or c
gggtgagggggggaaaaaaaacaacattatttcctactcgaggggaaaaacaatcagaaangctgagtggactctaagagctgaactgcaaataaggggctgccgggggctgaggagcagc

SEQ ID NO: 7649 - DNA, 121 bp, Artificial Sequence
  Synthesized
  misc_feature (61): n=a or g
gcatgcacctttacattgtctgtctttctactcagaagaatacaatttataaatgtattcngttctaaagttgttgaagaagaaaaaggtcagtatttggtgtgtgtatctaactcaggct

SEQ ID NO: 7650 - DNA, 121 bp, Artificial Sequence
  Synthesized
  misc_feature (61): n=t or c
gaaaaactttcagtgagtaaaatcatcttattgtctttcttaatagtcctcctttgtgctnatttcagatcattttgtgttaattcagtacttcattttttccatttagaaattgctttcc

SEQ ID NO: 7651 - DNA, 121 bp, Artificial Sequence
  Synthesized
  misc_feature (61): n=t or g
gtatatgtagggtttaaattcatgggttaaaggagctctggtagtttgtgtatatacaatncttcgaatagtagaatccatccatcaaaaacatgtagaagagcagtgcctgcacgggcct

SEQ ID NO: 7652 - DNA, 121 bp, Artificial Sequence
  Synthesized
  misc_feature (61): n=t or c
cagcaacacaaaggtgagtttttacgcaaaggagcgcaatgttgggaaaatcgtgagcaangcacagatgaggtgggagagatcaaagccctggcaactcctgcagcaccttggagccact

SEQ ID NO: 7653 - DNA, 121 bp, Artificial Sequence
  Synthesized
  misc_feature (61): n=t or c
taggtttgcagctgatgaggaggtgtactttgcagtgcagcgaggaatttaggatcgtccntctagggcttgggttaggaccctaacatgccaactttggaacttgctgctgttacgggag

SEQ ID NO: 7654 - DNA, 121 bp, Artificial Sequence
  Synthesized
  misc_feature (61): n=t or c
cctaagctgtttgcttagtgtatggataagtggctgaacttactctatagggacttgaagncttgcttttgtcacagtataattttatgggcttgcttagttttcgtgcagagtgtaacgc

SEQ ID NO: 7655 - DNA, 121 bp, Artificial Sequence
  Synthesized
  misc_feature (61): n=t or c
caaacactgctccatccacgtctcctcaagtgtgtgtcttggttgtgagcacatagcaaangtcccaggtttctgagcagctttaaaacaagctgggttagatttgtactgaggatggagt

SEQ ID NO: 7656 - DNA, 121 bp, Artificial Sequence
  Synthesized
  misc_feature (61): n=a or c
atgaatcctaagcccagagagactgaagagaagaaacagggatagagagggactgccttcngaaagagaagtgtcttttaatctggacacccagtcctggctgggaaacaaagagtttccc

SEQ ID NO: 7657 - DNA, 121 bp, Artificial Sequence
  Synthesized
  misc_feature (61): n=c or g
aaaagatggccactgcaacgtccagtttattaatgtgggtgagaagggacagcgatacctngcagacatcttcaccacttgcgtggacatccgctggaggtggatgctggttatcttctgc

SEQ ID NO: 7658 - DNA, 121 bp, Artificial Sequence
  Synthesized
  misc_feature (61): n=t or g
ctttgtgcatccactgcacagctcagagctgcccgtctgcggctccatgcacgcatgtctntcaagagctctaaaaactgatcagagaaaacaccatagcaagttctcaggctgcatcagg

SEQ ID NO: 7659 - DNA, 121 bp, Artificial Sequence
  Synthesized
  misc_feature (61): n=t or c
gaagctttctcctttgtaccaaaatttgtctgatggccttttctcaccagatcccatctangctgggtcatacacaatgcacagtggactcttgcttgctgaattcatgcctcagtctaaa

SEQ ID NO: 7660 - DNA, 121 bp, Artificial Sequence
  Synthesized
  misc_feature (61): n=t or c
agtcattctctgtctttctttaatgaaggaagaactcactgcgcttttctggcttcactcngcaccttgaaggtaaatgcaaatgctataaccacgaaaggaagctgataaaatccaggtt

SEQ ID NO: 7661 - DNA, 121 bp, Artificial Sequence
  Synthesized
  misc_feature (61): n=a or g
gctgggaggaggctgtgatgctgtgctttggacacgtttgccctgactatcacggacctgnagcagcctgatagcttcgctgcagcccaattacagccacagagctctcttttttatcaat

SEQ ID NO: 7662 - DNA, 121 bp, Artificial Sequence
  Synthesized
  misc_feature (61): n=a or g
acagtcccagctgggatgccttcattcactttgtgctcccctgccttgacataagcacttnttacatgcctgtgcaaagttagctcacacctcttccctcaggctggccggagaaaggtcg

SEQ ID NO: 7663 - DNA, 121 bp, Artificial Sequence
  Synthesized
  misc_feature (61): n=t or c
gcctttgaacctctaaatgctgtagtgtatcaagatctccattcagtctttgctataggtnttctgtaaaacctcaatgaaccaaatagatgagtctcatcatggctaactaccgtcatct

SEQ ID NO: 7664 - DNA, 121 bp, Artificial Sequence
  Synthesized
  misc_feature (61): n=t or c
aagataccaaatgaatcccagctgagcacagagttaaatatgcaaccccataccagcatgnaaatgaagagtcagtccatgtacagcatgagaacaagtatatggaaacagaataatctga

SEQ ID NO: 7665 - DNA, 121 bp, Artificial Sequence
  Synthesized
  misc_feature (61): n=a or g
actctgaatgaagccctgagggtgtgctgtggctcagaggagtggtgtaggaaggcctgcntcaagccagctgaacctgctagtgactgtgcttggttattttatccctgtcttttagcaa

SEQ ID NO: 7666 - DNA, 121 bp, Artificial Sequence
  Synthesized
  misc_feature (61): n=t or c
aaaaaggttttgcatttttcaaaacacaacccaaggactctaacaaccacacagctagctncaccagggatatacagagcagtaaataaggtgcaaatgcaggtgttacactcagagctgc

SEQ ID NO: 7667 - DNA, 121 bp, Artificial Sequence
  Synthesized
  misc_feature (61): n=a or g
ccccaacagcaatttgcacaaaggatgggaatatccacctgcaaacgcagcgccagtggcngtgatgggggagagctgaatataacaccccaatgcagtgctgctcacacagtggagcagt

SEQ ID NO: 7668 - DNA, 121 bp, Artificial Sequence
  Synthesized
  misc_feature (61): n=t or c
actgcaacatctcccatcagagcaacctcccctgtgacagacatctcagctatgcaatccnggtatcacagcagccattggtaaagttgtgctggctgaaagaaagcctccctcacagaag

SEQ ID NO: 7669 - DNA, 121 bp, Artificial Sequence
  Synthesized
  misc_feature (61): n=a or g
ccagggatgatggagaaggctccagcaggcagcccagcagtgcagcacaggagaagttacngcatcatctcccgaagccagcaaaatgctctgggatccatctttgcatcttgctttacac

SEQ ID NO: 7670 - DNA, 121 bp, Artificial Sequence
  Synthesized
  misc_feature (61): n=t or g
tgacactgttcctgtcctaaacggcaccagctgagccagtagatctcttctgtatgtccanatggctgctgggacaatgccaggaggatgtcagttctacatcactggaacaaaataataa

SEQ ID NO: 7671 - DNA, 121 bp, Artificial Sequence
  Synthesized
  misc_feature (61): n=a or g
acttcactcacagacacaaaaaattgcacagctgattccaataggacttactgcaggatcntaagcagcaaatccagtgaccaaattgctgatgaatcaagtgaccagatcttctaggagt

SEQ ID NO: 7672 - DNA, 121 bp, Artificial Sequence
  Synthesized
  misc_feature (61): n=a or t
cacgtggatggagaagtgaggcagctggtaacaacacaactccaaatcacttaagaaacancatctaagaaccactcatccaaaacagcagactgacagcacaggggatgtgagagtcctt

SEQ ID NO: 7673 - DNA, 121 bp, Artificial Sequence
  Synthesized
  misc_feature (61): n=a or c
agctaaaacttggctatgtgatgcgcccagttagctgcccaccttctcccagtcaagaaangggaggagctgcttgagcagcagcacccaccaaaaagccaaacatctgctgttccacagt

SEQ ID NO: 7674 - DNA, 121 bp, Artificial Sequence
  Synthesized
  misc_feature (61): n=c or g
gtagcagatactggttccacatctctctgctcttaaagaagagcaaacagtgctcatactnagagattggagtccatgtactcaatggaagcagacgtttgtatattgcatttcagccacc

SEQ ID NO: 7675 - DNA, 121 bp, Artificial Sequence
  Synthesized
  misc_feature (61): n=a or t
ggagctcattatatctagccccattaaatctgtgatgaaagcagacatatgatcggtagcncgttgctctggtctgtcttgtgctattatcaggcatagctatagggaacggagatgtaca

SEQ ID NO: 7676 - DNA, 121 bp, Artificial Sequence
  Synthesized
  misc_feature (61): n=t or c
ttcccaggtcaaaacgtattcacctactgttatgctagtatcaacagacaaatactcaaanggctggcattaatgccatatatccctgctcatcctaaaataaaggatcaccatccctcag

SEQ ID NO: 7677 - DNA, 121 bp, Artificial Sequence
  Synthesized
  misc_feature (61): n=a or g
tctgctgagtgcctgacagatgttggcttgcaaattgctaaatcagtctgctctggactcncactgctcccactgcattcatggggagttttaccccatgtgtgctgggagaaatgcagtc

SEQ ID NO: 7678 - DNA, 121 bp, Artificial Sequence
  Synthesized
  misc_feature (61): n=t or c
tccttatgccagacaccagccctagagactttttcctgctcagccaaacatgttttctgtntgtcccgttgctgggatgctgtgatagtcaggttggtgaggtgatgccaggaagagatga

SEQ ID NO: 7679 - DNA, 121 bp, Artificial Sequence
  Synthesized
  misc_feature (61): n=t or c
gaagaggtgagggcacacaccaccaatccaatgccattggcccggtggctattggtacgangccttggattgagcagaagcagccaggggaaagggccagcccatgcacgtgcaccaacgg

SEQ ID NO: 7680 - DNA, 121 bp, Artificial Sequence
  Synthesized
  misc_feature (61): n=c or g
acactatttaaatagcctaatactataagcatctcctactaacattcctggcagctttgantagaagctctctgcactgcaccataaagtgctgtgatgttgtgagcctcgatgcttctgt

SEQ ID NO: 7681 - DNA, 121 bp, Artificial Sequence
  Synthesized
  misc_feature (61): n=a or g
cctgttctaatgcaccccaaactgttcccatctcaggtgccatttgtgcagcactgtgctntatggacaggtatactgtattagcaagtcttgggcaccttagcaagttgagacgtttccc

SEQ ID NO: 7682 - DNA, 121 bp, Artificial Sequence
  Synthesized
  misc_feature (61): n=t or g
gcactgtattcctaatacctacactaaaaatgggggatatggaatgatttcattctacttnagctcgagaaaatatgaaggaaaagagaatggaaatgctcggtctttaggcaaacatagc

SEQ ID NO: 7683 - DNA, 121 bp, Artificial Sequence
  Synthesized
  misc_feature (61): n=a or g
tggcagcccgctgtggctcaggagcctgctcagacagcagcaccactgcccgagtcacacncactctgttcaaaacttgtgtcaagccctgcatttataatatttttcttctttcttttct

SEQ ID NO: 7684 - DNA, 121 bp, Artificial Sequence
  Synthesized
  misc_feature (61): n=a or g
aacagatgtcagccattgcagatttgcacagagcagctcctgatagcagcgctttcctccntgctttccacctggggatgtcgaggtgttctgggggcagccaggctgggagcagcaccag

SEQ ID NO: 7685 - DNA, 121 bp, Artificial Sequence
  Synthesized
  misc_feature (61): n=a or g
tgtttctttctttaaaaataaaatagtaaaggctactgtgtggctcttttgcagctcagcnatatgctggtgaataactgctcgctagtgggatgcattaccctgcaggataaagaaaagc

SEQ ID NO: 7686 - DNA, 121 bp, Artificial Sequence
  Synthesized
  misc_feature (61): n=a or g
actaccagcttactttcctgatttgtttcagtctccaggaacagtatttcttttaaacacnagcagaaaaaaatatggctccagcactgagctgggatgcctggggtgcctggtgctgcca

SEQ ID NO: 7687 - DNA, 121 bp, Artificial Sequence
  Synthesized
  misc_feature (61): n=t or c
atttctgtctgtctattatttttagatccctatacatttccagtgctcttagcaggaggtngcagtcagcaaagtttcagtaccaaaccatttcccatctttggtttggaatagagctatc

SEQ ID NO: 7688 - DNA, 121 bp, Artificial Sequence
  Synthesized
  misc_feature (61): n=a or g
agcattggattaggtttctatgttatatgtgaaaagaggaataattacagcacatcaggcnctaggagctagcaacttggtaaatattgatttagcaaggtaactgctataatattgatct

SEQ ID NO: 7689 - DNA, 121 bp, Artificial Sequence
  Synthesized
  misc_feature (61): n=t or c
tattcgtatataattacatgctgttatggtaacttaggccagatccacagcccagtgaaangagtgtgaatatctccaacttcagtcagaaaacagagcgcagagctgattaaacagttaa

SEQ ID NO: 7690 - DNA, 121 bp, Artificial Sequence
  Synthesized
  misc_feature (61): n=t or c
cttgtttaatgcacacaagacagggttatttttgggttctctaggtctcatggacaccacnggcagggaagtccggctctggagattgcaggagaaatgctgcccttgcagagcagagaga

SEQ ID NO: 7691 - DNA, 121 bp, Artificial Sequence
  Synthesized
  misc_feature (61): n=c or g
agagtggcagcagtccttgagcttcccctctcttctcttggctgtggtaaagctaccaagngaaaacacctataaagcccacatctggaatttgatacaataaaactaaaaccttcaccca

SEQ ID NO: 7692 - DNA, 121 bp, Artificial Sequence
  Synthesized
  misc_feature (61): n=t or c
atgatttgaaatcagatggcggatcagaagttctttggatggtagatgggaaataaggagngcttcgaaaatacaaaagctcagacctcgtggcttttgaggacaaaggcagcctgatata

SEQ ID NO: 7693 - DNA, 121 bp, Artificial Sequence
  Synthesized
  misc_feature (61): n=a or g
tcacatttgccaattaacctatgtatatctaaaactcaagttcttgaggagaatgtctgcncttagcatgcacatgtccatgatgctgagggttctaccattttttggaatccagctgtag

SEQ ID NO: 7694 - DNA, 121 bp, Artificial Sequence
  Synthesized
  misc_feature (61): n=a or g
aaggagcagacttgaaatttgcactgtgttgttcttcagttgcatttagttttgaagtacnctgtttttatttcaggatttaagtaggtttacacacctggaggataccagtcagtttaag

SEQ ID NO: 7695 - DNA, 121 bp, Artificial Sequence
  Synthesized
  misc_feature (61): n=t or c
tatcaaaggaaaaaacattttcaaaggtcactgctgaattaatgactactgatgaactttngcaaacgcctatggttaagacgtgatcacagctgtagcacttccaatggcaaaacttctc

SEQ ID NO: 7696 - DNA, 121 bp, Artificial Sequence
  Synthesized
  misc_feature (61): n=a or g
tacaacaggaaagcgaggcaattagcgttaaacgggattactttacaagcctcccaggtcnccacactcctaagccaaactaccagagagcagcagaacgcgcacacaacggcagcccacg

SEQ ID NO: 7697 - DNA, 121 bp, Artificial Sequence
  Synthesized
  misc_feature (61): n=a or g
aggattaaaggatcaaggataccttcagtaaagcataccgggttttctcctatggaatganatctttccagagtgtagaaaaccattctggaagactttaatagctcatattttaagctga

SEQ ID NO: 7698 - DNA, 121 bp, Artificial Sequence
  Synthesized
  misc_feature (61): n=a or g
ctgctgcaagtttgtttatttcagtcacactaagactcagtatttcaaaaccgcccagcgnatttcccagcataatgaaaattcagctgagacatcctaatgcaacaggacagaaggctgg

SEQ ID NO: 7699 - DNA, 121 bp, Artificial Sequence
  Synthesized
  misc_feature (61): n=t or c
caatccccatgtttgagtcctttcccatatctaatacagaaacatttctaaaaatgctttntttccttgccagttccaagtattctcactgccttttagaaatcctccttatttccaaaat

SEQ ID NO: 7700 - DNA, 121 bp, Artificial Sequence
  Synthesized
  misc_feature (61): n=a or t
ggaaacaatccaaccttcaaggtttaatttatattgtgacggaaaagctacctcagaattnactagtccacacacattcttgaagtggtacactcaccacatacctgtgggactgcacaca

SEQ ID NO: 7701 - DNA, 121 bp, Artificial Sequence
  Synthesized
  misc_feature (61): n=a or g
aaaaaagtaatacaggcagttttaagatttacaactttacctttggtttgtgtgaaaaaanatatctaattattatagagcccctggaactaagaaacagacaaatagagaaaagggatga

SEQ ID NO: 7702 - DNA, 121 bp, Artificial Sequence
  Synthesized
  misc_feature (61): n=a or c
cctgcaccagatcctgaacaactatacaccactgaaaggttgaagtattactgaatgtcancccaaatcactctactgaacagatcaccatgctttacacatgaagagaaatgtaaaattc

SEQ ID NO: 7703 - DNA, 121 bp, Artificial Sequence
  Synthesized
  misc_feature (61): n=a or c
tccaggttttcacaaagcaactgcaaatttatatacgtgccctgcaagctcttttcaccgnagttcatgaatgctcaagcccattcgcctcatttgcttcagcttttcacatccacaaaac

SEQ ID NO: 7704 - DNA, 121 bp, Artificial Sequence
  Synthesized
  misc_feature (61): n=t or c
atcctaatctcttcctctgtgataagaaattacacagtggactatattttccctgagcagnctggtagaagggcaggcatgcagaaatccaaatgtcaatagtttgtgctcatctgtaggg

SEQ ID NO: 7705 - DNA, 121 bp, Artificial Sequence
  Synthesized
  misc_feature (61): n=t or c
taatataaaacaagacaaaaattcaaattctgtctctacagttctgaagaaaccagtcacntttgcttactagagagcaggaaaagctgagagtgcatgatttgactcttgaatgtttgga

SEQ ID NO: 7706 - DNA, 121 bp, Artificial Sequence
  Synthesized
  misc_feature (61): n=t or c
tgtggaatgatgagttacagaaatagcattcttacactaccccagcattttaagaaggcantgccaattccatgtgggagcagaggaatcccaaaacaatagggacagacccagcagttac

SEQ ID NO: 7707 - DNA, 121 bp, Artificial Sequence
  Synthesized
  misc_feature (61): n=a or t
ggcgtgtaaaggccatgcatcttttgtgttgatgcatgtgcttctttagctcactttccancccacgttagaaatgctgtggttagtgattgaatggaagtgctttgccaccatgtagaca

SEQ ID NO: 7708 - DNA, 121 bp, Artificial Sequence
  Synthesized
  misc_feature (61): n=a or g
gagttagaaaactgcaggtaaaacaatgcagtgggttcctataatgacctgtacagggccntgagggataagactcatgattaagagcttacagtaaggttgttctgaattatcacttaat

SEQ ID NO: 7709 - DNA, 121 bp, Artificial Sequence
  Synthesized
  misc_feature (61): n=a or g
aatacaagttacccacttcagcctcttaacctagtacctgtttgcaggaaagtgccccacntaagatgctccgataagcatcgccttaccttaactttccacatcacctggagattacttc

SEQ ID NO: 7710 - DNA, 121 bp, Artificial Sequence
  Synthesized
  misc_feature (61): n=t or c
caaaaaacatgagttttttagagataaaattacttgatttcaaaacaagcgtgaggaaatntaaaaatctaatgaaaagcacatctggtattagagaggaagggggagaggttgccagaca

SEQ ID NO: 7711 - DNA, 121 bp, Artificial Sequence
  Synthesized
  misc_feature (61): n=t or c
aattcccaaccagctccatttattgtatgtcagttcttactgcttacagaatagttagagngagtagagaagctgaaaatttagcttgcttggtgagttaagtctgtgatctggtactttt

SEQ ID NO: 7712 - DNA, 121 bp, Artificial Sequence
  Synthesized
  misc_feature (61): n=a or g
taaacaacactagaaaaaaattattcctgctgacagccttagaagctgcctctggtgttcntcctagtaggttaaagtgccacagagactctaaaatcggcaaatgattaattctttatgc

SEQ ID NO: 7713 - DNA, 121 bp, Artificial Sequence
  Synthesized
  misc_feature (61): n=a or g
gtcaagggaaaaatgtcttaggtctaatagcagagaatgtaccagaaagtgcaagagaganaaatgcacagttaaaacacttgtgcgctggaggccataggagaaaaaagactctgggacc

SEQ ID NO: 7714 - DNA, 121 bp, Artificial Sequence
  Synthesized
  misc_feature (61): n=a or g
cttaatctcagaaagaacagatgtagaaagagacctgaagcagtctgagcacatcccctcnatggcacatttgtgtgtgccactcatgatcagtctctgttcatctaatacttaacgagtg

SEQ ID NO: 7715 - DNA, 121 bp, Artificial Sequence
  Synthesized
  misc_feature (61): n=c or g
aaagcccttgaaagttgctcagtaaagccctgcttaactggctgacataatcaatcccaantaggctcaaagccagaccttagccttgtcctttggtgtagttggtggcgtctgcttttgt

SEQ ID NO: 7716 - DNA, 121 bp, Artificial Sequence
  Synthesized
  misc_feature (61): n=a or g
tttgacacgcggccaaggtgcttacaaaatacctccaaacagttaatgcaaatccatattnccaggtctattaatggcctgtcattgcctgtctgcagatcaccattttgtgccagtaagc

SEQ ID NO: 7717 - DNA, 121 bp, Artificial Sequence
  Synthesized
  misc_feature (61): n=t or c
catcttgaaatcaaagtcatttatgaaagctgcagaattttaatgttcctcagacaaaagnatttgtttaaccaccgccagacgaagagatgaataagagagaccgtctgctcttgattta

SEQ ID NO: 7718 - DNA, 121 bp, Artificial Sequence
  Synthesized
  misc_feature (61): n=a or g
ttctcttggtttcacactctattttatagtttccagacacattcagcatcaaagatatgantaaatcactagcttccacacagaatttagtacccatgttttctaaactcactacagtcat

SEQ ID NO: 7719 - DNA, 121 bp, Artificial Sequence
  Synthesized
  misc_feature (61): n=a or c
gaatatagaaaaaagagatctgaacgtttgttttgtttgttttcatgtggcctttgactcntaactaaggaacagaagagagtgcaggactcctggaacctgtcagctctcttacttgaaa

SEQ ID NO: 7720 - DNA, 121 bp, Artificial Sequence
  Synthesized
  misc_feature (61): n=a or g
gaagaaacagatcttattaaaaagtcaacatttgttaaataaaagaaaacagggcactganactccagctcagtttgtagtgaagccaggcaatgttagcagtaactggaaagtactggga

SEQ ID NO: 7721 - DNA, 121 bp, Artificial Sequence
  Synthesized
  misc_feature (61): n=t or c
ttgactgggagttgtttgctcttaaatacaacgaaggcacactctgtgttgttaatagacnctctttgtgcactgccctttcagatatctagcccctcagcatctagctgtagtaatttgt

SEQ ID NO: 7722 - DNA, 121 bp, Artificial Sequence
  Synthesized
  misc_feature (61): n=t or c
aagtgccgtttgcttgaagtaagacatttcttctctttctttagttaatgaatgtttagcngtgtctagggcacttcagaaaggtaatctaaatctgggattggctttgagttgctgttaa

SEQ ID NO: 7723 - DNA, 121 bp, Artificial Sequence
  Synthesized
  misc_feature (61): n=t or c
gaagcaaacatagtttgtaaggacttgcatgttgtgttagcatgccacattctcccatggngcagacaaaaggaatcgttctgaaatcttctgatacaaagagacgctttagtgtgctgaa

SEQ ID NO: 7724 - DNA, 121 bp, Artificial Sequence
  Synthesized
  misc_feature (61): n=a or g
gcttagttttattacagccagaggctgctgaagtcacagccataagcacctgcagggtctngctgctttgaattgcaaaatcatatcataactgagagctccttggagcctttgactaggt

SEQ ID NO: 7725 - DNA, 121 bp, Artificial Sequence
  Synthesized
  misc_feature (61): n=a or g
tatgaaagtctggacgagtcatgaagagcttttgtacttcacattccagcttcatgctgcntccgtaaattctgagacagatggaaataagtttcagacagaccattttctgcaaaatctt

SEQ ID NO: 7726 - DNA, 121 bp, Artificial Sequence
  Synthesized
  misc_feature (61): n=t or c
tgtaatttaacttcgtttttgtatgcaaatgcatcataacaaatctgagacaatgattaanggagtaagcaccgtaaagtgctgttttctaaaacaacaagaagttttttttttaaaaaaa

SEQ ID NO: 7727 - DNA, 121 bp, Artificial Sequence
  Synthesized
  misc_feature (61): n=t or c
aatgatgtccctaattcccaccaacacttctaaattaaaacctctgactctttgtaggaanaagagttgaaatgtaagcaggaataaaagagggaggataccttttctccacaaaggagag

SEQ ID NO: 7728 - DNA, 121 bp, Artificial Sequence
  Synthesized
  misc_feature (61): n=t or c
acagtgcacgtaacagagtccatctgaatgagaagttagcatgcacaagtcccctactctntgttttgcaatttgtttatttagttctgttgtctcctcatattcagctattcttccatcc

SEQ ID NO: 7729 - DNA, 121 bp, Artificial Sequence
  Synthesized
  misc_feature (61): n=c or g
ggctttgtgtgctgggagttctgaggccgtctcctggtttctaaaaaaagatgtaaagtgnagtgcttcaataataaatctcaaacttcccctgagaagtggtttaggaggcttccaactg

SEQ ID NO: 7730 - DNA, 121 bp, Artificial Sequence
  Synthesized
  misc_feature (61): n=a or c
atagtttctgaagccacctcaaggactgatttatagcaaaatcgtctttcaacatcacatnctcactgccagtttccgtaggaccactgtggtctggcagtgcagggacagagagagggtg

SEQ ID NO: 7731 - DNA, 121 bp, Artificial Sequence
  Synthesized
  misc_feature (61): n=a or g
agcagaggtgacggtgattatatacaggtttagactaacaagcaaatcagactggttgctnttaagggtttctacccaagctgaaggcagccgtgctgtaaacacccattactgtggccca

SEQ ID NO: 7732 - DNA, 121 bp, Artificial Sequence
  Synthesized
  misc_feature (61): n=t or c
atcctatgctggggactaattggagttctgcagtcgttcaggaatatgctaggaataagantgtgagacccagcatttgtatttccatttttattagcacagggacggatactaggaacgg

SEQ ID NO: 7733 - DNA, 121 bp, Artificial Sequence
  Synthesized
  misc_feature (61): n=t or c
tattaaatacttagtaatatcaaaatttcatgtggtacttgtcttcaaagaagtctggggnggctctgttcatcaagcaattttcccttagactgacctggcctgtcacagtcacctggga

SEQ ID NO: 7734 - DNA, 121 bp, Artificial Sequence
  Synthesized
  misc_feature (61): n=a or c
tacaagtcaacattaacagtgtgagcagagaaactccttacatacctggccagaatctccngtgcagaactctgcaatatcacattcattcactgcatatctacagtcatagcctcgtgga

SEQ ID NO: 7735 - DNA, 121 bp, Artificial Sequence
  Synthesized
  misc_feature (61): n=a or g
accaattcatttgtgatgttactgttctgaagtcaaattgtagtggggacagagagccaanttagtatttgttaagtgaagactgcagtaatgcttgttttacttgatatggtcagtagta

SEQ ID NO: 7736 - DNA, 121 bp, Artificial Sequence
  Synthesized
  misc_feature (61): n=a or g
atagcttgtttagggtaacaggaagcctttaacgtgatgagtctttaaaaacaattgatcntcttgctctcgtttcccaatgtggaaaactgctgctggcagccatgcatctccctgtgtg

SEQ ID NO: 7737 - DNA, 121 bp, Artificial Sequence
  Synthesized
  misc_feature (61): n=a or t
agctactttagttgctcttttggaggcaaatgcccaatttagcttaaatgattccttcaangtcctccaggaaatgtgtaggagaactgacaaaaaggatccagaaagcttggctcagggc

SEQ ID NO: 7738 - DNA, 121 bp, Artificial Sequence
  Synthesized
  misc_feature (61): n=t or g
agggggagtaaggcgtccatttcctgcagcgcgggcgaaaggggagggagggttcaaatgnggcctacaacgaattactggaggatggaggctttctggctgccggatcgcaaagagaaag

SEQ ID NO: 7739 - DNA, 121 bp, Artificial Sequence
  Synthesized
  misc_feature (61): n=a or t
agatgatgcagctcacatccttgctctaagaccaaatcccttcactaatagcatatgacangtattcaccttcctcttaaggtctgtatttacgtgtgtttctagtgcttgtgcttaacaa

SEQ ID NO: 7740 - DNA, 121 bp, Artificial Sequence
  Synthesized
  misc_feature (61): n=t or c
attatcaagagacatttaaatgaacagcacaattgagtactcactcagcatttggatctgnagtgctatgaacctgctctcccactgcctacatcgccttggtttaggtaaagctgaatgg

SEQ ID NO: 7741 - DNA, 121 bp, Artificial Sequence
  Synthesized
  misc_feature (61): n=t or c
atgtgtttgccttgtgttgttgctcaactttcctgacacactgtatcacaacaaggtttgncccccctacgtaattgctaattcatttcaagcactttatttttttccaatacattctgta

SEQ ID NO: 7742 - DNA, 121 bp, Artificial Sequence
  Synthesized
  misc_feature (61): n=a or g
agaggaaagcaagaagctggttacaccttggcttcgtgttttgaaaaaatgaagtcttacntggatgatgacataatgaaccttaaagcgtggatacacttcagaatatatttttggcttt

SEQ ID NO: 7743 - DNA, 121 bp, Artificial Sequence
  Synthesized
  misc_feature (61): n=t or g
agtcacgtttgaaaaggaaactttgatatttcatgttaatctcagccatccctgcttatanctttcagtccgcaaggcaatgcatagcgtacttgaattgttaaaatgtgaataaagttgt

SEQ ID NO: 7744 - DNA, 121 bp, Artificial Sequence
  Synthesized
  misc_feature (61): n=t or g
acgttttcactgtcaacaccatcatgttgacatctccatacttgaatggtttcagctactncatgtgttactgagcatctttcccagtagttctagttctgccattgcacttcccaactgt

SEQ ID NO: 7745 - DNA, 121 bp, Artificial Sequence
  Synthesized
  misc_feature (61): n=a or g
tggatcttatgccggtttttctgactttgttgcttgctgagaagttagtaggttgctctgngcatatgtatgaatctgtattttactcttacgttagtaggagcacctactgtgggaagga

SEQ ID NO: 7746 - DNA, 121 bp, Artificial Sequence
  Synthesized
  misc_feature (61): n=a or g
cttagtactgtgtctggagccctttgctcccattttttgcctggctgggctggcagcaggnctctgtgcccaagcaacttgtgatgcccgagcattgtgctatggctgcagaatggcatgc

SEQ ID NO: 7747 - DNA, 121 bp, Artificial Sequence
  Synthesized
  misc_feature (61): n=t or c
attctttgccttaaatacacccactgtagatgtctctgaaactcagtgtattaaataatgntacaatgacagtgcaattgcactattacatgacaaagacaatttcttatgttaatgataa

SEQ ID NO: 7748 - DNA, 121 bp, Artificial Sequence
  Synthesized
  misc_feature (61): n=t or c
atgttggtacttgtagcttcccagcaagggagtcctgttcaatgactttccgctttcatgnatagtaacactcaggtggataaacaatagcaatccttcatttgcatcctgcactcatgaa

SEQ ID NO: 7749 - DNA, 121 bp, Artificial Sequence
  Synthesized
  misc_feature (61): n=a or g
aaacagctacttgaactgtttgaggcgctcattccgatctggaaaaagagtcttggtgggnatcacacctgatggccaagatgattacagatggtgctttaggtaacctgcttgtaggcca

SEQ ID NO: 7750 - DNA, 121 bp, Artificial Sequence
  Synthesized
  misc_feature (61): n=t or c
ctgagcacatgaaaatatgcagaattcatttcaacattgtatttcactgtatgtagaacantataaaaatacatttgagctgttttgtaacagaaagcagagcaattcctaaggaaataga

SEQ ID NO: 7751 - DNA, 121 bp, Artificial Sequence
  Synthesized
  misc_feature (61): n=a or g
gagaggggaaaattaccaagcaacgatacctttttatttccctttgaatactttaatttanggaggtgtcctcgaagtgctctgatgttggccagcccatgtcctgaagtcatatttcagc

SEQ ID NO: 7752 - DNA, 121 bp, Artificial Sequence
  Synthesized
  misc_feature (61): n=a or g
aagttgcacaaaaacattaaacttagccttaaggtataaaacaaagagtaggatttgctcncttgcttcatcaaacagcaagaacataatcattgcattaagtgatatttcagtgattgca

SEQ ID NO: 7753 - DNA, 121 bp, Artificial Sequence
  Synthesized
  misc_feature (61): n=a or c
atcaggttgtatccagttccagctctgactaatttaaaagtacttaagatctcaaaaaaanccctcaaagtttatggtgaatatatattttaaaagtgattttttgttatttagaaaaaaa

SEQ ID NO: 7754 - DNA, 121 bp, Artificial Sequence
  Synthesized
  misc_feature (61): n=a or c
gaaaggtgagcttttgtcttctgctgtttcagtttgcagttttggtaactcattttccatntggcaatgtcttattttggcaaagggagcggagagggccgcgtttgcttctatcaggatc

SEQ ID NO: 7755 - DNA, 121 bp, Artificial Sequence
  Synthesized
  misc_feature (61): n=a or g
tctgctcccacttcaggtactccagtagaaccttgttaccaccaaaggaaaaggtctcagntaggagacccagggagggaactaagtgcagtcagactgtcaaaacacagctctcttgaga

SEQ ID NO: 7756 - DNA, 121 bp, Artificial Sequence
  Synthesized
  misc_feature (61): n=t or c
aagttttctgtgactattgacttcaataaaattagtgaaggaaatgaataggtatgtctcngtcagattgttaatgaagctgtaataagtaactaatattataactatattcaaggtggga

SEQ ID NO: 7757 - DNA, 121 bp, Artificial Sequence
  Synthesized
  misc_feature (61): n=a or g
agaatgcagctgtgtgaggggagcctgcagcaccgcttggtgctcttagagcagcagagtnttcttttctgtctggcacatgatgcttctgcctgtatgtaggcaaaacaggaggcagtgg

SEQ ID NO: 7758 - DNA, 121 bp, Artificial Sequence
  Synthesized
  misc_feature (61): n=a or c
attgttctaattgacatgcagacaattgatcttgtaaatcaaaattaaccagtttgagcangcttctgtgaatctgtgatccaagcagaaatatctggggtaagcaggcacccagttgggg

SEQ ID NO: 7759 - DNA, 121 bp, Artificial Sequence
  Synthesized
  misc_feature (61): n=a or g
actgaaacttctcctttgtgccagtagtatgaccatcaaaataaaagctgagttacgttcngtgtatgtgcaacttcagcatctttctgctcattgatacgcactaatatgccaaaacaaa

SEQ ID NO: 7760 - DNA, 121 bp, Artificial Sequence
  Synthesized
  misc_feature (61): n=t or c
gagcagagataaatgaatgaaactttcataggaaagccatacattgtagtattttatttantgaatgtcctctaagaggaacatacagagaggggtaaaagtgcaatgtatgtacattctt

SEQ ID NO: 7761 - DNA, 121 bp, Artificial Sequence
  Synthesized
  misc_feature (61): n=t or c
ataataatctttttgggaaagttcctattaacaaatcaagattacagaaatatgattatanaaatacaggtgagaaggtaacaaagtgtagccatgaaagtaaaaatctgcagttgaaaag

SEQ ID NO: 7762 - DNA, 121 bp, Artificial Sequence
  Synthesized
  misc_feature (61): n=t or c
tcccctccatctctcgtaaatcttgtttcaaactaggctaaagccatggattgactttgcntcttgcagtaatggcttgaaactgttgtgcatcacagttctgcgttcaaaggggatcaag

SEQ ID NO: 7763 - DNA, 121 bp, Artificial Sequence
  Synthesized
  misc_feature (61): n=a or g
cctgcccggcatgccagagctccgtccctttgccaaagctgtcgacatcgttagcagggcngccaacagcacagcagtgatctccattccccccaagcaggactttgccctaagagggtaa

SEQ ID NO: 7764 - DNA, 121 bp, Artificial Sequence
  Synthesized
  misc_feature (61): n=t or c
catttacagatttgtatcctttgaagtagcacatgggatgcaaagagcacacaattctttngaaattctatttcgtctggaagaagaagcatcatatagatgcacaacttactgattctgc

SEQ ID NO: 7765 - DNA, 121 bp, Artificial Sequence
  Synthesized
  misc_feature (61): n=t or c
cagactgaccaacagcctttccctgatggtaccgatcccccttacagacacacagtaatgntccaatcagagaggcagtgtgtaaaacttcttccttagatacacaaattaactccaaaac

SEQ ID NO: 7766 - DNA, 121 bp, Artificial Sequence
  Synthesized
  misc_feature (61): n=a or g
tctttctgcatatgttctcatatagacaacgtttaaaaatcatttcaaagcatatttggcnttttcgcccctacctgtgggagttaagtgtatgcaaggaaaaaacacgtatttcaaaacc

SEQ ID NO: 7767 - DNA, 121 bp, Artificial Sequence
  Synthesized
  misc_feature (61): n=a or g
agccattggccaacgctgagcactctgcttccacagcccttcacttcttacatcaccaccngacgaaatttgggtgcatcacagcctacatttaggaacggtccataggaatactgcttca

SEQ ID NO: 7768 - DNA, 121 bp, Artificial Sequence
  Synthesized
  misc_feature (61): n=a or g
attagatgaattattgctgtgtgataattcatgaaagagttcttgtcgggaagtttcgatncaatgaaaatgtttatgagcctgttaattaccaatctatggcagtggtctcatcttgcag

SEQ ID NO: 7769 - DNA, 121 bp, Artificial Sequence
  Synthesized
  misc_feature (61): n=c or g
atagctagagtagcaatgaaaagggcaaaatatgtagtcaccacgaatttaaacatatttnaaacagcaaagcctctaatcagtgtaattcctgattgctatcataatgcaaatggtgaaa

SEQ ID NO: 7770 - DNA, 121 bp, Artificial Sequence
  Synthesized
  misc_feature (61): n=a or g
ggaaatggaattaaaatgaagggtgctttatttcttttcttcttagtgttttttgctgacnttgcagcctatcagtcacagtgtagtggctggttttaaattggcttgttttcagtaggtg

SEQ ID NO: 7771 - DNA, 121 bp, Artificial Sequence
  Synthesized
  misc_feature (61): n=a or g
gatgtatggctgtggcttttgcggcacgtatctctggagtgtggctcactgacagcgatcntgctggtgcctctggtggtttggttttcttgtgtggcatgtgacagttctgtgcagcttt

SEQ ID NO: 7772 - DNA, 121 bp, Artificial Sequence
  Synthesized
  misc_feature (61): n=a or g
cccagtaattcttgggctaaatttaaaggtgagaaaagtaggtctgtaccttcttctgcangggttattctcatgcaggtatgtgctgtctgctggtccagttctgcattcactcatggga

SEQ ID NO: 7773 - DNA, 121 bp, Artificial Sequence
  Synthesized
  misc_feature (61): n=a or g
ctctaaaagtcccaaactgcaaaaggtaaaaggaaacaagggctaatttatacttgatctnaaagtaaatccaaggcagatcctctattttattcatgtcctttggggcaaagagaagcct

SEQ ID NO: 7774 - DNA, 121 bp, Artificial Sequence
  Synthesized
  misc_feature (61): n=a or g
gctgtgctgtaagaaccggtcattctcgtgctttccagctctggagcactcagcacgtagnaattctcacgacacggtcgtataggacgagcgttctccccgttgtagcggtggaggaggg

SEQ ID NO: 7775 - DNA, 121 bp, Artificial Sequence
  Synthesized
  misc_feature (61): n=a or g
ataagatggacggatgggagaacaaatgatatttgacacacagttattttaaaaaagaacnacaaaccaccaagtatcaagaacagcattcagaatgggctgaaccccttgaattcaaagg

SEQ ID NO: 7776 - DNA, 121 bp, Artificial Sequence
  Synthesized
  misc_feature (61): n=t or c
tagcacagtactgtttgggctgatttaattgctgaattattaggcatgctttaattccaanacaggatgataccatgttttactttctatactatgaatgatacagcttgtattgggttgc

SEQ ID NO: 7777 - DNA, 121 bp, Artificial Sequence
  Synthesized
  misc_feature (61): n=t or c
aagggcaggagaatatggactccctattggtgtgcttttacaggaaaggtctgaaatgtgngtcttggatgcattcagatgaaagcaacttctcccttcaaactcatcaataataatacat

SEQ ID NO: 7778 - DNA, 121 bp, Artificial Sequence
  Synthesized
  misc_feature (61): n=a or g
atgtccaaaaccttaccctatattcagatatggaagtgacacttcatcaaacacttccagnagtcaattaactacactgctaacagaccacaaattccatgtactgtctacaaaaaactct

SEQ ID NO: 7779 - DNA, 121 bp, Artificial Sequence
  Synthesized
  misc_feature (61): n=a or g
acctgcaggatggaagtgtctggtatctgtagctgtctgtccttccacagtaacaaagggnggtaaagaggatgtaaggacagcatagtgtgcgttcactgaacatttataaaataatttt

SEQ ID NO: 7780 - DNA, 121 bp, Artificial Sequence
  Synthesized
  misc_feature (61): n=t or c
agttacactccacacatccctctatcaggagacaacctgcaggtgtagcgctcttcaaggncagacactgagatctaaaacagaaatacaagtggttaaactgaaaagagatctgagcctg

SEQ ID NO: 7781 - DNA, 121 bp, Artificial Sequence
  Synthesized
  misc_feature (61): n=a or g
actcgtcagcattttacagaggttttgtctctgcacaataggatgactcccacattttggnatctttcaacacacacgtgcgaccaagcagcttccagagtccatggggtaaattcactgc

SEQ ID NO: 7782 - DNA, 121 bp, Artificial Sequence
  Synthesized
  misc_feature (61): n=a or c
aacagtaacatttgttttctcctgaagcactgaatgaacacatggaacttctttctcaaancttaaaaagatacttggaaaaagcaacagctactctcatttctataaacactgaacttgt

SEQ ID NO: 7783 - DNA, 121 bp, Artificial Sequence
  Synthesized
  misc_feature (61): n=a or g
tttgcagttgacagtgtctgccagacagctgctgccagcgtgactgcatggcactgcacancacggaccgagcacaataattactgctttcttgtaaccactggtctgtaatttcattagg

SEQ ID NO: 7784 - DNA, 121 bp, Artificial Sequence
  Synthesized
  misc_feature (61): n=t or c
caggctggagagatgctggtgacatggaccagtcatttcttacagcttaatttttgaactngtcactgactagaggcttgcatttcattgcagcttgcttctctggagatagctgggttga

SEQ ID NO: 7785 - DNA, 121 bp, Artificial Sequence
  Synthesized
  misc_feature (61): n=t or c
acaacccccctcctgcctccagtcactgtcactgctgcccatctactgctcttattgtagnacagctacttagatgcgttttctgctgatctggtcagaacgtggcattctgtcagctgtt

SEQ ID NO: 7786 - DNA, 121 bp, Artificial Sequence
  Synthesized
  misc_feature (61): n=a or g
taattcttaagaattttcggagctgatccctcaataacttgagggattcacacacacaaantctctttccaggatacgagtgttctcgtgttcctttgaattcagaagcctaccttgcatt

SEQ ID NO: 7787 - DNA, 121 bp, Artificial Sequence
  Synthesized
  misc_feature (61): n=t or c
acttcttgtcaccagttgttggttgcagtcaaaacattcaaagcactttccattagcagcnggcagacttcataaacaatcattgctttcctgtactggtaaagcaataaactggtatgag

SEQ ID NO: 7788 - DNA, 121 bp, Artificial Sequence
  Synthesized
  misc_feature (61): n=a or t
aactttttggggggaggaggaggtttcccttttttcctactagtgtgatctcacttgagantaggagtggagggaacccagaatgaatggagtagtattattgcatctctcttttcagaac

SEQ ID NO: 7789 - DNA, 121 bp, Artificial Sequence
  Synthesized
  misc_feature (61): n=a or g
gagtttgagtaatgccttccagaattggaagctttcctctgatgacgagtaaaactctatnctcctattcaagttcatggatggcactgagctgtctggtgcggtcgacacacacaaggga

SEQ ID NO: 7790 - DNA, 121 bp, Artificial Sequence
  Synthesized
  misc_feature (61): n=t or c
attcttgaggattatcattggttggtcttttcctcccaaaggcagacgtttgtaaagaganaactaaaacccacccaggatctccccacactgagagaacacatccatctgccttcactca

SEQ ID NO: 7791 - DNA, 121 bp, Artificial Sequence
  Synthesized
  misc_feature (61): n=t or c
agtatcagaatacagaccagcacaagactaaaaccaagaatctctaatttccttgtcaacngcccacacaaatgggtgaaacaaaatcacaaccaaaaggagtggttaagtgtgcgtcaac

SEQ ID NO: 7792 - DNA, 121 bp, Artificial Sequence
  Synthesized
  misc_feature (61): n=t or c
ataagaaagagaaaaattgaagggatttttatagttggcttcatttgtctgttgatctccngcttataagtcataatctgaaacagaactatggcattacatctgaaattggtatttttcc

SEQ ID NO: 7793 - DNA, 121 bp, Artificial Sequence
  Synthesized
  misc_feature (61): n=a or g
aaatttgctaggcttatattaacttctttattttctttgagaaaatcttcatattaaacangcaaaataaatccaattgtgtgcttactgacaatgtgagactaatctagcaataaggaat

SEQ ID NO: 7794 - DNA, 121 bp, Artificial Sequence
  Synthesized
  misc_feature (61): n=t or c
aggattcacctccctgctgatggaacgactctccgttgactatggcaagaagtccaagctngagttctccatctacccagcaccacaggtctccactgctgtggtggagccctacaactcc

SEQ ID NO: 7795 - DNA, 121 bp, Artificial Sequence
  Synthesized
  misc_feature (61): n=a or g
atgctatcactgcttgtttcccactgggctgtgagcccggtgactccctgaaggtgtccantggatatataacagaccagggtattggagccaaggcggggaaagttgcatactcccacac

SEQ ID NO: 7796 - DNA, 121 bp, Artificial Sequence
  Synthesized
  misc_feature (61): n=c or g
caggctccgtggatgacatctcagccctggagaagcccatggcatctcctggggatttcanctctggtaccagttagcaactgagagcatgagtcaagaggaagggtgaccatggcatggg

SEQ ID NO: 7797 - DNA, 121 bp, Artificial Sequence
  Synthesized
  misc_feature (61): n=t or c
gcaagggctgagtcccacctgctgtcagtgcaattagcactagaggggtggccaaggaggntaatgaagatcaagctcctgctttgcttgtttctgcccacctacagagaaagggaagagg

SEQ ID NO: 7798 - DNA, 121 bp, Artificial Sequence
  Synthesized
  misc_feature (61): n=a or g
gtcctcgtctctgaactggtctgaagctccccatgtccctttcccctcaagttgagaggangccagcaactgctttcatgacagtctgctatgaggtgtgcccaaggtgtcctgattactg

SEQ ID NO: 7799 - DNA, 121 bp, Artificial Sequence
  Synthesized
  misc_feature (61): n=t or c
aagcagtttctgaggtgattttcaagatgcaaaaaggtaatataagcagttggatgagtgntgttgtaactcatttctgttctttcaacagaagatattactgcttagaagggaagatgat

SEQ ID NO: 7800 - DNA, 121 bp, Artificial Sequence
  Synthesized
  misc_feature (61): n=t or c
catggcgtatgtctaaccatatatatgatctctcccttataaaactgcttaggtatagaanagccaggctattttttgggagtttagatctaaagtagactgagggtaaatgggatgtcta

SEQ ID NO: 7801 - DNA, 121 bp, Artificial Sequence
  Synthesized
  misc_feature (61): n=t or c
gcagcagaggtagcatgttcttgtttcagatggacactcttgtgaatacacactgcagacnatgtagaagaacttgacacaattaagaaacgaatactcaatccaggaacatatgatcaat

SEQ ID NO: 7802 - DNA, 121 bp, Artificial Sequence
  Synthesized
  misc_feature (61): n=t or c
ccctaggctgacggataaagttaaatgtgtaagtcagaaacttgctttgacagaactctgnttgcacttctgtatttacccatctctcccatggccttcttatttcctcttacttcttata

SEQ ID NO: 7803 - DNA, 121 bp, Artificial Sequence
  Synthesized
  misc_feature (61): n=t or c
agtgttttttctcctagcacaaatttatctctcacactatgtgtatttacagtcacagtanctccatacagaatttattttgctaggctgaaaaaataccacctttctagttttcttttgt

SEQ ID NO: 7804 - DNA, 121 bp, Artificial Sequence
  Synthesized
  misc_feature (61): n=t or c
cgcagctcccctatggaatgatttatgttcacctcgatcaaagcttttacaattacaaacngatctgacagacgtgttccctttaagactggaaaagctcatagttaaatatattttactc

SEQ ID NO: 7805 - DNA, 121 bp, Artificial Sequence
  Synthesized
  misc_feature (61): n=t or c
acccagctgttcccttgcatgagactcctgtagccccatttcttttaggagggcatctaangaagccaggtgtgtcctaaggacatatatatctgtacctacagtcacctgagggtgcttg

SEQ ID NO: 7806 - DNA, 121 bp, Artificial Sequence
  Synthesized
  misc_feature (61): n=a or c
aacttccctctgtatgcacttaaaccttctgttcttcgatacctccaccgaggaccttccntgcctttgagctttttatagcctcaaaactgtgttcaaatttagtgattcttaaaaatga

SEQ ID NO: 7807 - DNA, 121 bp, Artificial Sequence
  Synthesized
  misc_feature (61): n=a or g
aaccaactggagacaaagtaagctgaaggaaaatctcactacagtagggaatcaggctcantattgactggtggtaagcagctgttctaatagcaaaaataagtaaataaaaataggatct

SEQ ID NO: 7808 - DNA, 121 bp, Artificial Sequence
  Synthesized
  misc_feature (61): n=a or g
ggctgcatcaaaggctatcgttagccagagaaacaaggtagaaagattcccattagttctntttggggtaggccagtggtaatctaatgatgtgtcaaaagaagcaaggaaatacgcactt

SEQ ID NO: 7809 - DNA, 121 bp, Artificial Sequence
  Synthesized
  misc_feature (61): n=a or g
gatcacctgtggtatagaaacctgaggcagtgctacaggattcatctcagattctcattcnacttactgaggacttgtgctaacagaacccacagagtccacatttaacagaacacacatt

SEQ ID NO: 7810 - DNA, 121 bp, Artificial Sequence
  Synthesized
  misc_feature (61): n=t or c
tcattgtttattctcactgaggttagttcaagtatgaagaactgcaggatcacagaacagntgaggcttgaagggggcctctagaagacttctggtccggcaaacctaagtagctacacaa

SEQ ID NO: 7811 - DNA, 121 bp, Artificial Sequence
  Synthesized
  misc_feature (61): n=t or c
gaaccaagaatgctgaagtagagccaggcccctctgctttctgtccttgcctttcaagagnagattctgctgtattctgtgaaagcgggaggcagtcacagaaaagtcaaaagatgagatg

SEQ ID NO: 7812 - DNA, 121 bp, Artificial Sequence
  Synthesized
  misc_feature (61): n=a or g
agctgcttgagacaactttgctggtaaatgtatgtttgtatgttctaaataaacagtgtcnactgctagccagttagagagaaagggaagaaagaggaagctacaagaagaaattgaagga

SEQ ID NO: 7813 - DNA, 121 bp, Artificial Sequence
  Synthesized
  misc_feature (61): n=a or t
tacatgctgttttcaaatttatgtacttctgactgcatcccagctgtctcccacacagatnaacaattatttggatatcggttctctgatgttaatacccaccttttattgcttcatcaat

SEQ ID NO: 7814 - DNA, 121 bp, Artificial Sequence
  Synthesized
  misc_feature (61): n=t or c
catgggaagaaatctaaacatgaaaggtaacaacacttggtattacagtgtttaagtcttnggagtcttctaatgcatatataagtaaaatatatccaaataaatgatctggtttagataa

SEQ ID NO: 7815 - DNA, 121 bp, Artificial Sequence
  Synthesized
  misc_feature (61): n=a or c
aaagcaccagctgcactttcaaggtggatgcaatcagggaatctcactgagttgctgctgntgattcttggggtggctgcacacatcagagctacagctgtaagcagtggccgtcaaactc

SEQ ID NO: 7816 - DNA, 121 bp, Artificial Sequence
  Synthesized
  misc_feature (61): n=a or g
gtagagctttctagaattcaggtaagtctacttgagagaaggacaaatactatgaaggacnaccttatattttggaattagtccacattatagctacaaagcaagtcaaaaattcactacc

SEQ ID NO: 7817 - DNA, 121 bp, Artificial Sequence
  Synthesized
  misc_feature (61): n=a or g
aggattatttctaagtctcctggcatcctgttcacagaaactaggattttaagaggaagcntgctagctgaagtcctaaatctcctcaccctgttgggaagccagccacatcaccttccca

SEQ ID NO: 7818 - DNA, 121 bp, Artificial Sequence
  Synthesized
  misc_feature (61): n=t or c
taaacgctgccagtgccctgccaccaactgggatgtttccttggtatcaaacacttctcancttcagagcagggggccccatcccaacagcctgttggtacactgcttgtcccaccactaa

SEQ ID NO: 7819 - DNA, 121 bp, Artificial Sequence
  Synthesized
  misc_feature (61): n=a or g
atgaaatgaatataaatgaataacaatgaaatgagtataaatggcaatgtagtctgaaagntatgtgaagtaacagctctgcttagtgcctgcagtctcttcatgaaagaatgtctggttt

SEQ ID NO: 7820 - DNA, 121 bp, Artificial Sequence
  Synthesized
  misc_feature (61): n=a or g
ggtccgtcaggtccacacttcttgagtttcactcacacaggttgttacctctgcttgtacnttaagattgccaggacagccattcagtcttcaagcccaagcgtggctcgtgcccatacta

SEQ ID NO: 7821 - DNA, 121 bp, Artificial Sequence
  Synthesized
  misc_feature (61): n=c or g
ttgaagcaggtttagactatgcataatgcagacaggcaacaagtaaggatttcctgctccnatctgtgacttctcgagtcaagcttgcagaaatagccctctctggttgggcacagtcaaa

SEQ ID NO: 7822 - DNA, 121 bp, Artificial Sequence
  Synthesized
  misc_feature (61): n=a or g
tatatttctttgtaactaagacttaacaaaggcatttcatcattagcaaggacttagagcnctgtgtccccatgcagggtacatgtggacttttttaacatgctataaatcctgtgtttgt

SEQ ID NO: 7823 - DNA, 121 bp, Artificial Sequence
  Synthesized
  misc_feature (61): n=t or c
cagtagaagttgtctacttcagcctttcaactagactcgatgtccagcacgaagttacttngtgagggcaaattagtggtaccatgtctaagaacactgaaagaacctccatgccacttat

SEQ ID NO: 7824 - DNA, 121 bp, Artificial Sequence
  Synthesized
  misc_feature (61): n=t or g
cccaaggcaagcagcaatccagcaaagcatggaactcagctggttacacatgcatttgggntattatttagtgtgtcataccttggtgcaaatgacaaattcattaaattagggacaaggt

SEQ ID NO: 7825 - DNA, 121 bp, Artificial Sequence
  Synthesized
  misc_feature (61): n=t or g
aagctccctagataatctctttaggtttaccagcagggttgccctgaactggctcacaaangccagctgcaagcaaaggagaaggccaatcagctaacttggcctccaacctgccctaggg

SEQ ID NO: 7826 - DNA, 121 bp, Artificial Sequence
  Synthesized
  misc_feature (61): n=a or g
ctggattctccaaaagaggatcagggatccagggatcttggccaagtgcctcaatagccanatattccaacacgacttcagtcagctggttctgtgattgaagagcttttatccagttcaa

SEQ ID NO: 7827 - DNA, 121 bp, Artificial Sequence
  Synthesized
  misc_feature (61): n=c or g
cacaaacgtcccttaactgtaggtcagtaggttggccaaggaggagtcagccttttgaaantgggatgctgcacattaaagaaggtaagttcaaccagttccaagggagaaaaagaagtgg

SEQ ID NO: 7828 - DNA, 121 bp, Artificial Sequence
  Synthesized
  misc_feature (61): n=a or t
aataataacctttgttagagaagtttatagctctgggatgatctacaatagctgttaatgncttttacaaattaatattgctttctttctagctggtgctgcctttagattcagttcaatc

SEQ ID NO: 7829 - DNA, 121 bp, Artificial Sequence
  Synthesized
  misc_feature (61): n=t or c
tctgtcagcactgtcagccctgctgctcccatgtggatatctcagctacccccgggctttnggatggcacaagatgcttatgtttagacagctaaactgtacccaacttgtgcaatttaat

SEQ ID NO: 7830 - DNA, 121 bp, Artificial Sequence
  Synthesized
  misc_feature (61): n=a or g
aagccctttatttctataaaaaagatggctctcaggctgggattcatctcacccaacttgngatattttcagcataggagtctctgtcagagctggttgcatttaaagtcaatggagagaa

SEQ ID NO: 7831 - DNA, 121 bp, Artificial Sequence
  Synthesized
  misc_feature (61): n=a or g
acacgagaacaagtcacacaggaagaaaatttcaccaaagcagttatctgcgaaatacctnaaaatacaaactgccatcctgcaactcacctgtgtaacaattgtttttgtagtagtagag

SEQ ID NO: 7832 - DNA, 121 bp, Artificial Sequence
  Synthesized
  misc_feature (61): n=a or g
ccaaacagagcaaagtttggtttttgtcctaccaaaggcttttgttcctcccaggaacatngcaaaatcatccgctttcttggaggtacagtagaagtcagctcaaccttaagccagaaca

SEQ ID NO: 7833 - DNA, 121 bp, Artificial Sequence
  Synthesized
  misc_feature (61): n=t or c
tatagaaaagcagatgatttatccatattagacgaattgttttgggtggaagaagccccangctttggagtgaagctctaatttgatagcagagctctccaggctctatttcaaaagttgg

SEQ ID NO: 7834 - DNA, 121 bp, Artificial Sequence
  Synthesized
  misc_feature (61): n=t or g
gggccaggcgcaggattaacctctcttgggtcctactctcaaggtcacatcaaatgatcangaaacaccaaaaattttgttcacattccagctctaagtctcattaagccatggtttgaca

SEQ ID NO: 7835 - DNA, 121 bp, Artificial Sequence
  Synthesized
  misc_feature (61): n=a or c
tgtttgcaaaccacaaacactggttgttcaggaagtttcatttcatctggctttaatgagnaatgagttttgcatttagaggataaaaggtgcgttcctaactctcattagtatgaaagcc

SEQ ID NO: 7836 - DNA, 121 bp, Artificial Sequence
  Synthesized
  misc_feature (61): n=t or c
caaaagactttgtgctaaatataatgtaagaaaaaagcatctatcagtggctcaacccttnattttttcagaactaccctaacgtaggactgaaaacgttgttcctgcaggctcgtgctag

SEQ ID NO: 7837 - DNA, 121 bp, Artificial Sequence
  Synthesized
  misc_feature (61): n=a or g
tgttggtagtggaacgctgggctctgcagtgcctaattcctgcttgcttcatagcaccatncagcttttctgtgcattttcatggaagagctgtccttcctctgcataatacctcacattg

SEQ ID NO: 7838 - DNA, 121 bp, Artificial Sequence
  Synthesized
  misc_feature (61): n=a or g
cttttctgctccataaatctgtaattacaattttcactacttagcatccatttgtaagtgnaatacttgcacattttaacctgtttacaacaacttctagaactgatttcaactttcagaa

SEQ ID NO: 7839 - DNA, 121 bp, Artificial Sequence
  Synthesized
  misc_feature (61): n=t or c
cagaacaattaacagttgatggcactgataaattaaaataaatgaattccatccaataaangcattcattaaaattaattgccagaagtactccacaaatgtttagcacattactcttatc

SEQ ID NO: 7840 - DNA, 121 bp, Artificial Sequence
  Synthesized
  misc_feature (61): n=t or g
ccccaggcctcctagcttgaccaaatattacgttctaccataacagatgtgcctcctgacnaactcgcaggcttttacttgcctggaaaattgtaaccataactgtaaatacataaaatac

SEQ ID NO: 7841 - DNA, 121 bp, Artificial Sequence
  Synthesized
  misc_feature (61): n=t or c
aattagcaaaagaaagagcttaacataatctccgtatcatttttctctgcattcatcaagnctggagagcacgacctccactgagagagtctgttgatcagtgagcagagcatcactgaga

SEQ ID NO: 7842 - DNA, 121 bp, Artificial Sequence
  Synthesized
  misc_feature (61): n=a or g
aaaggacgcagaacagtgctaatatctcaggacctttagaccaagcctggtttgtgaaccnttttctttgttaggacaaatgacaactgcagaagttgttttttcttaatacttctgtttt

SEQ ID NO: 7843 - DNA, 121 bp, Artificial Sequence
  Synthesized
  misc_feature (61): n=a or t
tttttctaccagttgcttctttccacatgcatagtatcttgggcattgtctgttactttanggtatacagactaataactgatttttattgtatatataatagcatgatctcagttaccta

SEQ ID NO: 7844 - DNA, 121 bp, Artificial Sequence
  Synthesized
  misc_feature (61): n=a or g
caacaatctaagcaacaccatgacagactctcattcaccctcctcaaagagacagaggaanaaaatacaatgaaaaaaccttgtgggttgagatgaagactttttttttttaatttaaaaa

SEQ ID NO: 7845 - DNA, 121 bp, Artificial Sequence
  Synthesized
  misc_feature (61): n=c or g
ccatttgttttgctttagagttaaaggaagtcagaaattttccacagaattggaacatttntcaggaaaaaaaataaggacccctaacagtgaactgctacatcagcaggtgatgggaacc

SEQ ID NO: 7846 - DNA, 121 bp, Artificial Sequence
  Synthesized
  misc_feature (61): n=a or t
gagcggcagagggacgctggctccttcacaattcagggaggtgtcaaagggtgaccttcanggaaatgcttgatggtctcccttaggcttgttttgtttggcgctcaatgaattgagtaac

SEQ ID NO: 7847 - DNA, 121 bp, Artificial Sequence
  Synthesized
  misc_feature (61): n=a or t
cttacgtctttctcaacaacccccacggcacatagggtgctgccatatcctagaataggcntgttactcgttcaattcgctttggtagaggagaattgagataaaaacaaaatgttgggat

SEQ ID NO: 7848 - DNA, 121 bp, Artificial Sequence
  Synthesized
  misc_feature (61): n=t or c
agaggtgttttgcaaccttgccgtgatggcaataagcctttatctgaacaaattgatcctnagacgctggagtttgtaccttgtttgctgctgccttgcctgctgtttctatcctggctcc

SEQ ID NO: 7849 - DNA, 121 bp, Artificial Sequence
  Synthesized
  misc_feature (61): n=t or g
ttagatacctgaagctaagtggtgggaatatcccagagaacctcattgctctcattaaagngcttctccaagagcagctgcccttgaaatatcagtgtttgttatttgataactttgtttt

SEQ ID NO: 7850 - DNA, 121 bp, Artificial Sequence
  Synthesized
  misc_feature (61): n=a or g
tggagaacctgcaaagaagtactgcagaatgctctctcagttccgacaccattagcttcantaagaggagaagtggaaactgcccagaaagttgaggacacttgacacaattagcttcatt

SEQ ID NO: 7851 - DNA, 121 bp, Artificial Sequence
  Synthesized
  misc_feature (61): n=t or c
ctgtgtagactttcacagctaggatagcatattgcaatctttttgccctcacagtaggtangcttgggcagtgagcaagcacccagtttggttagctttctttctgcatgcagtaatatta

SEQ ID NO: 7852 - DNA, 121 bp, Artificial Sequence
  Synthesized
  misc_feature (61): n=a or g
actcacttcacccaaactgtccatatttactccaggggtaggtgttatgccgttgggcagntatgagcaggaccatgctcttgtgtttctgagcagatagggcaaagcccatgcaagattg

SEQ ID NO: 7853 - DNA, 121 bp, Artificial Sequence
  Synthesized
  misc_feature (61): n=a or g
agaaaaggacttgaactatatcttacagaaagtatattctaaatgaattctcttccctcantactatgatctgtttttacagatttgctcctacaacatcgataatatatgattatcagaa

SEQ ID NO: 7854 - DNA, 121 bp, Artificial Sequence
  Synthesized
  misc_feature (61): n=t or c
attactgatcttctccaagtgttcagaaaaagcacggactgggccacaacgaaggaggtcngactatcagcatcccctgacttcagggcagcacgactgacagcacatccttacctatggt

SEQ ID NO: 7855 - DNA, 121 bp, Artificial Sequence
  Synthesized
  misc_feature (61): n=a or t
gaactagtgcattttgtcacattactcaaaatttaagaaagcagctaaacatactaatggnattgcaactgcctttccagtgaatgacagtgcaaatgcacacagtactccagtgtgacag

SEQ ID NO: 7856 - DNA, 121 bp, Artificial Sequence
  Synthesized
  misc_feature (61): n=t or c
ttttcattctcagaaaacaaaacctggtgaacattgaggcttacattctgcttttcagcanttagcattacagagccttcctgcagccccaagaaaacttttaggatgtatgtgcaagaat

SEQ ID NO: 7857 - DNA, 121 bp, Artificial Sequence
  Synthesized
  misc_feature (61): n=t or g
agcaaacagatggaaaaaggtgtgcaatttacactaagtacaaatctcttcagtgaaagtncttgcttttgaactacaatgtaaacctgaccctgctgctatatgataaggacagccaaat

SEQ ID NO: 7858 - DNA, 121 bp, Artificial Sequence
  Synthesized
  misc_feature (61): n=t or c
gtcctgatgcacagtgcttctaaatcactagctaaggcagtttgtagtcattcatcaacantgacacaccagcactggggtgcttctcaccaaaacatctcaccatagctatcaattacgt

SEQ ID NO: 7859 - DNA, 121 bp, Artificial Sequence
  Synthesized
  misc_feature (61): n=t or c
catctgcctttctgcagctccatctgcactgcacaatgcagtgcaatgcatacacaagcantgaatgaggctgcattgttatgtggcaaagaacggtgccatgcacaggtaccagggcagg

SEQ ID NO: 7860 - DNA, 121 bp, Artificial Sequence
  Synthesized
  misc_feature (61): n=t or c
agcctggatccatttttctacatttgtacttgctgaagatggacatgtttttcattagttnctcttcagactgacaaaatggattgctataataatatttattttctttccattattagca

SEQ ID NO: 7861 - DNA, 121 bp, Artificial Sequence
  Synthesized
  misc_feature (61): n=t or c
tcagtctattcaataaatatttgatctgaaagtcctaccacatatggacctgacctctgtngttggacatctttgaaaatctggcccttaggacagctaacagagtttgcagtgttgtatg

SEQ ID NO: 7862 - DNA, 121 bp, Artificial Sequence
  Synthesized
  misc_feature (61): n=a or g
ttctacaggcactttgatgaggtacgtggcttttttccttgctgcttagctgacctgttcncaccttcacttgcggtgtgagccatcgtttttttctccttgtgagccaaacagggctgct

SEQ ID NO: 7863 - DNA, 121 bp, Artificial Sequence
  Synthesized
  misc_feature (61): n=a or c
agcatctcagcagtccgtggctcgtttgcttttggctggtttctctgaccaatcttcttcnctaacctgtgactgtccttatttctaggtccaccaaatcccacagggagacagacaagtg

SEQ ID NO: 7864 - DNA, 121 bp, Artificial Sequence
  Synthesized
  misc_feature (61): n=t or c
ccagcacctggtaggtgaagggacttggagattccctcctgttaaccttccttgtgcaccnaagacctgttggccacagaggtgcgctgggctctgtagcacttgatccggtgctcacccg

SEQ ID NO: 7865 - DNA, 121 bp, Artificial Sequence
  Synthesized
  misc_feature (61): n=a or g
ttgcactgaggaaacacccagtaattactgttttaagccaaagcagtgcattattcagaangatgcgagggcagccttttcttcaaaggatttgtgctgcagataagtgggaaagcagagc

SEQ ID NO: 7866 - DNA, 121 bp, Artificial Sequence
  Synthesized
  misc_feature (61): n=t or c
ttgcaatgagaaactttctacctccgtgttttcaacagggattactctgcaatgtttgtcntgtagcttcatctcagtaaatagcattgtgccgagccacttagccagttcatcataaaaa

SEQ ID NO: 7867 - DNA, 121 bp, Artificial Sequence
  Synthesized
  misc_feature (61): n=t or c
acatccagtcacgcacagcaaaacaaatctcctcagaacactgggctggatgaggaagatnccacaacttacttctaatagtcctaaacaattccaagtgctgctgcatctctacgtcttg

SEQ ID NO: 7868 - DNA, 121 bp, Artificial Sequence
  Synthesized
  misc_feature (61): n=a or g
cccaagtgctttacaaagaccaggtgtaaactgctgctactaaactccctgatgaacagancccctttctgttacatcagatccatcacaaacttgatttcaactgtggaaaggatgaagg

SEQ ID NO: 7869 - DNA, 121 bp, Artificial Sequence
  Synthesized
  misc_feature (61): n=a or c
ggaaccagacaagaaggaggacttacagtataagttctgtagtaaaaggttcttttctatntggtttaaggagctatgacttttcttgtgacttaccacagcacatcccagcccatacatc

SEQ ID NO: 7870 - DNA, 121 bp, Artificial Sequence
  Synthesized
  misc_feature (61): n=a or g
gacgagttttatttctgcttcataaccagataggttcacttttctccagctataatagaancaatatgattcattacatcctaccagcaacctgagtttggaagattcttacttcttcaga

SEQ ID NO: 7871 - DNA, 121 bp, Artificial Sequence
  Synthesized
  misc_feature (61): n=a or t
ctccttgaagggtgagttgggagtggtgattatttaagaccacctttccctaggaaaaaangacatactagtttcattttcgttgagttcactcactgtgatccaaatactgaacatactg

SEQ ID NO: 7872 - DNA, 121 bp, Artificial Sequence
  Synthesized
  misc_feature (61): n=c or g
agtgccttcaagacaaggctgcaaacagatacatgatataagcaactcagtcagtagttcnattaagatttctgcagccctcttatttgcatgtcttattgttacttctgctctcatagaa

SEQ ID NO: 7873 - DNA, 121 bp, Artificial Sequence
  Synthesized
  misc_feature (61): n=a or g
acgggaacataacggaattattcagtaatgaaagacagctttcacaatctcaaatttcacntctttctcctattgttttgttcatcctactccttgacttaaatacctctgtggcaaggtc

SEQ ID NO: 7874 - DNA, 121 bp, Artificial Sequence
  Synthesized
  misc_feature (61): n=a or t
acatggtagcatctaccactttagcccactccttccattgcccactccatgggcactccantctaaaatttcatgtcataccaccagtagatatcacaaacaaaaatgaagattatgtaca

SEQ ID NO: 7875 - DNA, 121 bp, Artificial Sequence
  Synthesized
  misc_feature (61): n=a or c
tctggagcgtccaatctgactaaacatgctatttttaaaaattcagaattaggtgctctgngctttgctacatattaagtaaatctctctgctaaataccctttataaaagcttaagctca

SEQ ID NO: 7876 - DNA, 121 bp, Artificial Sequence
  Synthesized
  misc_feature (61): n=a or c
gcctggaacactttcaagctgacattaactaagaaataagtaataaggagatgttctatantatttaaaatcatctctgagattaactgtgcacaaatctgggtgattttccttttaatgt

SEQ ID NO: 7877 - DNA, 121 bp, Artificial Sequence
  Synthesized
  misc_feature (61): n=a or g
gattgtgctgttttaggttattctcttcagcatcagttttaggttagaatgagcagctacntgtttgaagggatatcgtatatgagtcaaaatactgggaggcatcttaacagcctgagaa

SEQ ID NO: 7878 - DNA, 121 bp, Artificial Sequence
  Synthesized
  misc_feature (61): n=t or c
atgatatttgcagagattaaggcttagcccactgccaagccatggtatcctttcagatgtngcatgatcagatagaacagttcagcaagaccaatggatcacagttacagctaagacaaac

SEQ ID NO: 7879 - DNA, 121 bp, Artificial Sequence
  Synthesized
  misc_feature (61): n=t or c
accccctgcatcgtaaggcccctccagtcacacaactcccatattgcatttggtctgtgantttgtggcagcatctactgttgcttcataaattggtttttgtatttatctgaataaccat

SEQ ID NO: 7880 - DNA, 121 bp, Artificial Sequence
  Synthesized
  misc_feature (61): n=a or g
tttcgcttctttcctaatttttcaagcacttgggataattcagagaaacaattttgtcacnaatgttgaaagtgaaggacttttattaggatgatacttgtatcttgtgctctgcacattc

SEQ ID NO: 7881 - DNA, 121 bp, Artificial Sequence
  Synthesized
  misc_feature (61): n=a or g
gtaaccataattgttttcatctgctatttaagagtctgtatgtttattgaaacatgatttnttttgatttaagggtgcgttaaacggcactgtcacacttcactgactataaaactgtttg

SEQ ID NO: 7882 - DNA, 121 bp, Artificial Sequence
  Synthesized
  misc_feature (61): n=t or c
gtgttgagtagttaaatgtttgagatttctagcttggactcttcagtctgctttaaattgnaggtgttttccctgacaagccttcttagtcttttattaaaaaattaagaagaaaattcag

SEQ ID NO: 7883 - DNA, 121 bp, Artificial Sequence
  Synthesized
  misc_feature (61): n=a or t
ttgctgaaaataaatcttttcaagagctcagcagtatatttggaggggtattttgaacagngtgggtgcttcttcaagagattaatgaattagaaaatgaggaaatagtattttgaaatta

SEQ ID NO: 7884 - DNA, 121 bp, Artificial Sequence
  Synthesized
  misc_feature (61): n=c or g
ccaaccaaccaaccaaccaaccaaacaaaaaacactgaacagggcaggagaagtattgganatgaagcacttctcttgctctcctcacaaaccatgagtgcagggatcaccagtgtgcaga

SEQ ID NO: 7885 - DNA, 121 bp, Artificial Sequence
  Synthesized
  misc_feature (61): n=a or g
aggtaatggagggcaaaattgaattttacatacccatcaaccacagtagcaaagatacaantagaagttgagccatttgccagttgctttctagtgaagtataaagcattataggttgttg

SEQ ID NO: 7886 - DNA, 121 bp, Artificial Sequence
  Synthesized
  misc_feature (61): n=a or g
aacagcatattctgaattgctgttgtgatggcatttatttcctttatggttatcactgaantgtttgatagaaaaggtatattatattctgttgtacaaatgcgtagaattcattcatatt

SEQ ID NO: 7887 - DNA, 121 bp, Artificial Sequence
  Synthesized
  misc_feature (61): n=a or g
gaccaagccacgaaccttagtttcttgaaagaatttcaaaacactaaattcatttcctccnaaaagttctaggggtcaaaaaaatgtttgcctgttctgaaaaacaaaaaacaaaagacta

SEQ ID NO: 7888 - DNA, 121 bp, Artificial Sequence
  Synthesized
  misc_feature (61): n=a or g
gggctcaggtgaaataaagcccttcacaggaatctaaggtttttattcctattgtttttgncaaacgtttgccttggtcttgattatctgtacaataaatgtttttacttcaggggttaaa

SEQ ID NO: 7889 - DNA, 121 bp, Artificial Sequence
  Synthesized
  misc_feature (61): n=c or g
ctgtttaatccctttgtggaatatgatggactgagtacatgctttttagaaaagctgttgnaagaggacagtaatttcaaaccagggtaggtttcgtgcctcgtgttctagggtagaacac

SEQ ID NO: 7890 - DNA, 121 bp, Artificial Sequence
  Synthesized
  misc_feature (61): n=t or c
aaacagctgccattagccctgtatttccttaactgctgtaaaaaatgcagtgggttatagnatcaatctttggatcaaaataatctatagagcacagcacagctaagccactcttcctacc

SEQ ID NO: 7891 - DNA, 121 bp, Artificial Sequence
  Synthesized
  misc_feature (61): n=a or g
aaatatgcacgaacatttaaatgtatgcaaacatggagagaagccaaattatctcgttgcntctccaaaaccctgtgcttactgtactgtgatgctgctggagttgctgctggacacataa

SEQ ID NO: 7892 - DNA, 121 bp, Artificial Sequence
  Synthesized
  misc_feature (61): n=a or g
cctcttcaccccaaacccccactcccaccctaagccagccggggaaagggcagagcacccnagaacctgcaaagtgattgagaagggagctgctgtgcagcaggtgctggaggtaacactg

SEQ ID NO: 7893 - DNA, 121 bp, Artificial Sequence
  Synthesized
  misc_feature (61): n=t or g
cagtgcagtttaactgcttgcctccccttttcctcccatcccaagccaaaggatccgagancttcccgagcccttgggacaccgcttcagctgagcaaaccatcattggcttttggggacc

SEQ ID NO: 7894 - DNA, 121 bp, Artificial Sequence
  Synthesized
  misc_feature (61): n=a or g
actgcagtttcatatcagcttcttttcagagagtggttgtgctttgggcccacacagctcntgtccatttaccatggacttaatagcactgaatagctaagagcaatgtacaaaacctggc

SEQ ID NO: 7895 - DNA, 121 bp, Artificial Sequence
  Synthesized
  misc_feature (61): n=a or g
gcagtttattctccaatcattaaagtagcattacaatgaataattggtaaagtgttcatcnagcctaccctgccaggttgaggctctttcttcacatttatccataaaatttggcagcccg

SEQ ID NO: 7896 - DNA, 121 bp, Artificial Sequence
  Synthesized
  misc_feature (61): n=a or g
acttttgggactttctctgggtagttacatgggcacctgtcacactacagagtcccttgancctgaaaacaatgactgttgttaccttgcctttcttgcctcagattgttgcgtgtaccat

SEQ ID NO: 7897 - DNA, 121 bp, Artificial Sequence
  Synthesized
  misc_feature (61): n=t or c
aacaagtcccagcctcccctccttacacacacttaccttcttccacaccaagaagctgagntcctcgcagactccattacagatccagaatgagcaggttcttccagccagtcggcatctc

SEQ ID NO: 7898 - DNA, 121 bp, Artificial Sequence
  Synthesized
  misc_feature (61): n=a or t
caaatgcagagcaactctaagattcagttatgtttagacattctggtttataggacagagnctattattcttcaaagaattccatgtttgcaaaccacagatacaggatacttactaacat

SEQ ID NO: 7899 - DNA, 121 bp, Artificial Sequence
  Synthesized
  misc_feature (61): n=t or c
cgtgtgacttggttgtctgtcttctgcttttacttaatatatcccaaattacaagaagccngtatgactcagtccaaaattgttactgctgttttataatacatttttgttaattctcttt

SEQ ID NO: 7900 - DNA, 121 bp, Artificial Sequence
  Synthesized
  misc_feature (61): n=a or g
aattcttggaaggcaatcaggaaagtacaaagtattccagctcaggacagcctgggactcnttccttagaggcacaatggttgtttactcaatccctcatacattaatatctaaaaattca

SEQ ID NO: 7901 - DNA, 121 bp, Artificial Sequence
  Synthesized
  misc_feature (61): n=t or c
ttccctcaatttggtagaagaataccacccaaaatggcaaaacatggctgcacccagtgtnctggagtttggtgtcaccaccaggacaagccctgtgcccacacaccgatgttccctgact

SEQ ID NO: 7902 - DNA, 121 bp, Artificial Sequence
  Synthesized
  misc_feature (61): n=a or g
ggcttgttttattatttgtgttctggtgtggttgggaagtttcagctgtgagaccctgagnctcagctactgtttggaagttcccagctttcctcacctaaaatttaatgctgtctaaaca

SEQ ID NO: 7903 - DNA, 121 bp, Artificial Sequence
  Synthesized
  misc_feature (61): n=a or c
tcaaattacacagtgggaaaaagaagtttgatggatttagctttctttgtttcaccagaangtaaacttgtgatttgcacctgtatttagatttgtgtgtttgttgctactgaaacacagc

SEQ ID NO: 7904 - DNA, 121 bp, Artificial Sequence
  Synthesized
  misc_feature (61): n=a or g
tccctcttttctcctctgccatgtcctcccttcttcagtatggccgggagggaaagatccntccgcacattggagcagtcttcaagctggaagaggtacacgtggctcagaactgttagcc

SEQ ID NO: 7905 - DNA, 121 bp, Artificial Sequence
  Synthesized
  misc_feature (61): n=t or c
attgcatttgtttttagggagcactgttcttttagtgtcttttcctctcccagcacatttnggagtcttggtgatggctgtgtgtcagtgttggggcacgcttttgacattgcaggggctt

SEQ ID NO: 7906 - DNA, 121 bp, Artificial Sequence
  Synthesized
  misc_feature (61): n=a or g
atcagacacaccagggtgccctctcctgcacccaacatataagatcactttgggctcaggncagggcgcctgtaagctaagctgctaccagttgtgacagccacatgcccaagctccgtcc

SEQ ID NO: 7907 - DNA, 121 bp, Artificial Sequence
  Synthesized
  misc_feature (61): n=a or g
acttgaaataaccgtccagcagatgtggaagaccaaggcccagtgctgtgtctgctgtggnagctggtggtaattctcaatttaaagacagcttgctggtaatgggtttcaaatcttcaaa

SEQ ID NO: 7908 - DNA, 121 bp, Artificial Sequence
  Synthesized
  misc_feature (61): n=a or g
aaaatacctattttccatcttaccatatccccatacttcaggatggaaacgaccagttcanatatgtagctcagctattgctcaacatcccgtgtttgagtactgatggttacacagctat

SEQ ID NO: 7909 - DNA, 121 bp, Artificial Sequence
  Synthesized
  misc_feature (61): n=t or c
tttatttttaaagcctacccttaggtctcagtatagcagagtgcttcaaaagttattcccntattccatttcccaaacagcagagcagacctgacagcacggcaaggatttttgctctgtc

SEQ ID NO: 7910 - DNA, 121 bp, Artificial Sequence
  Synthesized
  misc_feature (61): n=t or g
tcagcacagaccgtacttatctcactccagccacaaagcagtcctcaaagcccttgaaatnaagggaaagctccctctgaaacctgctgttataagactgtttacaacccttaagtatata

SEQ ID NO: 7911 - DNA, 121 bp, Artificial Sequence
  Synthesized
  misc_feature (61): n=a or g
caacccacgaaggcttttcctgttaacacagggacagaaagcacagcaggcatcaccacancttacactgatgcagtgagtaaacgtagcaagaatatgccattccacagagctgttaatt

SEQ ID NO: 7912 - DNA, 121 bp, Artificial Sequence
  Synthesized
  misc_feature (61): n=t or c
gctggcgtttctgggagatggactcaccatcttttcatcaaagctgtacaaatacagcggngagctttacagaattatcagaccacgttttctgattcttatggcgatccgcacactgact

SEQ ID NO: 7913 - DNA, 121 bp, Artificial Sequence
  Synthesized
  misc_feature (61): n=t or c
ctggtgatgggataggacatctgtgttgaagtgactgaatccctgaatataagcttttcanaaacagtcgagaggaaaataatggttgtaacaaaccaccttcaggagggaacttccttaa

SEQ ID NO: 7914 - DNA, 121 bp, Artificial Sequence
  Synthesized
  misc_feature (61): n=t or c
atgtgttttgagaaggaaaaggcccgatatacgtacatttcctgtcctattttagtgttcnacctggtgttaatgtagctgagaacctgcatgtcttgcatgagggcttgagtatgcttgt

SEQ ID NO: 7915 - DNA, 121 bp, Artificial Sequence
  Synthesized
  misc_feature (61): n=t or c
gttttgggcaagaaaggcagggaacagtgcaaggaagcacggaaagacaagtgctacaganagggcctgcacaagaccccttgtcttcaggactgcccaacaagctttgccccatctcact

SEQ ID NO: 7916 - DNA, 121 bp, Artificial Sequence
  Synthesized
  misc_feature (61): n=t or c
cacacttgtagtctcatgtagagtccttccctgctgccccacagaaagctgctgaagcaangtgtgctgtgcaggcctgcagcaccataacagcataggcaaaatgtatgcgaggggtctt

SEQ ID NO: 7917 - DNA, 121 bp, Artificial Sequence
  Synthesized
  misc_feature (61): n=a or t
atgcaaggtactaattcattagttgaaactgcagctgatgatgacccagttccttgtatcntaactaaaccgaagtaaacaatttaaaatacactgcaagtccctcctggacactcaatta

SEQ ID NO: 7918 - DNA, 121 bp, Artificial Sequence
  Synthesized
  misc_feature (61): n=a or g
gactcctgattatcactttttcatgtatccactcagcacatggctgctgcaggatgcaatnctcagtttgcatgcatgtaagtgaagaaaggagactaagaacagaaaacactgctggcaa

SEQ ID NO: 7919 - DNA, 121 bp, Artificial Sequence
  Synthesized
  misc_feature (61): n=a or t
ttatcacagtctttttgaactaaataatgacatgtaaatattccagggaacagaacttccngttaacttaatgtaccaaatagagagtggagatggagcgccagagagcagcaatgtcttt

SEQ ID NO: 7920 - DNA, 121 bp, Artificial Sequence
  Synthesized
  misc_feature (61): n=a or g
ctttcacactaagaaaaagaactgtgggtgtaattaggtctattgctgtattttatgctcntctgtgtgcatgatgcaccttgtcggttgcattccgaagagtggcatgcatgcaaaatca

SEQ ID NO: 7921 - DNA, 121 bp, Artificial Sequence
  Synthesized
  misc_feature (61): n=c or g
tccaacaaaacttgtcgtgcaagcccgataaactgagatggatacaaaaagtaaaaatctnataccaaattttgtacatactgcttcatgaagtgcagtaactacagctgcatatccctgc

SEQ ID NO: 7922 - DNA, 121 bp, Artificial Sequence
  Synthesized
  misc_feature (61): n=t or c
ggacttctcagtgaccctgtgcgggtattgttttcctgcaaaaccctactgctcttctaanggtcataatcatcctatatagatcagaaggttttctgtttctgcttaaattgcaatcatg

SEQ ID NO: 7923 - DNA, 121 bp, Artificial Sequence
  Synthesized
  misc_feature (61): n=a or g
ctgcattagtctgcaatatgatttaaaaaaaaaaagtgccattgctaaacacttaaacatnactccttctaatctcaacaataccctaattatcttttctccctttgttcagtttatgaaa

SEQ ID NO: 7924 - DNA, 121 bp, Artificial Sequence
  Synthesized
  misc_feature (61): n=t or c
ggtagctatggactgacacatgaagataggactgtgagagcacagtaatgactcttcagtnctacgctgagcatgacatgaacttgtgatttaagtctatcataagggaaaggaaacacgg

SEQ ID NO: 7925 - DNA, 121 bp, Artificial Sequence
  Synthesized
  misc_feature (61): n=t or c
tgcagtgagattgttaacagagagtagctgacagcccagaaccatgctctcactatgctanggagcctcagtgcccatcatgtggcagaactgctgacagttgtccccaggctcatgagag

SEQ ID NO: 7926 - DNA, 121 bp, Artificial Sequence
  Synthesized
  misc_feature (61): n=a or g
tttctgctcactgtaattatgactcccaatcaatctggggttatgttgacaaccaccagcnattagatataaaagtgtccatttagacctgctctccccttaagccaggttatgaatgaca

SEQ ID NO: 7927 - DNA, 121 bp, Artificial Sequence
  Synthesized
  misc_feature (61): n=t or g
acagtcaataaaatttcttcatgcttttgcaaaccattgtccctttttgagagagagaganatataaatagtctcagacacagatgctgaactgaaagcttatgtgctttggaagtataga

SEQ ID NO: 7928 - DNA, 121 bp, Artificial Sequence
  Synthesized
  misc_feature (61): n=t or c
ctgcacttatgtctcaagttttaaagaaaaaaatgactcaacagttaagaaaaaagagctntagcctgcgatgaaaattctccctggcaataaaatgtatgctttctgcttatattaaagt

SEQ ID NO: 7929 - DNA, 121 bp, Artificial Sequence
  Synthesized
  misc_feature (61): n=a or g
ctcaaaaaatctgcacgacatgcatgcagtaagtgtggtgcattcaggctgtactggcacntatgtggcctaatcagccttactgaatctgtgtcctcactgcattactgctgcacatcag

SEQ ID NO: 7930 - DNA, 121 bp, Artificial Sequence
  Synthesized
  misc_feature (61): n=c or g
ctttcccagtagcagctgatggtctgaaagtgctttggctgcaccagcagtcactgggatntgttggtggggtgacttcttcacagaatagaatctagtccaaccgtccacctaccaccaa

SEQ ID NO: 7931 - DNA, 121 bp, Artificial Sequence
  Synthesized
  misc_feature (61): n=a or g
tgtcgcactctccttacaaatgttttttaaagaagaagcatgtttatcaacaaaccacccngactcttacctctatggcccacacagagctgatgagatttgcacgtggtggtccgtggct

SEQ ID NO: 7932 - DNA, 121 bp, Artificial Sequence
  Synthesized
  misc_feature (61): n=t or g
tagggaaaaagcagaggaaaggaagaagaggaagaacctagagtccacagacactgatatnccagcacttaatatgaatctttattccaagaaactgaagccaccatccctttgatgtgga

SEQ ID NO: 7933 - DNA, 121 bp, Artificial Sequence
  Synthesized
  misc_feature (61): n=t or c
tatcacactgtccaatgggaaaaccctctgcaatgaactgataggtgtacaacacttacangtggattatacacaaaatttttctttgcattctactagaattactcaatcactgccatat

SEQ ID NO: 7934 - DNA, 121 bp, Artificial Sequence
  Synthesized
  misc_feature (61): n=t or c
caaatggagaagaaatgaacaaactgtcaaaatcaaacagaaatacagtgttacgcattgngtgaccacacagcgggcacccacggcacgcatcagtacaatgctagttatgcttgtctgg

SEQ ID NO: 7935 - DNA, 121 bp, Artificial Sequence
  Synthesized
  misc_feature (61): n=a or g
aatatttctgagtcttccaaacacactgtcttactattactatactagaatttatcccaantcttttctgattggagcaatgttcatttcctgctccaatgtaagaaataaaataaaacag

SEQ ID NO: 7936 - DNA, 121 bp, Artificial Sequence
  Synthesized
  misc_feature (61): n=a or g
tggtacaaagtattacctgtgaaaagctattgtgtgtcaagttctattttgaaccattganttatagcagcaaaggcagcagaaaggcagaaaagtcctttatagaaaagatcattatttt

SEQ ID NO: 7937 - DNA, 121 bp, Artificial Sequence
  Synthesized
  misc_feature (61): n=t or c
ttaaaaaaatcatcctgatattgctgtgaaatgttctttccagcgtgcagtctggctggcnggtggttcactctgaactcgtgaaatggtgcaccagctgctaagaagtgaagggcagaag

SEQ ID NO: 7938 - DNA, 121 bp, Artificial Sequence
  Synthesized
  misc_feature (61): n=a or g
acctataagttttttgcctgttaaatatccctgtgtgtcttcacacgggcactttcccagnagagacaaatgctcacccaaaagctagatgtgcagttactggtttatctggagttttaca

SEQ ID NO: 7939 - DNA, 121 bp, Artificial Sequence
  Synthesized
  misc_feature (61): n=a or g
gctgaaattatctcttaccagcgtaaggatttcaagcaaatattccttatccaaacttcanattgtaatctatatatcaggagacagtggtaaattaaaatcataagagctttgtcttaat

SEQ ID NO: 7940 - DNA, 121 bp, Artificial Sequence
  Synthesized
  misc_feature (61): n=a or t
agctatcgccatctcagccttcaaactgccgcctctcctccaaagttgtcccaacaatcgntctgtccccgtacaatcgatctgtccccgtacaatcgatctgtccccgtaccactcccgc

SEQ ID NO: 7941 - DNA, 121 bp, Artificial Sequence
  Synthesized
  misc_feature (61): n=a or g
tagattacttattgtcctaactttcaagagctctgcatatatctgtaatacattcttgccntagtgcttgaaaaaactcaataattgttgaacagtctcaagaaataaggaactgtctgct

SEQ ID NO: 7942 - DNA, 121 bp, Artificial Sequence
  Synthesized
  misc_feature (61): n=t or c
acatagctgagttggtgtagtggtttttctttttccctattaataataatagttcacaaangtgggtttttacaaccatttgtgtcgtacaaatacaacctttcggggttcttatcattca

SEQ ID NO: 7943 - DNA, 121 bp, Artificial Sequence
  Synthesized
  misc_feature (61): n=a or t
ataataatttctttaatgtgctaattcaacagtgataagtgatgacatagtataacctatnttctacttaaaacgtgggcattattcttacagtcattagacatgcagcttctacttgatc

SEQ ID NO: 7944 - DNA, 121 bp, Artificial Sequence
  Synthesized
  misc_feature (61): n=t or c
gcaaacagagccatcaccgccaaagagggaaagtcctgacctgagaaagtgtttcagaganagaaaagcaaatgtttgagttaagactagttgtgaacgaccacagatgagtcctgcaaac

SEQ ID NO: 7945 - DNA, 121 bp, Artificial Sequence
  Synthesized
  misc_feature (61): n=a or c
ttaggtaaggtgattatcccatcaaaactccatgctttctgtgctggagagggtatcctgnctatttcttcttgaagttcgcaaacaaaaacacgttcatcactttttgtgtctcactttt

SEQ ID NO: 7946 - DNA, 121 bp, Artificial Sequence
  Synthesized
  misc_feature (61): n=t or c
ctactgctaagggcaaccatgttatctctgctgctgcagcgtcaaaatcagaacggacacngtgttccatactgtagttctcaacaccagagcagcgattgtcagcttttgaccttatcag

SEQ ID NO: 7947 - DNA, 121 bp, Artificial Sequence
  Synthesized
  misc_feature (61): n=a or g
atccatccattcatttaggcatctattcctttggccactaattcatacagcacataaaacnaaatatttagtcagttcttttacatctctgaataatgaaatcagtagtaaagaactattg

SEQ ID NO: 7948 - DNA, 121 bp, Artificial Sequence
  Synthesized
  misc_feature (61): n=t or g
gctgctaattctacccacagcaatgctcttcacatggcttccaggatgggatcctacattnactttgaatttttggcaagacaaggagtctattcattcctatctaccttcactgggaaag

SEQ ID NO: 7949 - DNA, 121 bp, Artificial Sequence
  Synthesized
  misc_feature (61): n=a or g
tggtagcatctgccccagttgtccctggacacgcagagggaggtgaattatcctgtggttngaatgatggtcaaattgaatctataagatgtgaaacatttgtttcacaagtatagaagct

SEQ ID NO: 7950 - DNA, 121 bp, Artificial Sequence
  Synthesized
  misc_feature (61): n=a or g
acattttttcgtgctaagcagcacaaaaactttgtggataatcacatggtttatgtgaatnggaaatatgctacagatctggaatatttagggactgccattatgataattgcaacatttt

SEQ ID NO: 7951 - DNA, 121 bp, Artificial Sequence
  Synthesized
  misc_feature (61): n=t or c
tggcctgccccttctgtcaggggcccatgttgcacaggatggtcacagagtcccctctcgntccctctgcagccttggaaattccaactgacctgtgaatatctggggtattcatgactga

SEQ ID NO: 7952 - DNA, 121 bp, Artificial Sequence
  Synthesized
  misc_feature (61): n=a or g
agtgagtacaagtgaagacaaagcaataactagagaatgtaacactgaaccatgtcactgngaaggtcaaagaacaagcaaagtaagatcttaaagctatgaagagaaacaagcaggcata

SEQ ID NO: 7953 - DNA, 121 bp, Artificial Sequence
  Synthesized
  misc_feature (61): n=t or g
ctgaaaatatcaaagaaggcttaggactatgggatcttttgctacgtcccaatgtatattnacactggtaatcagctaaataaagcagatattttcgagaagaaaacagatgattcattca

SEQ ID NO: 7954 - DNA, 121 bp, Artificial Sequence
  Synthesized
  misc_feature (61): n=t or c
tgaaagggggggagggaggaaaagaagaagggggaagttaaagggatctcttcaacacctngaattttccttgcatgtgtgagaacccagagatacctgtaagaaaccaaccttgcaccgc

SEQ ID NO: 7955 - DNA, 121 bp, Artificial Sequence
  Synthesized
  misc_feature (61): n=t or c
gtctttttcacaagattcatcttctgtccatgagtcagatgctgtctacttggctgctgtnttcccaggacagaatggtctgtacattgtacattctgcataggaactctgcacaacaatt

SEQ ID NO: 7956 - DNA, 121 bp, Artificial Sequence
  Synthesized
  misc_feature (61): n=a or g
gtatgtgatcacacagcactactaaatgagctgtactgccagtcgtgacagacatttgtantatgtgatgtacagtgagatgaacaactgttaattatttttcctgaagataagtatctat

SEQ ID NO: 7957 - DNA, 121 bp, Artificial Sequence
  Synthesized
  misc_feature (61): n=a or g
caaaatagcagtcttcagtttcaccagttagatactttccaggcaaaatggtgtatttgcncagagacacaaagctaaagaacagaaaaccacaaacatcttgataagtatacagacgtgc

SEQ ID NO: 7958 - DNA, 121 bp, Artificial Sequence
  Synthesized
  misc_feature (61): n=a or g
aggtgcgttttgatttaggaaggtgaagtgtggttccttgcattagaaaggcagcaggtcnctttacaaaagaccccaaatactcttcccaaaaccattgatgcttcacttctacggcacg

SEQ ID NO: 7959 - DNA, 121 bp, Artificial Sequence
  Synthesized
  misc_feature (61): n=a or g
cagaggcttcttggttgtccaagaccacctggaatctatctggccaaatatctgtctttanaggacttgtgcagaattgttgtgatcagcaatgtggctgcagcaatcacaaaaccattaa

SEQ ID NO: 7960 - DNA, 121 bp, Artificial Sequence
  Synthesized
  misc_feature (61): n=a or g
tcatggcatgatgtgcagcctgggtgttctcagaaactgcagtggatgagttgcatatacngatgcctgttagtacagtaggaacaacgctgatattattctatgtaacttacttcataaa

SEQ ID NO: 7961 - DNA, 121 bp, Artificial Sequence
  Synthesized
  misc_feature (61): n=t or c
tctgctagctcactgcatgttaatctctgaatctgatgtacaggaacagccttgcttccantgagaattatggggtctgtctcttctttccttactgagatctgcatggcactgtcaaggg

SEQ ID NO: 7962 - DNA, 121 bp, Artificial Sequence
  Synthesized
  misc_feature (61): n=t or c
cagtctgagtggtaacagtcaccaggaccccataaacctcctgtctcaatgctctcatccngggacacctagttactgaggttttaaagtttaggttgtcgagatattttcattttacagc

SEQ ID NO: 7963 - DNA, 121 bp, Artificial Sequence
  Synthesized
  misc_feature (61): n=a or g
gctctctgacagcaaatgctcctggttcattccctaaatacatacggagatattatatacnacgtagatgcctgtaaggagcaaggtctttacattattccagagctggtgactgcttaac

SEQ ID NO: 7964 - DNA, 121 bp, Artificial Sequence
  Synthesized
  misc_feature (61): n=a or g
ttactttgaaaagtgttgctgtttttgcataagcagatgcttcttcctactctttgtacgntgtaagacaggtgatcaaagaaagttcctgaagtcaaagagtgcttgcatcagtctgtaa

SEQ ID NO: 7965 - DNA, 121 bp, Artificial Sequence
  Synthesized
  misc_feature (61): n=a or g
ttgggtcccctgaaatgtaagtcctgcaggactcagcacttggtttccttgcattatatgngaaagactgacctgtgccaaaactttctgtgtcctctgtcaggtcagcaatgcttcacgt

SEQ ID NO: 7966 - DNA, 121 bp, Artificial Sequence
  Synthesized
  misc_feature (61): n=t or c
tacggctgttctgtcattctcaatccaagcctctttaaaaagtgttttggcaatccatatnagggaaatctcctctgatgggttcagcatcccatctactcccagtagggtagtagagctg

SEQ ID NO: 7967 - DNA, 121 bp, Artificial Sequence
  Synthesized
  misc_feature (61): n=t or c
agtgctttgtggtatgagtttggaaaagtggtgaagaatcgaactcagtcttagctgtgtntcaccaagagtcgaatgtgaaatggagaagtttcttatctttgtttccaacaaaacttca

SEQ ID NO: 7968 - DNA, 121 bp, Artificial Sequence
  Synthesized
  misc_feature (61): n=t or c
acagacgtgagcaaaacctagagatgctctgcaagtgaagatgcttttaatctataagcantgcctaggtggatgcaggatgctttctgacaccacccagtgccaccagctcctaagagca

SEQ ID NO: 7969 - DNA, 121 bp, Artificial Sequence
  Synthesized
  misc_feature (61): n=a or g
acctcatctggtcacctttatttatatcttctttctaaagcaaagaaacacacactgcatngttgctcccagtgccagaagcactgttttaaacccttgtgtatgtaaacagctggaggcc

SEQ ID NO: 7970 - DNA, 121 bp, Artificial Sequence
  Synthesized
  misc_feature (61): n=c or g
atacttttctgaaagaaataaatagaaagaagttacttctcaatatccagatgttacactnaggatgtcactgatgttccaagtattgctctgctgagtcaagatttttccccaaagatta

SEQ ID NO: 7971 - DNA, 121 bp, Artificial Sequence
  Synthesized
  misc_feature (61): n=a or c
actgctggctgatggtcaacctgttgtccacctggacatacttgcacagaggaaacagtcnctctttaccatttacatttgtgtacccccaaaatgtccttgatgacaatgaaagcttctc

SEQ ID NO: 7972 - DNA, 121 bp, Artificial Sequence
  Synthesized
  misc_feature (61): n=a or t
aatagaaattcttggaaggttctgtttttccctggccattcaaatcttcagtgggactagncaccttctggacataccagtctttcttcactgacctcatggaaccagggcaacactggca

SEQ ID NO: 7973 - DNA, 121 bp, Artificial Sequence
  Synthesized
  misc_feature (61): n=a or g
tccttgccagaaccacaaaaacattggcactttctataggctcaggcaatgggaaaatgcnatacatatctaaagaagacagattgcctgtccttactgcaatgattttaaggcccagtgc

SEQ ID NO: 7974 - DNA, 121 bp, Artificial Sequence
  Synthesized
  misc_feature (61): n=t or g
cttttcccttctccattgtctcccagcaattaatctagcaattaacattactcactcattntagtccctgaactttctgctcttttaggaagctaaattgttttagaaaatcatttttcaa

SEQ ID NO: 7975 - DNA, 121 bp, Artificial Sequence
  Synthesized
  misc_feature (61): n=t or c
tgaaaaattgctaatcttgttaaattggcttccttagcctgaagagagctaaagagatccnctctaatctaattagctgttttaccatgtgtttcactaaacctgtttttttatttgggga

SEQ ID NO: 7976 - DNA, 121 bp, Artificial Sequence
  Synthesized
  misc_feature (61): n=c or g
gaaaggatgagatcagtcagagcgggaggtacaagaagtgtggttttaagctttcggagtntacaaatagtctgcgacattaaaaacaccttctgagactgtaaaattcatttttctggat

SEQ ID NO: 7977 - DNA, 121 bp, Artificial Sequence
  Synthesized
  misc_feature (61): n=t or c
gatagacacatttttgagtaatctttttcttcatcagcaatgatcagaaacctttcttttngaactgattttgataataccattacctgctggctggtgtcctacatcactgtgtcttcat

SEQ ID NO: 7978 - DNA, 121 bp, Artificial Sequence
  Synthesized
  misc_feature (61): n=a or g
tcccacctcactccttacccaggaggcttcagctcgtgttggaacagattattacacagcntaacttcccaggcagttgtctgcactgtgtgctggaattcacgatgggaagaagtcaaaa

SEQ ID NO: 7979 - DNA, 121 bp, Artificial Sequence
  Synthesized
  misc_feature (61): n=t or c
attacccctctgcagagagcagctctgcatccaagtgctctgctcacctttatccatcccngtcccatcggtcctcagtatggaacagctcttcttcagtttggaaatgctgaagtcacct

SEQ ID NO: 7980 - DNA, 121 bp, Artificial Sequence
  Synthesized
  misc_feature (61): n=t or c
gcagccaggttgggttgggtgtgtttggaagggggttgtcacagtgcaaggggcagagtgnactgtgagtgggtgacactggtggtggcaagaagatgtggcccaagggtgagaagcctgc

SEQ ID NO: 7981 - DNA, 121 bp, Artificial Sequence
  Synthesized
  misc_feature (61): n=t or c
ttctgcctagaaaatgacagatcttttttccaagaaaaaaattacaaacataggaaaaaanccaccaggaaacagcaaatcaggaaattggacagacagggtatatttttgctcgtgggat

SEQ ID NO: 7982 - DNA, 121 bp, Artificial Sequence
  Synthesized
  misc_feature (61): n=t or g
cagtttaagcagcacaaaactggattaagggcacaccagaggggagactctttctgtctgnttgtcagggttggcagtttctgagctaagttcagccttgcacaaacacctgtgtgctgca

SEQ ID NO: 7983 - DNA, 121 bp, Artificial Sequence
  Synthesized
  misc_feature (61): n=a or g
ttacctaaaatgctaacaattttgctgtggcaaattgattaaacgatgaaccactgttgtngcttaaccagctcggcagctaagcaccacacagctgtttgctcacttcccctcccaatga

SEQ ID NO: 7984 - DNA, 121 bp, Artificial Sequence
  Synthesized
  misc_feature (61): n=t or c
agtcccaatcttggatgatttcttaagggaacagccactacaattccccattgtcaagcgngaactgagcaagtcatcagtgccaaaaagcagcttctgtgcctgggtcaataaaatgcaa

SEQ ID NO: 7985 - DNA, 121 bp, Artificial Sequence
  Synthesized
  misc_feature (61): n=t or c
ttgctgaagagacaagatgagatgactgttctctcagcatcaatgggcaagctagatccangtgccagcagtgatacctggctcatgagacttgccttctgccacgctatgttgcaattta

SEQ ID NO: 7986 - DNA, 121 bp, Artificial Sequence
  Synthesized
  misc_feature (61): n=a or g
tgcagcccttcaggtgagaaaaagattacagttcatgtcctatgctttcccaggcacagangtagatgggcgctggagctgctggtcatcctggaccccgtgccagtcgggctcacggcgc

SEQ ID NO: 7987 - DNA, 121 bp, Artificial Sequence
  Synthesized
  misc_feature (61): n=a or g
caacctgctgtgctgccctacccgctgtctactgaggggctaaacttcttttaagcttgcncaagacctctatgttcagcccacaggagaagatacttcaccagtgtaaatccttttgcat

SEQ ID NO: 7988 - DNA, 121 bp, Artificial Sequence
  Synthesized
  misc_feature (61): n=t or g
agttcctggagctgtacttctaattgtaatagcagcaccactaaggctccaaaattactcnatgcctcttctcccctccattgcgtactgccatcctgctccttttctagctgactgccag

SEQ ID NO: 7989 - DNA, 121 bp, Artificial Sequence
  Synthesized
  misc_feature (61): n=a or g
tcagaagggtttgtgggcctgaaaacttgactattttttccagctgtactggagagtccantagaagttatccccttactacaagtgctgtctcactcgtgtacttagaccctgacagcca

SEQ ID NO: 7990 - DNA, 121 bp, Artificial Sequence
  Synthesized
  misc_feature (61): n=a or c
gctctgaagcactgaaaaagagatgcaaatttttcagaaactgctagaggaacaattggtncagcctgaagagatgtaaaggagaggggtgttggcacagacggatcgtcagcagaaagca

SEQ ID NO: 7991 - DNA, 121 bp, Artificial Sequence
  Synthesized
  misc_feature (61): n=a or g
cagaagtgcagaatgagtagcaaacaatataggattactatagaaatagacaagagtgatnttcttcatagaaacagcagttcaagggaaaccattcaatggctgaatgcacaaagcttta

SEQ ID NO: 7992 - DNA, 121 bp, Artificial Sequence
  Synthesized
  misc_feature (61): n=c or g
agcagattcatgctgctgcagctacgaacagaatctggcccaaaagaggttttaaaataanaggacttctttcaacttaaaaggatgatgtcctcctgttgggccataggaataggtgaag

SEQ ID NO: 7993 - DNA, 121 bp, Artificial Sequence
  Synthesized
  misc_feature (61): n=t or c
tgcattacagatgtattagcactgctttaggttttgaccaacttggcagcaatttattttngggacccttcattttataacaagaactgtggcacaatattaccagagcagttccataagg

SEQ ID NO: 7994 - DNA, 121 bp, Artificial Sequence
  Synthesized
  misc_feature (61): n=a or g
ggccccatatagagctatatctgagtatgcctggattcataatccacagaaatacacttcnctgttcatccaactgtgtaatcactctgcaaaaacctcaaagaaagcaaaagccactttt

SEQ ID NO: 7995 - DNA, 121 bp, Artificial Sequence
  Synthesized
  misc_feature (61): n=t or c
agaaggcaaatacagagacaaggggaaagtgacatatcgcagcagtgtgattctgtgatcnacagagacctggataactatgaaatgttttttggatggtttgtgtgataggcagcaggca

SEQ ID NO: 7996 - DNA, 121 bp, Artificial Sequence
  Synthesized
  misc_feature (61): n=c or g
tatccttatattgtgtattaacactttacccatcgctgctgcattcccacagccatgtaancactctgaactgaaaaaaataggtctgagcataatcatgtttaatctcttagttaagttc

SEQ ID NO: 7997 - DNA, 121 bp, Artificial Sequence
  Synthesized
  misc_feature (61): n=a or g
gctccttgcccttcctcagaagcatcacggtgatgttgctggggtgcctgctgactgctcngcactttctggactagatacagcactctgcccctctcctctgaagctcttcacatgaagc

SEQ ID NO: 7998 - DNA, 121 bp, Artificial Sequence
  Synthesized
  misc_feature (61): n=t or g
aatgaccccttgtggaaaaaaaagcctgaaaggaggaggaatcggctctaaagtttcagcnttttcccagaaatttaatgggtactcaacccagacatgcaagagcaaaaacattttgttc

SEQ ID NO: 7999 - DNA, 121 bp, Artificial Sequence
  Synthesized
  misc_feature (61): n=a or t
taggcatctagcagatttaacataactgagatcgtctttgagtttctataattgatgaagnctatttgattttgccctgagctcttattgtatctttacatctttctgtatttctgcttgc

SEQ ID NO: 8000 - DNA, 121 bp, Artificial Sequence
  Synthesized
  misc_feature (61): n=t or c
aattctttttctagttaaagattatttaattaatgcttttataattactggcattaggagnctataatgcccaagcagcctcttaaaatatcatcaagtatagtgtaatgcttcaatttat

SEQ ID NO: 8001 - DNA, 121 bp, Artificial Sequence
  Synthesized
  misc_feature (61): n=t or c
aacatagatggcagcaggggtcaggcagacaagcagactgtccagtcaaatttgcatgacngcatcaaatgttttgaagtatcggtgtaccggtttaaaaataataacaacaaaagagggg

SEQ ID NO: 8002 - DNA, 121 bp, Artificial Sequence
  Synthesized
  misc_feature (61): n=a or g
gcttttttgccctttgctttttctgacttatatatataaaaaagatcaactctgcttgctnacagagcaagattgacttttgctgcctaagaccccttgcagtatagtccacaaacagaac

SEQ ID NO: 8003 - DNA, 121 bp, Artificial Sequence
  Synthesized
  misc_feature (61): n=t or c
tttttaatttaccatctatttttaagccattttttgtgtatattggcccctgctcaatatncctgactctaggattatccctcatgataagtcaccttcgggagcatgacaaaaagtgctt

SEQ ID NO: 8004 - DNA, 121 bp, Artificial Sequence
  Synthesized
  misc_feature (61): n=t or c
taaattaaattcctcactatttgggggaaggagcagcaaatgagtttttccacttacaagntgaagtttaagatttgattagtccctgtaacagaaaaagtacgattcacaaaaggcaaaa

SEQ ID NO: 8005 - DNA, 121 bp, Artificial Sequence
  Synthesized
  misc_feature (61): n=c or g
cctgcctcattgctgctggcactgtgctgatgcagctcaaatccgttctgctgtcctgcantgctcctccttgtgcaggtgacatggaggtattttcttccaggagaatcatcacatcatg

SEQ ID NO: 8006 - DNA, 121 bp, Artificial Sequence
  Synthesized
  misc_feature (61): n=t or c
tacagggccatgagaagccaaaccgggaagggaagctggtactgttggcagatagatgcgncatgggctgtactcatacacatttgttcctcattccagttgctcaccagagctggtaaaa

SEQ ID NO: 8007 - DNA, 121 bp, Artificial Sequence
  Synthesized
  misc_feature (61): n=t or c
tagctttttctgcaatatgctctttaagctctggagggaaattttcttggacacgcttacntaaatggggccccttttgcaattgccacttagcaagcacttccattgtgtcacaaaactt

SEQ ID NO: 8008 - DNA, 121 bp, Artificial Sequence
  Synthesized
  misc_feature (61): n=a or g
ccctgctatttgggattacagctccattgcacagtgggtgattgtgtcctgtccaggactnaaacaaaccctgcgttctctggagatgtccttgtcataaacaataaggaagtaacttttt

SEQ ID NO: 8009 - DNA, 121 bp, Artificial Sequence
  Synthesized
  misc_feature (61): n=t or c
attttatttccagggtatcaagtatgttattttagcttcgtgactacaatgtcacatattnagttcaacttaatagtaaatgtaaagtaatagagcgaattcatacatactattggcttag

SEQ ID NO: 8010 - DNA, 121 bp, Artificial Sequence
  Synthesized
  misc_feature (61): n=t or c
agtaaaaaattacattaaaaagcatttctcttctacctttgtcagctatctggtgcagctnctgatggtgccctggcaatagttggtaaacaaacaaacaacaacaacaacaacaacaaaa

SEQ ID NO: 8011 - DNA, 121 bp, Artificial Sequence
  Synthesized
  misc_feature (61): n=t or c
gtgagtgactgttctccttcagactgtatgcttttgctgtattgtcccaggagttgttgangttgtggagaaagagcataaatcttcatttgggggtaattaacctgtcctaaaaactcag

SEQ ID NO: 8012 - DNA, 121 bp, Artificial Sequence
  Synthesized
  misc_feature (61): n=a or g
gagtaaagcagaatcacttcctctccttctctactgtgaccttggcagcaacattgtattngttgtggtcctctttgtatttgtaacaagtcacttaaaatgttgtcatgcaggagttgga

SEQ ID NO: 8013 - DNA, 121 bp, Artificial Sequence
  Synthesized
  misc_feature (61): n=t or g
agggaaagtattgaggctgcaatgaaatcactccaacctggccttataatgcaggtcttgntagggatctgtgcagcgtgacaagctttcagctgggatagcaaagaaactgtccagaaag

SEQ ID NO: 8014 - DNA, 121 bp, Artificial Sequence
  Synthesized
  misc_feature (61): n=t or c
gcacagattctaacaagctaaagtgtcacaagaaaatttattatgcccagctctaaaaacnaagacacagaagttgcacgcaggactgaacagaaaagggagtggaggaatcttcctgctg

SEQ ID NO: 8015 - DNA, 121 bp, Artificial Sequence
  Synthesized
  misc_feature (61): n=t or g
ggttgctcatcgttttatctattttcatctggaaagcgtcagagaacacagcatggtaccnaaaattcagcagagctctcacactgttccactgcaccagcaagagaacagtggaaaaaga

SEQ ID NO: 8016 - DNA, 121 bp, Artificial Sequence
  Synthesized
  misc_feature (61): n=c or g
aacacaggcggtgccacttggcaacactgccttgaaatttatgaggaaccacacgactaanaagttctctcttgtcatcagagataaaacaagcccataaaatacagggagctgggggtgc

SEQ ID NO: 8017 - DNA, 121 bp, Artificial Sequence
  Synthesized
  misc_feature (61): n=t or g
tcaactaactcaactgtagacacatgactttgtacaggtttccatcttagcactaaaggcngtctcagttcctcatcctcgtgcacagtaactacattttctccttgttaaatgtaaaaat

SEQ ID NO: 8018 - DNA, 121 bp, Artificial Sequence
  Synthesized
  misc_feature (61): n=t or c
gagtttgggattcctgtttacttgactgatgttctcaatctgcagcacctctggttgatangcaggcagagagggcaatgtgtccttaaatgaggagagcagtcagtgttggcttggagct

SEQ ID NO: 8019 - DNA, 121 bp, Artificial Sequence
  Synthesized
  misc_feature (61): n=t or c
ggcatctcccctctgtgtccaccaccatagtcccaatgtactccccaaaacagcacgtgantgcagctcagttgggtgcccagattttctgggtcttttagcttaatacggatggcttaca

SEQ ID NO: 8020 - DNA, 121 bp, Artificial Sequence
  Synthesized
  misc_feature (61): n=a or g
ctgcttctgctccaccaggtaatcaggagtcttggagcctgtggaaatatgttttgttcanagcaaacatttggcattgcctcctgccctgcaaaattagagaagagatggattgtggtca

SEQ ID NO: 8021 - DNA, 121 bp, Artificial Sequence
  Synthesized
  misc_feature (61): n=a or g
agtggtgaggtctggaagcagggcagcctgacatgccctcacttgagaagcacttcgtacngctgttacccagaggctttccaaagtgctgtttccctcaccgccagctcacattccaaga

SEQ ID NO: 8022 - DNA, 121 bp, Artificial Sequence
  Synthesized
  misc_feature (61): n=a or g
gacagaggagtttgtatagttccgtgttttagcatggcaagcaaccatgactatttttaantcatgggtaaaagggtagattataaggaaggaaggttgagctaaaagagataaagatcta

SEQ ID NO: 8023 - DNA, 121 bp, Artificial Sequence
  Synthesized
  misc_feature (61): n=a or g
aattgtctagtctccccatgtagttaatggagaaagacaggcacctctaattgataaggcntctatcctgatagaacgtgaacagtataaatgtgaattactctcaagtgcctagtgctct

SEQ ID NO: 8024 - DNA, 121 bp, Artificial Sequence
  Synthesized
  misc_feature (61): n=t or g
ttataaaactttctcaagcttttgtgggtctcatttcggcaccaaacttcctattcttaanatggaatagctttcacaggagagcagctccacactgtctgcaaatgggagctctttaaaa

SEQ ID NO: 8025 - DNA, 121 bp, Artificial Sequence
  Synthesized
  misc_feature (61): n=t or c
ttagaaaggttctgaccttaggaattgtttttcttgtgccgtttcttgtggagaaggtagntacccatcatctcctgtcaatacaatattggatgtgttaatatcagcccagtcctcaaca

SEQ ID NO: 8026 - DNA, 121 bp, Artificial Sequence
  Synthesized
  misc_feature (61): n=t or c
tataatagtatgctttggatgtctgttcgcagcatccttcctcgtgtgactaaatggaaantctcctgggactattacttttaggccacattcttcctccatgtaatatatgtgtatattt

SEQ ID NO: 8027 - DNA, 121 bp, Artificial Sequence
  Synthesized
  misc_feature (61): n=a or t
tggtggtaccagaatgccctgcctgttgttgtagtcctggctaaaatcagtgcttttttcnctcctcccctttatacgcttcatagcttcatcagccatccatacagatgtattcagtgcc

SEQ ID NO: 8028 - DNA, 121 bp, Artificial Sequence
  Synthesized
  misc_feature (61): n=t or c
ccccacatccagactttccgcagtggtgctgctgcctggccacacggcttctgtccgctcntcacattctgcacaccctgcagtcctatgaccgttcttgtcacctctgctgggtggcatt

SEQ ID NO: 8029 - DNA, 121 bp, Artificial Sequence
  Synthesized
  misc_feature (61): n=a or g
tctatttgcacagaatatgcaggagatacagcaaattatttttaaacccacaaacataagntttatttcctcctacatagaaaatgatctcagttcatgcatttctatggaaatgcagtac

SEQ ID NO: 8030 - DNA, 121 bp, Artificial Sequence
  Synthesized
  misc_feature (61): n=c or g
ccaaaccttttgtatcagtcttagcgactgtaggatacatagcctgtaggtttctgctgcnacatctgcatccaccttgtctacagacacagtgagacagacaaagtaggcacctcctggc

SEQ ID NO: 8031 - DNA, 121 bp, Artificial Sequence
  Synthesized
  misc_feature (61): n=c or g
cgatggaagggctaaaaacccattagtcccctaataaatctgcttggaaaatggctaggtntaatctgatccactgagctcagtacagcattcccctgagcagactggatttgcagtgcct

SEQ ID NO: 8032 - DNA, 121 bp, Artificial Sequence
  Synthesized
  misc_feature (61): n=c or g
agttctgtggcacaaacccatgaaatttagtagcagtgcccaatctatggattaccacatnctttttggaggatgcaaaacagaccaaaattaggtgaaggattcatagcactcaaaggat

SEQ ID NO: 8033 - DNA, 121 bp, Artificial Sequence
  Synthesized
  misc_feature (61): n=a or g
catgtctcaactgtttggtgaagtatgaggttgtaaacactctaatctctgcagatacctnatagtattaagatgattgatgcttccagtgcatagatgcagaaattagagataaattctc

SEQ ID NO: 8034 - DNA, 121 bp, Artificial Sequence
  Synthesized
  misc_feature (61): n=t or c
agtaagcgttccagtctgagtggaagaaatttagtgctctaggtggaactactgaatgagntgggtactcaggactccaaaaatcctgttattcatcttagtactgacaatgtcagtattg

SEQ ID NO: 8035 - DNA, 121 bp, Artificial Sequence
  Synthesized
  misc_feature (61): n=a or t
atatacatctgagtgccattgtgttttatcacagtggtggaccacaaaatatagaaaaacntctttgcttatggcggagcaagacgcaatcaagacatttagctttggcattgttaagagt

SEQ ID NO: 8036 - DNA, 121 bp, Artificial Sequence
  Synthesized
  misc_feature (61): n=c or g
gggcatctgtgtttttagaaatagtaatttctctgacttacgaagtgtcattcagtggcantctgcctgaacagggacataacctgcacatcttggggttaaacagcccacggtattcact

SEQ ID NO: 8037 - DNA, 121 bp, Artificial Sequence
  Synthesized
  misc_feature (61): n=t or c
tagtatctatagacctgagagaaactgttcaaatgagcacagctgtgctcctggctaggcngtagatggtgtcagaagagcttttgcttagtgatatctaacatgcaagactgtcagtggt

SEQ ID NO: 8038 - DNA, 121 bp, Artificial Sequence
  Synthesized
  misc_feature (61): n=a or c
agatggagaagtaattttctaatgctcagctacccttttgttctcccatgttagggttacngaacagacactgggtagactttgctgtgcaagggaatatgtatgaatccaggcttcccta

SEQ ID NO: 8039 - DNA, 121 bp, Artificial Sequence
  Synthesized
  misc_feature (61): n=t or c
aacttgtcctgaaaaggagataggcatttaataaactagtaagaagatcattgcataagantgcctatacccttgctgaatgaccaattcacaagcttattccctcagttcatcaccgtca

SEQ ID NO: 8040 - DNA, 121 bp, Artificial Sequence
  Synthesized
  misc_feature (61): n=a or t
atcacaaacctacttgatttacatttgtaagaatttgttaattctttgaatgacacttaantgttagggttgtttattctaagacttggaaataaagtaataccaacccgatccaagtcaa

SEQ ID NO: 8041 - DNA, 121 bp, Artificial Sequence
  Synthesized
  misc_feature (61): n=a or t
caaaacaagggtagaattttatttcagtaagtttcatttttctcataacacctgaaaaaantttctagaatgagacagtagtccaaaaacgtcagaagttacccaaactaccccaaataaa

SEQ ID NO: 8042 - DNA, 121 bp, Artificial Sequence
  Synthesized
  misc_feature (61): n=t or c
actgaagtaggacattggactaggttatccagggccttctcaaggcaagtattgaaagttnctagtaacatcctctttggacaatcctttccagtgttttactattctcatagtaaaaaaa

SEQ ID NO: 8043 - DNA, 121 bp, Artificial Sequence
  Synthesized
  misc_feature (61): n=a or g
ctacttgcatattcctgtaagctcttatggccatttaagtaacctcatctgtgacatgacnaccacctgaggagcaaagacaaaactctctgcaagtacatttatataaatacagattagg

SEQ ID NO: 8044 - DNA, 121 bp, Artificial Sequence
  Synthesized
  misc_feature (61): n=a or g
cctcattcaaaatcaagcattaagagtggtgggtctggagacagaatgaaatacaaggaanagttgccactacctcataacccacaaagccaacttgggcctagctgaggtcatgagccat

SEQ ID NO: 8045 - DNA, 121 bp, Artificial Sequence
  Synthesized
  misc_feature (61): n=a or c
aaactaaaaagaaacactttttatttactgagctgaaactagttaactttggggctacttnaaatattggatgtcggaacactatgagaaccgtacatctacagcgttgtgctgttatgca

SEQ ID NO: 8046 - DNA, 121 bp, Artificial Sequence
  Synthesized
  misc_feature (61): n=a or g
ctacaggctgttcttcctggatgacacactagacatagtgatccatgatgagtcttacagncattctgaacaattcatcctacttccttgaaactaattactgacatactagaattgatag

SEQ ID NO: 8047 - DNA, 121 bp, Artificial Sequence
  Synthesized
  misc_feature (61): n=a or t
ttccacaggacttcataatacaacactgataaatgaccataccagatctaatgatctcatnattaaaacccttaatgtgcgctctgtggttaggagataaataaagtatacccgagtagtg

SEQ ID NO: 8048 - DNA, 121 bp, Artificial Sequence
  Synthesized
  misc_feature (61): n=t or c
agaagcttgctcacactgtgtgccactgccttgcactgaagcctatctcaggctgcaaacnatcctgtatgtacctatctcagcatccatttactggtcagccacagcagcagagcagtga

SEQ ID NO: 8049 - DNA, 121 bp, Artificial Sequence
  Synthesized
  misc_feature (61): n=t or g
gagaagtgctcttacctgccctcagcctcttcccacactgcagcactgacaagaacacagnagcacagaaggcagagaagcccaagaggctctcagtaatcgtgaaatcctagagaaactg

SEQ ID NO: 8050 - DNA, 121 bp, Artificial Sequence
  Synthesized
  misc_feature (61): n=t or c
atcagatgagatacgcagaacacagagaatcatacagtggctgcacaaggctctgcctcanctccactcacttccaccaggatttgcactgcagctgctgacatgaccaagactgcccact

SEQ ID NO: 8051 - DNA, 121 bp, Artificial Sequence
  Synthesized
  misc_feature (61): n=t or g
cttgtttctctggtgtactccttagcctgaaatttattgtctgtttttccttgtattcccncaggacattctccaaagcttttattagaactccttattttgtaaacaaactgatttgctg

SEQ ID NO: 8052 - DNA, 121 bp, Artificial Sequence
  Synthesized
  misc_feature (61): n=t or g
tgggagcatgatgcctcatgttgtttcaggcggggtctctatccaaataacaagtcatttnctccttgcacagcgctttaaaaccagtggaaatggcctgagcagccatccaggtaatttt

SEQ ID NO: 8053 - DNA, 121 bp, Artificial Sequence
  Synthesized
  misc_feature (61): n=a or g
gctcaggagcccatcagcagagcctctgatttgtctcattgttctgtcaccttgagacagnggcaatatgggaaacgacaccctcttgtgcttccgagccttctgaaaggcagatggagcc

SEQ ID NO: 8054 - DNA, 121 bp, Artificial Sequence
  Synthesized
  misc_feature (61): n=a or t
ccactctttcagtactagtcccaaggtacataattagtgacagaagggataggttgaggcntgcgagtacaatagaagtcaaggttgataccaagatttttgtactgcttggaagataact

SEQ ID NO: 8055 - DNA, 121 bp, Artificial Sequence
  Synthesized
  misc_feature (61): n=a or g
ctagaaatggtattctgagagaccaggtgatactaagaagtctgtatggagaaattccagnaatatttagatgtggagaacagtgggctcagatttagtcagtcacccacttcatacatct

SEQ ID NO: 8056 - DNA, 121 bp, Artificial Sequence
  Synthesized
  misc_feature (61): n=c or g
agatgtttatgcccaagatcgggttgtagagttcacaaacattttcatatgtctgaaacanagatttttagtaacatttacagtttcatgctacatttgattgaatcaggtgtttcctctg

SEQ ID NO: 8057 - DNA, 121 bp, Artificial Sequence
  Synthesized
  misc_feature (61): n=t or c
agagactgtggcttccattcaaagcattacaatctctatcccaaaaccaattcagcccaangaaagagttgttacaacaacgcaaatggtgccaggattgtacagaaggctccaatgcatt

SEQ ID NO: 8058 - DNA, 121 bp, Artificial Sequence
  Synthesized
  misc_feature (61): n=t or c
ctggaagctggtgatagaaacagtgaaacccaccccgaattcagaaagggctgtgcagatngaaactcccagctttgtgttgtgagaactgcagggtggaggggagtgttgtacagatgct

SEQ ID NO: 8059 - DNA, 121 bp, Artificial Sequence
  Synthesized
  misc_feature (61): n=c or g
gagcgcagcaggagcaggagggcagaggagccgtggccaactgcgtccttgctctcttcancaagagcagaagtagtggctggaggatccaagagtgcacaaacatcatctgctgtgagac

SEQ ID NO: 8060 - DNA, 121 bp, Artificial Sequence
  Synthesized
  misc_feature (61): n=a or g
ttcctgcatgggaagaggattaagatatcatcccgttaactatcaagaagattccttgcanatttaacttcttgtgtataaattatcacaaatttgttcattttttggaaggaatttttcc

SEQ ID NO: 8061 - DNA, 121 bp, Artificial Sequence
  Synthesized
  misc_feature (61): n=t or c
aagagagcaggctgctactatcctctgatttaggcaggaaagggaaaaaggtgaattcagnggctcaaaaaaagtactaatactttctacttcaggtgctaacagtatggaagcattgtaa

SEQ ID NO: 8062 - DNA, 121 bp, Artificial Sequence
  Synthesized
  misc_feature (61): n=a or g
gaagcttgtgagagctggatacagaacaaaatagcagaggaaattattcttcctacatcangtagtcaacttgttgagcaatttgcgaaagggtactatgagattatagagcatttgtatg

SEQ ID NO: 8063 - DNA, 121 bp, Artificial Sequence
  Synthesized
  misc_feature (61): n=t or c
gtcattgtttgctttttgtttttctctaacatgagtaacaatagtattgctgacaaaatcntcacctcgagaaagatgtagtgtgggtgttttcttcaaaaaggaagtccaacaaaacgag

SEQ ID NO: 8064 - DNA, 121 bp, Artificial Sequence
  Synthesized
  misc_feature (61): n=t or c
gcatagaaaaatgcaggagttaatagtatagtcaagttgtcagagaaaccattagcactcnggtagatcatgggctattttaaacattttcttctaaataccccagcaaattatagggtcc

SEQ ID NO: 8065 - DNA, 121 bp, Artificial Sequence
  Synthesized
  misc_feature (61): n=t or c
acaaggcaaacagcttaatgattttttttttccacattactataagaaatgccataatcangttataaagtctgttcagggttagaccttatatcatgcagacaggaaaatgcatcagaag

SEQ ID NO: 8066 - DNA, 121 bp, Artificial Sequence
  Synthesized
  misc_feature (61): n=t or c
aaattcagatgaagatggtgtgtgtgttatgtttattatatattatattcatctttagagngttcaaagtaagtattgcctttttttcttcctagtgcgttccttgcaacagatgatgaca

SEQ ID NO: 8067 - DNA, 121 bp, Artificial Sequence
  Synthesized
  misc_feature (61): n=a or g
tctatgcaagaataaaaagtagaaagagcctggaagtatcacaaagacctttttggagacnttctataatattaccaccttacacactttgttctcatgtctttgagcaccaggcctttgt

SEQ ID NO: 8068 - DNA, 121 bp, Artificial Sequence
  Synthesized
  misc_feature (61): n=t or c
tatttaaatcatcttaagaagcagctgtccagagtcacagcaggatggtgatctacgcagngctgcagacaaacagacccacttcctgcccttgctgcagcaccactgagctctggagaaa

SEQ ID NO: 8069 - DNA, 121 bp, Artificial Sequence
  Synthesized
  misc_feature (61): n=a or g
gagtaagtatgaaagcttaagttaaaataaaggtttatagaatgacgcgtacaagatgganagggactatctgaaggacataaatttgctgagagtttccacagtgaaaaggtatacatta

SEQ ID NO: 8070 - DNA, 121 bp, Artificial Sequence
  Synthesized
  misc_feature (61): n=c or g
actaagagcaaaagaatagatttttccaaatgctaatgaaatagagaaagggacattaaanaaaatgggtttggttactgtttatgaagtcataaagcatcattatttcactgtcaattac

SEQ ID NO: 8071 - DNA, 121 bp, Artificial Sequence
  Synthesized
  misc_feature (61): n=t or g
taattacctatgtagactcttttagtctttgcctgggaggcagtgaattagtcattcagancctagcagtcaaaaggttcaagaaacttgcttttgttctttgtttgcagattttattcct

SEQ ID NO: 8072 - DNA, 121 bp, Artificial Sequence
  Synthesized
  misc_feature (61): n=a or t
ggagaaatgcattaggcttgattgaccatatacaagtggctgaaacagttattgaaataancagatgattcagtaattatttcaatcaagtaatgcataggaaaattttgagtgatggaga

SEQ ID NO: 8073 - DNA, 121 bp, Artificial Sequence
  Synthesized
  misc_feature (61): n=t or c
gggtcacaaaaaacagatctgtatctgctgactgaccatcagattgttcttattcctcctnctagcttttacaattatttcattctcctaatcagtacaaacaaattaatgttagcttatg

SEQ ID NO: 8074 - DNA, 121 bp, Artificial Sequence
  Synthesized
  misc_feature (61): n=t or c
ttcctttgattgcatgtgctctagggtacgactttcctatggccttacagtttaagtactntacagatgctgaacttacttctgcaccattccactgatacgaagtagtgtgatttttcca

SEQ ID NO: 8075 - DNA, 121 bp, Artificial Sequence
  Synthesized
  misc_feature (61): n=t or c
ttgaaatatttgcacaaaatgtctctgagtacaatttatgtgtggacacatgaaccaagangggacatcagctcatgacttggctatcagatatttccttggagattcttacggaagtatt

SEQ ID NO: 8076 - DNA, 121 bp, Artificial Sequence
  Synthesized
  misc_feature (61): n=c or g
ttggtaattgggttgttacatggctccattttttttttcctttaccagtgcagtgattttntgtctggggagcatcagaaagtatcctggaggatgaaagatatatgagccccagacaaca

SEQ ID NO: 8077 - DNA, 121 bp, Artificial Sequence
  Synthesized
  misc_feature (61): n=a or g
tctgaattggaattcttccttagaaggactttttgaacagccttttactacctattttacnatgtatataggaaatcttatgataaatctctaggtatggtccatcttgcaaacctgcacc

SEQ ID NO: 8078 - DNA, 121 bp, Artificial Sequence
  Synthesized
  misc_feature (61): n=t or g
caccaggtcagctggagttgttaaggaacattacctccccatcactgtttttttgataaanaaatcttatattcatttaatgaactgaagtccattctaaattcagacattccctctgtca

SEQ ID NO: 8079 - DNA, 121 bp, Artificial Sequence
  Synthesized
  misc_feature (61): n=a or c
gcctgccctgagctgcccggcctcagcatgtgggcaaacctctccttctggacagggctgngtcctccccaggcacccaaatctttctgatgcaaagcaaaggcgagttcaacagtcagag

SEQ ID NO: 8080 - DNA, 121 bp, Artificial Sequence
  Synthesized
  misc_feature (61): n=t or c
gacaaaggccagtggacaaagcaatgcacacacatgtaacgctcagacctggagacccagnccatgactctgaggaggccctgctcccagtctgggggtgcagccaggatcagcacagctt

SEQ ID NO: 8081 - DNA, 121 bp, Artificial Sequence
  Synthesized
  misc_feature (61): n=a or g
tgagagggaagacagctcaaaaatgagatcattgtgcagatatgggacaacagcaacagtnctatgtccagaaagaacccaagagccccttactcgctggaaatcatggatgatatctgca

SEQ ID NO: 8082 - DNA, 121 bp, Artificial Sequence
  Synthesized
  misc_feature (61): n=a or g
tgggcacaagcagaaatcacgctccattcagcaaagctgctgcgtactctcttattgaccncatttactggtgatagcgatgttatgagataaagtgccataaagatacagaaatgacaca

SEQ ID NO: 8083 - DNA, 121 bp, Artificial Sequence
  Synthesized
  misc_feature (61): n=a or g
gccctgatagcagctttaccatgatacagaaatgcgagacactgtaagacatgaaaacccnttatcatgttgggttatgcattcccagactgcacagataacaggttaagagagtaatggt

SEQ ID NO: 8084 - DNA, 121 bp, Artificial Sequence
  Synthesized
  misc_feature (61): n=t or c
ttttaaagccccaaaaggacaggttccatcactgagcactgtaacttactgcttgtatgantcagtccaagggaaatagttcggtttttttcctaatgtgacatctcgaataacttgttcc

SEQ ID NO: 8085 - DNA, 121 bp, Artificial Sequence
  Synthesized
  misc_feature (61): n=t or c
tttttgtttttatttgtgcttctaatctaatatggatatcctggtccataacttagtttantctctttatttgctaaaagcagtaattgcaggatcagctcagcacttaattgccactgaa

SEQ ID NO: 8086 - DNA, 121 bp, Artificial Sequence
  Synthesized
  misc_feature (61): n=a or t
tttgtcaccccttgctttatgtgagacctaataatacaacacagagcaaatgccaaagccntgagatattctgctgtccccaactcctgttccttgcccagccatccccaggggatggagg

SEQ ID NO: 8087 - DNA, 121 bp, Artificial Sequence
  Synthesized
  misc_feature (61): n=t or c
ataccaccacagctctggcttatcctcagcgaagggctgtgaggaatacagagctcacagngctgctcgtttgcagagtgcattctgatggctcagcttgacataccctgcagcaggcagt

SEQ ID NO: 8088 - DNA, 121 bp, Artificial Sequence
  Synthesized
  misc_feature (61): n=a or g
aattaattctgagtataactaggtgtaaagttgaatggacataaatatctatctaccacantgcagtcaagaccagaatctggacaaaagtttttgcattggcagaatttcacttgcacgt

SEQ ID NO: 8089 - DNA, 121 bp, Artificial Sequence
  Synthesized
  misc_feature (61): n=t or c
cttacggccacgggagctgcctctgctcagaccaagggctcatcaaacctacccctaaganagaaatcaatgcagaaaacacacccaaaactaatttcaattaagaattattttcaccagc

SEQ ID NO: 8090 - DNA, 121 bp, Artificial Sequence
  Synthesized
  misc_feature (61): n=t or c
cttctctgagatggggcggttctactagagcagatcatgcagcagctaaagtgacagagancatgatggtcaactggtacttgaaaagttgtagttcagaaacactacagaaagacctccc

SEQ ID NO: 8091 - DNA, 121 bp, Artificial Sequence
  Synthesized
  misc_feature (61): n=t or c
cctgagctgtaccttttgctagggatgcactaaacaaacattacaaatgcctgtaattaanaagctgccttataagccaaccaacgcccataagtatgccatacaactagctttaacaaag

SEQ ID NO: 8092 - DNA, 121 bp, Artificial Sequence
  Synthesized
  misc_feature (61): n=t or c
tttagcatctgttttttgaatgtttgcatgaggctgacagttggtatacaatatttcaccncatttcaatccgcaactaccatgatattaaacgttacgtaaaatacaaacttagcctaaa

SEQ ID NO: 8093 - DNA, 121 bp, Artificial Sequence
  Synthesized
  misc_feature (61): n=t or c
tccacaaacctgggctgctacaaggctcccattgtactgcatggtactgataaatcatctnaattttagattacttattgataacaacaacaacctcaaacattttgtgcacattttaatg

SEQ ID NO: 8094 - DNA, 121 bp, Artificial Sequence
  Synthesized
  misc_feature (61): n=a or c
ggaatacacagagcaattactaatggccagctgatgggtggtaagttgcagcctccctgcntctaaccccacagaaaatagaacctgatgtaatttatttcctgaaatgacaggggtaagt

SEQ ID NO: 8095 - DNA, 121 bp, Artificial Sequence
  Synthesized
  misc_feature (61): n=a or c
tttttttttttaatttcccaaagttaccttcctgaatgaactcactcactgcatttaccangcctcctgccatagctctgtctctagatctctcattccatcacctaatctctctctagct

SEQ ID NO: 8096 - DNA, 121 bp, Artificial Sequence
  Synthesized
  misc_feature (61): n=t or c
caaactagcattgcacagacaagaaaaacacagacttcattttcacggccctatggatatntgcctgaaacatgacgtaaaatagaactaccagattctaataatatttacaataatattc

SEQ ID NO: 8097 - DNA, 121 bp, Artificial Sequence
  Synthesized
  misc_feature (61): n=t or c
tatgctgggaaagagactgtgctcctcactgacctacatcaagccagatctgggccacccnacagagcttaatgcctctcagacacagtccctgtcctgataatgagctgcagtggcacag

SEQ ID NO: 8098 - DNA, 121 bp, Artificial Sequence
  Synthesized
  misc_feature (61): n=a or g
cccttcttcctccctccctcttccagggctcaaaatcaactatgtctctcctacaaccacncacatttcttcttttatatcacgattcagtatgaagagcactgttatcagctcacaaagt

SEQ ID NO: 8099 - DNA, 121 bp, Artificial Sequence
  Synthesized
  misc_feature (61): n=a or g
acattaaatagattgtggaattctttgtttttgctctcttactacttctcagtgggatagntgctatttgaatatgtctcctctggtccagatgttcagagtgatgaccacaggttgatga

SEQ ID NO: 8100 - DNA, 121 bp, Artificial Sequence
  Synthesized
  misc_feature (61): n=t or g
ggctgccctggacacagtgatgctgtaaatagcaagacagcagcagcacctgtctttctgnctggggtttcaaaacgtgagttttcagcatcttctgtgaccacaatgctgagaaatgcct

SEQ ID NO: 8101 - DNA, 121 bp, Artificial Sequence
  Synthesized
  misc_feature (61): n=c or g
catcttttaccaaagacacctgggccttcttaacagttacagtagaatctggagactgcanttcatgcaatctggtccagatatttttgtgtaggcaatctctgataactgtgagagggcg

SEQ ID NO: 8102 - DNA, 121 bp, Artificial Sequence
  Synthesized
  misc_feature (61): n=t or c
acacgttcccggaacagatttttgtcctttgttaaatataaaagacagcagggaagttaantctgctagaaaaagcctctggacaaatccataaaagaaaacttcgcaaggttttattaaa

SEQ ID NO: 8103 - DNA, 121 bp, Artificial Sequence
  Synthesized
  misc_feature (61): n=c or g
actgtgaggtgtcagaacataaggatctctttgctgacatgcccagtctacacccagctgntaagtagtgctggtggcttgccagaacacgaggaggagctatcactggctgtgttgatct

SEQ ID NO: 8104 - DNA, 121 bp, Artificial Sequence
  Synthesized
  misc_feature (61): n=a or g
ctacaaattccctgtcttgtactgtaactttctattctgataaatgaggcctttttttgtncttaataatgtttcatcagtagtcctgtcagacctgtcttttcatgtcgtaagggttgga

SEQ ID NO: 8105 - DNA, 121 bp, Artificial Sequence
  Synthesized
  misc_feature (61): n=t or c
actaaagaggcaaaatgattacgataacttattaagcttctcatcacaacttgaaagccangctgtgatcaagcaatacaagctacaaaagtaaacagttaaatgcattgtttgactgcta

SEQ ID NO: 8106 - DNA, 121 bp, Artificial Sequence
  Synthesized
  misc_feature (61): n=t or c
gttatccccattttccctacaaagaaggtagttcttagggaagccaagtaacttgtattgntcttgttcatgacctgacttttgtagccagaagcttgtgataggtaagcctccatttctg

SEQ ID NO: 8107 - DNA, 121 bp, Artificial Sequence
  Synthesized
  misc_feature (61): n=t or c
tcagtcattaaggatcttcctacagctgctgcagaagtcaagtgactgcaagagaagacangcccacaactatcatctccaccaaggagccccagaacagcagctcctcttcccaccatgc

SEQ ID NO: 8108 - DNA, 121 bp, Artificial Sequence
  Synthesized
  misc_feature (61): n=t or g
acaactttctttccagagctgagaaataagatggaggagaaaggacacagaagaattaganaaagtagctaagtagcaaaatgacgatggtcttaggggaaaaggaaaaggtgagtgatgt

SEQ ID NO: 8109 - DNA, 121 bp, Artificial Sequence
  Synthesized
  misc_feature (61): n=a or g
ctcttaattagccatcaggctgctgctgtgccaacagctcctgtccttccttgaaacggcngggctgttagaaatgttttttaaccctgcagctgctgactgtttccagactgtgagccag

SEQ ID NO: 8110 - DNA, 121 bp, Artificial Sequence
  Synthesized
  misc_feature (61): n=a or t
tgggagccccatgggcagaatacacagaaatgcaatacaccaccatggaaaatagatgccnttacagaataaagccccacctgtttctatagaatttggtagtgagattccagctcatttc

SEQ ID NO: 8111 - DNA, 121 bp, Artificial Sequence
  Synthesized
  misc_feature (61): n=t or c
gggctgcagccattaccaacacctagatataaatctttggacatgtcacgccatatatcangttacacatgtctgaatactacagtgaggtgtttgcaaactggcacgtcctcagaagaac

SEQ ID NO: 8112 - DNA, 121 bp, Artificial Sequence
  Synthesized
  misc_feature (61): n=a or t
ctgatcctcatgcataactgtcctagagcttaaaactagaatctcttgattgtgtccggtntaacacaacaaagtgaatcatataggattggaaaagaccactaagatcatcagttcgtcc

SEQ ID NO: 8113 - DNA, 121 bp, Artificial Sequence
  Synthesized
  misc_feature (61): n=a or g
catcagattttttgctaagcaatttcagaaacaaagtacactttttaatcattggatacantgctaaccccaaataaaccacttctgacagaaacttgacttacaataccttcacactgct

SEQ ID NO: 8114 - DNA, 121 bp, Artificial Sequence
  Synthesized
  misc_feature (61): n=a or g
agaaaagagaaaaagcaggcaggaagtaagtttcttgaactccaattataagatcctgaanctcaaggacaagaaagtatcacaagcaggattttggttcacacacacacagctttaagca

SEQ ID NO: 8115 - DNA, 121 bp, Artificial Sequence
  Synthesized
  misc_feature (61): n=a or g
ccatcacatagtcttggaaacgaggagccaagatctagtcaaatgatttaactctgcaatnactacaaacaaagctgaaggaacaagatgccagtgaagttactccaaaatgcatgtaaag

SEQ ID NO: 8116 - DNA, 121 bp, Artificial Sequence
  Synthesized
  misc_feature (61): n=a or g
gaactattcctgttaggacatcaaccagctattaaaaattgaattgactgaatgtttagtntaattctacagaaaggtagttagatacttaaatctcggctttctcaatggatagacaatt

SEQ ID NO: 8117 - DNA, 121 bp, Artificial Sequence
  Synthesized
  misc_feature (61): n=a or c
ttgcactctctcatctctgaccccatattttgttactgtactgtaatctttttttgggccnctgctagctctaatgccagctttttgctggaggagcatgacatatgtatgggaggcaggt

SEQ ID NO: 8118 - DNA, 121 bp, Artificial Sequence
  Synthesized
  misc_feature (61): n=t or c
agaggtagcaaaatccatggcttctgctgcaattactttcaggtcatccttccattggctnggaagcaagataatgttctccaccctgtcttgaacatggtaatttaactagatggtttgg

SEQ ID NO: 8119 - DNA, 121 bp, Artificial Sequence
  Synthesized
  misc_feature (61): n=t or c
cacccatatttcttctatctttcatggaatcagttggaggtacggaatacttgatgcattngaaattgaaattgctcaaataggggctgaagtaaagccaagggagctctgttttaggtgg

SEQ ID NO: 8120 - DNA, 121 bp, Artificial Sequence
  Synthesized
  misc_feature (61): n=a or g
cacacctgactgtgccctgttcatgccagtgacatcaaactgaacatcaaacaaacatacntacgcaggatttctacctgaggctttctgaaagtgttctgaagttggatgttgatgggtt

SEQ ID NO: 8121 - DNA, 121 bp, Artificial Sequence
  Synthesized
  misc_feature (61): n=t or c
gaacttcagcaggaaatgattctgcaggtttcaaaagagtctggtgggaagtggagggatngttagcaaatcttctccatgtggggctggtagtttactgctaaacaacagaaggcacaga

SEQ ID NO: 8122 - DNA, 121 bp, Artificial Sequence
  Synthesized
  misc_feature (61): n=c or g
cctgtaaagtaacctgcaaatgagctctacaaggaccaagttctcctgggcaacacctggnagtgcacaggctgaaaaaggctcaggctctctgcggagcagcccaggggacagctcaggg

SEQ ID NO: 8123 - DNA, 121 bp, Artificial Sequence
  Synthesized
  misc_feature (61): n=a or g
aacaaggagttttttggtatatgtgcccatgtgattatattctgaagtttccagtaaattnaaattctacattgtaccttctgttgttagctactgtcaataaaaaagtgacatttctact

SEQ ID NO: 8124 - DNA, 121 bp, Artificial Sequence
  Synthesized
  misc_feature (61): n=c or g
atagacgttcaaaatgaaaaacaggtatttccaagttcgcttgaatgaagtatgtgccaangaaaagtcggtaagtagattgcttcattcaaagcaaagagtagagtggaaagccagatca

SEQ ID NO: 8125 - DNA, 121 bp, Artificial Sequence
  Synthesized
  misc_feature (61): n=a or g
cataactatttcagtgtgtcttaatggtcccctaaccacactacttgaggcagttgttgtnccattgaagttctctagggaaagaccaggacaactatagcactgagcctggttagattaa

SEQ ID NO: 8126 - DNA, 121 bp, Artificial Sequence
  Synthesized
  misc_feature (61): n=a or g
ctgtgctaaaaaataaaggatgaaaaggcaataatctgcttggaggaggagggagagctgncctgccacaggcagggagtgcagctctccaaaattaaagtgactttgccctgaattttag

SEQ ID NO: 8127 - DNA, 121 bp, Artificial Sequence
  Synthesized
  misc_feature (61): n=t or c
cagccatgtggatctcatccttctccctgtgtcataaattgctgagcgcacaccggtgtgncgtaaaactgacccagaatgaaaaatgaggtcttgcaagacctatgcctcatgctcagag

SEQ ID NO: 8128 - DNA, 121 bp, Artificial Sequence
  Synthesized
  misc_feature (61): n=t or g
ccatgaagattaaacagtgctccaaaagtgctgggcacaaatccaatatccaattcaaaantgcagtataatgttcacataggcatcctacgaggtcaataagctaagcagtgatctgtcc

SEQ ID NO: 8129 - DNA, 121 bp, Artificial Sequence
  Synthesized
  misc_feature (61): n=t or c
tctaactcattctcatcctctgacttttactcctgtcttgtaggctgtgtcatcattatcntggcctttttttagtttaagttcagtctactgaaacatgaataagatggagaaacatgtt

SEQ ID NO: 8130 - DNA, 121 bp, Artificial Sequence
  Synthesized
  misc_feature (61): n=a or g
tatattttcaggggaagaaagcaggtgaaagataccatgattagtgataaaaccagaagtnaactgtggtatgcagggttcttaaccaggatggcatttggtacgctgggtatttttcaca

SEQ ID NO: 8131 - DNA, 121 bp, Artificial Sequence
  Synthesized
  misc_feature (61): n=t or c
aattgtgatccttctttgttacatattgtacattttaggtcaacagtgtactctgtaatcntttcatcctgtgaaaagaccccagagattgagtcaataggcttggttgggaataatacag

SEQ ID NO: 8132 - DNA, 121 bp, Artificial Sequence
  Synthesized
  misc_feature (61): n=a or g
tgcttctaccagtatgtagacagacactgcatatatactactcataacagagttggacagnttctaaagcgtttaaaattagggtaacactggtatagctcacatgaggatattaaataaa

SEQ ID NO: 8133 - DNA, 121 bp, Artificial Sequence
  Synthesized
  misc_feature (61): n=t or c
aattatgtacccttttttattcaagaacgtagtgaatgtgttctaacctaccgtatgtaantcaccaatatctcaccgagttcaccaataacatgagttccagcaaaaataattactgttt

SEQ ID NO: 8134 - DNA, 121 bp, Artificial Sequence
  Synthesized
  misc_feature (61): n=t or c
ttaaaattaaaataaataaatgactctttttcctaccccaaaattcacaacaaaatatttngcattggaaacatctaaatttgtggctgtgcgcaccgttctatggtctggcacagtcatg

SEQ ID NO: 8135 - DNA, 121 bp, Artificial Sequence
  Synthesized
  misc_feature (61): n=t or c
tcagcaagttctggatgtgcaagcatcaaaatctggccttaagatacactacaagaggaangatgagatgtggtaggactccctctgcacaggagaaaaaaaagcaactaaatttcatatg

SEQ ID NO: 8136 - DNA, 121 bp, Artificial Sequence
  Synthesized
  misc_feature (61): n=t or c
tcctttgacaaaatattctcatctccattaacccatgaggccttggctgtgcctggttctncgtcaggtatgctctcctcaagcaaaccttactcctcccagcaaacccctctgactgcag

SEQ ID NO: 8137 - DNA, 121 bp, Artificial Sequence
  Synthesized
  misc_feature (61): n=c or g
atgaaatataaattgttgggaagatgactttgtaaactacaggatggtcaagtctttattnttctggaaggtgttgtgattaggggtttttatcacttgagttattcttaaacaatgatgg

SEQ ID NO: 8138 - DNA, 121 bp, Artificial Sequence
  Synthesized
  misc_feature (61): n=t or g
gacatttgaggttacagtggctgcactacaacatttcttcatctgacctgctgaacaaatnataagtatttttcatcaatttaatgcatcataacatctgtttcagattttctcactctcc

SEQ ID NO: 8139 - DNA, 121 bp, Artificial Sequence
  Synthesized
  misc_feature (61): n=t or c
tacacattaacatttctagagcagagggcagggcataagatgctacacaagcgctattaancgcagtgcaaacacagctccacatgggcacaatagagccatgcgtggtggaatctggcca

SEQ ID NO: 8140 - DNA, 121 bp, Artificial Sequence
  Synthesized
  misc_feature (61): n=a or t
gtattttcacagtgaagggcagcatttgttccttattttgtacctactgtctagcaccacnagaagcacagaaatgattatcacaaagctatggttcacacatcacagttcagtcaatgca

SEQ ID NO: 8141 - DNA, 121 bp, Artificial Sequence
  Synthesized
  misc_feature (61): n=a or g
agttcatacagttgaggtaacttaatctattgctgaaatgtagtaatgctaatttgagcantaggttactgtacgcagcacaatttcttaatgtttaaattaactgcaaagtaacctattg

SEQ ID NO: 8142 - DNA, 121 bp, Artificial Sequence
  Synthesized
  misc_feature (61): n=a or g
gcatgctctcaattgcttctttgtagaaccatgagcatgtgtgaagtcagtgggttggcancacagcacctgctgggcaccgtggagccagctagtctgaaagcctccagcatggctgtgg

SEQ ID NO: 8143 - DNA, 121 bp, Artificial Sequence
  Synthesized
  misc_feature (61): n=t or g
ttttctagtagttcctccccacacctgctcttctcttcttgttaaaaattatgcattcttntatattcctaagacatcaggggtattttccaaaaagtgaaagggccctttcaaaaaatat

SEQ ID NO: 8144 - DNA, 121 bp, Artificial Sequence
  Synthesized
  misc_feature (61): n=t or c
atacttcttcctctttctggagtcccctctttcttcctcctccaccaacaaagggaaaaanagaacaaaattgggtcatttgatctgggtaaggtacaccgcattgtgcacattgtctttc

SEQ ID NO: 8145 - DNA, 121 bp, Artificial Sequence
  Synthesized
  misc_feature (61): n=a or g
gtgctcctgtaagggttctgaatatacttcagctattctggttgcaaggcacatggcagcntaagtgaacgcaaactgggcagtcatggcttctctgttcccatctttcttcatgaaccag

SEQ ID NO: 8146 - DNA, 121 bp, Artificial Sequence
  Synthesized
  misc_feature (61): n=a or c
ggatactcttgaatcccagaggaaaaaaatcacattgacgtataattgttatcaaatgatntctgaccaattattaattcctgggtagcaattgaaattacgtaataatttaggttttgtg

SEQ ID NO: 8147 - DNA, 121 bp, Artificial Sequence
  Synthesized
  misc_feature (61): n=t or c
tttctacagtcacagcagcatttagtagtagactaattactaggaaaattctctcagatcnctcagttgtttttatctgtgatatcttttatgctcttgattaataggaacctcagacctt

SEQ ID NO: 8148 - DNA, 121 bp, Artificial Sequence
  Synthesized
  misc_feature (61): n=t or c
cagaaattgtgtgtctatggatgtaactcataaatgcttatttccattcaaaactaaattnggtagtccttgtctcttccttttctgggcctcatttgtatgacaaatgcaaattatgcca

SEQ ID NO: 8149 - DNA, 121 bp, Artificial Sequence
  Synthesized
  misc_feature (61): n=t or c
ggcatggaccctttagcctcagggccctgcacactgttttcaggagctcagttatttcttnaacaaggctggttaactcaagtttgatgtatcattcatgctgttctcccttactcagttt

SEQ ID NO: 8150 - DNA, 121 bp, Artificial Sequence
  Synthesized
  misc_feature (61): n=a or c
ctaggattgtctgactctccacttgatgttaagggagtggagatgcacaacaaagaatcantttgagtggttctctttctaaggaaccgtgtctaccaatgaatagggagggaagagctgt

SEQ ID NO: 8151 - DNA, 121 bp, Artificial Sequence
  Synthesized
  misc_feature (61): n=a or g
aaatgtttcatgttctcttgattgaaaggtctcctgaagtgaggttatttgccacatctcntggggaagttatcccagcataaaaccactgaaaagaatggcagaaagaggacaccaaaca

SEQ ID NO: 8152 - DNA, 121 bp, Artificial Sequence
  Synthesized
  misc_feature (61): n=t or c
ttttgaaagcacctagtgtcacagactgacatgaagcaagcaaccagccgtatccaacaanaggacaacgaaaaaactagaacaaaataccaaggaagcaccctgcccacctgaacctcta

SEQ ID NO: 8153 - DNA, 121 bp, Artificial Sequence
  Synthesized
  misc_feature (61): n=t or c
agtattataatcctgccactatctcctcccttgtatgaagtttgcacaatgagcatcagcncagagtatacaagtcctacatcaacagtgcctaagtgaagaagaaacccatttcccatgt

SEQ ID NO: 8154 - DNA, 121 bp, Artificial Sequence
  Synthesized
  misc_feature (61): n=t or c
tacctggttcctgtctgctgaaaacattgataagagcaggcaggaatagctccaaaaagcngtataatcgttggcgcgatgagagcggctttacgagaggcatgggaggagctgtgttggt

SEQ ID NO: 8155 - DNA, 121 bp, Artificial Sequence
  Synthesized
  misc_feature (61): n=a or c
caacataactacaagagacccatcagagcagtgcagagcatcagagcagtctccttcctgntaacacctggaaggagaactcagcatcactactgctgagcatgtcttactccaagacgtg

SEQ ID NO: 8156 - DNA, 121 bp, Artificial Sequence
  Synthesized
  misc_feature (61): n=t or c
tgaaatcagatctttttaaaaagttctaagtattttcctaacttttccacatgaggcacantgtgaaggacttgtctaagttagcgtaaagcaaatcacaaccagctggtatgctctgtat

SEQ ID NO: 8157 - DNA, 121 bp, Artificial Sequence
  Synthesized
  misc_feature (61): n=a or g
caattttttatgtctattgtgtgaaaacagttaccattttccaccagcccatttgtttacnctgtaggaaaggaaagacaagccagggcataatggagagcaaaataaattttttataact

SEQ ID NO: 8158 - DNA, 121 bp, Artificial Sequence
  Synthesized
  misc_feature (61): n=a or t
tatgtgtttttgtttgtttggagttatttagctcagcagaggactggcagctcagtatatntgcaccaaaatggcaatacttaaattacacacaaaaacatagccaaaggatcacttccag

SEQ ID NO: 8159 - DNA, 121 bp, Artificial Sequence
  Synthesized
  misc_feature (61): n=a or c
cttacaactcagcaaagtttaaatctgggattttgaaaagtattcctttagttcagactcnaaatctcctcagcaaaacgcagtgctgcatttctccaaagccagcacaagtactacaata

SEQ ID NO: 8160 - DNA, 121 bp, Artificial Sequence
  Synthesized
  misc_feature (61): n=t or c
gtcccctgcccacctggggggttctcctggtgtggccatgctgtgccattccatagcacgntgtcaatgcaacctcaaggtggtgcagatggggatttcacaggaacctgggcttgttgtt

SEQ ID NO: 8161 - DNA, 121 bp, Artificial Sequence
  Synthesized
  misc_feature (61): n=t or g
ggaactacccccgattgctctgatccctgctgcttgcaaagagagcatggatgaatccagncatggagcaatgcacagtacccagccatgctgcactgagcagcacagcatgcagtgcagc

SEQ ID NO: 8162 - DNA, 121 bp, Artificial Sequence
  Synthesized
  misc_feature (61): n=a or g
atctttgctgtcaaaagtcctcttgcagagaaaggacagcactgcaccacactctgatgtngtgcgaatgaagcagcctgacgaggtcagtgtgcaaatggagaattgcgaacgttgaaag

SEQ ID NO: 8163 - DNA, 121 bp, Artificial Sequence
  Synthesized
  misc_feature (61): n=t or c
agtcccgttcctgtccacgctttctttcaaagtttactttcagacttaatgtaacccttgnttatctggcaaccaatgttcaggtcctccagcttcaccggagacttatgttgattcctgc

SEQ ID NO: 8164 - DNA, 121 bp, Artificial Sequence
  Synthesized
  misc_feature (61): n=a or c
tgttctaggagaccacaagtttggcccgatttgccctttttgaggctatcttgcctgtcanctaacagcatactttcccttttctctctgtgcagtttcaaataactaccactgaacagtt

SEQ ID NO: 8165 - DNA, 121 bp, Artificial Sequence
  Synthesized
  misc_feature (61): n=t or c
atatcttctttagaagtctgtgagcatttctacagaataaatatgaccattaggatgttcnttgaaatgtatatatgtcattattcagatgtttaattctcctctcagaatgtacaataat

SEQ ID NO: 8166 - DNA, 121 bp, Artificial Sequence
  Synthesized
  misc_feature (61): n=a or g
gctggcaatctggcaaactgctatgagatacagaggtgacaagcacagtgcttgccttgtnaaattcagggataggaagctaatattttactatattagtcctacatgagctttgcattat

SEQ ID NO: 8167 - DNA, 121 bp, Artificial Sequence
  Synthesized
  misc_feature (61): n=t or c
atcagccattcaattcggcaaagcttgcagaagcaggcatcagtgctgatagtccctaaantagataatggtagaagttagttttaagagggtatggctgtgtttgtttgggtcttactct

SEQ ID NO: 8168 - DNA, 121 bp, Artificial Sequence
  Synthesized
  misc_feature (61): n=t or c
acaaaaatgaatttttacagtctttgagacctgcttacctgttcaaaagccaaattttaanccctctgacattccatttaaatagcaacttttatgtcgaatagcatcttgtaggacaaga

SEQ ID NO: 8169 - DNA, 121 bp, Artificial Sequence
  Synthesized
  misc_feature (61): n=a or g
aaaagaaaagtaatttttgtggaattaaaatggagccactcctgtagttaaagcatgtacntagctattagatcaaggactgagctttcaacagcagtgaagaattagatctttattttct

SEQ ID NO: 8170 - DNA, 121 bp, Artificial Sequence
  Synthesized
  misc_feature (61): n=t or c
gcaaagctcccaggcagctcctccatgtgttttacgttaccagtgccactgcattagatangctgaacaacattaatgccaggacatttcactgcttggctaacctaatgacatacagaac

SEQ ID NO: 8171 - DNA, 121 bp, Artificial Sequence
  Synthesized
  misc_feature (61): n=a or c
gtgtgggccctacattgtctggtgcccaataatcaacctagcttttaagatctagagatcngctgttaaggacaccttagtgcacacagtggaaaaatacatattttcatacacattatgg

SEQ ID NO: 8172 - DNA, 121 bp, Artificial Sequence
  Synthesized
  misc_feature (61): n=t or c
cttacatttctttatttagaatgatatttgaagtaacttgtgcccatatttatcctagctnttatgggataaggagaagctttctgagaaagtaagagaaaaacaaaaaagaggagaatct

SEQ ID NO: 8173 - DNA, 121 bp, Artificial Sequence
  Synthesized
  misc_feature (61): n=a or g
ttcacctgtcagctggacctacagcaagtgagtcagaaagagcagacagaacagtgggcanaacttttcactgtgcatcacgctaaaagacacaggggattgcaaatgatgaacaatctct

SEQ ID NO: 8174 - DNA, 121 bp, Artificial Sequence
  Synthesized
  misc_feature (61): n=t or c
cacatatctaaataaagggtttcactactgaagttgaaaccatccctttatcactattttngatggaaagtgtcagtgacatctgacaaattcctgcaacatacttcaacagagcatgtta

SEQ ID NO: 8175 - DNA, 121 bp, Artificial Sequence
  Synthesized
  misc_feature (61): n=a or c
cactgaggaggagtggggagcaacaaagaaatccttccctttcaaacatctctacactcangtaacttaagtttcatacgatgtggatatgctaaaaaacacacaacggcaacactgaggt

SEQ ID NO: 8176 - DNA, 121 bp, Artificial Sequence
  Synthesized
  misc_feature (61): n=a or g
tcttaaccagtgtgggctcccgctagaacaatgaacatggtcaatggctaaggtaattgtntagggtcactgccattcagattcagtttgagagaaaatggacaaaattattcttttactc

SEQ ID NO: 8177 - DNA, 121 bp, Artificial Sequence
  Synthesized
  misc_feature (61): n=a or t
acagacagcgtgaaaggagtactgtgtgcagacagaaaaaaaagagtcctcagatttgggntgactatcagttttctgtttggcagagaaaccagcacagattcagggacacaggaacacc

SEQ ID NO: 8178 - DNA, 121 bp, Artificial Sequence
  Synthesized
  misc_feature (61): n=t or c
agagagctaatttttcttcttctctacatcccacagttcctaatagaggtagctgaattcnccaataaaaactaatcaggaagtgaaacacacagctgtaaacaatttcttagtctgatga

SEQ ID NO: 8179 - DNA, 121 bp, Artificial Sequence
  Synthesized
  misc_feature (61): n=t or g
gaaggtagctgcagtaaaactactcccttaaaccataatcagtgcacacttcttgccaaangacactgtaaatactaggtattcacaaagggatcaacaaactgatggagaaaattaccct

SEQ ID NO: 8180 - DNA, 121 bp, Artificial Sequence
  Synthesized
  misc_feature (61): n=a or g
attgttggttggagtgttttctgttgttttttttcctcaaagcagtggcagttacggaacngttggagcaaacacgcaggggtagggcttaaattcttcatctccatctcctggtgttgag

SEQ ID NO: 8181 - DNA, 121 bp, Artificial Sequence
  Synthesized
  misc_feature (61): n=a or t
ccctaacctgtatgtctggtgactgagtagattataatcactgaaaactctgtcttgctcntttcttctatactggtttgtccagtgagactgaagtttggactggctcttaaatgcagtt

SEQ ID NO: 8182 - DNA, 121 bp, Artificial Sequence
  Synthesized
  misc_feature (61): n=a or t
ttataatagtctacactgacaatttgctgtgatgagaatggataaatttgaagccacttcngagaaagactgggccaggttttctaagctaggaaactgctatattaagccaaagactcga

SEQ ID NO: 8183 - DNA, 121 bp, Artificial Sequence
  Synthesized
  misc_feature (61): n=t or c
gccgagtgggataagatgtatgggtccaggcactgaccgggaagacccggcgacaaccaanatacctctttcttagggtttctgataggactgggcctttttggtcctttgtttttctgaa

SEQ ID NO: 8184 - DNA, 121 bp, Artificial Sequence
  Synthesized
  misc_feature (61): n=a or t
atcttgtgaaactagacctgattttcatttagtgttgaagtacaaaagggaacaaaaaaanaaaggctcaaaatggggtgtttaattacacattgataacaaaattgtagtagtaattaga

SEQ ID NO: 8185 - DNA, 121 bp, Artificial Sequence
  Synthesized
  misc_feature (61): n=t or c
aaacagtgtaaagaactactgctgccatctttttacaataaagttcataaaggttttatancctgtagcagttaacatcatgaacagagaaaggagccttcaacacaaactaattaaagac

SEQ ID NO: 8186 - DNA, 121 bp, Artificial Sequence
  Synthesized
  misc_feature (61): n=t or c
ctaggatcctcatcagcaggattcgccctagcccagctgtcacaaaaccacctgctacttnttttgaaacaacaacaaagagagggagaagacatttgtgaatgcaggaaaactttattgt

SEQ ID NO: 8187 - DNA, 121 bp, Artificial Sequence
  Synthesized
  misc_feature (61): n=t or c
gccctgtgtgcaggtgtgcggtgccgtgcagagcagcagggcagcccggccggctccctgngggatcagttctgctctcactgagccttcagaagtagaaagcacagatggctcagacctc

SEQ ID NO: 8188 - DNA, 121 bp, Artificial Sequence
  Synthesized
  misc_feature (61): n=t or c
gcctcattaaacaaattagtttagaggagaagaagaacttggaggtaggcatctggggtanttccaacggctaattttcccgagtgtgcaagcagataaaaacagaggtaaaacgtgtcag

SEQ ID NO: 8189 - DNA, 121 bp, Artificial Sequence
  Synthesized
  misc_feature (61): n=a or t
ttctgaactcctcttagacagatgcctgtactgacaacactaaccttcctaaaaaagttgnggggataaagccagaggttctgggtggaagtgttgatgcttttgattgctggaatggtag

SEQ ID NO: 8190 - DNA, 121 bp, Artificial Sequence
  Synthesized
  misc_feature (61): n=c or g
aagacaacatgcatgtgcaggatactggtgtaggttagctactatacaggcagttcccacnagctattctggcactagattccaaagctagatagatcttctgctacagaagtacaacttt

SEQ ID NO: 8191 - DNA, 121 bp, Artificial Sequence
  Synthesized
  misc_feature (61): n=t or c
tgtgaattggaggtattccatccccgtcaactggattcagacagagaattactcaggtgangcactacttacaaaccccagtaatggtgccgagcagattgaaagcaaaatgtggtttgaa

SEQ ID NO: 8192 - DNA, 121 bp, Artificial Sequence
  Synthesized
  misc_feature (61): n=t or g
ctgtttcaaccaaacaaaatactcttctttggcataggagatacaagatgttaaaacactnagctctgcaaagagtggcagcattttgtttgccttttctttccccccagcaagtgttatc

SEQ ID NO: 8193 - DNA, 121 bp, Artificial Sequence
  Synthesized
  misc_feature (61): n=a or g
tgtaaatataactttagctctctgaggaagtaaaatgtacctggttaagattgtgtcattncttccctctatagagaagtatggaaaagggaaatttcctctaacagagatttaatgtttg

SEQ ID NO: 8194 - DNA, 121 bp, Artificial Sequence
  Synthesized
  misc_feature (61): n=t or c
attttttgctgattatcaaatctaagcttttgtagattgaacaacattgaacaataaccgntgtcccacacacacgaagtctgctatccaagactacccagatcctttgcactcccatcat

SEQ ID NO: 8195 - DNA, 121 bp, Artificial Sequence
  Synthesized
  misc_feature (61): n=a or g
aagacttcaaatatgctacataaaaaacaccctcctgatacttcaagccacattctgaatntgagtttgcctgtgatatggtggaagggatctgatctgctgtttactaagcaatcacttg

SEQ ID NO: 8196 - DNA, 121 bp, Artificial Sequence
  Synthesized
  misc_feature (61): n=t or g
aaacaatgaagccataaaaccatatcagtttatgcaaaatttcagaaaaatgtaagaaatnaaaatctgaaagccttctgtgaggcatgtcatttattaaagttgctatagaatgaattcc

SEQ ID NO: 8197 - DNA, 121 bp, Artificial Sequence
  Synthesized
  misc_feature (61): n=t or c
atgagatataatttttcattatcttttgaattactgttggtgtgtggcatattccaactgngggctggttggaagatgcacaagagctaagacaaccaaatacctggttatctttgagtat

SEQ ID NO: 8198 - DNA, 121 bp, Artificial Sequence
  Synthesized
  misc_feature (61): n=t or c
cttttttgctaattttgcttttaaaatctgcagtatgatctactgtcttgcatgtctgccngaataccacagctgtctgaataccacagccacctgtggtatactagagatccccacacaa

SEQ ID NO: 8199 - DNA, 121 bp, Artificial Sequence
  Synthesized
  misc_feature (61): n=t or c
agtattccatatcatgcatcaggctgtttgatgctaaagcacagttccgggtgcagttacngggttctttgcttctagcagattcagcgattatcacataagttctggttctctgcgagga

SEQ ID NO: 8200 - DNA, 121 bp, Artificial Sequence
  Synthesized
  misc_feature (61): n=a or g
tgaactgtaacttaaagctcaacaaatttccatacgtctgatagctagctatattgtgttngtagctcaatatttctttggcaataagatttttgtaagaaactatcaaatcatagtatga

SEQ ID NO: 8201 - DNA, 121 bp, Artificial Sequence
  Synthesized
  misc_feature (61): n=a or g
taggtggatgtgcagaagactcctgtgctttggaaactcctggaacagtgatatctgattncttcatgtggcacatggaaatactaaataactttggtagcttcaacaggaaacaacagtt

SEQ ID NO: 8202 - DNA, 121 bp, Artificial Sequence
  Synthesized
  misc_feature (61): n=c or g
ggaagggagaaggcaagaggcagccagcaggacaggatagagaaggaacagtgacagagtnggatgtgatcccagctcactcatacctccagaacatggtgggagtcagcagcaacaggtt

SEQ ID NO: 8203 - DNA, 121 bp, Artificial Sequence
  Synthesized
  misc_feature (61): n=a or g
ttctctgtaagatgccaagatggtattagtcttgtttacaaaccctgatatagagaaattngtactgctgccacctctgattatctcatagaacagtgtgcgtgtccattaaatggaaaat

SEQ ID NO: 8204 - DNA, 121 bp, Artificial Sequence
  Synthesized
  misc_feature (61): n=a or g
tctacttcacaaagacaacaagaatacagtttttgaatagagaatttccagatttggtctntgtgactgtagatcaaaaataatttgtcctttccagttcagatcagagattggtatgtag

SEQ ID NO: 8205 - DNA, 121 bp, Artificial Sequence
  Synthesized
  misc_feature (61): n=a or g
ttatgacatactgctataagtgtggtatttatggcttagattcagaggcaagctacatacntgaagggttgagttagcccttctctttcccttctactttctgaaaataacttctgaacta

SEQ ID NO: 8206 - DNA, 121 bp, Artificial Sequence
  Synthesized
  misc_feature (61): n=a or g
taactcctgaccttgagttatgcagcactatgctggcataactactcaagcacataagcgnctaagtcattttctaaaactctcacagataagaatcagatactgtgcttgtctgatggag

SEQ ID NO: 8207 - DNA, 121 bp, Artificial Sequence
  Synthesized
  misc_feature (61): n=a or g
aaaaaaaggaataagaatgcaggtcgagaacttgtaattccagttcatcttagggaaagangaacaacttgagtttcaaggtttgtgtgtacgtatctgctacagtccaaagcgctggctg

SEQ ID NO: 8208 - DNA, 121 bp, Artificial Sequence
  Synthesized
  misc_feature (61): n=a or g
taaggccaaaacacagcatcacaacaggaagaaaattatctcatctgaaaccagggcagtnctgtatgggtaagaacttctgctgagggggaagcaggtaggtacatcatccatcagtttc

SEQ ID NO: 8209 - DNA, 121 bp, Artificial Sequence
  Synthesized
  misc_feature (61): n=a or g
gatataatttggaacaattgaactatgcttgtgtgagtgtttgaactgaaacacaggtagngagacaatgattcgataagtatataatcttttttagatttaggattaagcaaaaccaggc

SEQ ID NO: 8210 - DNA, 121 bp, Artificial Sequence
  Synthesized
  misc_feature (61): n=t or c
gttctggtccagtttctgatgtgtgatcacacacaagtgtgagcaggaaatggagacaganttcagctgcacatccacagggatcccaaatgttctctgtaactttctttggactgacgtt

SEQ ID NO: 8211 - DNA, 121 bp, Artificial Sequence
  Synthesized
  misc_feature (61): n=a or g
cacttctatgaaaaaaatcatcaacagattatttgtgaattgcttctcataagtgagctangaggatggaaacagttaaatgtgggaaaaaatcaccagtggttttcaaagatcaataata

SEQ ID NO: 8212 - DNA, 121 bp, Artificial Sequence
  Synthesized
  misc_feature (61): n=a or g
gcttcttgaagtcggttctttaaaacttgcacgggtgaagatcacacagcctgtgcaaaanatgtcttccggtgcttagctttattttttttaaatctctctcatacagccagtctgaaaa

SEQ ID NO: 8213 - DNA, 121 bp, Artificial Sequence
  Synthesized
  misc_feature (61): n=t or c
gcaagacccggtactgtccttcagttagcagatgataaatcctgtttttctagaagatctngcttaacagccttatgaaagggaaacagcctgctggctgactgaggacccaaattttggt

SEQ ID NO: 8214 - DNA, 121 bp, Artificial Sequence
  Synthesized
  misc_feature (61): n=t or c
tttttctgggtgagtgagtctgcaggctgtgtcctgtataaattaatactagttgaattanatgttttaagagtaatgttgatattatctgggagggcctgtaattttgtttgccttaacc

SEQ ID NO: 8215 - DNA, 121 bp, Artificial Sequence
  Synthesized
  misc_feature (61): n=a or g
gggctgtcctgcagtgacaggcacccacttctctttttcttttgacttcagcttttcagcncaagcactcaccgtttgtaaaggttacagaaagatagtgcccgccatgccaggctcctgg

SEQ ID NO: 8216 - DNA, 121 bp, Artificial Sequence
  Synthesized
  misc_feature (61): n=a or g
ttatggcaagttcctagctaacagtatgaaaataaaaggaagcactttttctaaggattcntttcgtgaataatgcatcactgaagaactttatgacaaattattttgtagaacttgataa

SEQ ID NO: 8217 - DNA, 121 bp, Artificial Sequence
  Synthesized
  misc_feature (61): n=t or g
tggtctcccacttggtgtgcctcacacccttcacatatctgctacagtttcctgactgaantcctgccaaccatctctttccagccgctgacaccagtttttctgtctattcttcatctct

SEQ ID NO: 8218 - DNA, 121 bp, Artificial Sequence
  Synthesized
  misc_feature (61): n=t or c
ggtgtggggttaggtagagatgatggtggccctgacagcactccaggagacacacacacanggtgacgtggcccagcatcacagctgcagtgccgcagaggctcagcactacacgtgtcct

SEQ ID NO: 8219 - DNA, 121 bp, Artificial Sequence
  Synthesized
  misc_feature (61): n=t or c
ttcaagcagatggtttgtgtttcaagagcgctggcaagagggagtgttagaatatcaattngtccaccagacactaacgcatagtttaggtacttcggtcattctgccttagtcccaaaaa

SEQ ID NO: 8220 - DNA, 121 bp, Artificial Sequence
  Synthesized
  misc_feature (61): n=t or c
ttcactttgaatttttccttcagtctgccaggctttgcctattatgcgagagctccacacnccttcagtgtattttctacaaaatttgttacaaagattgcagtgtgcactggtagtccaa

SEQ ID NO: 8221 - DNA, 121 bp, Artificial Sequence
  Synthesized
  misc_feature (61): n=t or c
tctttcaagagcagttagtcacctataataaggacagaacatggggtgaaaacagaatcgntgacacagatggatgatcacctactgttgatatagggcagatttccattctgtgtttcca

SEQ ID NO: 8222 - DNA, 121 bp, Artificial Sequence
  Synthesized
  misc_feature (61): n=t or c
aaaacaaccttccataaaagcatccgcataaaagatttaacactccacttggttatgaganaagaaagcctgaagctcacctctgcaaccatagttcaaaccaaccacgggacatcagcat

SEQ ID NO: 8223 - DNA, 121 bp, Artificial Sequence
  Synthesized
  misc_feature (61): n=t or c
tagaagcaactaaaggaaaaaaaaaaatcctcctctcagtgggactgttgtcatgaattgnattttaccactctaacacactccctctgttggctttttctcaaggaatatccacgagaat

SEQ ID NO: 8224 - DNA, 121 bp, Artificial Sequence
  Synthesized
  misc_feature (61): n=a or g
cacaagggcatataagtcatataaaatatccatttcccctgtgtttactggtctactttantccttctgtattactttctattttctattaacatgacaaatttttgctcccctgaatgtc

SEQ ID NO: 8225 - DNA, 121 bp, Artificial Sequence
  Synthesized
  misc_feature (61): n=a or g
aaaataacattatttaaataataacgcacaataagtccacaggtgacttttagatctgggngcccggatacaactttcatctaatgaatttcgaatgagtgtcaggatgtgatttggtacg

SEQ ID NO: 8226 - DNA, 121 bp, Artificial Sequence
  Synthesized
  misc_feature (61): n=c or g
aagaaaaaaacccaaaccctcatgctcaggcatatctaaacttcagtccaaacaccatctnagtatttcactcacagccaactacatcttttttaaactaatgcttaatatgcctatagca

SEQ ID NO: 8227 - DNA, 121 bp, Artificial Sequence
  Synthesized
  misc_feature (61): n=a or g
aacacttggaaaaagaaaaatctacttgcaattgctagtgcctagaaatcttgggtgatcnacttcaggcatgtgagaaaaactcagtctttctagatataacacttcacatatcatgaaa

SEQ ID NO: 8228 - DNA, 121 bp, Artificial Sequence
  Synthesized
  misc_feature (61): n=c or g
atcaaatcagcaacactgtcacctcactactggtgctctgccccgaatcactcggaagaantggaattgacagatgcacatttttattaactgcaaaatgacaggcagtgtttgcctgcta

SEQ ID NO: 8229 - DNA, 121 bp, Artificial Sequence
  Synthesized
  misc_feature (61): n=t or c
aaaagacaacttgtcctgaataaaaggcaacattcatccgggacaaaggccagtgtaaaangtagccgagattggaaacacaaacttcagtggagtgccaaaatcttgcctgcgagtctta

SEQ ID NO: 8230 - DNA, 121 bp, Artificial Sequence
  Synthesized
  misc_feature (61): n=t or c
aaaacttactgagacagagaactggagaagtacatgcctgaggacattagcttctgactcntggtatcagctctgtcagcgctaaagacaaatatctgaagagaagaaaatttacagttat

SEQ ID NO: 8231 - DNA, 121 bp, Artificial Sequence
  Synthesized
  misc_feature (61): n=a or g
agactatagtttagcaatagaacaagcaggtcctcaagcctacactgctttgcccgaagcngtagtgaaaaatgcaagctttatattctacgttaccatttgaataaccacaaagaacaga

SEQ ID NO: 8232 - DNA, 121 bp, Artificial Sequence
  Synthesized
  misc_feature (61): n=t or c
ccacggcacacagagcatcacacccatgcacaccattgggtttaactgtcggcagccccangctgtgcctctgggctcactgtgcttggagtaaagtggacagagtaaagtgggatttgtg

SEQ ID NO: 8233 - DNA, 121 bp, Artificial Sequence
  Synthesized
  misc_feature (61): n=a or g
agaatagattttcaggctgtaaatactgcctaacatacagatgccaactcttgcatcccantgctgtcagacaactaatgattgagttgctaacacattcaagtaggaagaaaactttgga

SEQ ID NO: 8234 - DNA, 121 bp, Artificial Sequence
  Synthesized
  misc_feature (61): n=t or c
actaaaatacacatctttaaggctaaatataaaacacagcatatttacacaactctcttcnagtctaatcctaggtcaaaatgttaatgtgcaaccccagcaagataaagcacagcctgtt

SEQ ID NO: 8235 - DNA, 121 bp, Artificial Sequence
  Synthesized
  misc_feature (61): n=c or g
taaacatgcaaatgcttcaagaaactgctctttattgatgtgaaatctactgcaagatctntgtggactttagcacccataggagaagggattcacatgtgcaaagggacactgtaactca

SEQ ID NO: 8236 - DNA, 121 bp, Artificial Sequence
  Synthesized
  misc_feature (61): n=a or g
ccctcaccttgggaaagatgcttattgtgacatgaacaactccttcatgttacaccatacntgcatggctgtcctatataaaaaatgtctgtttgcattatgttgttgaggagccttgtct

SEQ ID NO: 8237 - DNA, 121 bp, Artificial Sequence
  Synthesized
  misc_feature (61): n=t or c
gcaaaaccttttacttctccttttttaggtgagcatttccaagttgaagctgccactgtgnaagatgcctgagtgttaagcactgggccccagcaatgtgtggctgtgcagagctgccaac

SEQ ID NO: 8238 - DNA, 121 bp, Artificial Sequence
  Synthesized
  misc_feature (61): n=t or g
gtaccacagaagtcacagcatatgttggtttcttccagcaatgaaagtgaagcttcattanctgaaacaaagcagtactttccttgtaccctggagggtcttctccattctgcctggcttc

SEQ ID NO: 8239 - DNA, 121 bp, Artificial Sequence
  Synthesized
  misc_feature (61): n=a or g
gaaagcccagaaagctttaatggcaagcggagcttgttctcccctcatcaactaatgtacntaagacacctgtccacacaactcatttcttctaccagtcgatttgggtttgcacaaatgt

SEQ ID NO: 8240 - DNA, 121 bp, Artificial Sequence
  Synthesized
  misc_feature (61): n=t or c
aagtcaggtcctatcctccttggctggaatcttaattcctgccagttcatgcatttgggancagcagcctgtcatagagcaaaggtgactctgttcttgctggcttaattctgtgctctat

SEQ ID NO: 8241 - DNA, 121 bp, Artificial Sequence
  Synthesized
  misc_feature (61): n=a or c
tggagtggaggggaggagagcccaaagcaggacagcagtggctggtggtcttcgtcccctnctgatggatgagcagataacacgttgtgcacttgtcgtgcttttctttaggcgactgagt

SEQ ID NO: 8242 - DNA, 121 bp, Artificial Sequence
  Synthesized
  misc_feature (61): n=t or c
agatgtgaacatgtaaaatgcaaagttaggctttggagccaacattaaagagtactgcaanagttgtcttagaatttaagagagaaaagcattgttttttcatatagcaagaatgtatcag

SEQ ID NO: 8243 - DNA, 121 bp, Artificial Sequence
  Synthesized
  misc_feature (61): n=a or g
tacaaaatgcacttgagcattactgaagagacagcaattcacacattttgatcatttcccngagtcttccctcatttgaagaaagagggacagtttcttactagtgttacaggataaaata

SEQ ID NO: 8244 - DNA, 121 bp, Artificial Sequence
  Synthesized
  misc_feature (61): n=t or c
gttttgccctcgatgtttttaacacaagatgtacagttctctcagtgcattgatctttagntttatttttaaatcttatactcctgacaatggaagacctttcacctttagcagttttttt

SEQ ID NO: 8245 - DNA, 121 bp, Artificial Sequence
  Synthesized
  misc_feature (61): n=a or c
tgctgatgcacaatatattcagcaatatgtctttcttccagatgggaagtggggaacctgnatttattagttatgggactaataggcatttttttttttccctatcatgtagactttatgt

SEQ ID NO: 8246 - DNA, 121 bp, Artificial Sequence
  Synthesized
  misc_feature (61): n=a or g
agcctaccagagaatccacaggtgctgggtaggagaacaagaaacagaggtataaagtcanaagaattttttaggctggctgaaagtttttttccacacaaggatgtgtgagcaagccagc

SEQ ID NO: 8247 - DNA, 121 bp, Artificial Sequence
  Synthesized
  misc_feature (61): n=t or g
aggacaagcaaataaaggggaacactgctgtggaccacttgacaggacaatgacaccaatnaattattctttaagaactaaaagatacctctagatccgccacccttatccttgtccatct

SEQ ID NO: 8248 - DNA, 121 bp, Artificial Sequence
  Synthesized
  misc_feature (61): n=a or g
tgacccattttactgaaggtctctcccatcctctcagccagaaatgctgcttactgccacnttctgtagctgtttacagtccgattctgcccactgtttaggtaaagcgttatgaatttgc

SEQ ID NO: 8249 - DNA, 121 bp, Artificial Sequence
  Synthesized
  misc_feature (61): n=a or g
aacattaggcacaggcagatacacaactcaattgagcaacacgcatgcaaataatttttcnaagtatacctagattttaaaatgctctttagtcctgtaattctttattgtagctctatag

SEQ ID NO: 8250 - DNA, 121 bp, Artificial Sequence
  Synthesized
  misc_feature (61): n=a or g
gtggtgagcttccatctgcagggcttgctgccatttccttgcccttttgctcggtgtttcngacacacagcatgctcagtgccccggcattgcctcagaaacactgggcaaaggctttgtt

SEQ ID NO: 8251 - DNA, 121 bp, Artificial Sequence
  Synthesized
  misc_feature (61): n=a or g
agtttgccctcaggcaattcactgtgctgtgtatgtattgcacagaaagagactgttcganaaaggcagcagactccactaactcactacaatgcttatttggagtttggaagcctcttat

SEQ ID NO: 8252 - DNA, 121 bp, Artificial Sequence
  Synthesized
  misc_feature (61): n=a or g
acgttcctgacacataagccaaaaacctgtcacatttcaattcctttttccaaagcctggnggcacgaaaagaaaggtcaccaaatttcttgaagcatgggggaaaaaagagcttattttc

SEQ ID NO: 8253 - DNA, 121 bp, Artificial Sequence
  Synthesized
  misc_feature (61): n=a or t
aaattatttttattcctcctataagagcaaaattattatgcactttcagcacctttattancattcgttctgaatctgcaggattttcttcctacacatgctttctaaaaatgttcttcag

SEQ ID NO: 8254 - DNA, 121 bp, Artificial Sequence
  Synthesized
  misc_feature (61): n=t or c
tttgagttactgtacgaagttttataaggcagaaaattaatctgtcaagcaaaatctgcangacttcttctagataggaatcaaaaagtagcaacagccaatacttgctgctcactaacgt

SEQ ID NO: 8255 - DNA, 121 bp, Artificial Sequence
  Synthesized
  misc_feature (61): n=a or g
atatatgtatgcactaaccaggcatggaaaaggatgctgattagaaaacctgtggcatggnggaaaatgttatttttcctgctggcaatttttctgggggttggcagagcatgccatttct

SEQ ID NO: 8256 - DNA, 121 bp, Artificial Sequence
  Synthesized
  misc_feature (61): n=a or g
cggccccacactccagcatcccctgcgagctttgagggtatctgagcaccacaaatggcantggtacctggtgcacaccaaagtgatttggtcaccagtagtcccaggttgctcatgggtt

SEQ ID NO: 8257 - DNA, 121 bp, Artificial Sequence
  Synthesized
  misc_feature (61): n=t or c
gcccctggaggtcctgcagaaagagacactgcaccaccagggccatgtgcagcaagcaagngcagccactctgcagacttttcctccctgctttgacaaacacttcagtctctgcagctcc

SEQ ID NO: 8258 - DNA, 121 bp, Artificial Sequence
  Synthesized
  misc_feature (61): n=a or g
gacaatataaaactgagaggagtggtaaacaggtgagatggttgttcttccactcagtaanaccttgacagtttggagaaatgggctaacagtaatatcataaaattcaacaaaggggaag

SEQ ID NO: 8259 - DNA, 121 bp, Artificial Sequence
  Synthesized
  misc_feature (61): n=t or c
gcctgaattaaagtatagaacagattttagttttgccctactagactgtgatccaaggtcnggctctcccacattaccttttaatacctttcattcatcctgtgacagccaaacgatgaat

SEQ ID NO: 8260 - DNA, 121 bp, Artificial Sequence
  Synthesized
  misc_feature (61): n=a or c
ggctttcgaagaaaggaaggaaggcgtattgtttatgcctctaaaggagctggtccagtgntaatttggcatttctgtagcctgaggtcccatgcagggcatgtagagatctggagtttgc

SEQ ID NO: 8261 - DNA, 121 bp, Artificial Sequence
  Synthesized
  misc_feature (61): n=t or c
ccccgtgagctttctgcaaacatgcactgctccgcaaaccaacttattcccacagcgttcngtgccatcattgtaggatcgtggttttggtaatgagatgaggatgagcagtccttggtgc

SEQ ID NO: 8262 - DNA, 121 bp, Artificial Sequence
  Synthesized
  misc_feature (61): n=a or g
tagtactgtggtttcaaaatattttcctaggtgggattctaagtagtggagacctcctgcnttaacacaactacactgatataaactgaagccaggtagttcaaactctacatgaaacaaa

SEQ ID NO: 8263 - DNA, 121 bp, Artificial Sequence
  Synthesized
  misc_feature (61): n=a or c
aacaaatggcagctaattagcccgaagaagaaagaactaaagaagcagtattataacagtnatcaagaatgtaagattgtgtcatgaagaagaaaggcatgatttgctcctctgtgcccat

SEQ ID NO: 8264 - DNA, 121 bp, Artificial Sequence
  Synthesized
  misc_feature (61): n=t or c
agatcacaacagtttcatagtgggagaaataagactgaacaattagaacacgtctgctttnaaaatgagtcagagatttcttaaatactaggcttatatctcagccttaggatagccagac

SEQ ID NO: 8265 - DNA, 121 bp, Artificial Sequence
  Synthesized
  misc_feature (61): n=t or g
cctttttccttcttccagtgcctgacttctatgtccatctgggtgaacaaggactcactcngagctgacctggtcacagatcatgcgtatacacacacataaactgcatatctctgcaatg

SEQ ID NO: 8266 - DNA, 121 bp, Artificial Sequence
  Synthesized
  misc_feature (61): n=t or c
cctttattgatttatttaattggatatatgtgtgctgcttcctgggacctgctgctgggtncaaccacttgtggattttcataactcttccccctatttatttaatactttacctgatgat

SEQ ID NO: 8267 - DNA, 121 bp, Artificial Sequence
  Synthesized
  misc_feature (61): n=t or c
ttgccttgctcctaccagaacgtggagcaaattattcccaccatcgtggatggaaacgccnatggtggttttgcaaccatttgcacgtgtttaactttacaccttcgaagttgccaactgc

SEQ ID NO: 8268 - DNA, 121 bp, Artificial Sequence
  Synthesized
  misc_feature (61): n=c or g
aactcacccacaaccaaccaacaccctgtagatacgtattgttttgtgctgccagaacaantggtaggaaggaaaaggtctcctagccagacctccagctcacaaaacttgctagagccat

SEQ ID NO: 8269 - DNA, 121 bp, Artificial Sequence
  Synthesized
  misc_feature (61): n=t or g
accaacaagtccatgtcttcttacacaggggttccagagttaaacatagtactataagtgngttctcacaattatgaagtagaagaggacaatcacctctctgtctactggccacactttg

SEQ ID NO: 8270 - DNA, 121 bp, Artificial Sequence
  Synthesized
  misc_feature (61): n=a or g
gggcctcattttgtattttacataggctgctcggttgttgttgtaataataaatgacatanagacaattttacattgttctgacaaaaaacgggactcctaaggggagccagcctcatgaa

SEQ ID NO: 8271 - DNA, 121 bp, Artificial Sequence
  Synthesized
  misc_feature (61): n=t or c
ggaaggcgtgaatatgatttggaagggtcacataaagatttccatgggcatttcaagtganatctaagtctccatagctcccatgggaacacacgttgacacttcatatttttgggctttt

SEQ ID NO: 8272 - DNA, 121 bp, Artificial Sequence
  Synthesized
  misc_feature (61): n=a or c
ggatgcaatgagactcatcaagatagaacaagtagtctagattttatactacatccaatgnagaggaacagagaaaggcttggagtcattgtcaggccaggagattatgaggaaaatctcc

SEQ ID NO: 8273 - DNA, 121 bp, Artificial Sequence
  Synthesized
  misc_feature (61): n=a or c
agttctcatgatggcaaattttgtgactatttcttttgtcatttcagttgagtggtttctncagttaaactggtgtcttgtctctgttcagtattgtcttaatttagacatttagtagaga

SEQ ID NO: 8274 - DNA, 121 bp, Artificial Sequence
  Synthesized
  misc_feature (61): n=t or c
tttctaaaccattgcctatctctgcatgggaacgctgtgctgtaatagccttaggactggntgaatatcacatgctctcggattgtgaattcccccttaatccaggagattcttacagtct

SEQ ID NO: 8275 - DNA, 121 bp, Artificial Sequence
  Synthesized
  misc_feature (61): n=a or g
aaagtatcaaagatagtataatatagtatcaaagatagataataactttctctgccttatncagtaaaacagaatctttaaacctgtgccttgtattctgttgaaaatcaatcttttagat

SEQ ID NO: 8276 - DNA, 121 bp, Artificial Sequence
  Synthesized
  misc_feature (61): n=a or c
tcaaatatggggtctggggatctctggctctgaagccacagtgttggcacagcagaactgncaccttcacccggcgttgctgggtctgagtgcggctgaacccgaggatgggtgggacaga

SEQ ID NO: 8277 - DNA, 121 bp, Artificial Sequence
  Synthesized
  misc_feature (61): n=t or c
cagctgagcctgactgctgctgccttctctttcacatttgcatcctcccatctgttcttgnttcatttccatcaccgcacacaaattattacactcctatctcagtcctcctccatctcct

SEQ ID NO: 8278 - DNA, 121 bp, Artificial Sequence
  Synthesized
  misc_feature (61): n=t or c
gcagcggcgatgctgccttgcaacagccccaagcgaccccaaaaaccactcagcaacacanagccccattccaggaacaacagcagcaaataagtaacagggagacagcactcagagccat

SEQ ID NO: 8279 - DNA, 121 bp, Artificial Sequence
  Synthesized
  misc_feature (61): n=a or g
tttggaaagtaggttacaacctgtaaagcaaaaatacctgagatggtatcatagtatatancttgagatggagatcatgggttatggtgcaggtgtcccatttccaggccattcacttggg

SEQ ID NO: 8280 - DNA, 121 bp, Artificial Sequence
  Synthesized
  misc_feature (61): n=c or g
aaaaaataagaataaaacagtgactgagtactaagtgactaagagaagagaagtatcttgnaacataaatcaaaaattctgacaaagttttatatcttctgagacagatccaggttattct

SEQ ID NO: 8281 - DNA, 121 bp, Artificial Sequence
  Synthesized
  misc_feature (61): n=t or c
tgagcaaacagtactagaagggtcatattgaagtaaaatgtctttaagcatcgtagatagntgaagttctaagcaagacttcaggtttggcttctggcattctgtcattgctaatgcagat

SEQ ID NO: 8282 - DNA, 121 bp, Artificial Sequence
  Synthesized
  misc_feature (61): n=a or g
gcataaatcttctctgtcaaaagcttagttgtgttaaaccagaagtcaccagacaaggggnagagagctgctgtatgcaaactgttgtgttgaatagttctttcttgtgcaatgtgtactg

SEQ ID NO: 8283 - DNA, 121 bp, Artificial Sequence
  Synthesized
  misc_feature (61): n=t or c
ctattactcagctatcatcttgtaagccacagagtgtttatctggaccctgctgcactcanggcccaaccaacatctctcagcaaagcttttgacactatagttgcagggttgtgactgaa

SEQ ID NO: 8284 - DNA, 121 bp, Artificial Sequence
  Synthesized
  misc_feature (61): n=t or c
tatctaaaaaattagtaactagcagctgtgacttaacccagcagggcgctgaacaatccanaagttcttcagtgtgcacacgactgtgtgatgagataaagacagtttaataagaaaagag

SEQ ID NO: 8285 - DNA, 121 bp, Artificial Sequence
  Synthesized
  misc_feature (61): n=a or g
aaaaaaatgcaaacatcaatgttcaggcactgtggatatgagatctccacattttgttgcnggataacataagcaatgctgtcacatatagaaatagaagtctacattaggaagaaaatag

SEQ ID NO: 8286 - DNA, 121 bp, Artificial Sequence
  Synthesized
  misc_feature (61): n=a or g
actgtgactaatggccttgggcctcaactgtgcaaagccacatactgcgcaaacacagccnaatctgtccagataagcagtggaggaatccaacagttaggactgaaccagttctattcta

SEQ ID NO: 8287 - DNA, 121 bp, Artificial Sequence
  Synthesized
  misc_feature (61): n=a or g
cacaactagatatcaggctgcagctgtctgctctgcatagaaagtcaggccaagcattgtntgtggtttaaatccctctcccactgtcagaaacaagactgaagtggtagaaaggtgtttg

SEQ ID NO: 8288 - DNA, 121 bp, Artificial Sequence
  Synthesized
  misc_feature (61): n=t or c
aatatggtggtgaggagctatggggagtaatgagaatgtttttaactgccaatggtcatgnacagtcctcctagctaaccctagctcctgagcagtacctctgaagttgggctgcacagcc

SEQ ID NO: 8289 - DNA, 121 bp, Artificial Sequence
  Synthesized
  misc_feature (61): n=a or t
gttgggtgcctagtgctcataaaaagtaacaacaaccagtacactgtaagcatgagctacngtttggtgtggcttagctcccttgtataagagatataaacaagccctacctgatgttatg

SEQ ID NO: 8290 - DNA, 121 bp, Artificial Sequence
  Synthesized
  misc_feature (61): n=a or g
gtataactgaaaaaaaatcacatttaatttcctgttataagaatatattaacatttggaanaagcgtagggtatgcatgacttaatgacagatagctaatggataatggccgcgtatgtga

SEQ ID NO: 8291 - DNA, 121 bp, Artificial Sequence
  Synthesized
  misc_feature (61): n=c or g
gtgcaggcgcagcaggatgcaagcccagctctgtgctggagccaccagttccagatgacantgctcccattgcccttctcttagtgctgtgttttgctgctgctactggcctggggcactg

SEQ ID NO: 8292 - DNA, 121 bp, Artificial Sequence
  Synthesized
  misc_feature (61): n=a or t
gcaatcccagctgcacaaatacattttaggtgggacactcttcatcttccaagttttcccnttttaaatgtcagtgcttaatataagcccaggatacaactgatctgagttgtaaattcac

SEQ ID NO: 8293 - DNA, 121 bp, Artificial Sequence
  Synthesized
  misc_feature (61): n=t or g
agtgcagacccttgcccctgggggaatggcatgtaagtgagaatgccacaagagatggganccccatgtatcagcctcacacagcctgggcagaggaacgcagggcaggagagcagaagcg

SEQ ID NO: 8294 - DNA, 121 bp, Artificial Sequence
  Synthesized
  misc_feature (61): n=t or g
aaggtgcaaggatcacctgaactctaccagagcaagagaaacctgaaattgcacaggactnctagcaaatcaagctcattgtttgttgcttgcaaacagcagaattcagagcattcatgtt

SEQ ID NO: 8295 - DNA, 121 bp, Artificial Sequence
  Synthesized
  misc_feature (61): n=t or c
ttatttacagactggtaccacaatatctctgaagcaaaaggcacaagcccacaataccttngtgatattgtatactaggtcctacccatgtagtgaaagcaatgtccagagcagtatttta

SEQ ID NO: 8296 - DNA, 121 bp, Artificial Sequence
  Synthesized
  misc_feature (61): n=t or c
agtatggttctaatggttgcatcaatgaaagacttaagagaattcggatttgaaactgagntgtgaataaacaagggtggagatcttaaaatcttaagcaaacagtagtctaaagaaaccc

SEQ ID NO: 8297 - DNA, 121 bp, Artificial Sequence
  Synthesized
  misc_feature (61): n=a or g
ttgaactcacttcagcctgaagcagaaacccatgatgggaaacttcatcctaataattaanctgaagcatggtctttataaacagagctctggacactgtggtcacctctgccttatagat

SEQ ID NO: 8298 - DNA, 121 bp, Artificial Sequence
  Synthesized
  misc_feature (61): n=t or c
tatctcaaaggattgcatttgactcaccaaggtataatcttcaatttgttctacgttgagnttttgggcaataaaacaacttcattattgaaaataaaaattattatgtagtatattagag

SEQ ID NO: 8299 - DNA, 121 bp, Artificial Sequence
  Synthesized
  misc_feature (61): n=t or c
tgtaagaaataagatgctgatggatgatgccatgctgtctagactagaataaaaaatgcanggtaaaaaacttagctaacttgtttaaataaaatattttaaaattccaagaaatcacaag

SEQ ID NO: 8300 - DNA, 121 bp, Artificial Sequence
  Synthesized
  misc_feature (61): n=a or g
ggtttatatgtgtattttaacctaaagttatgattgtttctgtataagaagcacttgaacncttaattactgcggatattctttagggcttgtaaagaacaatgtgtactcctttttgaaa

SEQ ID NO: 8301 - DNA, 121 bp, Artificial Sequence
  Synthesized
  misc_feature (61): n=a or t
gaatttctctccctcttgtttccaagctactgacagatatttgttgaggaatgctctggtngttcattctgaatgctctagtctcaagcctgatgagcaaggtagtgaacctgcacagaca

SEQ ID NO: 8302 - DNA, 121 bp, Artificial Sequence
  Synthesized
  misc_feature (61): n=t or g
tttcgatgcctaggacctgatatcgccatgcctacgcttacagatcaggtggacgaaagtntaaggctctgggctgaactagatgtaccgcatcaccttattcacctttaaactctacaat

SEQ ID NO: 8303 - DNA, 121 bp, Artificial Sequence
  Synthesized
  misc_feature (61): n=a or g
tcttgactttatttagccagatttgatcattagttgaaattcccagaaatgtcaataagtnactaagagctgtgtgggcaagtggagcaccacggctctggtggacaaaacatgcgtggtc

SEQ ID NO: 8304 - DNA, 121 bp, Artificial Sequence
  Synthesized
  misc_feature (61): n=a or g
atcatcaatgccagcaaagttcacctctatcactgcagctggggcttgctcagtcatgtantgtatggcatcctggtcacccagccagtcagatcctttcactgtgtcatagaaatgccac

SEQ ID NO: 8305 - DNA, 121 bp, Artificial Sequence
  Synthesized
  misc_feature (61): n=t or g
taaacccactttgctgtaagagaaagatacataattatgtggctgcttgtccaaattgttntcataaattacatgtctttacttctagctcttataagtgaatgctacttttcagttattg

SEQ ID NO: 8306 - DNA, 121 bp, Artificial Sequence
  Synthesized
  misc_feature (61): n=t or g
taaatggagtttaatctcactttactatagtcatctgaaaatcagttttctattacaaatngatcaatttgtcatgccaaatctaatggcaccaacaggtgcagaaaaggacaactaattc

SEQ ID NO: 8307 - DNA, 121 bp, Artificial Sequence
  Synthesized
  misc_feature (61): n=c or g
ttttatttaaatttactgtaaaaattgccacagaaagcagtagtggatcttgctataaganacagaattttaataaaggtctttaaaagtattattacatttctaatagtatatattcttc

SEQ ID NO: 8308 - DNA, 121 bp, Artificial Sequence
  Synthesized
  misc_feature (61): n=a or g
cgtgtcggggtttttggagcacgtcttctcctcctccttcccaaactacatcctcatgctncacgaggaagggaggacagatctcgagagacgaggtgagcgatccttggccctgggatag

SEQ ID NO: 8309 - DNA, 121 bp, Artificial Sequence
  Synthesized
  misc_feature (61): n=a or c
tttttcactgcgatatattggtatagctgagcacaaaatgtacgatcagtagcaagagaanggttaaagacttcagaaatgaatgaccagggaagtaataaattcctgaaagaaaaatagg

SEQ ID NO: 8310 - DNA, 121 bp, Artificial Sequence
  Synthesized
  misc_feature (61): n=t or g
tttcctctgtctggagaggtagagcaatacttgttcaacgatacttaaacccaagtgttcngttcagatgtagaaaggatctgtggttagtccagccctccttcacctacactacagaatg

SEQ ID NO: 8311 - DNA, 121 bp, Artificial Sequence
  Synthesized
  misc_feature (61): n=a or t
aacaacgtgctccaagcctgtaaaagcaagaattacaaacatctatatttataatagcctnttataaacagaagtattttcttcaaagatgctcactaaaagccaaaattaataaagaaaa

SEQ ID NO: 8312 - DNA, 121 bp, Artificial Sequence
  Synthesized
  misc_feature (61): n=t or g
tgggggacaccactcatctctggtctccacctcatatctattgctcaggggcactatgggngtaggagaaagatttctccatctgctcttagcagagatgaggatccagtctccctcacct

SEQ ID NO: 8313 - DNA, 121 bp, Artificial Sequence
  Synthesized
  misc_feature (61): n=t or c
aacaggaaatactgggattccaattcaagctgcacaaccagagcactgggttacagttctntgtcagtgaccagctgcaagagtgttaatgcagacactgaatttgtcacagtttcaaaga

SEQ ID NO: 8314 - DNA, 121 bp, Artificial Sequence
  Synthesized
  misc_feature (61): n=a or c
aagaaaagtaaaagcttttctatattttttgaataattttctgtctttacagtgaaataantctttttatacggatcatattatttcacaaacccgaggccattttttttttactactttg

SEQ ID NO: 8315 - DNA, 121 bp, Artificial Sequence
  Synthesized
  misc_feature (61): n=t or c
ttggaaaagactcagcatgaaaatggtaaatgctagtccctgaaaaactcccaggaagaanagattggaaaaagtagcagcaaactgagaaaaaaatcacaataaacagaaattctttaga

SEQ ID NO: 8316 - DNA, 121 bp, Artificial Sequence
  Synthesized
  misc_feature (61): n=t or g
atctagaagccagctgctggacacttgcctctggtagacttcaggtgccacaggagggctntgcaaggtcctccagagatcttagacctgtgtacaatgatatctagatagcaagtgaaaa

SEQ ID NO: 8317 - DNA, 121 bp, Artificial Sequence
  Synthesized
  misc_feature (61): n=a or g
tttttctccccccttttcctggggacatcagaatatgaacctatttttttgtttatgcganagttcatccacctttcattttctactctgctgctgatgtgtgagaatcagtatttggacc

SEQ ID NO: 8318 - DNA, 121 bp, Artificial Sequence
  Synthesized
  misc_feature (61): n=a or g
actgtgaatcaggttcactccacaatgttcagacccattagatttggagacagaaacaccncatcatactgtcatccagactgacttcattctgcattatctgaccagaccaaaggatatt

SEQ ID NO: 8319 - DNA, 121 bp, Artificial Sequence
  Synthesized
  misc_feature (61): n=a or g
gctaaaatctccttacatatcgtccacgtcattaagctgttaccctgcgtcttgactaccnagtgcttcccctccacccttaacacaaggcttcctcacatgcctcagagttgtgagaaca

SEQ ID NO: 8320 - DNA, 121 bp, Artificial Sequence
  Synthesized
  misc_feature (61): n=t or c
gatggaagtttggagccattcttttaaggcaagagaattaagagcctggcctgtgaggtgnatggcagcttcaggtcttgagaggaaagagagctcttaaattcactggagtggagcgtat

SEQ ID NO: 8321 - DNA, 121 bp, Artificial Sequence
  Synthesized
  misc_feature (61): n=t or c
tgcctgtttcaatattttagatgtgtggctttctcacaccaccctcttagtcctcagaacngataactgctttttgtgaagtgttttattcagcacacaagaagtgactttattttgctat

SEQ ID NO: 8322 - DNA, 121 bp, Artificial Sequence
  Synthesized
  misc_feature (61): n=t or c
agataattgtccagtgcatctctttgttctgtgttcttatctgttttatctatttttagcngtgtgttgttgaagcaagcatgtgaaatagcaacccaaacagctaacttcagtgtgtttc

SEQ ID NO: 8323 - DNA, 121 bp, Artificial Sequence
  Synthesized
  misc_feature (61): n=a or c
tcttagaaagtatgtcctagcagcacttgataatatactccacatttgctttcttccctgnagaattaacgtgtacataatttgcttgtatcttactgtacacattctgctgcttgctgtt

SEQ ID NO: 8324 - DNA, 121 bp, Artificial Sequence
  Synthesized
  misc_feature (61): n=t or c
aataactcaccaggaaattttaaagttttctgctgaattccaagtcatttgagaaaaggantcaacaaaattgttgagttctgcaacaatttctgccagtggtagaaatattgttaaaaaa

SEQ ID NO: 8325 - DNA, 121 bp, Artificial Sequence
  Synthesized
  misc_feature (61): n=t or g
catgtagctcctaaatattttgtgtcattattcaatgtacgactaatgggtactgaaacancaaataaatgcaaagctatgacaaagtaaagcaaggatattgtacaggtgcaacaaaaaa

SEQ ID NO: 8326 - DNA, 121 bp, Artificial Sequence
  Synthesized
  misc_feature (61): n=t or c
attgtcaatgatggtggtttcatttgtacctggcaatacactgtgcatggcttttccttcncaacacagcacaattgcttatgtttttgacacttttggaatatgtggtatttgagtttgc

SEQ ID NO: 8327 - DNA, 121 bp, Artificial Sequence
  Synthesized
  misc_feature (61): n=a or t
tctaatttctcacttaaaatatttagtcacaattccaataggcacagagactctttcttgntgttgtattctgaattctgagggaaaacatcaaaagtgatacaacatttatgataaaata

SEQ ID NO: 8328 - DNA, 121 bp, Artificial Sequence
  Synthesized
  misc_feature (61): n=a or g
aatatcaatggcaaactctgcctttcttggcttatctgaacctagctagaaagtagagaancaactcagtggaaaatatgatgatctatacgattctggaagatgtcagtttaaaaactac

SEQ ID NO: 8329 - DNA, 121 bp, Artificial Sequence
  Synthesized
  misc_feature (61): n=a or g
aggctgtaagagctcagggcagcagctacgtgatgccatctcagctcaatatctccttccntccccatgcatatgtccctgaggctttccagcctgaaccacaacacacaactctacctca

SEQ ID NO: 8330 - DNA, 121 bp, Artificial Sequence
  Synthesized
  misc_feature (61): n=a or g
gtacctattgagcatctactccccaggccacaactttctgagcctcagcatctctctctcntgttccaaaacaatcttattgctttcaggtcttttcctccctttgatctctccttctcta

SEQ ID NO: 8331 - DNA, 121 bp, Artificial Sequence
  Synthesized
  misc_feature (61): n=t or c
accaattggaattgctttacataaacaagtatcaatctggcagaaatattttggaccttcngtgttcagggagaagcaaaaacagaagctgcggtacacagccaaccacaacatgagacag

SEQ ID NO: 8332 - DNA, 121 bp, Artificial Sequence
  Synthesized
  misc_feature (61): n=a or g
tagtttcttgaaatatgctgtaaacctcaattgtttgtagttgaatgagtggttcacaagnagtcccgccaattgaagtatcaattactaaaagaaagaaatagtccaatttcttaaggca

SEQ ID NO: 8333 - DNA, 121 bp, Artificial Sequence
  Synthesized
  misc_feature (61): n=t or c
ctccttctctccctccttcctctgggtgcagaccatcagcaacgtgctgctgcagtacgcngagatcatctccaaggatttcgcctcatactgctccaaggagaaggagaaagtggtgacg

SEQ ID NO: 8334 - DNA, 121 bp, Artificial Sequence
  Synthesized
  misc_feature (61): n=t or c
ttatgtgaggacagcgcaggggcagagcgccgacagccagcttctgagctgccatttgagntaattctgtgcaatctgctgtgtgcagtggtcccgggcagagcaggcagtctataagaaa

SEQ ID NO: 8335 - DNA, 121 bp, Artificial Sequence
  Synthesized
  misc_feature (61): n=t or g
tgctcgcctcgggtcatcctacagtgagggtgtagggctgtcagtcctgatggtcattcancaacacgttctcataagatggagctctgtatgtgggcagggctgctctcactgctgtcca

SEQ ID NO: 8336 - DNA, 121 bp, Artificial Sequence
  Synthesized
  misc_feature (61): n=a or g
tatttaggacacaatgaaggcattggataaggttgtcattcattaagctttaggagctcangaaaattttgacttttagagaactagttagctttttcatgtcagttaacaggaaagttgg

SEQ ID NO: 8337 - DNA, 121 bp, Artificial Sequence
  Synthesized
  misc_feature (61): n=t or c
cgatattctcaggagtcacaggccttaacatgcacctaatatctcataggaacaagtatcngtgaaagtgcattccatgaaatcagagagttcattctggaatacaatgccaaaatctatt

SEQ ID NO: 8338 - DNA, 121 bp, Artificial Sequence
  Synthesized
  misc_feature (61): n=t or c
aatattaagcagcagaagaaaaggaaagatttaggagaagaattgtgtcatgaattctcantagctcatgagcgtatttctagaatgacagtcctatcttatattcagtacatatttttcc

SEQ ID NO: 8339 - DNA, 121 bp, Artificial Sequence
  Synthesized
  misc_feature (61): n=a or t
caagactcaactataagaggtttgattaaaaaccacatgagtagatgactatgtaggaacngttaaacctttacttcagcactcaaatattgacagctatatcacataaatcactctttta

SEQ ID NO: 8340 - DNA, 121 bp, Artificial Sequence
  Synthesized
  misc_feature (61): n=t or g
gaatgttgtgagagtgataacttgtttctataagacgtggaaaggattttgttttgggaantttattggatgtctccttgccacaagccagatagtcctaatggccatgcattttcttgat

SEQ ID NO: 8341 - DNA, 121 bp, Artificial Sequence
  Synthesized
  misc_feature (61): n=t or c
agccctcccacttcctcagggtgagcaactcggcatacaggataaactcctctgcaaaccngacattaccttgtgaaaatgaatcatttctcaccatcagcaggctcccctggtagctgat

SEQ ID NO: 8342 - DNA, 121 bp, Artificial Sequence
  Synthesized
  misc_feature (61): n=t or c
tgcagaagtcttgtgagagatgaaaatcctatatttcaggcaacaaagatggaagaacaantgaagactaggctttcaagctacattcccatcagtaatctcaacggctgtatgaatccat

SEQ ID NO: 8343 - DNA, 121 bp, Artificial Sequence
  Synthesized
  misc_feature (61): n=a or g
ccaaacgaagccaaagggaaagcaaacctgaggtcctctcctcagcgttcagagctggagnaatgttaattgcctgtggagtcacccaggggctacgttaattatatgataagataattca

SEQ ID NO: 8344 - DNA, 121 bp, Artificial Sequence
  Synthesized
  misc_feature (61): n=a or g
taaagctcaaatttaagaaataaaacataaaaatcaagctactccaggttatgctggtcantaagtacagttcccagctttctggaataaaattccctatcattgaggaaacaatatttaa

SEQ ID NO: 8345 - DNA, 121 bp, Artificial Sequence
  Synthesized
  misc_feature (61): n=a or g
ctgagccagccagggtgcatctgcattatgagacagtctgcagcactaatgcaccctttgnttcatatgtataagtgaagattattggtatttctaaaatttaaacattgttacccagcag

SEQ ID NO: 8346 - DNA, 121 bp, Artificial Sequence
  Synthesized
  misc_feature (61): n=a or g
gacaacaaaatgatgttgtgagggccggaacaaagatgggtggctcaatgggaggacccantgcccaactctttggtgctgagcttcagtgggagcccagcctctacaaaataaagttgag

SEQ ID NO: 8347 - DNA, 121 bp, Artificial Sequence
  Synthesized
  misc_feature (61): n=t or c
catcactacttggaaatagagtgaatctcattcagtacaaatgcacttgttattgcacttngtagcactggaaaaggaggaataagagattcctattaaagagcatacagacaacccacag

SEQ ID NO: 8348 - DNA, 121 bp, Artificial Sequence
  Synthesized
  misc_feature (61): n=t or c
tgattagacctaacagctgaatgcaatgacgtatcttctaagaggtcaatgacaggccttntgaagattcactttttttcagaatgcataaatacttgacatttctatgtatcacatacag

SEQ ID NO: 8349 - DNA, 121 bp, Artificial Sequence
  Synthesized
  misc_feature (61): n=t or c
cccacattggagcaggggaccaaatcaaacgcctgcagtcatcctaaatccataccagggntcccaaaggagctcaggttcagccataagtgctcatgcctaaacacgcctaagaattcat

SEQ ID NO: 8350 - DNA, 121 bp, Artificial Sequence
  Synthesized
  misc_feature (61): n=t or c
ttctgctgcttgtctttaaagaaaagttacccagtcattgtatctcctaacttcatttaanatcacctatcttgctaccatcaattgcctgaggcttctttacactgtctttggctgactt

SEQ ID NO: 8351 - DNA, 121 bp, Artificial Sequence
  Synthesized
  misc_feature (61): n=t or g
cctagacccagtattgatgctgaagtacaccggaagtacactactggaacccaactggacntcatgtccagggcccaacaatttggctccttcccattctctccattgtctgcttatttag

SEQ ID NO: 8352 - DNA, 121 bp, Artificial Sequence
  Synthesized
  misc_feature (61): n=t or c
taattgtctgagaaacacagacacatgaaaaactgagacaatccttgatatgtttgagtanagtgttaattcatcatggctttttagctaaattcaaatacactgtctgtttaaaatccaa

SEQ ID NO: 8353 - DNA, 121 bp, Artificial Sequence
  Synthesized
  misc_feature (61): n=c or g
aaactagacctcagccctcagccagtgcagaaatcagctttgagacaaaactgtatccgtnacagaaagtgttacagcactgagtagaaaaatattctgctagattttggtctgttataag

SEQ ID NO: 8354 - DNA, 121 bp, Artificial Sequence
  Synthesized
  misc_feature (61): n=a or g
caaagactttcttctgtttcacaccatgaagcattagccacgttcaaaccttgcttatgcnttctcccactcatttttctttttgccacacagggtccactacctaatacgtgttgtcatt

SEQ ID NO: 8355 - DNA, 121 bp, Artificial Sequence
  Synthesized
  misc_feature (61): n=t or c
tcgtgcacaagaagccaatatagcaaagaccataaaaaagaaaaccacatttacataacangttatcttcctcttaaggactcaagcagtaaaaggaagatttaaagcattctccgataaa

SEQ ID NO: 8356 - DNA, 121 bp, Artificial Sequence
  Synthesized
  misc_feature (61): n=t or c
aaaaaatgaaagcaggtcagcttatgtagaataagaaacagagctgtaatgcacaaaggtntggcctccctgctcaaagcctcttagaggacagaagacgctgttcacagagcagcacaaa

SEQ ID NO: 8357 - DNA, 121 bp, Artificial Sequence
  Synthesized
  misc_feature (61): n=a or g
gagatgttcaaactgcaaacactatgaaaacagcacgaaagactatggcagagttccacanagacctacccacacactcattctcaggaaagaaagtgaacaaaagctgtggaaacaatgc

SEQ ID NO: 8358 - DNA, 121 bp, Artificial Sequence
  Synthesized
  misc_feature (61): n=t or c
gctggagggaatccgcatctgccgcaagggtttccccaaccgcatcctctatggggacttncgccaacggtgggaacagcacgacagagttgttgggaatgtggggatgggctttgagctc

SEQ ID NO: 8359 - DNA, 121 bp, Artificial Sequence
  Synthesized
  misc_feature (61): n=a or g
acaacaaagtcttgcaacatccagtatatgctgcacgtgaccagtgaaaaagactttttgnccagacatgattgagatatccaaagtgggacgagattctgcaaggtgccgaagtccatag

SEQ ID NO: 8360 - DNA, 121 bp, Artificial Sequence
  Synthesized
  misc_feature (61): n=a or t
atcttgaaatcacgtaaaaggagtaaatagcttccatcatcaatgtgattttcccagtttntcaaatgcatccatacttcatgagcaaattcttattttgggacacaaatgaaggtctaga

SEQ ID NO: 8361 - DNA, 121 bp, Artificial Sequence
  Synthesized
  misc_feature (61): n=t or c
agatccctgtcaaattgtaattcatcctgtttttaatcactttgctcacaaatcttcttgnggacactgacacatgctgagcatcccaagcacctggcagacactggactgtactccacca

SEQ ID NO: 8362 - DNA, 121 bp, Artificial Sequence
  Synthesized
  misc_feature (61): n=t or g
gatttcttctttatatgcgtaattaacaacacagtgagcaagtcttgcaacctaatactgngtataatactgtgtatagtattaataagcaatcagcagtagtcgttggataataacattg

SEQ ID NO: 8363 - DNA, 121 bp, Artificial Sequence
  Synthesized
  misc_feature (61): n=a or g
tcaaagttctacatcagttctgtataattactgtattactataatttctgtacattagttncacagtggtcctctctacagaattcatcaatattgactattacactgggttggtgaaaat

SEQ ID NO: 8364 - DNA, 121 bp, Artificial Sequence
  Synthesized
  misc_feature (61): n=t or c
cctgcaacatctaacaaactcttctacttcctgaagctcttgagcaatgctgacagtcacngctgaggatctgagctgaagaggttactgtccttcccagagtacagtttaaccagtgacc

SEQ ID NO: 8365 - DNA, 121 bp, Artificial Sequence
  Synthesized
  misc_feature (61): n=t or c
ggctacatgatttctgtgtgcactggtacggcagcttcacaacatgtcaaagccctgatantgtgtttccacagaataaccttaggattaatctctggttgctacacagttctccagaatc

SEQ ID NO: 8366 - DNA, 121 bp, Artificial Sequence
  Synthesized
  misc_feature (61): n=a or c
tcttttgctattctggtagcactggagtttgtccgtctgtctgacttggttaaaggagcantgagacataatgctctggggcagaaatttcttccctcctctctctcgtgcctacagcctg

SEQ ID NO: 8367 - DNA, 121 bp, Artificial Sequence
  Synthesized
  misc_feature (61): n=a or g
cgcataaggaattgcatgctccaaggtgagcgctgcgccagggattgcacactgatatgcncattgcataaggaactgcattctctgaagtgcattgatttgaagcagcagtagcattctg

SEQ ID NO: 8368 - DNA, 121 bp, Artificial Sequence
  Synthesized
  misc_feature (61): n=t or c
aaactcatttgggtgaagcccagtgaaagaaatctagtgtgggcaagtggaggagctgggnactctgttctatcctcactgccaccaccatcccgccataccagagcacagggagggatga

SEQ ID NO: 8369 - DNA, 121 bp, Artificial Sequence
  Synthesized
  misc_feature (61): n=t or c
atattcaataatttttcatgaacaccagcaacacttcctgagtcttccaaatcaagaattnatcctaagtgttttgtttgctcatatatagcctcctctctaagtgtttgagagatgtaag

SEQ ID NO: 8370 - DNA, 121 bp, Artificial Sequence
  Synthesized
  misc_feature (61): n=c or g
actgtggtgtcataggtaaggcaataccagcatcttgagttgttactggaccttacttggngaacagcaccattcttttgtacagaagaatagagaagagggagaaaggaactgctacatt

SEQ ID NO: 8371 - DNA, 121 bp, Artificial Sequence
  Synthesized
  misc_feature (61): n=a or g
caaagcccaaagggtgtgggataaagcagggatgctccctggttctctctgctcgctgtancagagcagatgagcagtgggatttcagctctgtgtccccaacccacaatggcaccagagg

SEQ ID NO: 8372 - DNA, 121 bp, Artificial Sequence
  Synthesized
  misc_feature (61): n=t or c
tttggaagagtatgtatttaaggaactgtgaggttcctctacagtggctactgtgttgtangtgtagcaactgccttcctgtcatgaatgctaaatgtattttctgttctaatgatgtgtt

SEQ ID NO: 8373 - DNA, 121 bp, Artificial Sequence
  Synthesized
  misc_feature (61): n=a or t
gctgcatgggtctgtgtgctcatgttcccagtgctacacatattttttagcatacatgtcngtgaatatgatgtgatatctgtattataaaaagcctgcccctagcacgtaggactgcaaa

SEQ ID NO: 8374 - DNA, 121 bp, Artificial Sequence
  Synthesized
  misc_feature (61): n=t or c
gtagacacttctcaggaatttggcagtggcattctccaaagactctgcctctatcaacagnctgcagtatatgggcaaactttgcccttctattgttgctcccaaatgtcctggctgcgca

SEQ ID NO: 8375 - DNA, 121 bp, Artificial Sequence
  Synthesized
  misc_feature (61): n=a or g
acacacagattaagtacataacagctttactgtctgacttgcactcttcaaatgatccccngtgcccacaaatgaggatccctaacaaaaagcattggtttgagttcgcagatttcccagc

SEQ ID NO: 8376 - DNA, 121 bp, Artificial Sequence
  Synthesized
  misc_feature (61): n=t or c
aatatgcaatgagaggtgggattcttggacatggtgtatgttaactatgaagaatcagagngtgattgagttgtgtgagggttgagtaaatttccttctaaatacctggattttatattga

SEQ ID NO: 8377 - DNA, 121 bp, Artificial Sequence
  Synthesized
  misc_feature (61): n=t or c
attgttcactccaattaaacacaactgtggacaaattcatcttagcccccttgagcttttnctcctgactctcactctcagcagtcaggtgctacactggtacaaatagctgacaaatgtt

SEQ ID NO: 8378 - DNA, 121 bp, Artificial Sequence
  Synthesized
  misc_feature (61): n=a or c
aaatctttgtagcaaaataaaaaatatttcagaaaagcgtaatattccacttggtaacatnatttctcccattacttaaaaaccgagctttgtgacagattatttctcatgtaaatagctc

SEQ ID NO: 8379 - DNA, 121 bp, Artificial Sequence
  Synthesized
  misc_feature (61): n=a or c
gctccccactgccttgaccccaaggagcagggctggagcagcgccctaatcccgacacagnggcgttgttgtgtgcaccgggtgtatttttatcctcttagcactgcctgttgagctgtga

SEQ ID NO: 8380 - DNA, 121 bp, Artificial Sequence
  Synthesized
  misc_feature (61): n=t or c
agggaactgtaggagttggccatgaatacacaattatatgatttcagtggcagcaatatangctctaacagtaagaaggcaccatgagacttcagaagctatcctatccgtaaagaaaatc

SEQ ID NO: 8381 - DNA, 121 bp, Artificial Sequence
  Synthesized
  misc_feature (61): n=t or c
aaagagaaatccagtgaataaactagaagtatatgtaggaggaaactgacaatatatatgngtataagaggaaaagataactttaatgactactgtaatagagaggaaatatggtgaaagg

SEQ ID NO: 8382 - DNA, 121 bp, Artificial Sequence
  Synthesized
  misc_feature (61): n=t or c
catgaactggacttttacacatttatgattgtgtagtacatccttaccattcatttttcanagagtgggacttttcaaccaaatttgtttgttctgatttggaaggaagatgaatgcttaa

SEQ ID NO: 8383 - DNA, 121 bp, Artificial Sequence
  Synthesized
  misc_feature (61): n=t or c
ttttaccacgagtgtggtcaaacacctgaacaggcttttttgcaggcagttgatgtcccanactgtcagtattcaagagacacttagacaagtatcttagtaataagctataacttaaagt

SEQ ID NO: 8384 - DNA, 121 bp, Artificial Sequence
  Synthesized
  misc_feature (61): n=a or g
ctgacgttatgatccaacgtagtaaaataagagcagccctcataacatagtaaaaacatcntaaaaaacatataatactaaccaagtctagagtgaagaaatgagcagaaatcatgtttta

SEQ ID NO: 8385 - DNA, 121 bp, Artificial Sequence
  Synthesized
  misc_feature (61): n=a or g
gcaggaaaagatccactgcaggagcaaagagatgaatgaatacagaaaccacattaatccnatgatggcaaattggcatggacaggccacagctacctgtcttttgcatatggcagtgaaa

SEQ ID NO: 8386 - DNA, 121 bp, Artificial Sequence
  Synthesized
  misc_feature (61): n=a or c
ctaaagctagcacaaagaagggaacaggaaagtatgacccggagtaaggaaagctggaacnacagtgaccagcagttggatcgttttggccttcttgagatgcacctctctctgcacagac

SEQ ID NO: 8387 - DNA, 121 bp, Artificial Sequence
  Synthesized
  misc_feature (61): n=t or c
tctactggtggtctgcttaaaaacaattcgtagtctagcatatgccggagttggtttctancaggttatataactggtagacttatcaatgacagataaatgttagattctaatctatatt

SEQ ID NO: 8388 - DNA, 121 bp, Artificial Sequence
  Synthesized
  misc_feature (61): n=t or c
tctgtatctctttataataaaaaaggaatcatccttctgaagagtcagctatgttcttccnctataggaaattcaggggctaaatcagctaataactcagattttgtcacccatctccaga

SEQ ID NO: 8389 - DNA, 121 bp, Artificial Sequence
  Synthesized
  misc_feature (61): n=t or c
gtgtattgagaggcaataggtaacggaatatttttctaattcattcataagcagtctcttncttcttgacttaacacccacaggatggcctctgcttggcgaaaaggtgcttacccagaca

SEQ ID NO: 8390 - DNA, 121 bp, Artificial Sequence
  Synthesized
  misc_feature (61): n=a or t
ttcaccatttgtgcagaaagatttccactctgcaaaggaacagtgctgctgttgcccttcnggtagagcatgtgtgctcagatgacagtcatgtgcatcccaatctcagtcataagaaatg

SEQ ID NO: 8391 - DNA, 121 bp, Artificial Sequence
  Synthesized
  misc_feature (61): n=a or g
ttgaattgggttaagtctttgcaggaagaaaggaaagcttgctgaggagaaggataagatnccaagggaaaagcaatgtttacagagatatctgcagttagggcagttagggtctcttcag

SEQ ID NO: 8392 - DNA, 121 bp, Artificial Sequence
  Synthesized
  misc_feature (61): n=a or g
tccatgttcatttaataataaatggaaagataacactgtagtgttcacggttcaggtggantacaaaaaatacagttgaagaagtgcattttttttgcttaagtaaattgctttaatcttg

SEQ ID NO: 8393 - DNA, 121 bp, Artificial Sequence
  Synthesized
  misc_feature (61): n=t or g
gtgcagctcctctggtaatttagttttggcaacacgagagggaaaatcttcccaagcatcncaaaccagaaaaaattccctgttttaggtgagtgtcatttagtcagttttggtctccatg

SEQ ID NO: 8394 - DNA, 121 bp, Artificial Sequence
  Synthesized
  misc_feature (61): n=a or t
agacatcatttaaatgtggcttaaaccaccacatttgtatgtagaagttaaaatgtgttcncttcagcaggaggaatcacttcggatatgagcaagataaaaatatttgatctttactaag

SEQ ID NO: 8395 - DNA, 121 bp, Artificial Sequence
  Synthesized
  misc_feature (61): n=t or c
gaatcacatctgctctcttgcaaaaccattgcatacttcaaccttttaagaaacctacttntacaaaatactggtgcctgttttaatgggcctacagtcattcatgctaaaagctttaaca

SEQ ID NO: 8396 - DNA, 121 bp, Artificial Sequence
  Synthesized
  misc_feature (61): n=a or g
gttactgaccctgtgaaaatgatgttcgaaagccaggaaggactaatgctgagcagatacnacgtgatttgtgcagagtacccatgtactagccttgtgtggcacactgtgtgctctgggt

SEQ ID NO: 8397 - DNA, 121 bp, Artificial Sequence
  Synthesized
  misc_feature (61): n=a or g
ctgtaaacacaagccaatttcagagactgaactctgtgctccagttcacattaagaatctnggaggggagcagactgattgctttctgatgtgctcatccatcaaccatcttccctgctgg

SEQ ID NO: 8398 - DNA, 121 bp, Artificial Sequence
  Synthesized
  misc_feature (61): n=t or c
caaggacatttagcacaaccaataaatcactatccatacattcctcagcaatagctgtgcncataaatccacagcaattatttttactcccccacacatgtacagtcacactagagttcaa

SEQ ID NO: 8399 - DNA, 121 bp, Artificial Sequence
  Synthesized
  misc_feature (61): n=c or g
ttctattgtgattttgtggagacggaagcaaatgtctcagtagcactaaagaagcacagancaaaatgctgtgcaggagaccttttgctgacctcagacctacttttgatcagcaagtata

SEQ ID NO: 8400 - DNA, 121 bp, Artificial Sequence
  Synthesized
  misc_feature (61): n=a or t
ttcaataggaaccttttgatttgcagaataactcatgcagtggcaaaaagataccaagtcnaggttgttactgataggagaaaagcaaaatttaaggctccagctcaaatgaaaaaagtga

SEQ ID NO: 8401 - DNA, 121 bp, Artificial Sequence
  Synthesized
  misc_feature (61): n=a or g
tcaaatctgcctcttcttattttactgttacatttatctacatcccaacagaattttgaangaacttgtgcttttagtcctctctggtctgacaaaatgaagattattggtaggaatcttt

SEQ ID NO: 8402 - DNA, 121 bp, Artificial Sequence
  Synthesized
  misc_feature (61): n=t or c
aataagttgcactagaagatttatcatgggaatattctaggtgagaaacctttatggtttngtggtatggctacagtaagttgtgcaaaggatcatacagtgtcatacctcttgtagcaag

SEQ ID NO: 8403 - DNA, 121 bp, Artificial Sequence
  Synthesized
  misc_feature (61): n=a or g
ctgtcaggaagccattggatattgcagatgtccataaaaactaaattctcagcataaaaancacaacagtgttgatcaaagctagagaggttaatgcaaggaaaagctaacacaatagcat

SEQ ID NO: 8404 - DNA, 121 bp, Artificial Sequence
  Synthesized
  misc_feature (61): n=a or g
cctattgcttagtcaaagttcctctttatcagactgagggcatgaagcaaaagagacaatngcaaagacattctccccacagctgcatgtgctgcaaatccataatactcactgctcagca

SEQ ID NO: 8405 - DNA, 121 bp, Artificial Sequence
  Synthesized
  misc_feature (61): n=t or c
atttcatatagagacaaatcaaaaccaacttgttataaaaatggtacataacagtaaccanatgacataataggcagaaattgtcagagctttatatccacatagtagcaaagtacatcat

SEQ ID NO: 8406 - DNA, 121 bp, Artificial Sequence
  Synthesized
  misc_feature (61): n=t or c
aatttggttttgagattaaatgaatgtgctgttacgtatgacatatattctagactactantggggcatttgtgtgtgcaaagatattgcacacatcgactcagaatatagcatgagctgg

SEQ ID NO: 8407 - DNA, 121 bp, Artificial Sequence
  Synthesized
  misc_feature (61): n=a or g
ctctacccagatttctttcttctttgttgtggcctagtgattgtgttgcattgcatccctnaccaagcatattttttcttctcctcattcttcatcttgtttgaaacagtaccatatccca

SEQ ID NO: 8408 - DNA, 121 bp, Artificial Sequence
  Synthesized
  misc_feature (61): n=t or c
ttcagtgctgacccttccaggtgtcactcattcacaggttccaaaattagtctagttcccntggagttgccctgcagtgcatgtcctccaccgctctcggttctgcctaaatattggcatc

SEQ ID NO: 8409 - DNA, 121 bp, Artificial Sequence
  Synthesized
  misc_feature (61): n=a or g
atgacaatctaattctagtctaaatttttctaaatctgaatgacacaatcattacctctantgactcatgatatacttcacatcagaggaaaacttctggagaaactggacggaaatccat

SEQ ID NO: 8410 - DNA, 121 bp, Artificial Sequence
  Synthesized
  misc_feature (61): n=t or c
tttttcacagcaagatatgtcttcttttctagtcttccctgtgttagatggaggctgctgntagtgcaatatctgaacaaaaaaaattctcctacattggaaatattgatttatcccttcc

SEQ ID NO: 8411 - DNA, 121 bp, Artificial Sequence
  Synthesized
  misc_feature (61): n=t or c
caacagcaaaaagccacacacacacacatccaaaccaactttcattgttcttcctcattgnacactgttctcatgaaatgtgctgtgtgaggagcgtgccacttaattcacattggaacag

SEQ ID NO: 8412 - DNA, 121 bp, Artificial Sequence
  Synthesized
  misc_feature (61): n=t or c
tttgaagggggcataaataggtgctagctctgcacaaatttttactgcttaattatttttnaaatctagactcattttcaaaactgcagatgattcccattgatttctgttagtgaagtag

SEQ ID NO: 8413 - DNA, 121 bp, Artificial Sequence
  Synthesized
  misc_feature (61): n=a or c
tttgtgactgtctctctgggtctgacatctcatgttcttgttgtccatcacttctgggcanaacatatccacaccagctctttggtttatgaccttcactcctgactttgcagtcagcctg

SEQ ID NO: 8414 - DNA, 121 bp, Artificial Sequence
  Synthesized
  misc_feature (61): n=a or t
gacattactgtgactgaaatgatatgcacataaagtaggcacatggatttatgatttctgngaactggaggattctggttatagtaatccgagcaaaagtgttaagcccctacataaacct

SEQ ID NO: 8415 - DNA, 121 bp, Artificial Sequence
  Synthesized
  misc_feature (61): n=t or c
ttctcccccacctcctccttttagcagaacctaactcagccatctagaacaagcctgtccngcaacaatgacagttctgactccatttcaggaggcctggtagaaatctgctgaataaggt

SEQ ID NO: 8416 - DNA, 121 bp, Artificial Sequence
  Synthesized
  misc_feature (61): n=a or t
agcttgaggcctgtagacacgtcaatccttggtaaacagaggcacagggacaggacactgngacacttgaggcacctgttttgtacttgagctgcagtgctcatctctgccctccctgctt

SEQ ID NO: 8417 - DNA, 121 bp, Artificial Sequence
  Synthesized
  misc_feature (61): n=a or g
gtgctgaaggatatgtatcgctcttctccctttctggaacgtttcatttgaggcatcaacntgctgaagtagatcccaactggcagttatcataagtagtctgacagtggcatgaactggt

SEQ ID NO: 8418 - DNA, 121 bp, Artificial Sequence
  Synthesized
  misc_feature (61): n=a or g
ctacttaagatctgagttagaaaaggagacttcagaattaagaaaatgttagaagtacaanaaataaatatgtgaagacttagaggtttgattgttgtttatttaatgtctcctaggtgca

SEQ ID NO: 8419 - DNA, 121 bp, Artificial Sequence
  Synthesized
  misc_feature (61): n=t or c
tgaagaaagtcttatggagagatagttaaaagtatggttttcactgattttcatcacttcngaaacatccagtttaaaatcatagcttagtgagctctggccaaagcctgtatttgtagaa

SEQ ID NO: 8420 - DNA, 121 bp, Artificial Sequence
  Synthesized
  misc_feature (61): n=c or g
cccacacctccacggtcttgctgattaattaccacctgatgaggctctggctccctgctcntatgttcagtgatgctcttctgagtatcagaaatcagaggatcagatgtgaagacaagac

SEQ ID NO: 8421 - DNA, 121 bp, Artificial Sequence
  Synthesized
  misc_feature (61): n=a or g
acagggcattcacaaataaggtgcaaatttctgtcgtgcagaagcgccttctccaaatatngacaagtcttttcacgccaaagatggtgcaagagaggcaaaataatttttccactaagtg

SEQ ID NO: 8422 - DNA, 121 bp, Artificial Sequence
  Synthesized
  misc_feature (61): n=t or c
gtatttgccccctgaccttcttgcctttctctcacaggtggatggtaacatcatggtctcnatgtacacggagctgcggtggaggaatccaaatgcgacgagtgacatgccaacgactgac

SEQ ID NO: 8423 - DNA, 121 bp, Artificial Sequence
  Synthesized
  misc_feature (61): n=t or c
ttgtgatgaggactgtgacatggagctgtagttaaagcaggatgaggaacgaaaggggcanagattaagaagctttcatctacccctaggttgcaaccgagaaaaggagaaatagctccct

SEQ ID NO: 8424 - DNA, 121 bp, Artificial Sequence
  Synthesized
  misc_feature (61): n=a or t
tcttaaaatggctgctggaaataattatacattgtgggctctcatgacaaggatgctgggnatgctttgatgtttgctacagtggtgatattattgatcagcaggtttaaaccatactaac

SEQ ID NO: 8425 - DNA, 121 bp, Artificial Sequence
  Synthesized
  misc_feature (61): n=a or g
tattatcattcctattcattgtcagtgcaagttttgaagatgaggaatgcttcatcctgcntggcttttatatccttatttgatttcagtgcactggagcttctcagccttgacttaaagc

SEQ ID NO: 8426 - DNA, 121 bp, Artificial Sequence
  Synthesized
  misc_feature (61): n=t or c
gacctaagagccttaatgatggatattaactattaaggtaaagcctaaccattgtccaccnatatacaaaacgtcagtttttgcaattaagagcaattcacaatcttctgaatgacagaaa

SEQ ID NO: 8427 - DNA, 121 bp, Artificial Sequence
  Synthesized
  misc_feature (61): n=a or g
ttttaaaggtcacttttataagcttccttataactgattgaggactttcttccatcaacanctattctacggaaataaaaggagctgaaaatcattttgattggaaaacagatatgctcaa

SEQ ID NO: 8428 - DNA, 121 bp, Artificial Sequence
  Synthesized
  misc_feature (61): n=a or g
tgctgtgctccgcagctggaggaggcttgcagtgatggccatcagatccagctaaataggnacatttgaagaatactcctaggactttgaataacttttctgcaggcacacatatacacaa

SEQ ID NO: 8429 - DNA, 121 bp, Artificial Sequence
  Synthesized
  misc_feature (61): n=t or c
tctcttttccatgtttcaccttctgttcttgtgccagccaagagattcttccaccttatcntgtgggttgtaccaattaacatgagcccaactcatatgaggggaaaaggttaggcattat

SEQ ID NO: 8430 - DNA, 121 bp, Artificial Sequence
  Synthesized
  misc_feature (61): n=t or c
ggtacaatgaagggagattgaaaaagcaggcaattaaagtgtataggatctcaatgtgaanctaaggagtaaaaatggagataacttgtagaatttctgggcaagtttactgtatttggag

SEQ ID NO: 8431 - DNA, 121 bp, Artificial Sequence
  Synthesized
  misc_feature (61): n=a or t
aaaacttgaaaaattatttgttcaaagaatttgcatatagtcaaaaacaccaattcatcanttttttattgccaatttctgaagccaactttgcagttttgaaccaagtaagaagacaaag

SEQ ID NO: 8432 - DNA, 121 bp, Artificial Sequence
  Synthesized
  misc_feature (61): n=c or g
gactactgcatacacacaacagagcgggagcccctaaattcaggtgtaccccatggagcantggggctaacatctctcactacaacaagtaatttgaaaagcaatgaaaccagaaaaataa

SEQ ID NO: 8433 - DNA, 121 bp, Artificial Sequence
  Synthesized
  misc_feature (61): n=a or t
cattaactgtttttaaaggaacataaagctctatcaaataaaatcaataatgttttatacncctttccaggggtgtatgtgatgaaacatgaaatctggcaagagagaatgtgacccacaa

SEQ ID NO: 8434 - DNA, 121 bp, Artificial Sequence
  Synthesized
  misc_feature (61): n=c or g
cctcatgctgccaaagcctacctgcagcatcacccaaactggggtgctcagagggccaaanctgagccacaaacgcatgcatcagtttcagttaaaatttaactcctcgtaactgggccac

SEQ ID NO: 8435 - DNA, 121 bp, Artificial Sequence
  Synthesized
  misc_feature (61): n=c or g
atattttctttcaggatcagagaaaattagtgacacagcatctatttccattctcacaatnacaaattcattcaaactccagaagccttataaatgcacctttacaacaacactgtgcact

SEQ ID NO: 8436 - DNA, 121 bp, Artificial Sequence
  Synthesized
  misc_feature (61): n=a or g
aatgaagttgacatttttatcagtacctgccatttgacagactgcacctatagttgcatgnagattacacatgtaagggcgtaatactgatagtggaattaatcaaattattctgctctca

SEQ ID NO: 8437 - DNA, 121 bp, Artificial Sequence
  Synthesized
  misc_feature (61): n=a or g
gaaatgtccttccaaagctctgtaaaattcagttttattattcactgaagttcataatagngtgtttaggcttgtaactcacccacagtgcagatgacatgtgacatgccaaagtaagcaa

SEQ ID NO: 8438 - DNA, 121 bp, Artificial Sequence
  Synthesized
  misc_feature (61): n=t or c
atgggaaagaaggtctagaaaagaaagaggtaaatctgtttctttttaaccatcaagttgnctagtaaacttctggtttgcaatctgaccttgtggtgatggccagcttgccattgtttac

SEQ ID NO: 8439 - DNA, 121 bp, Artificial Sequence
  Synthesized
  misc_feature (61): n=a or g
ctcttacaatgattctcaaagagcgcacaacaactgtaaaaatccagtctctgctgccacntagtcatggctgttatgctccacatgtctcttggcagtatctttggtgcccatagtggag

SEQ ID NO: 8440 - DNA, 121 bp, Artificial Sequence
  Synthesized
  misc_feature (61): n=t or c
ctcacaccacaacagtaaactacacctcatgacaaagccgtacagcaagatataaaggacncaggtgaggaataaagacagctgtaatttaggtttccaaacataagcaaagtgccccaat

SEQ ID NO: 8441 - DNA, 121 bp, Artificial Sequence
  Synthesized
  misc_feature (61): n=a or g
tccagagacaggccactatccttaaaagtggaagggcctaatgctcatataaagagaaatnacatcagaatttatttctaggtaatttccaccaggctcctattctttaaagcagaaatcc

SEQ ID NO: 8442 - DNA, 121 bp, Artificial Sequence
  Synthesized
  misc_feature (61): n=a or t
ttcacctcaaccccttcacattcatgctagaaaccacattgctgtattgaatccacaggcncacaacagtgctcttgcttttctagccctgtgctcaagcttaaaggtcactgcagcactc

SEQ ID NO: 8443 - DNA, 121 bp, Artificial Sequence
  Synthesized
  misc_feature (61): n=a or c
tctccacataatatatgttttactcatagggtttttttgtttgtagttcacataacagaantaagcacaacaatttagagtcaatggaacagacaaatgagagaatttctcttgtgtacaa

SEQ ID NO: 8444 - DNA, 121 bp, Artificial Sequence
  Synthesized
  misc_feature (61): n=a or g
cttttttgcagaaaacaattctcccttcacaataacagtaacccaagacagaaacaaagcnaggaaagaattcataccacaaagtcaaaaataaagtaagcagtaaaatattggtggctat

SEQ ID NO: 8445 - DNA, 121 bp, Artificial Sequence
  Synthesized
  misc_feature (61): n=t or c
gtgcaacttaccttggcttttgttaccaaattcaccattagtttaagggtgtgtttggatngatgatttaagtgatgtatgtagtgcaagtaggaataaaggtttaccaaacagacttgtt

SEQ ID NO: 8446 - DNA, 121 bp, Artificial Sequence
  Synthesized
  misc_feature (61): n=a or g
acttttgagtcactaagaagaaatagccagtgaagacagtacagaaaaacatttttaccanttttgctttccatcatagtgatggagataatacatgataaaagctatggttccttttccc

SEQ ID NO: 8447 - DNA, 121 bp, Artificial Sequence
  Synthesized
  misc_feature (61): n=a or c
ggaactgttaccacctccagcagccatggcctagctcccacttcacagaccaatggatctncattcagagactgggcccttgggctgtgtgcgcaggctgagggacacactcggacaaaca

SEQ ID NO: 8448 - DNA, 121 bp, Artificial Sequence
  Synthesized
  misc_feature (61): n=a or g
gagaagttcctagcacataaactgtcctggtctcactcctggctgccctgcttgcctccancccaggctgagcagcattcctccacacaggctgtaagcacaggctgtcatgcaaaaggca

SEQ ID NO: 8449 - DNA, 121 bp, Artificial Sequence
  Synthesized
  misc_feature (61): n=a or g
gccttaaactgcaattacctgagactgaaatactgaatgaactgttcatgatgaatcctcngggggaaattttcatcaaaaaaagtgtgaattatagttgaataattaaaaagttaaggaa

SEQ ID NO: 8450 - DNA, 121 bp, Artificial Sequence
  Synthesized
  misc_feature (61): n=c or g
cacacttcccttactcagaggaataagaaaaaagctcctctgagatgctgatttcagcttntgcacatctttctctagaaatcccaacccatgcttcatctgctttcataggtgtccttag

SEQ ID NO: 8451 - DNA, 121 bp, Artificial Sequence
  Synthesized
  misc_feature (61): n=a or g
aggaaaaaatgcaatggtgagcactagaagaatgagagaagagtacaccttcttcctggcntatgagagatcaagactagaaatgattttctgtttgttttgtcaagaataagcccctgtc

SEQ ID NO: 8452 - DNA, 121 bp, Artificial Sequence
  Synthesized
  misc_feature (61): n=a or g
cagctttttgcttctcttgtctaatgcacagctcaagttaaaaagtcacagacaaagcctnttatccagtaatagtgttttcaagggcagcagacggaaatgagtttaaataggaacttta

SEQ ID NO: 8453 - DNA, 121 bp, Artificial Sequence
  Synthesized
  misc_feature (61): n=t or c
tcattatccagggatatcaacagaaaataaagctgttctgtctttaccagaaattgtgctngggctcttccttaccatagatcaccacatgagctcagcagttcaaaatgctgctttttca

SEQ ID NO: 8454 - DNA, 121 bp, Artificial Sequence
  Synthesized
  misc_feature (61): n=a or c
tcatgcaggattttttgttgattttttgtttgtttattttatactttttgttccttgcttnatatgaatacattcagactgaatcaggagggtaagaatctaagcaagaacatggttgcat

SEQ ID NO: 8455 - DNA, 121 bp, Artificial Sequence
  Synthesized
  misc_feature (61): n=t or c
atagccattcttcaagtgtctaccttctggatgccagaagtttcacctggacaatgcactngaaacatggagaaggaaacagtgtcccgcttctacagagatttaatagggtcgtctgtat

SEQ ID NO: 8456 - DNA, 121 bp, Artificial Sequence
  Synthesized
  misc_feature (61): n=t or c
acagcaggaacatttccacgaacttcttcggagacaatgatggggttacaaagcctctgcncttggttagtttgaagtatgccccctgtccaaggtcagggcactggtgctgtactctgtc

SEQ ID NO: 8457 - DNA, 121 bp, Artificial Sequence
  Synthesized
  misc_feature (61): n=t or c
aatactaaatagaaaaactcaacgtggtcaaataccattactactgtgttccttccatccnatccctaatctttagtaagctctccatagggctgagctgaacaaagtactagactgttgt

SEQ ID NO: 8458 - DNA, 121 bp, Artificial Sequence
  Synthesized
  misc_feature (61): n=a or t
ttgttattccttcacccttggttcttatatatgttcctcccctaagtgtcccagtagaagncctgtgtaatatcaagatgcactttgcctgcatccaacctccaggcagcaatgttgtgta

SEQ ID NO: 8459 - DNA, 121 bp, Artificial Sequence
  Synthesized
  misc_feature (61): n=a or g
tgtcccaagtcaaagaacaagaaaatcctgagtacgtggggttaagtctcttataaatgcnaaacccagtcgcaaccacaacacagtgcacacagacctggaaatctggcaccagcactta

SEQ ID NO: 8460 - DNA, 121 bp, Artificial Sequence
  Synthesized
  misc_feature (61): n=a or g
attaggtgtagtatccaaaggtttgtagcacctgctaggtacgcataaagaacgtactgcnctacaattgattatttatgaagtggattcattatgctcaataactagaagagacagctgc

SEQ ID NO: 8461 - DNA, 121 bp, Artificial Sequence
  Synthesized
  misc_feature (61): n=a or g
aggaggaaaaaatggctaccgagggctgtgcagtttctgtacataatctgtttcagcactnctctaccctactagtcagtctgcacttcccaaggctcaaccagtggcaacggcctcttgt

SEQ ID NO: 8462 - DNA, 121 bp, Artificial Sequence
  Synthesized
  misc_feature (61): n=a or g
ggaaacaaaaggaaattagccttaattttcttataaaatgagcctgattgtgatgagccantctgtgatttttagggcctccaatgcttgtttagacatctaagccatccagatccaaaaa

SEQ ID NO: 8463 - DNA, 121 bp, Artificial Sequence
  Synthesized
  misc_feature (61): n=t or c
cttatttagattttgaataatggatccactacaaaaaggatagcacacataagaataaaanaaaatggaatgcctctagatagatgcaggcactagtgaaaacaacagactcagcctttat

SEQ ID NO: 8464 - DNA, 121 bp, Artificial Sequence
  Synthesized
  misc_feature (61): n=t or c
gttttaattcttcaacggcacaggatttttcactaagaaacaagcatgtgctttcaggaanatctttgtcatttcgtcccatctgttaggtacataagtattgagagcactactctttttt

SEQ ID NO: 8465 - DNA, 121 bp, Artificial Sequence
  Synthesized
  misc_feature (61): n=t or c
tctcaccaggaaaacttctttcactcaaactggcacccctatttgccacgtgctcttcctnttgtatagtctgcacaccccctgtggctcatcttatcttcttattaagtacaattacata

SEQ ID NO: 8466 - DNA, 121 bp, Artificial Sequence
  Synthesized
  misc_feature (61): n=a or g
atgggttggaagttttcaggttaacctcattttgcctccattattctgacactcaaggaanggcatttagctttctgagttaatctatcagcagagaagatctgaattattattattattt

SEQ ID NO: 8467 - DNA, 121 bp, Artificial Sequence
  Synthesized
  misc_feature (61): n=a or c
gtgaacaattaaatccatgtaatttgtactgctagaattcttttatccaatgtgttaatanatgatctcagctgaaacgtagtctgtgagaactgtgtaatatgctgttttaaatgaaaat

SEQ ID NO: 8468 - DNA, 121 bp, Artificial Sequence
  Synthesized
  misc_feature (61): n=a or g
tacagccatccattatttccagttgatgtcctgagcactcctgggcattcctcatttcagnagaaagtgtggcaggcagagtgactggcaacgtgatcacctcttccagggaagaaggatt

SEQ ID NO: 8469 - DNA, 121 bp, Artificial Sequence
  Synthesized
  misc_feature (61): n=t or g
atctccaccactaaacccaacaatattcatcacaaatctgcccacatagatctctgagaangaaaaactatattggtcaaggggaaaaatgagtattcagtaaaacttcccattcttcctt

SEQ ID NO: 8470 - DNA, 121 bp, Artificial Sequence
  Synthesized
  misc_feature (61): n=a or g
tcaacaccctcctttgcctagacattgatttatcttccctactcctcccagcccaacaacnctttgggttttttggtcatgctacttcattattctaacccttaaaaaagattaaagagtt

SEQ ID NO: 8471 - DNA, 121 bp, Artificial Sequence
  Synthesized
  misc_feature (61): n=a or t
caatgctttaactcatctctttttaaccatctccaccattaaacctctgacctgtatatcntgcttatgtctttactcctcaagtctctttttcgagctcctccagcatgacatccattgc

SEQ ID NO: 8472 - DNA, 121 bp, Artificial Sequence
  Synthesized
  misc_feature (61): n=a or g
ttcaagatgatctttcacatcctttcattatcatccatgcaagttcctagacatcagctcntaaagagttttgtcatctcctcacatacagaggtactgatctaacaagaaaagaatatca

SEQ ID NO: 8473 - DNA, 121 bp, Artificial Sequence
  Synthesized
  misc_feature (61): n=t or g
aataaatactctttgaggagattctaatgcaatattctgaagttgtatcttcctgtacttnttcatcaagactaaggcttcacaatcttgacaattttaataggaagatatccattaatat

SEQ ID NO: 8474 - DNA, 121 bp, Artificial Sequence
  Synthesized
  misc_feature (61): n=t or c
cacaacaggttctgcaactactccagttcccatgatagactttgcaactgttccagttctngcaacaggtcctgcaattgctccaagcactgcaacaggccctgctattacttcagtcctt

SEQ ID NO: 8475 - DNA, 121 bp, Artificial Sequence
  Synthesized
  misc_feature (61): n=a or g
cctatcactagtcacacgagaagaaagccgaaagctcctgtcatggatggcagtgcaatgngtgtgcaagtcctctgcagtatggggtacagcagaaggaaggagagcagaacgcttcctt

SEQ ID NO: 8476 - DNA, 121 bp, Artificial Sequence
  Synthesized
  misc_feature (61): n=t or g
agccattatactatgtaatagctattgtttgcttaatcttaacccaaattctgccttagcntatgctaacattcacgttcagagctgcaatctactctacaattgcttacttattatgcac

SEQ ID NO: 8477 - DNA, 121 bp, Artificial Sequence
  Synthesized
  misc_feature (61): n=t or c
gggtttctatcattgtcaagcgtctctagtgatgggcacctctgtgaggaagagactgtangcagtaattataattagtaaagaggtagaaggaggctttgcaatatgtgcgtttcgagga

SEQ ID NO: 8478 - DNA, 121 bp, Artificial Sequence
  Synthesized
  misc_feature (61): n=c or g
gttttcctcagtgaagagactcatactggacagatgtgtttaaaatcattacttcaaattnttcctgccctatttcaatttatagactgggacaagcagtatgatcaagtttgctgttata

SEQ ID NO: 8479 - DNA, 121 bp, Artificial Sequence
  Synthesized
  misc_feature (61): n=a or g
tatcacataaacaagctgatttaaaataaagttctcttttcaggtgccactgaaacaagtnttttatagattaacttttctaaagatagaatcatatgtccttagcatgcattaaagggct

SEQ ID NO: 8480 - DNA, 121 bp, Artificial Sequence
  Synthesized
  misc_feature (61): n=a or g
tcttcttatttccagtgattacccttctattgatgagatgggacagatgcattctgtgaantcatttgtaagagggatctcatatcacaagtactctagtttctaataaaattacaatctt

SEQ ID NO: 8481 - DNA, 121 bp, Artificial Sequence
  Synthesized
  misc_feature (61): n=a or c
gaagcaaatgcttggcaaaacaactacattgaggacccttttggaggagatttgagaggcntgttcgaatggtaatgagaagatatacttggaaatggctggattattttcagctggcaat

SEQ ID NO: 8482 - DNA, 121 bp, Artificial Sequence
  Synthesized
  misc_feature (61): n=t or c
tggtgattattcatccaatgagatctgtagccctaccctaaaatatccccaggtccagaanataatctccacatggctttctgtgctttttacacaataagatttcaggatgccagttgct

SEQ ID NO: 8483 - DNA, 121 bp, Artificial Sequence
  Synthesized
  misc_feature (61): n=t or c
gcccctctgcctttcagttaaaatcaagaagatgaacactaataagaacagtgggtcattnctctggactttgcagtcttccacattatgcatgaatctatcctacagccatttggagaag

SEQ ID NO: 8484 - DNA, 121 bp, Artificial Sequence
  Synthesized
  misc_feature (61): n=c or g
taatgcactaaaatcactgaaatatcacaatcacaaagcattaagagaaaaggagatcaanggtgtaatttagcttgccctgatccagctactctcatgcattcttcatgtacccaagtgc

SEQ ID NO: 8485 - DNA, 121 bp, Artificial Sequence
  Synthesized
  misc_feature (61): n=t or c
ttttccaaaatgacagcttactcacagatagctgaaagcttcattatttgatgaacattantatattttagtgaaatgcaattgcagtgatcttgaaccacatatcctcatactagaaata

SEQ ID NO: 8486 - DNA, 121 bp, Artificial Sequence
  Synthesized
  misc_feature (61): n=c or g
ggatggggcagattagtgaggcagaggatggcctggagcctgctgccttggagacactccngagcataggcaggtatggttcaggagagtgcaaaaagctcctgccttgaaacagaagaag

SEQ ID NO: 8487 - DNA, 121 bp, Artificial Sequence
  Synthesized
  misc_feature (61): n=c or g
agccaaaagctaggaaagctcatcatgagctcagctgtgaggtgagggagaatttctgctnagtggagggaagaaacacggagcaccttcaccttcctcactgcagcctgaggaaacggta

SEQ ID NO: 8488 - DNA, 121 bp, Artificial Sequence
  Synthesized
  misc_feature (61): n=t or g
ctattccaggcaggatcaagagttcaccaaaagtagttccagtgacctctggtccttcacntgtcttacacttcacttccaaaccactaacatgtatcaaagacccccatccccattgtca

SEQ ID NO: 8489 - DNA, 121 bp, Artificial Sequence
  Synthesized
  misc_feature (61): n=a or g
ttggcaagtggtggcatttttccagtctagatgccagaaaaatactttaacagctctgggntttcctgaatcctaagaaggatcaggagtacttgttgttattagatactgccgtggtcct

SEQ ID NO: 8490 - DNA, 121 bp, Artificial Sequence
  Synthesized
  misc_feature (61): n=a or g
actttcttgggatctttatagagaaatgctttttcaacacaattctgcttttaccttcacntatctgtaatgcaatttagcagtgcatgtaatttttttaattgatcacctgagacccaat

SEQ ID NO: 8491 - DNA, 121 bp, Artificial Sequence
  Synthesized
  misc_feature (61): n=t or c
ctgagcattcctagtgtctgggagaagcaagtccagactgctccatacaagaaggtgagcnaggaggtgatgccagtataagtctggcagggacaacacttcaccactagaaagtgaacat

SEQ ID NO: 8492 - DNA, 121 bp, Artificial Sequence
  Synthesized
  misc_feature (61): n=a or g
ctgcatccccacttcctatgtgtgaatataatacagctccagcatatttacttccttgtcngtttgtctctgctttaacagaggctgcacaaagataattgccacaaccactcatgaagac

SEQ ID NO: 8493 - DNA, 121 bp, Artificial Sequence
  Synthesized
  misc_feature (61): n=a or t
tacctttttaaatgtcaggacagtctggcagaaacacatacaaatgtaagggttgttcgcnactgtttcacaaggacagtaaactctgctagtctagagtgtaatgttttggaaccatttt

SEQ ID NO: 8494 - DNA, 121 bp, Artificial Sequence
  Synthesized
  misc_feature (61): n=a or t
gttttgtttgggaaacctaatgtctgacactttcaaaacccctggaaaaacaaagaagttngcacacaggatacataccagttcttgcagataaaggagttgtaacaataaagcttcccta

SEQ ID NO: 8495 - DNA, 121 bp, Artificial Sequence
  Synthesized
  misc_feature (61): n=t or c
taacagtgagctcttaaagcccagccagactcagtattgtacaaagagagtgtgtatccangctctgaaaagtgtgcaatttatatggatgggattaggaatgggttgaggggattagttc

SEQ ID NO: 8496 - DNA, 121 bp, Artificial Sequence
  Synthesized
  misc_feature (61): n=a or c
agtgctgagaatgtgcattgaaatttagactcataagaccattttcatccatgttctctcngaagtgtgggaaagctgtctacactactcatatagtatccatacagtggataaccaaaac

SEQ ID NO: 8497 - DNA, 121 bp, Artificial Sequence
  Synthesized
  misc_feature (61): n=a or g
taaggattatcaaggtcaactcctgcctccacacaggatcaaccaaaactcagagcatatntgtaaggattttgtccaggctcattttatactctggcagcttggagacatgacctgtgcc

SEQ ID NO: 8498 - DNA, 121 bp, Artificial Sequence
  Synthesized
  misc_feature (61): n=a or c
gagtgcactgcactgacatttccaaagctcactcacctggaatgagaattgagttgtctantttgctcttatatttcccaaaacttcatgctcttctgtgtcacgcttgaaacaactttta

SEQ ID NO: 8499 - DNA, 121 bp, Artificial Sequence
  Synthesized
  misc_feature (61): n=t or c
aaatcagtttcagcatatggtttaagcaaagaaaaacatttttgcttcctataatacgtangcagtagtttaggcagatcttttcttgcataagccatcacaaattgccaaacaagatacc

SEQ ID NO: 8500 - DNA, 121 bp, Artificial Sequence
  Synthesized
  misc_feature (61): n=a or t
gagaattctaaattacagatcccagtaacttgagatttgtaggcaaaaaataagttaattntgttgatcaatgataaactattggccttctctgctttcagctcacattttccaggaaata

SEQ ID NO: 8501 - DNA, 121 bp, Artificial Sequence
  Synthesized
  misc_feature (61): n=t or c
ctacttaattattttctcaaattattacacattgttatgtagattgcttaaggaccttganattgcatttcttagctgaataactttggagttcttttccgagaacaattttaacacttga

SEQ ID NO: 8502 - DNA, 121 bp, Artificial Sequence
  Synthesized
  misc_feature (61): n=a or g
ttttaggaatgctagcgggcttgatgttagccaagttcccaggaagacagagaattgtacntaccttgggaagagaaggacaaatgatttgactgaaatagttttcccatccatgtgaaat

SEQ ID NO: 8503 - DNA, 121 bp, Artificial Sequence
  Synthesized
  misc_feature (61): n=t or c
actgggtacaaaactgcttccctgcagacattagtcttactgccaagctttggaaggaacnaacaggaatcatcaatttcagctcacctcaaaccccgtgtttcagagtgtggtccaaatg

SEQ ID NO: 8504 - DNA, 121 bp, Artificial Sequence
  Synthesized
  misc_feature (61): n=t or c
ctatgagcactgaaggacacttgtgattatttcacttcatccctattaagtaacctcttcnagatatttgatggttttccagttatgtgcacacacacacacaaaaagaaaaacctgaaac

SEQ ID NO: 8505 - DNA, 121 bp, Artificial Sequence
  Synthesized
  misc_feature (61): n=a or g
aagtatcctgtgggctgtcctcttgcttgaggagacagcttcttccaagggagcaggaacnaacaccatggaaatgaaaagcagaggcgttcctgtaagaatctctaattttttttttctc

SEQ ID NO: 8506 - DNA, 121 bp, Artificial Sequence
  Synthesized
  misc_feature (61): n=a or c
tggtgttaagagtattttaagttttcagtcagtgctaatagcttttgagggaggaaaaaancgtgatgatgtgaatctttcatttgctttagtcagacaccaaagtttgatgagtggatcc

SEQ ID NO: 8507 - DNA, 121 bp, Artificial Sequence
  Synthesized
  misc_feature (61): n=t or c
gaacaataacgagacataagggttgactgtgactcatgttactggtcagaacaactgttangtaccatggatatacgctgcagtaagaccttgttcatcatctattgattaagttttttaa

SEQ ID NO: 8508 - DNA, 121 bp, Artificial Sequence
  Synthesized
  misc_feature (61): n=a or g
atccatgcagtgagggagaaacagcctttccattttctccttcattgtaccacaagcaccncaagtagtacattttggtagcccagagttaagcaattcacaatgtgaccacatcaatgca

SEQ ID NO: 8509 - DNA, 121 bp, Artificial Sequence
  Synthesized
  misc_feature (61): n=a or g
caggcatatatgtctacctgtccaagtatttggatatcaccgtgagtaacgtctcaacacncatacacagggtattcaaaatatgtaaatgtcttttaatgctatttatgacgtttgcaag

SEQ ID NO: 8510 - DNA, 121 bp, Artificial Sequence
  Synthesized
  misc_feature (61): n=a or g
cccagcctcgtttcacacagggtggctttgaaaggaccgcttacaagcccagccacgctcnggtgggacagcaagctccaccagcacgtgtgtgttcagtgtcaggcagcttcaggtccca

SEQ ID NO: 8511 - DNA, 121 bp, Artificial Sequence
  Synthesized
  misc_feature (61): n=t or c
agagctacagactgggagtgccttgctctaaaacacaggaaaactatagctcctggagacncataacataggacatagtttattgcattttttaagacttttttttaaatgttaggaaaat

SEQ ID NO: 8512 - DNA, 121 bp, Artificial Sequence
  Synthesized
  misc_feature (61): n=t or c
ctgcactagccgttgacctatgtggtatggagcagagtttgaatttctggaatatcttccnctccagaggaaaaggggtggtaaattcaaatggatattttcccagcatatctcatgaagt

SEQ ID NO: 8513 - DNA, 121 bp, Artificial Sequence
  Synthesized
  misc_feature (61): n=a or t
tcagtgtctacttctgtgtaccaaaggtacagaccaaataaaacagaagtggtggtggcanaggataaagaattgctactgtacaagaaaacagacagagatttgttggtgggcataacat

SEQ ID NO: 8514 - DNA, 121 bp, Artificial Sequence
  Synthesized
  misc_feature (61): n=a or g
agggaagtttggttttgaaagggggcagaatcagtctataaatggcgttattggcctgccncagagatagtttttgggttccaaattgattagtaccaatctgatcatttatgctgcagtg

SEQ ID NO: 8515 - DNA, 121 bp, Artificial Sequence
  Synthesized
  misc_feature (61): n=t or c
gccttctccacttctgaagggcagcagccataaggaccctcagggcatgtgcagatttatnaagcatctctggcatttgtacattggtgacctgctcagttccctgccctgggacctgtct

SEQ ID NO: 8516 - DNA, 121 bp, Artificial Sequence
  Synthesized
  misc_feature (61): n=a or c
tctctctgattgtaagtgtttaaaatgtagatcaatcaaagggtttatggtaattcagagntcagaaatttaaactgtctagaaatctgggtatgaagtacagctttgtgccttcactact

SEQ ID NO: 8517 - DNA, 121 bp, Artificial Sequence
  Synthesized
  misc_feature (61): n=a or g
cttgtattctcaaagtgactcctgttatttcagattacttttgaaacacgaacacaactgnaaactatacagaactttaaaagtcctgaatatattaaatatcatatatacaagtatatac

SEQ ID NO: 8518 - DNA, 121 bp, Artificial Sequence
  Synthesized
  misc_feature (61): n=t or c
aactggattaaagagataccctttttaagttgtcataggaaattttagtgagatttttgtngaacaatgaaacacctgagaaaaaatgcctgttatgaggctttgtattcccagatgttta

SEQ ID NO: 8519 - DNA, 121 bp, Artificial Sequence
  Synthesized
  misc_feature (61): n=a or c
aggctcagccaccgaacctccttttagtgctggccatggtgctggataacacagctgagangtgacaggctggctgcttttcagatggggaaaaatgggttatagcacacagcagcaactc

SEQ ID NO: 8520 - DNA, 121 bp, Artificial Sequence
  Synthesized
  misc_feature (61): n=t or c
cagtgcccaggtctgtgcagaaacttctgtagagagcaggagggcttgcaattagcaccanccttagggtgagcagggattagtaaatgcaatcctgcagcatgggattagcctgtctggg

SEQ ID NO: 8521 - DNA, 121 bp, Artificial Sequence
  Synthesized
  misc_feature (61): n=a or g
cataactaataagtgtgtgattagtttagaaccttttaatttaaacactccattctacagncatccctaataatgtttctagaagctccacagggattctgagtggtgtaatcatgttaac

SEQ ID NO: 8522 - DNA, 121 bp, Artificial Sequence
  Synthesized
  misc_feature (61): n=t or c
ggatagaaagcatagaaaaaaaaatcaagaaaaagaaatgggagaattaattatctagtgnaagatatttttgagacctctgctatcagcgacatagaagttctaaagtagcaattgaggt

SEQ ID NO: 8523 - DNA, 121 bp, Artificial Sequence
  Synthesized
  misc_feature (61): n=a or t
cagctagctgctgggttgggaccttgggtctgggattcactgagagatcattgttacatgnatgtgtgtgtttgaagcacaaggacacaggagcttctgaggacaggtgctggggatcact

SEQ ID NO: 8524 - DNA, 121 bp, Artificial Sequence
  Synthesized
  misc_feature (61): n=t or c
tcaagagaatttcacctcagtttagggcagtgcaggcctcaactccttctgttgtatactntggatgtagaaagtattttaattattaattagggtaataattccttcctaatttgaattt

SEQ ID NO: 8525 - DNA, 121 bp, Artificial Sequence
  Synthesized
  misc_feature (61): n=t or c
ggagccggggcccaattataaacccctctttaagagaggccttcatttagagagtgagatnggagctgtcggaatattaacgagctcttgccagcagcacagcatccagcagaggggaagg

SEQ ID NO: 8526 - DNA, 121 bp, Artificial Sequence
  Synthesized
  misc_feature (61): n=a or g
ttgattaagcaattttacttcttattattatcatttttagttattttctttggatagagtncactctgcataaacacagaaatagagatggtaactttaaaacaaggcaaattcttccaag

SEQ ID NO: 8527 - DNA, 121 bp, Artificial Sequence
  Synthesized
  misc_feature (61): n=t or c
ccaaaatttgccatctggcatctaccaaaaaactgagaaacagcaaatggtgtgcaagganaggtcactgagggtagaacacgcgctctgttttggtatctgtcacaactatagcagtctc

SEQ ID NO: 8528 - DNA, 121 bp, Artificial Sequence
  Synthesized
  misc_feature (61): n=a or g
ctgggagaaatcagaggtctaacaactgctctcagtcagctgattggcaggagaagacaancagtgcagtttgatgagtcattaagaagcaattttgcacaggcacagcttgattatataa

SEQ ID NO: 8529 - DNA, 121 bp, Artificial Sequence
  Synthesized
  misc_feature (61): n=a or g
acaaactgaagctttccagcagcatgctggtttaccaaaaacctggtcagcacagaagatncagaagtgtcatcacttctcctaacccattaatttatggccaatccttagagtcaatcag

SEQ ID NO: 8530 - DNA, 121 bp, Artificial Sequence
  Synthesized
  misc_feature (61): n=a or g
gtaagtcctcagttttctttgaagaagggaacaagaatggagcagaatgaatggaaatatnttgcagataaggaacatcccaggggagccctctgtgccagacttacaatttttgtttacc

SEQ ID NO: 8531 - DNA, 121 bp, Artificial Sequence
  Synthesized
  misc_feature (61): n=t or c
attattattatttttttttctgcagctgtatgtttaatagtaaaataatccatatttctcngtgtgtatataaaatacagatatgctcaccagcactctgtggagttatgaaaagcctcca

SEQ ID NO: 8532 - DNA, 121 bp, Artificial Sequence
  Synthesized
  misc_feature (61): n=t or c
gttggcgaccagtcatgactggtgttccccaggggttagtagatgggccaagtgtaatatnttcactgatggtttgaaaacaacaacaagcgggggggaagcatcaacccgcctgagggta

SEQ ID NO: 8533 - DNA, 121 bp, Artificial Sequence
  Synthesized
  misc_feature (61): n=c or g
cttccaacactaaccattctaagttactatttttctatgtttttatgaaattcactttctntagcacatagtacaggatgctgatgattaaaatagttcaaggaaagagaaaagtatggca

SEQ ID NO: 8534 - DNA, 121 bp, Artificial Sequence
  Synthesized
  misc_feature (61): n=t or c
tgttttctgccttcactgtgtgtgagcttcatttgagagatgctgttatattaaagtttgntcttttatttaagctagtctttgggatgtggaggaggtttatataggagaattactgcgg

SEQ ID NO: 8535 - DNA, 121 bp, Artificial Sequence
  Synthesized
  misc_feature (61): n=t or c
aaaggtaaaggtcacatgttatacagagtaaatgaggtgtagctgaaaaaacagtgacctnagtctccttcctggcctgtatctttttttaaaaccatgcatgcctccctgctacaaatca

SEQ ID NO: 8536 - DNA, 121 bp, Artificial Sequence
  Synthesized
  misc_feature (61): n=t or c
aaaacccactaacacctccctcctgagggtttagtctgcatcacagaaggagtgacaatangaatgcttctctctccagagatgcttttgatatgttttaaagcagataaacacaacagtt

SEQ ID NO: 8537 - DNA, 121 bp, Artificial Sequence
  Synthesized
  misc_feature (61): n=a or g
cagcaaaccagtccattactgaaagaggagatattcacagcactgtgagacaacacatganaaaggagaattgagcagtaaccttgaactttgctaggaagaagtaacaagggagctgaca

SEQ ID NO: 8538 - DNA, 121 bp, Artificial Sequence
  Synthesized
  misc_feature (61): n=t or g
tggctgttcctattgtttacgcagacaggtgagcaaacacctgcagtaggtcccagccacnctgaaggcagataagagcatcccaagaggaacacaattcactggaaaatagaaaagatgc

SEQ ID NO: 8539 - DNA, 121 bp, Artificial Sequence
  Synthesized
  misc_feature (61): n=t or c
tgactgcctccaacttttacttgggatcttaaaacagtaactctgaatgcacgcaaaccanagagcagtgaagaagcgagttattcagtataacctccctggttttgctgggcgttatttt

SEQ ID NO: 8540 - DNA, 121 bp, Artificial Sequence
  Synthesized
  misc_feature (61): n=c or g
tgcttgtacactgttcctttctccagatgcccattcacctttaccccttttgtgcacttanctagttacaaaataccagctaactaccacacatctccatgggtggttattttctaaactc

SEQ ID NO: 8541 - DNA, 121 bp, Artificial Sequence
  Synthesized
  misc_feature (61): n=t or c
cacatgtccacacaaccttgtgtttcagtaggaagtcaggctagaattaaggaaatgtacnatgatttctagctattttccgcattccaatttagacaaagtatttctgtaaggacacagt

SEQ ID NO: 8542 - DNA, 121 bp, Artificial Sequence
  Synthesized
  misc_feature (61): n=t or c
agatatgaagccaagagcaacccaattgccttcacagccaagggtgtgcaagggcatttgnagggtagaactgcagcctctctccctcttgatgaccatgcatgcagaggcagatggttgg

SEQ ID NO: 8543 - DNA, 121 bp, Artificial Sequence
  Synthesized
  misc_feature (61): n=t or c
ctaaacctgcaagatgccaaactgagctcccaaggaactgtgctcaagagcagaacagganctcctgcttaaaccactggttactgttactacaaagaaagctccatcctgggctccagta

SEQ ID NO: 8544 - DNA, 121 bp, Artificial Sequence
  Synthesized
  misc_feature (61): n=a or t
gctcattcacccatattttccagaaatccctcttattgcaagagttcatccttgttcactntttttgccagagtcttcaggcattggtatctgtgttatgcagatgaattcatatgtgtat

SEQ ID NO: 8545 - DNA, 121 bp, Artificial Sequence
  Synthesized
  misc_feature (61): n=t or c
aaataggacccagtgaaaaagtatgaaaggaaaagtaatcaaaccacagagaaggctgcangactctgtttttttccttccacatattatcagacctagatcttcaggaagggacatctgc

SEQ ID NO: 8546 - DNA, 121 bp, Artificial Sequence
  Synthesized
  misc_feature (61): n=a or g
gcagaaaatatgggttctcctcttctcagtaaaatatcacagcattagtaataactcatanagatgggcatcaggaattgtctgggctaatctcagcctgtgctcattttcatgtttcacc

SEQ ID NO: 8547 - DNA, 121 bp, Artificial Sequence
  Synthesized
  misc_feature (61): n=a or g
tcctgcagttagaaatccttaggactaccactggagtattttcatggattgaattatccgngccccagaaagtttattagctcagagcaaaggtaagtcctgagagatggtagaagaggag

SEQ ID NO: 8548 - DNA, 121 bp, Artificial Sequence
  Synthesized
  misc_feature (61): n=a or t
ataaatgagagaaaagtaaaggtcctctgcatgcaattcgaagattgacatggatcccaanggtacggtccatattacccattcactcagttgacttcagttcagcagtactgtagtttgg

SEQ ID NO: 8549 - DNA, 121 bp, Artificial Sequence
  Synthesized
  misc_feature (61): n=c or g
catctctaactcatcatgcttattccatgtattagtataaaggcattttagagataaactnaaatttgtttacttccttgaggttttgtgggaatgctctgtaattatgtcttgaaagctc

SEQ ID NO: 8550 - DNA, 121 bp, Artificial Sequence
  Synthesized
  misc_feature (61): n=a or c
ctgtggaacaatctgaacttcagaatggtgtgcagacttagcaggttgatttcagctcatntaagcatccagaaattggcaacttgtcctgaatttgctacctaagcttccttctgtagtc

SEQ ID NO: 8551 - DNA, 121 bp, Artificial Sequence
  Synthesized
  misc_feature (61): n=a or g
tcttaagtaagtactacctctaggaacacacatcatcccacagtctgactgtacaaaatcntttatgtagtgtgagaaatatgcagccctggattagacaagatattgaatgcagttgtac

SEQ ID NO: 8552 - DNA, 121 bp, Artificial Sequence
  Synthesized
  misc_feature (61): n=t or g
gcctgtgaaagaaatatgtcaggaaatggatccacagtgttcatcttcaaggaaaaaatcnatttattgtagcagcatttctactggcagttacatcaaccacaggctgggagacgtagag

SEQ ID NO: 8553 - DNA, 121 bp, Artificial Sequence
  Synthesized
  misc_feature (61): n=t or g
tctctccattcactacagtaggagccagtgtttgggtggaggcacctgggctgaggccacncaggtacgtcccattttaaactaagacaccaaacacagctatctatctgtaggtatgcaa

SEQ ID NO: 8554 - DNA, 121 bp, Artificial Sequence
  Synthesized
  misc_feature (61): n=t or c
caataaaaactgcctatgtcccgtttatgcaaattttttggtagatgattaatagcattancatgttctgagcaaagatctaggtttcaaactggacgagctgataaataaagccaactat

SEQ ID NO: 8555 - DNA, 121 bp, Artificial Sequence
  Synthesized
  misc_feature (61): n=t or g
acatcaaaacctaggtgtaaaacaaacttctctggtttgatgtcatcaacattttccatangcagcacatgggtgagaacagcacaaaagcagcaagaagcaacatccctgtacagaggca

SEQ ID NO: 8556 - DNA, 121 bp, Artificial Sequence
  Synthesized
  misc_feature (61): n=a or g
ctcctttccaatgactggcccctgtagtgctccgtggagaggggtgacaacttgctgacgnaaaccatgagggcagttccaggtgaatggacctcttgtagtttcctcaggaacattgttt

SEQ ID NO: 8557 - DNA, 121 bp, Artificial Sequence
  Synthesized
  misc_feature (61): n=t or g
aatatttgctatatagccttggtgacactgtcatttaaacagtctgtatttacctgtaaantaatagttatacaccttccatcagcagcaaaaagctctcaaaaaccgatacttgaaagtg

SEQ ID NO: 8558 - DNA, 121 bp, Artificial Sequence
  Synthesized
  misc_feature (61): n=t or g
cttgaaagctgtcggaacatcatcctctaaacttcaggctaggagataccaaccaggtcangtcatcctgttactactgctgagaaacgaactcagctctaaactgagatgcaaaggtaag

SEQ ID NO: 8559 - DNA, 121 bp, Artificial Sequence
  Synthesized
  misc_feature (61): n=t or c
ttttttgtaacagtctaaacctgtacttttcaaactgtattcattttgtagccctctgaangtcttcaagcagaggtgcaagtctctgtgtagtaaattttagcctactgagaaaatgctt

SEQ ID NO: 8560 - DNA, 121 bp, Artificial Sequence
  Synthesized
  misc_feature (61): n=a or g
taaatcactgtgttttgccttcccttcatgtgccttactctggtcacatacttttgcaaanaatgatgctggcatactcaaaatcttgcctactgctctcgcctcaaatgtgaaatcagtt

SEQ ID NO: 8561 - DNA, 121 bp, Artificial Sequence
  Synthesized
  misc_feature (61): n=t or g
ccacagaggaggtgaggccttgagagtgcacttaaccgtgatgtgcttctcatcatttctnattttcccatcgttttttctatcaatgctttgcttcttcctatatgctcaggtgcttggg

SEQ ID NO: 8562 - DNA, 121 bp, Artificial Sequence
  Synthesized
  misc_feature (61): n=a or t
aagttcagttcagatataatttaaatgcaaatctgtggtttttgagcttacactacacatnaatgacaccaaatcaaatggtttcttaagctgactgagaattgatttactcccttcaggt

SEQ ID NO: 8563 - DNA, 121 bp, Artificial Sequence
  Synthesized
  misc_feature (61): n=a or g
gccaccactgtttccaaattcattagatgcttctaagaatcctcacattcaatttatgcanttcatgccactgtttcattgcttttatcttaaaggttttatgtttttttcccctccacag

SEQ ID NO: 8564 - DNA, 121 bp, Artificial Sequence
  Synthesized
  misc_feature (61): n=a or g
gatgaaatagaactatccaaatgtttcttgtgctgaaccatcaaaaaccatctgaaatccnaaacagctctgggtaaacagaggtgaggatcagcctcttttcaagtgtaactatcaataa

SEQ ID NO: 8565 - DNA, 121 bp, Artificial Sequence
  Synthesized
  misc_feature (61): n=a or g
ttgataacattgcaaaagtagattaactcgcaaaagcggcatgtcttgaacaaaacatacntaacatctttatccctagtgttaaacaatttgttgtctttcagatgggaatctctctaga

SEQ ID NO: 8566 - DNA, 121 bp, Artificial Sequence
  Synthesized
  misc_feature (61): n=t or c
tctaaaggagtcatttaggggaatacattaagtgatgtagaggcaaaaggaagggagcaangctgcccttcatctagagctttctgtttacacctctgcatgtgcaatacacactaccact

SEQ ID NO: 8567 - DNA, 121 bp, Artificial Sequence
  Synthesized
  misc_feature (61): n=c or g
agacaaactttatgttctgtttaatagcagagctggaggatgtgagctgtgctgagagagntctcaaactttgttaaaatgtgtggatatctgattttagttttttattctttcccccttc

SEQ ID NO: 8568 - DNA, 121 bp, Artificial Sequence
  Synthesized
  misc_feature (61): n=t or g
tttcccttcctctttttacctccttgagctgcatctacttcagggcaggtttgtctcctgnatgtggcttttacagcttttggcttgctatggatgttggctatttgtcaaaggaaaacat

SEQ ID NO: 8569 - DNA, 121 bp, Artificial Sequence
  Synthesized
  misc_feature (61): n=t or c
cctcaggtgtttcccgagggctcaatttcatggcagttcctgaatgccacatctgaacagntctgaagagagcatcagctgaagcaaaaaaaaactgcttcatgtcattgtttttacagca

SEQ ID NO: 8570 - DNA, 121 bp, Artificial Sequence
  Synthesized
  misc_feature (61): n=t or c
actggtggaagagcacaacaggacggcttggagcagtgattaatctgaacacgagggaatntcctgaaagataaaatgtttccatcagcacaagcactgagggctcagaactaccactgca

SEQ ID NO: 8571 - DNA, 121 bp, Artificial Sequence
  Synthesized
  misc_feature (61): n=a or g
attaaaaaaaaatcacatatttacaagtggtaccatcaagtgtccaacagcacagtggcanaaacagtgagaggaagatagacggctggatggatcacttgttctggtgatacagcttaaa

SEQ ID NO: 8572 - DNA, 121 bp, Artificial Sequence
  Synthesized
  misc_feature (61): n=t or c
ccacagacgggatgaattgccacctctctgacgacagtactgggcaaagaggggaccttangcttcatacaagaagcatgaatggagaaggagcaagaggggcaattcttatctgaagaat

SEQ ID NO: 8573 - DNA, 121 bp, Artificial Sequence
  Synthesized
  misc_feature (61): n=a or g
ctgtggtctctgtattatacttgactgtgcagatactgtttagacatactcataagccttngaataatagaaggacagctgtatttggtctggacaaatccagccagtccagtgttctctt

SEQ ID NO: 8574 - DNA, 121 bp, Artificial Sequence
  Synthesized
  misc_feature (61): n=t or c
caagcacttggcttaaactgcctgagcccagccttttcctcctgtttccaggtgctgcagnttaccttgtacaaagctactactgctcagcctcttcagaaacagacttggtcatcatgcc

SEQ ID NO: 8575 - DNA, 121 bp, Artificial Sequence
  Synthesized
  misc_feature (61): n=a or g
gctgattctcaagaggtgtaacacaaataacagaatgaattcaaaggctaaagctaataantaatataatcctctgtagatggcatatggagctaaatgccccgttggacgtttcacttac

SEQ ID NO: 8576 - DNA, 121 bp, Artificial Sequence
  Synthesized
  misc_feature (61): n=t or c
ctactggaagcaaactgtggagtttatcagaagatgagtttcatcggcattcctgtcagangcagaaccacgttcaggtcaattttggaaatctccaagaagaccacacagcctctgggca

SEQ ID NO: 8577 - DNA, 121 bp, Artificial Sequence
  Synthesized
  misc_feature (61): n=a or g
gcatatttacattcatgcagctgtctctttctcctcttgcagaacttgagcaaaaacacangtgtcagagtaagtaagtcatcctggaaagagatattattgaaataactgttgtcagaca

SEQ ID NO: 8578 - DNA, 121 bp, Artificial Sequence
  Synthesized
  misc_feature (61): n=a or g
tgcatgtgggagcagtgacctaaagccaacactactgaactgctgctaacactgctccacntgaggtggctgcagactggctctcatcacaccgtgaaggagctgtgggacactatccagg

SEQ ID NO: 8579 - DNA, 121 bp, Artificial Sequence
  Synthesized
  misc_feature (61): n=t or c
agtggtgcagagaggaaggcttggttcacttcagagcatgctggccagagctggaccctcnttgatgaagaatgaagagcatccaagaactccaatgcatctgtcctgtgaggaaagattt

SEQ ID NO: 8580 - DNA, 121 bp, Artificial Sequence
  Synthesized
  misc_feature (61): n=a or g
tctttagcagtctcttgtgttttcctctcccttcagctgcagttacagttgcttagatccnggcaccttgaattaggatatctctgaatgcatcaaaaatatcaaacttgtgcctgtacaa

SEQ ID NO: 8581 - DNA, 121 bp, Artificial Sequence
  Synthesized
  misc_feature (61): n=a or g
gaagtgcagaaatcaacagagcacagaagagtttgtgattcttataaatctaaagaggcantatttgcaggagaatggatccctgataggagatgagatctcttagtaattcagatacagc

SEQ ID NO: 8582 - DNA, 121 bp, Artificial Sequence
  Synthesized
  misc_feature (61): n=t or g
ctctacctttgtattccaacagctgtctgaatgctccagctttgctaggtggaaccacagnattgttgtgatcaagtcccagcacctgcctaccaatatctctggtgttctccaaggagtt

SEQ ID NO: 8583 - DNA, 121 bp, Artificial Sequence
  Synthesized
  misc_feature (61): n=t or c
gcttagaggctcgcactgaaaagcacatccaagttttggtgctttatgtgacaaaagaatncagcgtggccaggttttctgcacagtgatattctttcacatgctttccaatgagatggac

SEQ ID NO: 8584 - DNA, 121 bp, Artificial Sequence
  Synthesized
  misc_feature (61): n=t or c
tactctgacaaagcaatgctgaacaatgaacacgctctgagaaataacataccatgttaangtagcttcagcagcatccttcactctcatggatgcagggtttggctccttatctcctttg

SEQ ID NO: 8585 - DNA, 121 bp, Artificial Sequence
  Synthesized
  misc_feature (61): n=t or c
atctccattttctagcccatacacacttcaaacaagacaccagactacatccagttcttangtgcactgtgtaggattctcaaacagatcataatcaatgccgacttcttgctttcaaagt

SEQ ID NO: 8586 - DNA, 121 bp, Artificial Sequence
  Synthesized
  misc_feature (61): n=a or g
accccatgggctgcagagtacctgaccgacatcagcgctgtgctgagagcatcactgtgcncatacccctgcccctgcaaagggtgaaggcacctgcagcacccggacagacaacacttag

SEQ ID NO: 8587 - DNA, 121 bp, Artificial Sequence
  Synthesized
  misc_feature (61): n=a or g
aagagcatgaactcagcactcggctgttttgtgggcagtgcagaactgacacaacacaacnatctgcccacaggaaagtgggtaatgtgggtgggaggaagggacagctgagggttatggg

SEQ ID NO: 8588 - DNA, 121 bp, Artificial Sequence
  Synthesized
  misc_feature (61): n=a or g
gtgagaattcttgcttctgatgcgttcagaaacattttaatgatcagttttaggattttancaagtgatttttctgagaggcattacagcaaaaatcctctacacctgctcacctctacag

SEQ ID NO: 8589 - DNA, 121 bp, Artificial Sequence
  Synthesized
  misc_feature (61): n=a or g
ttgctatatcactctgaaagaaactcagtactgacatgaccaatgaaactgaaaaattagngaagaaagctaagagagggttacaaaactccacccctggcttcagcacaaaggaaggcaa

SEQ ID NO: 8590 - DNA, 121 bp, Artificial Sequence
  Synthesized
  misc_feature (61): n=a or g
gctccagttgggatgatgggggacccacagaaccagaacagctgctggcaatattggagcngtcagtctgtgccaggtccccacacttcaaagtagaaagacgcactgcccaaaaccacaa

SEQ ID NO: 8591 - DNA, 121 bp, Artificial Sequence
  Synthesized
  misc_feature (61): n=t or c
tgccgacccctcctcagcacccacagacatcccagcacctcctgctttgcttttacgagcncaccccaagcagcatcttgacccacatctaccagctctctcaatgccgtgcgcggggagc

SEQ ID NO: 8592 - DNA, 121 bp, Artificial Sequence
  Synthesized
  misc_feature (61): n=t or c
cagaacgtgttaaatgctgggaataaacactcctagttgaaaataaccttgcaggatatgntgagaaagggggaaagcaggttctagcagtcacaattcatggttgccaggcctgtgcaca

SEQ ID NO: 8593 - DNA, 121 bp, Artificial Sequence
  Synthesized
  misc_feature (61): n=a or c
gcttggacagcaaacattcccattacttccacctttatgtgagatcacctttttcagagcnagggaaccacgaattcccatggcagccctgagacaacaagcctataatgcagcttcaggt

SEQ ID NO: 8594 - DNA, 121 bp, Artificial Sequence
  Synthesized
  misc_feature (61): n=a or c
actaaacaaaaggttacaaagaagtcatgaccaatatctgtgtgttttttccccaagtaangttatccattattatgatgtgcatctgtcttgtcagtgcagaagctagagcaattggaag

SEQ ID NO: 8595 - DNA, 121 bp, Artificial Sequence
  Synthesized
  misc_feature (61): n=a or g
agcagctctgcgagggctctgtgtggtgaggcagaggagggctggctgtatgtgagaagcnatccaaggatttcaaataaattttaaactttaaatacagcgaggaggcctctttgatcaa

SEQ ID NO: 8596 - DNA, 121 bp, Artificial Sequence
  Synthesized
  misc_feature (61): n=a or t
cttgctatggcagaggaccaaagctttactgcccatcattgttaggggtatttcacctgcngttaccagcagaaccaacaggattacataaaccttgttttgtgctgtgggtttgccctgt

SEQ ID NO: 8597 - DNA, 121 bp, Artificial Sequence
  Synthesized
  misc_feature (61): n=t or c
caaggagggggacagtgagaaacttctggtgggatccgagaagcacctctgtcagtccagngttgtttgccagtagaatctcacagggagcctttccccttcccaccatcccctcgtggta

SEQ ID NO: 8598 - DNA, 121 bp, Artificial Sequence
  Synthesized
  misc_feature (61): n=a or g
tgagccaccgtagctattgcagtgggcaccaacgtggccagaaccaccttgggacgtttcntatggaaactccatggtttgtaactgtgagctttcacgagatgactgggtacaccatgaa

SEQ ID NO: 8599 - DNA, 121 bp, Artificial Sequence
  Synthesized
  misc_feature (61): n=a or g
gtttgtagggctcagcgttactggtgttacagttcagtacagccagcatccactgacaggnctcaggtggacagaaaggtgaagttacttaattgatctgttgttgttgaaggtgttcagt

SEQ ID NO: 8600 - DNA, 121 bp, Artificial Sequence
  Synthesized
  misc_feature (61): n=t or c
ctttctcttactgcatttctgctatatgtaaatacacacacaaatactgagggaagcaagnggttggatgtcagatttgcactaagtgaaggtggaagggtattaacaagagagttaaatg

SEQ ID NO: 8601 - DNA, 121 bp, Artificial Sequence
  Synthesized
  misc_feature (61): n=t or c
tggatttttagctatgctcattttcctctcagctttctttcacctgacaaagaatagatgntccttcttaaaagattcagctacttttgtactataggaaaataatcttgtgtctgatttt

SEQ ID NO: 8602 - DNA, 121 bp, Artificial Sequence
  Synthesized
  misc_feature (61): n=t or c
cgtaaaataataataattttaaaaaagagttaattaactcaaggcttctttcctggagtgngtactctcaaaccatcagcgtacactgaaagcattacttctaatgcttttttttggtgca

SEQ ID NO: 8603 - DNA, 121 bp, Artificial Sequence
  Synthesized
  misc_feature (61): n=t or c
agcagcagcacagattcagcacattactgaggccaggatggcccctccagcaatgagtcanggcaataagcccacgtgtgctgaagcactgctgcctcctgtgccagcacgcactgctcaa

SEQ ID NO: 8604 - DNA, 121 bp, Artificial Sequence
  Synthesized
  misc_feature (61): n=t or c
tgaaggaattgtggtggggatgctttgcagttgtccataaaaaccaaaatctgaaacaagnaaacattttgcaggactctgggttttgctattaaccagccttgcagtcagcatcttggta

SEQ ID NO: 8605 - DNA, 121 bp, Artificial Sequence
  Synthesized
  misc_feature (61): n=a or g
tgttcccacaacaatccagattctgcctaagaatcaggtttcaagggtccaaaacatttcntcaggtcagaagttttacagccttctgttactgccccttcaaacaaaatgaaaggggctt

SEQ ID NO: 8606 - DNA, 121 bp, Artificial Sequence
  Synthesized
  misc_feature (61): n=a or g
agtgactctgaaaataatattgtgatagcaaactcaaagggaaaatgtcagttagttccanggagctgcatgttcccgcactcgagttcagaaatgtctgctcagaagacacgcacaattc

SEQ ID NO: 8607 - DNA, 121 bp, Artificial Sequence
  Synthesized
  misc_feature (61): n=t or c
aatggcataaacagcccattaaaagtagtacgagtagtttgttctaggaagaaaacctaanagtgacagaaattctaacagtgtagcataatcaaatcctgacatttcaaattcattattt

SEQ ID NO: 8608 - DNA, 121 bp, Artificial Sequence
  Synthesized
  misc_feature (61): n=a or c
ggaaaagactgctaatgtgagggttccttgggaaatagagaggcagaactaaaatgtccanaaaaaaatactaaagcaagtattccacataatatcaaaatcagttttcaaaactaaatat

SEQ ID NO: 8609 - DNA, 121 bp, Artificial Sequence
  Synthesized
  misc_feature (61): n=t or c
ctgtcttaaagcaaaattgtttgctagacagtaaggaaaaaaaacattttgaggacacttntcctttttcatttatctatatacttcagccaggtatagtttcaggaggtccaagtgcctc

SEQ ID NO: 8610 - DNA, 121 bp, Artificial Sequence
  Synthesized
  misc_feature (61): n=t or c
tgccaatagaactcaatgtaagtgggtatcattttcagcggacaagaggagcaacgtgttntatgaccttggattaatctctgcattttgctaaacatcaatagcttgaatcagttctctg

SEQ ID NO: 8611 - DNA, 121 bp, Artificial Sequence
  Synthesized
  misc_feature (61): n=a or g
aatgtgtcagttttgttctacatcaaatatttccaagtttgttatttttattctggtagcntgttggtaaactgaaggataaggccagaaaaggggaatgattgagactcaggattataat

SEQ ID NO: 8612 - DNA, 121 bp, Artificial Sequence
  Synthesized
  misc_feature (61): n=a or t
attctttcctctttgtagctggaaatcatctgtttgcagttatttccctaagtgttagtgnggaagtttagggcctttattttgtgtaggtttctgtctgttttctctttctccctctact

SEQ ID NO: 8613 - DNA, 121 bp, Artificial Sequence
  Synthesized
  misc_feature (61): n=t or c
cccaactctagaaacaaatccacacaactcccactgacttcaacatcagtctagactttantggccactcagcaactgttgtagcctaaatgggaataaatacttgtccccagtgagtcac

SEQ ID NO: 8614 - DNA, 121 bp, Artificial Sequence
  Synthesized
  misc_feature (61): n=a or g
tcttacagatacattattaatatcgatcccattgctgatcacattcaaaaccagcgagagngagaaggttcatctcacaacgagcgatacacctcgggggtcggaaacatgggtgtgaatt

SEQ ID NO: 8615 - DNA, 121 bp, Artificial Sequence
  Synthesized
  misc_feature (61): n=t or c
agcctggccctggggcaggagtaccatggctctctccagccatgcagccactcaatctctntacttcccctgtatttattaccctctgaagtgcagctctggtatggagggcacttctcca

SEQ ID NO: 8616 - DNA, 121 bp, Artificial Sequence
  Synthesized
  misc_feature (61): n=t or c
tcttatttttttttcaattagaaatgagtatagaatttaccattcaggtataaagtgctantaggaaatcagctcttcttaatgtatccatccagttgttaaagtgtccccttctctactt

SEQ ID NO: 8617 - DNA, 121 bp, Artificial Sequence
  Synthesized
  misc_feature (61): n=a or g
caacattcttgctcatctgtcactgcttctaatgtaaatttaaaaggcatcccagacagcnaggattaagtttatttttaaggaaaataaaaaataaagataccttttaaattactcaccc

SEQ ID NO: 8618 - DNA, 121 bp, Artificial Sequence
  Synthesized
  misc_feature (61): n=c or g
ccagtgttaaaggttcgggagactttaatgtatgctgcatgtactgttcttgtgacttttntcatccaaatagtgtgaagaacaacttgggttgaaagggactttgggggaaggaatctgg

SEQ ID NO: 8619 - DNA, 121 bp, Artificial Sequence
  Synthesized
  misc_feature (61): n=c or g
tggggtgctggggttgcaatgcctgcacacatgagcagttttcccttcagcctcttgcatncaggctaaacaaccactgctcacggccagcatcttcagggcacacatctcctcccagctc

SEQ ID NO: 8620 - DNA, 121 bp, Artificial Sequence
  Synthesized
  misc_feature (61): n=a or t
atagtgggcatcacccaaagtctggaaaagatcgaagtgagatcaaagctaaattttgtcntaatataacatattaagccaagcatactaagttaaaactctcagcagtcgcacccatttc

SEQ ID NO: 8621 - DNA, 121 bp, Artificial Sequence
  Synthesized
  misc_feature (61): n=a or t
catagagaacagtacaggtaatttgcttctggtctcctcctgtttaactacagagagaatngaagaggttaggctttcctgaaagtttgacatatgggtggcatgtgacagtgacaggcgt

SEQ ID NO: 8622 - DNA, 121 bp, Artificial Sequence
  Synthesized
  misc_feature (61): n=t or c
ggtaccacactactgaatcgaaattgttgcaagaagagctggtcaaataaaacagctttanaaaggacagttcaacgatacagtggtccttcaccaacagcacccagaagaaacattccat

SEQ ID NO: 8623 - DNA, 121 bp, Artificial Sequence
  Synthesized
  misc_feature (61): n=a or c
tgccaaattgtgctccctcggagggctgctcagctctgctgaggctgcagaatgttgcagnaggtaaagaaatcaatcagctcctgccaggaaacgtgggaaggctggagtgtgcctctcc

SEQ ID NO: 8624 - DNA, 121 bp, Artificial Sequence
  Synthesized
  misc_feature (61): n=t or c
aaaacctcagctttaaagtttgttgagagaagccaagaagggagaaggaagcagattagangagaatgttttcgactgtacccagcaaagaaaatatcagactcaattttctatggcttat

SEQ ID NO: 8625 - DNA, 121 bp, Artificial Sequence
  Synthesized
  misc_feature (61): n=a or g
agatgccccagttgttgctttattgataaactttagatctggtttgcacagctgacatagnaactggaaagccaaaacttaagagtctagaggaaaaaaaaagggtggtttatttatgaaa

SEQ ID NO: 8626 - DNA, 121 bp, Artificial Sequence
  Synthesized
  misc_feature (61): n=t or c
tgctatgaatgttatggtagaacttaaacactacaaagtgggcagagtactgcttccattntgaatgaaaactggtgcaccttatgcttcctgccatttgccaaatcgctgctgaaagaag

SEQ ID NO: 8627 - DNA, 121 bp, Artificial Sequence
  Synthesized
  misc_feature (61): n=c or g
catacctgctggaggggatatcggcagcatgtcaggggaagccaaatgcttaaaagtaaangtaatgaaaggggttcttcacatatggaggtatcaagtgaagaaaagctagcgacagaca

SEQ ID NO: 8628 - DNA, 121 bp, Artificial Sequence
  Synthesized
  misc_feature (61): n=t or c
tctccaaatatttgcatttttgctgacaaggttcactctcgccaggagatttcccttcccngtgagcaatctgcccgtggacgagatggtgggtgggtgggtgagccagtttgtaacccag

SEQ ID NO: 8629 - DNA, 121 bp, Artificial Sequence
  Synthesized
  misc_feature (61): n=t or c
cagccttagcatcagtaacagaacaggaagagagctgcctctgcttttgaacagcggcccngcagatctcagcatgcccatcacagctgtctgctgttgcctaaatgaatgcactcagcca

SEQ ID NO: 8630 - DNA, 121 bp, Artificial Sequence
  Synthesized
  misc_feature (61): n=a or g
caagaggatgctttgccattcaaacggctggcggaggaacatacatcaaggatcaaggganaaagcagcagtagctgcagcataccctcgaggcacagcgcaagggtagcagtacaaacca

SEQ ID NO: 8631 - DNA, 121 bp, Artificial Sequence
  Synthesized
  misc_feature (61): n=t or c
gctgcacctctaggttgaagtggagatggatgagttttgcactgatagcactcagccaganttcagagggacatgtggagtgtccttctttcctggagcaatcaaggctattcctggaatg

SEQ ID NO: 8632 - DNA, 121 bp, Artificial Sequence
  Synthesized
  misc_feature (61): n=a or t
aaaaatgaaagcaggattaacgagggcattccagcaaattggagagctaattattaccctnatatcagtactgaataatggctgctgatgttcatgtggcacttttgtatgtttttgctag

SEQ ID NO: 8633 - DNA, 121 bp, Artificial Sequence
  Synthesized
  misc_feature (61): n=c or g
tctgttcatcattggcaatgcatgagctcccttgtaaatgagggatgggtttgaaatgatntttctctttgaggatttccaaatacagttgtaccttgttctgggcacaaactaaagtgaa

SEQ ID NO: 8634 - DNA, 121 bp, Artificial Sequence
  Synthesized
  misc_feature (61): n=t or c
ggttggactaacaaaggctttgaacagtcatctctaccttaaatcttttactgacacaaanaacagaaataacaggctgtcttagagcagtctttgattataggaatggaaggctggcttt

SEQ ID NO: 8635 - DNA, 121 bp, Artificial Sequence
  Synthesized
  misc_feature (61): n=t or c
gagcagaactgcacttgggcaatctgttttacctcacagggtatatatgagctctatatgngcacaggctgcagagatgcttcccaacaaggcaaggatcccacctttgccaagcactcaa

SEQ ID NO: 8636 - DNA, 121 bp, Artificial Sequence
  Synthesized
  misc_feature (61): n=t or c
acatctggaccaccatctcagttacagaatgacccccagtggtactcagcaacacccaaangtgacctcagcaggtattggtgagaggatttattccagctgaccccatctttgctgctgc

SEQ ID NO: 8637 - DNA, 121 bp, Artificial Sequence
  Synthesized
  misc_feature (61): n=t or c
gaaaggtaatctggttggtggatggcagtattctacgttttctggctttctggtctttccnctgtaaagtcaattttcctgtgacgttcgtccagttgtggagtcgtcattgcttctgtca

SEQ ID NO: 8638 - DNA, 121 bp, Artificial Sequence
  Synthesized
  misc_feature (61): n=a or g
aaacataggacttctggatggagatcatgaattgccctcccagttgtttgtccaagctcantgtcactgcaaaccctggacacagtcacgttattgagatgtctctgacagtcagtcaatg

SEQ ID NO: 8639 - DNA, 121 bp, Artificial Sequence
  Synthesized
  misc_feature (61): n=t or c
caacactggtgcagtagagagactgcacaaggcacccgtactgaaatctggggtaagcagngagtgtaggagggcagcaaggagctcacatgtgagctagccacagagagctcttatttag

SEQ ID NO: 8640 - DNA, 121 bp, Artificial Sequence
  Synthesized
  misc_feature (61): n=a or g
ggaattctgttttgttgactgctgcttatttaatactactactagaacagtcctccaagtntagtgccaaaatccctacttccaaagatgtgcagtttttcctagatgttttatttcagta

SEQ ID NO: 8641 - DNA, 121 bp, Artificial Sequence
  Synthesized
  misc_feature (61): n=a or g
agcctttctgacctttagcttttaagtaacagcaaattctcccaccaggaaacgttgctcngtggaagtgtgagggctggcggatgaacctgcataacggccatacagattctatttattt

SEQ ID NO: 8642 - DNA, 121 bp, Artificial Sequence
  Synthesized
  misc_feature (61): n=a or g
cctgcagtgggcacgtggaagtgctgccatccaggaaacgtctctcagatggccgataacnctttgtttaaacaaaagaatgcttctgctttattacaaacgctcccacggattaaagatt

SEQ ID NO: 8643 - DNA, 121 bp, Artificial Sequence
  Synthesized
  misc_feature (61): n=t or g
attgtattccacctgagagaaggaggaggtctggcaggtctcacactgctggtagcttccnttctgtctctggcagggctcagggaagcataagccccactgtgggctgcctctgagggct

SEQ ID NO: 8644 - DNA, 121 bp, Artificial Sequence
  Synthesized
  misc_feature (61): n=t or c
tttatctcctctgcatccttttcaagactgctgagggaatggcagccctcactttgaccangagcagtggttcagacaggctcccctctgcactctgaggctttattcagatgccacttcc

SEQ ID NO: 8645 - DNA, 121 bp, Artificial Sequence
  Synthesized
  misc_feature (61): n=a or t
atcgatctcttctaccagcgttaagagacactcttcctagggaataaagaagtaccagcangcactgcaacatcgaatgtgttagaggggatgaaagggatggatgaggaaccacggggca

SEQ ID NO: 8646 - DNA, 121 bp, Artificial Sequence
  Synthesized
  misc_feature (61): n=t or c
aggagcacaaaacttgcatgtctaaaaaccagagacttctgttccatttttggcatcaacntgggtttaggcactcgagttgaggtccttgtttgaaagcagaggttttaaacagacagcc

SEQ ID NO: 8647 - DNA, 121 bp, Artificial Sequence
  Synthesized
  misc_feature (61): n=t or g
ctcgtgtaaaataataaatccatgtaaattgctccatctcttcaaaaggctgccagtaccnccagctgccctcagagcacataggcgcacacgtgcagagccaggtaaagcagctctgttt

SEQ ID NO: 8648 - DNA, 121 bp, Artificial Sequence
  Synthesized
  misc_feature (61): n=t or g
gcaggaagagcagggcactgctccagctctgctcatcactgacacgttagcagtgctttgngcttttgcagattttcttcactggaggaatttcacaaaccaagactagctattaaaaaag

SEQ ID NO: 8649 - DNA, 121 bp, Artificial Sequence
  Synthesized
  misc_feature (61): n=t or c
tggttaacttagttacatgttttttgtcaaatgagccctaggcaatatgcatacatacaanacgtggttgcaccacattcatgtgggcttatcagatctcctcaaaagagcatttattagc

SEQ ID NO: 8650 - DNA, 121 bp, Artificial Sequence
  Synthesized
  misc_feature (61): n=t or c
cagcgctgcaaactgtgcgtgctgatcctccggagctgggattggtgctggaaacatcctncctgagagcagcacatggaacccaacctgtgccagccctcctctgctcctaccgcgtccc

SEQ ID NO: 8651 - DNA, 121 bp, Artificial Sequence
  Synthesized
  misc_feature (61): n=a or g
tccatcaggtgcataaataatccttgattttatacttgcagattgggcagtgactcaccantataactgcttccagtctgtcccactcctgtagctcataagctgttaattttgctggttt

SEQ ID NO: 8652 - DNA, 121 bp, Artificial Sequence
  Synthesized
  misc_feature (61): n=t or c
tgcttctctttcatttttctcgccttgctgatcagcttgtcagagacagagttgggaactnggatgctttagatccactctcatgcttttgagagtaaattctcttgcttatcttgtacta

SEQ ID NO: 8653 - DNA, 121 bp, Artificial Sequence
  Synthesized
  misc_feature (61): n=a or g
ccttcctgagctcccagtttgagctttataaagcgactgctgcttgagcatctggagcaanagagtatttgaaaagctctgaatgaagagcaatgaatgtagctcaacaaatccagcattc

SEQ ID NO: 8654 - DNA, 121 bp, Artificial Sequence
  Synthesized
  misc_feature (61): n=t or c
tgacttgaatatagctctggatctccaagtgttcagaacatctatggagatcctcatgtgnatcaaaagtagaatctgtgtgttcgctgccagaaggcaaagggaatggtatcttctttta

SEQ ID NO: 8655 - DNA, 121 bp, Artificial Sequence
  Synthesized
  misc_feature (61): n=a or g
ggaaggacttgtagagctgatgagggcactctgtgcgcctgccttaatagatagggaaagnataactgcagttcctggtgaaattatggaaggaaatgcagctcagtgtagatagaaaaga

SEQ ID NO: 8656 - DNA, 121 bp, Artificial Sequence
  Synthesized
  misc_feature (61): n=t or c
acatctggttctggacctttctgctgtgactgttggagagaatgaagctcagagggtttangacgatgccctgaaccacgcagcccctgtctgcagttgtgtatagcagctgagggatgga

SEQ ID NO: 8657 - DNA, 121 bp, Artificial Sequence
  Synthesized
  misc_feature (61): n=t or c
atataacaatctgttaaggagcaatttgggttattcgtgtttgaagaacggagttttgcgntagcagaatctgcaaagataattcctcttccagatgagctctggaaaaccattcaagagt

SEQ ID NO: 8658 - DNA, 121 bp, Artificial Sequence
  Synthesized
  misc_feature (61): n=a or g
cccttagcagcagtcacacctcatcccatacacatacttgtttggttctggaacgtaccantacttactgattgttgttcagatgatagaagcttcatttagtgttgtgagcaaagaaata

SEQ ID NO: 8659 - DNA, 121 bp, Artificial Sequence
  Synthesized
  misc_feature (61): n=a or g
ggtgcaggacatgatttctttcttgccttctggagcttcgattgttcaataattgaatgangagcagaagttaaattccaggctgctagaagttgcactgaaggagagctgcttgagattc

SEQ ID NO: 8660 - DNA, 121 bp, Artificial Sequence
  Synthesized
  misc_feature (61): n=t or g
atgttagtggcagaatacacactaatgttgctgtgctatttttcctgccttctgatttctntgtctcacgtaggtatattcctgctattgtggaccacactggatgcctgccttgtcaggg

SEQ ID NO: 8661 - DNA, 121 bp, Artificial Sequence
  Synthesized
  misc_feature (61): n=a or g
ttggatgtcttgagcctggggagaaaaccacgtctgggcttttgagaggcagctcctgcantccgacagcagcacttccagaagcactgcgatgactgatcacagacgattcaggtgtaat

SEQ ID NO: 8662 - DNA, 121 bp, Artificial Sequence
  Synthesized
  misc_feature (61): n=t or c
aatggagttgatgtgatcgtcaggctgcagatccccctttacagacctcaatttatcaaangtttcaccttgaaacacttagtatgttatttccagttatgactaccatgaacaaagaaat

SEQ ID NO: 8663 - DNA, 121 bp, Artificial Sequence
  Synthesized
  misc_feature (61): n=a or g
ctaccctgtaaaaggcaaggactgaaatcaatagctttattaattcaaatcctatacttantgttgttgcttaggattcagaatcaggcttcatgttcaaagcgttatcagcacattagcc

SEQ ID NO: 8664 - DNA, 121 bp, Artificial Sequence
  Synthesized
  misc_feature (61): n=a or g
atatttcttacaacatggaagctactaactttcagaataaaacacagactgtgaagctaanttactatatgtaaaagagtgtgtgcaaaatgctctgtagtggtggagagtgggaacatga

SEQ ID NO: 8665 - DNA, 121 bp, Artificial Sequence
  Synthesized
  misc_feature (61): n=a or g
caagaaatctcatgagcaccaatctggaatgatgtcccttacgcgctatgaagctcggatntttcataggagattccccatttgcatcagagaagggatcagtcacttccctccccagcct

SEQ ID NO: 8666 - DNA, 121 bp, Artificial Sequence
  Synthesized
  misc_feature (61): n=c or g
aatggggttctgctgcaaggaaagggccacctgaatgaaagtggggcggcacagtcggatnagttctgctccagcacgtgcttctagggccaggttgttacagacacttctgctgtgccct

SEQ ID NO: 8667 - DNA, 121 bp, Artificial Sequence
  Synthesized
  misc_feature (61): n=c or g
agatgttcccaagcacccttgtgtcatgaccatgactatttggttaccaagccatgacttntagcttaaaataccccgagactgctgtgcatggggcaggtcaagatggccgtcaggggat

SEQ ID NO: 8668 - DNA, 121 bp, Artificial Sequence
  Synthesized
  misc_feature (61): n=t or c
caaagctcagaccggcagagcagcagggatggacgggttatgtatagggagagaaaccaangccccaaagtccagcccacagtaatgccttccctccctctagttccctgtttggcaggac

SEQ ID NO: 8669 - DNA, 121 bp, Artificial Sequence
  Synthesized
  misc_feature (61): n=t or c
agggcagctgccagtcccaaagacattcacagtgcacttccagaggcaagctttcctgcangaagctgacattaagctgagagttcacaggtcagaagcgctttggatctccttactcctg

SEQ ID NO: 8670 - DNA, 121 bp, Artificial Sequence
  Synthesized
  misc_feature (61): n=t or c
ggacctatctgtggtccacaaccactcttcaaaagaagccagtgcagctgccttaaaacanagccagaggaggatgtagtaacctaatggcatatactcaggaagcaagtttgcttcctgc

SEQ ID NO: 8671 - DNA, 121 bp, Artificial Sequence
  Synthesized
  misc_feature (61): n=a or g
gccctgagcaaaattaggctttgagaaagacttgccaagaaaagccatcagaatggaacanctttctccataagagtggttggcactggcacaggctgcccagggcggtggtggggtcact

SEQ ID NO: 8672 - DNA, 121 bp, Artificial Sequence
  Synthesized
  misc_feature (61): n=a or g
tttctgtcatcagccacttccatcaggatctcagtaactgtttcatttacaggtcattttntttcattcccttcctagctcacacctggctcttcatactctagtagataccttactacta

SEQ ID NO: 8673 - DNA, 121 bp, Artificial Sequence
  Synthesized
  misc_feature (61): n=a or g
agctgattacagtggttttgggctcatggtgttaaatgtgcaggaaaagtagggaactccnatgttctgcaggaggtggttgtgccagctgaagaagttgaactctgggtccaacctcagt

SEQ ID NO: 8674 - DNA, 121 bp, Artificial Sequence
  Synthesized
  misc_feature (61): n=t or c
gtctcaaagtgtggcccaatttccatctatttcatttactcaaactagaatctgcctcatnttattgagttggagctgcaaaataatctttcctttgtctacaatggctctgagcaggaat

SEQ ID NO: 8675 - DNA, 121 bp, Artificial Sequence
  Synthesized
  misc_feature (61): n=a or g
cccttctcagcagatgtcttctggttgtttacaatacaagcacaaataaacgctatttcantgtcattccagttgagccatccctgcctggaaggaatttcttctctttttgtctgtttag

SEQ ID NO: 8676 - DNA, 121 bp, Artificial Sequence
  Synthesized
  misc_feature (61): n=a or g
cctccagggcacacacagacccagggaagatcgtatctaagagaaaaaggtcatgattacntgcatgcacattccttcaatagtcagcaaacaggggggatcgctccagggaaatgactca

SEQ ID NO: 8677 - DNA, 121 bp, Artificial Sequence
  Synthesized
  misc_feature (61): n=a or g
tattggggttttcatcttggtggatttgctgcgtgctgaaggttgagcctaacagttaggnaaactgcgcccaaatttgtaccactcaggctttgtatttggctgaaattaagagctggct

SEQ ID NO: 8678 - DNA, 121 bp, Artificial Sequence
  Synthesized
  misc_feature (61): n=t or c
catctatgtcaaatttggccttaagctacaatcaccagaacgcattgtctagctgacatantttgatgttctcaggtcgtttactcagaattgcattttgcattaactgctgattttagca

SEQ ID NO: 8679 - DNA, 121 bp, Artificial Sequence
  Synthesized
  misc_feature (61): n=a or g
ttgaatgacaacgaagtgagagcgatgctacaccctccaaggatcctcctgaacagattcnggacattttcctccaccatttttattttcagcttctacagataaggaaaatgttataatt

SEQ ID NO: 8680 - DNA, 121 bp, Artificial Sequence
  Synthesized
  misc_feature (61): n=a or t
cttaatatgcaatgtaaaatcacctgtgacatgattcatgacctattaatcatcaagaccnagaaatacggactaattatttcttacaaagagtatcttgcacatcttttgtcaattctaa

SEQ ID NO: 8681 - DNA, 121 bp, Artificial Sequence
  Synthesized
  misc_feature (61): n=c or g
gacctacatcatccaagagctgcaccagagggtatagcagaaaaccaaaagagaattcatntgataggaagaacattggagttataaggtaactacaacacacctcagccagtaaaccaca

SEQ ID NO: 8682 - DNA, 121 bp, Artificial Sequence
  Synthesized
  misc_feature (61): n=a or c
tatgtcccagagcacttgcttttatactcctatggactttccagagggatgtttttgtttntttgttccaatggagttgaggaggagggctggagagaatggcaagaactttataaataca

SEQ ID NO: 8683 - DNA, 121 bp, Artificial Sequence
  Synthesized
  misc_feature (61): n=c or g
ctcccctggtacaactggagctcatcacctattctcctgctcaaagcttcatttgcaggantgagcttcaccacagaatagggaaaggaaaagaggaatggaaggagaaggttaagagctt

SEQ ID NO: 8684 - DNA, 121 bp, Artificial Sequence
  Synthesized
  misc_feature (61): n=c or g
aagcaagaaaaatgagaagaaaacttcttttcacttgtgaggatgcttaaaatcaaaacancccaacctgaaagctgcagaaaccttcccattagcggagcagcttgcagcctcagccaaa

SEQ ID NO: 8685 - DNA, 121 bp, Artificial Sequence
  Synthesized
  misc_feature (61): n=t or c
gctacgtgtagggagcaactgagcagaacagactttctctgctgcattcatcttaacctanacaaaaggatttccttcctccacccacttcttctttagagaggttaaggctaatctaaac

SEQ ID NO: 8686 - DNA, 121 bp, Artificial Sequence
  Synthesized
  misc_feature (61): n=t or c
tccttcccctctgaacttaactgccttttctccaacacactggaggtgctgcctgtatctntctcagagggaaggagagatcctacatttacaagtacaactagcactcaaataacatctt

SEQ ID NO: 8687 - DNA, 121 bp, Artificial Sequence
  Synthesized
  misc_feature (61): n=a or t
caattgaagtttcagagcagaacaagagtcctaggctttgtcttacaatatagatgatgtnggaatagttgttactgagcagataaaagttttttaaaagtagggagccatccaaaaaagt

SEQ ID NO: 8688 - DNA, 121 bp, Artificial Sequence
  Synthesized
  misc_feature (61): n=a or g
ctgcatgcatagatatatcatggactgaacaacgattattctccaagagtctgtctgtggncagaacatggtcagaaatgaggcagattgtcctgaactgactcaagtgtgtatatttact

SEQ ID NO: 8689 - DNA, 121 bp, Artificial Sequence
  Synthesized
  misc_feature (61): n=a or g
gaaagagctgagcactcatgctgctatcacatatgtcttgtctcttagtttgaaggtaaancaccatttgtacagtcagtcttctctaccagaggtctgcaaagcaaaaccttctgatcat

SEQ ID NO: 8690 - DNA, 121 bp, Artificial Sequence
  Synthesized
  misc_feature (61): n=t or c
cagtaaattacagggtccactgccagccaagcaaacctagcacggggtatcccacagacantaccatcagacactgagtgaagatctcagagctcatcttccatctatgggaaatgctcac

SEQ ID NO: 8691 - DNA, 121 bp, Artificial Sequence
  Synthesized
  misc_feature (61): n=a or g
agtttgggaaagtctgtgccagccttacgcaggcaggtccagaacagttagcacacatatnttgtccaggaatgtgtagctcacttcaagcaaaaacaccagtatagggcttagagcagca

SEQ ID NO: 8692 - DNA, 121 bp, Artificial Sequence
  Synthesized
  misc_feature (61): n=a or g
ccaatgttcagaaactttgtccttctgccctgaagggaacctcaccatcacagaacgaccngtatgctgctctccttctcagggtaaggccatgaactgatggttttgaaagcccttacac

SEQ ID NO: 8693 - DNA, 121 bp, Artificial Sequence
  Synthesized
  misc_feature (61): n=t or c
cccattcaggcattggaacgtgttgtctggggaaatggcaagtctacatgcctggaggtantgaagacattcatggatgtggcaccaagggacatggaatagagatgggacttggtaagtc

SEQ ID NO: 8694 - DNA, 121 bp, Artificial Sequence
  Synthesized
  misc_feature (61): n=a or g
tgagccaggagcttccagcccagctggccagagccctccttctgcatctcctccattaatnacattaatttctgtgtttcacagcgtgtggtcctgagatgagggctaaaaatgaagtttg

SEQ ID NO: 8695 - DNA, 121 bp, Artificial Sequence
  Synthesized
  misc_feature (61): n=t or c
gttctcccagctgagcccttcacttcccatttgggcttttattaggacaaagtcaaccctntcagaagccagcactaaagctaagccctttctggtcctcacataaaggcctgaatgaaat

SEQ ID NO: 8696 - DNA, 121 bp, Artificial Sequence
  Synthesized
  misc_feature (61): n=t or c
catcaagacgtagtagcaataaataaaccagcaatttctacaacactcaaacaacctttantttctttgcccacctgatcaatagagatacattaatttacctgccactattttggggcag

SEQ ID NO: 8697 - DNA, 121 bp, Artificial Sequence
  Synthesized
  misc_feature (61): n=a or g
agattcaatagagaatgaaaaacagagattcaacagaatgcatctgcccctgatccagatnctatgaaatgttgacagcctgcatctaccctttgagcttactatttgctaccacgttctt

SEQ ID NO: 8698 - DNA, 121 bp, Artificial Sequence
  Synthesized
  misc_feature (61): n=a or g
gtgatcccattgctttcagacgatggcactttgatccatctattgagttaaagatggcaantgaattgagcactattattctgaatcacgttgtgcaaaccttggggcaggttcgtggcct

SEQ ID NO: 8699 - DNA, 121 bp, Artificial Sequence
  Synthesized
  misc_feature (61): n=a or c
gaaagagcaagaatttgggattctgaccaagctcagtgggaagaaatccacccgagccctntgctctgagctgagttggccaagagaaccagatgcattcatcaccttccctttgaggcaa

SEQ ID NO: 8700 - DNA, 121 bp, Artificial Sequence
  Synthesized
  misc_feature (61): n=a or t
taagcacgtgccatgagacttccggagcaaggcagcttcagaatgcagaatatgtacatcngtgtaccaatgtctgaccctagagtcaagtaggagtccagaatgggaataggagagagac

SEQ ID NO: 8701 - DNA, 121 bp, Artificial Sequence
  Synthesized
  misc_feature (61): n=t or c
gtgtgctttgggccttttcctacctttgtcttcccacctgaagaacgcagatcccagtgangaagtgaagacagtgcagctcctcgtttctttgagtcaccctgcatggcacagccaactc

SEQ ID NO: 8702 - DNA, 121 bp, Artificial Sequence
  Synthesized
  misc_feature (61): n=a or g
tttgtcccattatatttaactgaactgctgcttccatgggacccttctgtcttcattgatnattcatttcctgttgcatgtctgaaaatttgtgaactcagatattgggttcaataaggga

SEQ ID NO: 8703 - DNA, 121 bp, Artificial Sequence
  Synthesized
  misc_feature (61): n=t or g
tttctgtggagaaggaggatggaaagcaacttagagtgttttgggggctgctgacgctcantatctttactacgttttctactccaaacctttctgttgctgtgtcccagagtcctttgat

SEQ ID NO: 8704 - DNA, 121 bp, Artificial Sequence
  Synthesized
  misc_feature (61): n=c or g
aaaagattttcccagagccttcaagacgcagtcctgcacagaacgatagcaaaagcaaaanctgcatgccctggcacagcccacggtgctgctgggatgcagctgtgctcccaccctgccc

SEQ ID NO: 8705 - DNA, 121 bp, Artificial Sequence
  Synthesized
  misc_feature (61): n=a or g
cctgagtgactgccagatgcccagcaccagctttgcagggctttggctcagctccagactnttgaatcagcccaccaccaccagtacacccaaagcatttcagtaaaaccccacaattcca

SEQ ID NO: 8706 - DNA, 121 bp, Artificial Sequence
  Synthesized
  misc_feature (61): n=t or c
ttcccctgaagcagaattccacccaatttcaagttctaacacaatgaaaggaatgaggtanggtttaggctttcttctgaagagtaatggagcaagcatacagacaggtatagactcctaa

SEQ ID NO: 8707 - DNA, 121 bp, Artificial Sequence
  Synthesized
  misc_feature (61): n=t or c
acggcgggctgatgtgattcccagcatctgcttaagaaatggttaaacgagagctacgtgngtgtggtggcaatgcatggggatggcaatgtgtggggatggctttccttgctccatgtcc

SEQ ID NO: 8708 - DNA, 121 bp, Artificial Sequence
  Synthesized
  misc_feature (61): n=a or g
actgaacagagagggacagaaggtttctgtgtggctgtatggctttttctgtccagctgancccaccgtacctgcaagcacacgagcaagcaggccaagaggcagtttgaaggctgtctca

SEQ ID NO: 8709 - DNA, 121 bp, Artificial Sequence
  Synthesized
  misc_feature (61): n=t or g
agagatgctctgaggatcacacaagatttcttgagaagcacaagaaccacagctgcagatngcaaagcgtggtcctttctaggcaatggcttcttctagcacgtaattctgcacaggagag

SEQ ID NO: 8710 - DNA, 121 bp, Artificial Sequence
  Synthesized
  misc_feature (61): n=t or g
tcatattcagaccctgagagacagaatcacacagctgtctgagggacacagacagctctgngagctcctggctgcttctggcccaaaacatgatctcaggaacccagcccagtaacttgat

SEQ ID NO: 8711 - DNA, 121 bp, Artificial Sequence
  Synthesized
  misc_feature (61): n=a or c
tgatacccggggatgcccccagacctctgtgttcataaagggggaaagcgtgagagcggcnctggcaagatctgcataagggcgaagccaagcccagccatcatttgggcaaaacagcaaa

SEQ ID NO: 8712 - DNA, 121 bp, Artificial Sequence
  Synthesized
  misc_feature (61): n=a or g
ccagaccaacagtgctaggacacaagattgcagcacagcccggttcaccatcctgtctagntgaatagacaggatgaaatgacagaatgaaagacagaatgaaagaataagaactttctct

SEQ ID NO: 8713 - DNA, 121 bp, Artificial Sequence
  Synthesized
  misc_feature (61): n=t or c
ccctacagatggacctgtgctactccaagaccaactcaatgcgagacatccacagtcaccntcaggacactgaggaatagcccatcactccattcctttcctcttggactctaccttaagt

SEQ ID NO: 8714 - DNA, 121 bp, Artificial Sequence
  Synthesized
  misc_feature (61): n=t or c
gggatgaactggatgtgtacagctccaaggcataagaaaagccctaatatctgtcagaatnacttcaagtgttactgcaatcccatctccactttgtagatttcttctgacaactgcagtc

SEQ ID NO: 8715 - DNA, 121 bp, Artificial Sequence
  Synthesized
  misc_feature (61): n=t or c
gcataatgttttaggacagatcagcaattccaaactgcttcccatgatacagaaaataaanacatacacaaacatctgtgaataaaaaactggaggaataaaataaaagcttcagcatcag

SEQ ID NO: 8716 - DNA, 121 bp, Artificial Sequence
  Synthesized
  misc_feature (61): n=a or g
taacactgcaacaccatcacagatcagaaactctgagacctcgtctgcaatttcaaaggtnccttcaatggtctgagtaactcagtatgttgttgggtttttggtttgactgtaatcctgt

SEQ ID NO: 8717 - DNA, 121 bp, Artificial Sequence
  Synthesized
  misc_feature (61): n=a or g
ttttgtcttgagtagacgtggggttgcacgactctggtgtggttgcttggttagaaagcanaggagaagctaagggtgcgcccattggctcctaaaagcgagctcagagctgatggactgg

SEQ ID NO: 8718 - DNA, 121 bp, Artificial Sequence
  Synthesized
  misc_feature (61): n=a or t
gatggatggatgctcactccaagggaaacacaataatctcctctgtttgcaatgctgaacngcattcccgaacctcctgcctccctgcgtaaagcctattagctacccatcagtgctaaaa

SEQ ID NO: 8719 - DNA, 121 bp, Artificial Sequence
  Synthesized
  misc_feature (61): n=a or g
gattccatctttacagtactgatggtaaaaagtacatgttgggaactctatgggaattccntgaactgaagagtttgtagaagagtttgatgaatcattctgtgattctatgaactcttca

SEQ ID NO: 8720 - DNA, 121 bp, Artificial Sequence
  Synthesized
  misc_feature (61): n=a or g
tgatgtgcaaaaatccggttcactgtggcttttcctttgaagcaaggaggaaaagcacaangtgacacagcactgagtaactccaaagctgagatacttgtagtcattttaggtaccgtgt

SEQ ID NO: 8721 - DNA, 121 bp, Artificial Sequence
  Synthesized
  misc_feature (61): n=t or c
accttaacccagcagtgctctctcctaggacccaactcagccaactaataagacattaagntggacttgctgtggtctcaacagcacagagccactcctcaatcaatcctttcaattatct

SEQ ID NO: 8722 - DNA, 121 bp, Artificial Sequence
  Synthesized
  misc_feature (61): n=a or g
agcgattaatgcctgagaaatggcatacataacttggtactatctttactgcaagagaccnggctgtctgtaagtcaaagagatggggaggcaggaatctgtggctctgtttccagctgca

SEQ ID NO: 8723 - DNA, 121 bp, Artificial Sequence
  Synthesized
  misc_feature (61): n=a or g
ggagcaaagcttggatgcttattatttggtgaagagctctaagaagggacaggtggcactntggagtgccttaactttcagcatgagacaatacgtagacaagcaagagttccaagatttt

SEQ ID NO: 8724 - DNA, 121 bp, Artificial Sequence
  Synthesized
  misc_feature (61): n=t or c
acagcatccgtctgcactatgagcacacctggatctgtaggagcttgaaacacatcagaangatttactcatcgcttgtgcttaagttggtgcatttctggtaatgcttttgaaggagtcg

SEQ ID NO: 8725 - DNA, 121 bp, Artificial Sequence
  Synthesized
  misc_feature (61): n=a or t
ttctggatatagtaagctgaaaacttcattattaccctactccaacttaccacttcctgcngaaggcagcagcatgcaacaagagtcaacagacatttgtatgccaatcattcatgcacat

SEQ ID NO: 8726 - DNA, 121 bp, Artificial Sequence
  Synthesized
  misc_feature (61): n=a or g
gctttcattccatctacgggctataaattctccaaaattcactgtggcagaaagggaaacnaatttcttcactaactggcccgtaggacgagtctagatgtcatactgtctgaggtgcact

SEQ ID NO: 8727 - DNA, 121 bp, Artificial Sequence
  Synthesized
  misc_feature (61): n=a or g
gcaacctactcggggaaaacaaggcaagagatcagacaagatgcaagtaagctcagtacanactgcctaagcaatacagaagtcaccgtgcttcttagctagaacttaacttgtttgttag

SEQ ID NO: 8728 - DNA, 121 bp, Artificial Sequence
  Synthesized
  misc_feature (61): n=a or g
atagggcaaaggtttggggttcaaggtggcagggcaatcctaaccttaaaatcatccaccngagcacgcgtttgagaggcggcagctcaatcgtgacaccttccaaccaaaaatcaaacgt

SEQ ID NO: 8729 - DNA, 121 bp, Artificial Sequence
  Synthesized
  misc_feature (61): n=a or g
cttgctcctgggggcactcagcacctcagcaacacctgcagcaaagacaaacctagggganaaaggccccccagccccctatttatcaccaggaccacctctctgctcacacctcactcat

SEQ ID NO: 8730 - DNA, 121 bp, Artificial Sequence
  Synthesized
  misc_feature (61): n=t or c
aataggatatcagaagaaaaaatggaaaaataaaaaataaaccaaaggcaaaacactgccncaactgacaccattagcattaggctccaggaagcatgagtgctgctggaagaagttccat

SEQ ID NO: 8731 - DNA, 121 bp, Artificial Sequence
  Synthesized
  misc_feature (61): n=c or g
aaatacagtctctccccaagcagctggcacagagcgtctgcacactcgtggccacacaganggctccctgctacagctccagtgtcactcaggtaaaactaccctatgggcgtcttcaaaa

SEQ ID NO: 8732 - DNA, 121 bp, Artificial Sequence
  Synthesized
  misc_feature (61): n=a or g
gagcaaatgcttcccagatgctgccagacctaccccattcttcttctctgcctgggaacancctgaaatcaggaagcaaaaggggagcatgttcagactgcagaggaattctgtatgcagt

SEQ ID NO: 8733 - DNA, 121 bp, Artificial Sequence
  Synthesized
  misc_feature (61): n=t or c
acccaaatgtggataaaatctcaaccttgtgccataactttaccttctgttcagtgttaantcaggatgggacaaaaccaccatctgtccttgcttactgaatccagctcaacacacccaa

SEQ ID NO: 8734 - DNA, 121 bp, Artificial Sequence
  Synthesized
  misc_feature (61): n=a or g
gtggcagatgctgtgttaatggagaatgtaaagtaaacaaggctgggagaaagcttccccncccttctgtctcccccagtgaaatgctgtgttttggatgaaaataaagcattgcaatgcc

SEQ ID NO: 8735 - DNA, 121 bp, Artificial Sequence
  Synthesized
  misc_feature (61): n=t or c
ggaatctccatgcttggtcactcggagtcttccaaaacatccctttatttctaggcaagancaagccaacacgaaaggatcccattctctctctccttactgcagtgtgaatctgaagtac

SEQ ID NO: 8736 - DNA, 121 bp, Artificial Sequence
  Synthesized
  misc_feature (61): n=a or g
gtgcagacagagaggctggtggggtcacagcagatgatttgtagaactcgaggcttcaagnttctccgtcattgctgaattcccagtctgagcctcccaggatcaggcatgggcccctgct

SEQ ID NO: 8737 - DNA, 121 bp, Artificial Sequence
  Synthesized
  misc_feature (61): n=t or c
tcctcctggcttcgtgctgtctcatcacattgcacaaaagaacctcccatccgtattgcanttgtgagaagacgtggatgaagcgaggagcaggtcggggttggagctccatccatcagtg

SEQ ID NO: 8738 - DNA, 121 bp, Artificial Sequence
  Synthesized
  misc_feature (61): n=t or c
gctcagcgtggggctcccccagcccagccgctcccagcaggaggagcgatggcaaaggcancgacttttggaattggttctgcagttggaagccttccctccacccctctcttctaccacc

SEQ ID NO: 8739 - DNA, 121 bp, Artificial Sequence
  Synthesized
  misc_feature (61): n=t or g
ttagccttacttggctaactgtcacttttaacatgaatcacatgaagagtattaaggaacncctacctcactttaaggacgctttgtgttcagttcctaatatatgttagctttgaataag

SEQ ID NO: 8740 - DNA, 121 bp, Artificial Sequence
  Synthesized
  misc_feature (61): n=a or g
gactgattctaaggcagctgctggccctagagctgcttcatatttcctcagataggtacanacaggctcaattttgtgtcatccccaaagtaccaccatcgtcctctaacagacaccaacc

SEQ ID NO: 8741 - DNA, 121 bp, Artificial Sequence
  Synthesized
  misc_feature (61): n=a or g
gtttgcttgcttaaattaataacacatattcacctgaagaaaggggatggaaccctgaganggtatatgagggatgcacagaaggatatgacagacagcagggagggaactggtcccattt

SEQ ID NO: 8742 - DNA, 121 bp, Artificial Sequence
  Synthesized
  misc_feature (61): n=a or c
ccttcctagcaaggatgcacggatagtgaagcctcaggacactccgagggaacacaatganctcccaaactcgagggatttcatcacttcctgacctactgcagaatgcaaagtgccaaag

SEQ ID NO: 8743 - DNA, 121 bp, Artificial Sequence
  Synthesized
  misc_feature (61): n=t or c
cccaggggatcaagacccacatgatgtcccattaaggtacttgggtcccctttggagagcncagaaagtcctcccacaccgccaacacccacaggtggggccccactgccgcgtggcccag

SEQ ID NO: 8744 - DNA, 121 bp, Artificial Sequence
  Synthesized
  misc_feature (61): n=a or g
gtgttgtgtctttgtaaactaaatactgtcataggagcatcctctaaggtaggcattatgngcagttccatgaaatgcttctcttgactccagctcgtgctgggatggtgctcttgctgtc

SEQ ID NO: 8745 - DNA, 121 bp, Artificial Sequence
  Synthesized
  misc_feature (61): n=a or g
gaactctgggggtgcttccaaagccaaaattaaattgtagaactatggaagcacagggatngaggtgctaaaagaggtgagagccctccagaggggcacagtctggagtactccggaggac

SEQ ID NO: 8746 - DNA, 121 bp, Artificial Sequence
  Synthesized
  misc_feature (61): n=a or g
gcacggtgatgcaaaccacgaggtgcccagcggtgctgcccagcaatttgctccatcatcncttcgctttgcgtcgttgtttttaaattcacgaggagtaaatcctgccccgagcgaggaa

SEQ ID NO: 8747 - DNA, 121 bp, Artificial Sequence
  Synthesized
  misc_feature (61): n=a or g
gtaggcatatggtaacgcctcccatgcaattaaaagcttcacatactctaaggaaggaacntgctttgtcttgctgactcaaggctgccccatagaaacacgtgctcctgtatgcaaattg

SEQ ID NO: 8748 - DNA, 121 bp, Artificial Sequence
  Synthesized
  misc_feature (61): n=t or c
ctggggaaaggttaaggtcagaaatggatggattctctacgttagcagactggaaacatcngaaggatgaaatcagcacaaccaaagccatctctaatagctttcatctgttatgtttgcc

SEQ ID NO: 8749 - DNA, 121 bp, Artificial Sequence
  Synthesized
  misc_feature (61): n=a or g
actgggaaaggcaggagtggagacaaaggtaaaccgcagcgacggttcgtgcgccacgaangggactgcaaaatggcttaaacagagggaaaatggagggatctgtttgatccaatccaaa

SEQ ID NO: 8750 - DNA, 121 bp, Artificial Sequence
  Synthesized
  misc_feature (61): n=c or g
ataagcctcttactatgtgtgaggtgccctggggaaggaatatgctcagtaagcagaacanagggttattagctgacccctcaccagcacaacaggattgctccctgctgtcccttggcca

SEQ ID NO: 8751 - DNA, 121 bp, Artificial Sequence
  Synthesized
  misc_feature (61): n=t or c
acaatagcttcccagaatagaaaacaggcaaagggagaaatttgaaaggcctgatgctccnctccgttgtcttgctagaaacctgaaggatgatcatagaaatctgtggccttcttctgca

SEQ ID NO: 8752 - DNA, 121 bp, Artificial Sequence
  Synthesized
  misc_feature (61): n=t or c
tcttttatatgcagctgtaaattataccactgagtgatggaggaaagggaaaactcgtccnccctctcctgtccggagctcagggccctgtggtgctcccacagagccacccggtgtctga

SEQ ID NO: 8753 - DNA, 121 bp, Artificial Sequence
  Synthesized
  misc_feature (61): n=a or g
gtgccctaatttgtcaacttgtaatttgattatagcacagcctgcactaattgatatcctntgtgcttaaaggaaagcattcaccatctggcatttagcagaggagccgtgcacgcagatg

SEQ ID NO: 8754 - DNA, 121 bp, Artificial Sequence
  Synthesized
  misc_feature (61): n=a or g
acacaggacagacagcacagcacagccccagctgtctgtcttcagggcacgatcttaaacntggcttggtgctagcagcatgagcaaggcctgcagcagcaagtgaagctcacatctcctc

SEQ ID NO: 8755 - DNA, 121 bp, Artificial Sequence
  Synthesized
  misc_feature (61): n=t or c
gttcttcactcgtaggattttccttttggaagcccttagtgctgcaggcaggcgacgtgtngggctgtgctcccactgcatcacacagaacaaagtgaagctgaggttggtgtccccccag

SEQ ID NO: 8756 - DNA, 121 bp, Artificial Sequence
  Synthesized
  misc_feature (61): n=a or g
acagcttctacagcacattccagggtacggaacaagaagtattcacaggcagctaacgcantaaataactacttaaagaaaacctttttgttacacaccggccaaaaacacgggaacagag

SEQ ID NO: 8757 - DNA, 121 bp, Artificial Sequence
  Synthesized
  misc_feature (61): n=a or g
agagtttaagagagaacatttcataaagctctgcttatttttcatgagatagaccaaaaanatggatgaaaaagacagtggtatttgcgaaagaaatgctatgctaaatatctctgttcta

SEQ ID NO: 8758 - DNA, 121 bp, Artificial Sequence
  Synthesized
  misc_feature (61): n=t or c
tatttacatcaggctcttaaaccattcatttatggacacacagggcaccagcacctatagntgtgaacagagagcagctggccatgtgagatacctacaactgccactgaaagcacagaaa

SEQ ID NO: 8759 - DNA, 121 bp, Artificial Sequence
  Synthesized
  misc_feature (61): n=a or g
agggtatttgtcttcagacagaaagttgaagagacaccagagcttgaaggcatcctggtgngatacaacgctattcccattccggtcaggcttgtaatttttcttcgctgtcaaagtccag

SEQ ID NO: 8760 - DNA, 121 bp, Artificial Sequence
  Synthesized
  misc_feature (61): n=c or g
tagaagctacagagccagacagtcttccccttactgtgtctaaaaatcaacatcttgtctntactctttgtcactatcagcatttcccaaatacatacttgaaacacaagaacatctgagg

SEQ ID NO: 8761 - DNA, 121 bp, Artificial Sequence
  Synthesized
  misc_feature (61): n=t or g
agttcagtacctaacctgctcacacaggggatctgcagccaaatccaaagagcttgctccntacatgtttagtttcatcctttgttagcttacatctccatttagctttaatacacagcag

SEQ ID NO: 8762 - DNA, 121 bp, Artificial Sequence
  Synthesized
  misc_feature (61): n=a or c
attcgcagagggctagtcaataagagatgaaggaggggactgagtttatctctttgtatanggcagtattttattgcaatcttagaataaatgaagccgcacaagagatggatgacactga

SEQ ID NO: 8763 - DNA, 121 bp, Artificial Sequence
  Synthesized
  misc_feature (61): n=t or c
tcacagctgtgtatttggctacagcaattatccaccaaaaccatgaagcaaaggactgtcnaacagggaaagaaaacaatatgtagttcttaaaagacacaaacagagtttgcagatctcc

SEQ ID NO: 8764 - DNA, 121 bp, Artificial Sequence
  Synthesized
  misc_feature (61): n=t or c
acatgtttttttacttcttgcaacactattacaaactaaagatgttttttccctccatttncaggacagacccagtgccttcaaggaaactaccttggtccatacctgcaggatgccctgt

SEQ ID NO: 8765 - DNA, 121 bp, Artificial Sequence
  Synthesized
  misc_feature (61): n=a or g
tgtgcggctgttgctggataaagaacatctactgggaacaaacagaacttgcgcaagagcnaaggctgtgccagccccgaaacatcaccactttcagaacccctttctcacgtgaagcctc

SEQ ID NO: 8766 - DNA, 121 bp, Artificial Sequence
  Synthesized
  misc_feature (61): n=t or g
aggaatccttgggaacagcctacagcagtcctgcagagtccacctgctattcaggaggtanctctcctagtgaggatcaggctgccttttgggaaagggcaccacccagatctaaactctg

SEQ ID NO: 8767 - DNA, 121 bp, Artificial Sequence
  Synthesized
  misc_feature (61): n=t or c
agctaagatcaagcttttcaggggagtaatccgtgataaggcacatttccaaatccttgtnatcttcagaggtcagcctgtagactgaaggagatggagtaatatctgaaaatggagaaga

SEQ ID NO: 8768 - DNA, 121 bp, Artificial Sequence
  Synthesized
  misc_feature (61): n=t or c
ggttataagagacgactttctccatatactgccttccagcatgaggagcaccagagtatcnattgcttgctcaacccaaatatcaggactctggtatccagcaaagatggagcagctcaca

SEQ ID NO: 8769 - DNA, 121 bp, Artificial Sequence
  Synthesized
  misc_feature (61): n=t or c
gtcagaattcacttcacatgaagaaacatcttcaatgctttttctgggtcggttttcttanccctccaagatgagtacttttgctccaggaatgcacagaagtgaagattcctggttttgc

SEQ ID NO: 8770 - DNA, 121 bp, Artificial Sequence
  Synthesized
  misc_feature (61): n=a or g
gtgtgcctcaccaggaaaagcaggcagggctaaaaggtctcaatggaagctgaatttcctnaaggaagttcctaggatcagtagcaggattttcacctactgaatagctttttctttttcc

SEQ ID NO: 8771 - DNA, 121 bp, Artificial Sequence
  Synthesized
  misc_feature (61): n=t or c
aaactgtcttcttcctctttcataactgtgagagaagagcagtagcagtgaggcttaggcngtgctccttaaacatcccaggtactgcatcttcattgtttcaagtacaacacattctaat

SEQ ID NO: 8772 - DNA, 121 bp, Artificial Sequence
  Synthesized
  misc_feature (61): n=t or c
taaatgggtgtaaaagcaacgtgcaggtgttgaacatctctgtcctgttgtgttcctccantgaacgcacatctggtcctgtgcagtcactgctcggagtggggtaaataagcacctctgt

SEQ ID NO: 8773 - DNA, 121 bp, Artificial Sequence
  Synthesized
  misc_feature (61): n=a or g
ctctctgagtgcagagactggccctgcttgaaggctgctcagggtgtggaataaaaagggngtgcctgacacccagaacccctcaccctgcccagcagggttgctctgcatggcctcatgc

SEQ ID NO: 8774 - DNA, 121 bp, Artificial Sequence
  Synthesized
  misc_feature (61): n=a or g
ctcgtgctgcggccagcgctgcgctgcgacctcctcccactgtcaggcttttctccttccncgtcggatatgaaggagatgcacacagataggaaacgcaaagaaatcccagcattacaga

SEQ ID NO: 8775 - DNA, 121 bp, Artificial Sequence
  Synthesized
  misc_feature (61): n=t or c
gagtggagtgactgaaacactctgattgccctaagtatgcaataaggactgcagtaccttnacctttgggcctgaaaaaacgcaaagcaccctccttccctgggaacacctcgctggatac

SEQ ID NO: 8776 - DNA, 121 bp, Artificial Sequence
  Synthesized
  misc_feature (61): n=a or g
tgggagctgctctccaaacttggatgctttcatgcacaagaatcctagttcttggaatccngtactgcactatccaaagcctttggacagctccccagacatgttacaaggccttgtcttg

SEQ ID NO: 8777 - DNA, 121 bp, Artificial Sequence
  Synthesized
  misc_feature (61): n=t or c
agctttacttctttgctctagcattgccttttgtatttcacggtaaaattgctaaacctcntgaatatattttcaagaatagaaagaaccttgttaaaagaatgaaccaccagtgcaatga

SEQ ID NO: 8778 - DNA, 121 bp, Artificial Sequence
  Synthesized
  misc_feature (61): n=t or c
aatatacacaaccgaatgttatcttattattctctcctaattactgaagttattttaaatngaagtcaagatgcatcggtgacagacatccaagctgtgcacacacactgctgcagagatt

SEQ ID NO: 8779 - DNA, 121 bp, Artificial Sequence
  Synthesized
  misc_feature (61): n=a or g
gggaaagaaaaaaaaagatcacacttttctctatatgttcagtacatggaagagattcttnattggtgaataacacaaagtaggtggcatcctgagttcttctagcactacacagctcacg

SEQ ID NO: 8780 - DNA, 121 bp, Artificial Sequence
  Synthesized
  misc_feature (61): n=a or t
tttgcctcctgctctatgccattgccaagagagggttactcaggccatgcatgagactggngcacaaagctcgttaaaaaaggctattcagtgtagctgctgtactggctcatctgtgtaa

SEQ ID NO: 8781 - DNA, 121 bp, Artificial Sequence
  Synthesized
  misc_feature (61): n=a or g
ggagctcacctgacacctggtgtggtacacacttccttgcctgaaaggacaagggtaggcngagtgcattctgcaggcatctcccacagccactgctggagatagggagcctctcccatcc

SEQ ID NO: 8782 - DNA, 121 bp, Artificial Sequence
  Synthesized
  misc_feature (61): n=t or c
gcggccacagcccaggcagagttggccttttggttcgcaccagttggtggaacacccgganccaggcagcctgtgaaaagagacaccgacaaatgaaataggcaataaataataataacaa

SEQ ID NO: 8783 - DNA, 121 bp, Artificial Sequence
  Synthesized
  misc_feature (61): n=t or c
gatactcccagctcttctcaattccaaccagacacagcatccattcagtggtgtcttctangacagaagagcagtagggcagcagtgctaaatcaccaggaactccagctccctaactaca

SEQ ID NO: 8784 - DNA, 121 bp, Artificial Sequence
  Synthesized
  misc_feature (61): n=a or g
tcatagctctggggacgccctgatgtactgggcagcttggtgagagggagcaaggagcacngagacaggtgtgggatcacgaggatgtgtatctaagcacgtgttacatgcgtgtgtgtgc

SEQ ID NO: 8785 - DNA, 121 bp, Artificial Sequence
  Synthesized
  misc_feature (61): n=t or c
ctgtgtctcttagcaaagaaaagccataactggttcccaggatgatttggcttctgctgangtcagctgggtccaggttttgttgagtgctgatcactcagagctgtaggggatcctctaa

SEQ ID NO: 8786 - DNA, 121 bp, Artificial Sequence
  Synthesized
  misc_feature (61): n=a or g
cctgttcacaatggatttctgccatttgcagaagctgtccagggatttcccggcgtggtgnttaatctccagtgtgggctggaatggaagcaatataacagcatgttcccagagaagctct

SEQ ID NO: 8787 - DNA, 121 bp, Artificial Sequence
  Synthesized
  misc_feature (61): n=a or g
gcgtgtaagtggaaagcattcttatttactgttatgtgcataaagttattgtttaaatganggagtgatttacaaaactgtaaccatggaagaagtgcaggatggtctgtccagaaacctc

SEQ ID NO: 8788 - DNA, 121 bp, Artificial Sequence
  Synthesized
  misc_feature (61): n=c or g
gcaacagcactgcactacggcacacacctctccaaggcagatgccctgaaaatcagaaaangctcaaccattggatttcacaaagtcctagtattgggtatgttttacgtaaggtatttca

SEQ ID NO: 8789 - DNA, 121 bp, Artificial Sequence
  Synthesized
  misc_feature (61): n=a or g
ccttttcttcccctgctggaaggaaaaaggcatcaggacaaagccatgaagagcaccgggncagcacagaacagaactacgggtgcggagctgtgggtgctgccctgcagctctgctgtgc

SEQ ID NO: 8790 - DNA, 121 bp, Artificial Sequence
  Synthesized
  misc_feature (61): n=a or g
tctgccacgtttgttcctttcctccccacaatgtaccatagccttctcagcacttcttcanctctgttcttctccaccactcctgccctgcttgcagaaatgcagttcccaagatagttag

SEQ ID NO: 8791 - DNA, 121 bp, Artificial Sequence
  Synthesized
  misc_feature (61): n=t or c
acaggtgagcaatggagagcctttagaaataatgcatgagcttcaggctcccttgccacangaggctgttaccatgctgctcacctggtagctgctgtttcctttaccactgatccctttt

SEQ ID NO: 8792 - DNA, 121 bp, Artificial Sequence
  Synthesized
  misc_feature (61): n=a or c
ctcagcacagatctgatccactcctcagcctctgcatgggagattctcagtgggatctatnccagagatgagataggaatcctcccctaacaattcctaaagctcacctgacatcagccta

SEQ ID NO: 8793 - DNA, 121 bp, Artificial Sequence
  Synthesized
  misc_feature (61): n=a or g
gttgtggcccaggaaggaggtgatctgcccctcgtagaagtccaggctcagcccatcgatngccacatggctgctgctgcggtaaaccttcaccaggttgcggatggaaactccgggctgc

SEQ ID NO: 8794 - DNA, 121 bp, Artificial Sequence
  Synthesized
  misc_feature (61): n=a or g
tccattgcatttccacaggctttgttcaggtctgaaagacaagagcttcatttgctcaccnagaaccaccgttcacacttatcttctctgatgtgactcttccccatagtaatgaatgaat

SEQ ID NO: 8795 - DNA, 121 bp, Artificial Sequence
  Synthesized
  misc_feature (61): n=t or c
gctttctttttccttcatgggccccacacagattccaggtggaggagacagcactggatangttgaagatcacctttgagaacagcattgacttctttggacgcattgtggtgtaccacct

SEQ ID NO: 8796 - DNA, 121 bp, Artificial Sequence
  Synthesized
  misc_feature (61): n=a or g
tttaattgtgttggcaagctgcttcccatctgaaacaaggacaaacccgagattgcacacntatatatgcgttacgtgtacagatatggggtgccatcctgcacacatgcattctgtctgt

SEQ ID NO: 8797 - DNA, 121 bp, Artificial Sequence
  Synthesized
  misc_feature (61): n=t or c
tttccaacttcatgtaatgaaatctttaataggttatggtaatatgatgaacccagagganaaaactggcacagaggatcattcctgtggcagaattttcattaatcttagctttgtaatg

SEQ ID NO: 8798 - DNA, 121 bp, Artificial Sequence
  Synthesized
  misc_feature (61): n=a or g
aaggttcatgagacattttgaggctgatgataatctgttagccaccaaaatgtggaaagcnctgtattaatggaaagcatctgctagcacagagcataagaattcagtgaaaataataaag

SEQ ID NO: 8799 - DNA, 121 bp, Artificial Sequence
  Synthesized
  misc_feature (61): n=a or g
ggcaacgagaagtcaatgagacgtgaatgtgagcagggtggaaatgtgcatgcaatgagcnctgccctcctctctcttgtggaaaaatgccatggagttgaggggagcagggcctcgtgga

SEQ ID NO: 8800 - DNA, 121 bp, Artificial Sequence
  Synthesized
  misc_feature (61): n=c or g
accaccaagctgtttgggttttcatttatttttggattttatatttacttattttagatgngtttcggttaacagcaggttcttgtggaagaagaatgacttttaaaaggtttatcacaga

SEQ ID NO: 8801 - DNA, 121 bp, Artificial Sequence
  Synthesized
  misc_feature (61): n=a or c
aacagaaaaccacccaggttaagctgttaggtactagtgtgaaagtctggtgggtgattcngtgcctccccttcaaaaatcacttctccctatgttcagggggtcactcagaaactcctca

SEQ ID NO: 8802 - DNA, 121 bp, Artificial Sequence
  Synthesized
  misc_feature (61): n=a or g
aaggcttaattactgtaggttgtagtgcacacacaggatggtgcagtcactgcagctcagntctcatctgctgaagacttttcagatgatttccagtgtaagagccttcataaaacgtgct

SEQ ID NO: 8803 - DNA, 121 bp, Artificial Sequence
  Synthesized
  misc_feature (61): n=a or g
gcagtggagatttctgccagggtagaaaacaaacagaacaatgtcatctttaagtgcttcntgtccccttgaggatgacatggaatggtatggatttgtgccctgagaatgggaagtatgg

SEQ ID NO: 8804 - DNA, 121 bp, Artificial Sequence
  Synthesized
  misc_feature (61): n=a or g
tgcccatacaccccatacacctttattttttcctcatctgcagctggctgtgaaaaattcngcctcaaagtttgtgagcgacagggaaacttttgttttcgtgccttctagaagacctgac

SEQ ID NO: 8805 - DNA, 121 bp, Artificial Sequence
  Synthesized
  misc_feature (61): n=a or g
tgtcgctgggaggggtcggagctcagcagggatggaccgctcagtggaaaagcacgcctcnctgtcctgctgctctgcattattcgcttggactcgtcgttctcccgtgtgttttatttgc

SEQ ID NO: 8806 - DNA, 121 bp, Artificial Sequence
  Synthesized
  misc_feature (61): n=t or c
ctgctcctgatgcacacgggtgtaaaggagggtcagaatacagtcagaacacagtccttangaccacgtcgtatatttgtgcattattattccagagcatctttgaagctatcagggagag

SEQ ID NO: 8807 - DNA, 121 bp, Artificial Sequence
  Synthesized
  misc_feature (61): n=t or c
actctttctggccaacaagagacagaggaaatgttgcagcagacaagcaaaaatgcattgntgacgaatgactccgtttatagtccagatttcggacaccctgtccttagtcaccagtgac

SEQ ID NO: 8808 - DNA, 121 bp, Artificial Sequence
  Synthesized
  misc_feature (61): n=a or t
aggagaataatgtcatataagatgtcaaaaacaagaatcaacatgttagaagagtgcctgntggaaataaagccctgcttttactggatagctgatcttctaaaagcagttatttgaaata

SEQ ID NO: 8809 - DNA, 121 bp, Artificial Sequence
  Synthesized
  misc_feature (61): n=a or g
gacagaagtcaggcctgagctgatccaggttctctgccagtccttgtcaaagcagcagctnggaggcttgtggctaactctcctcattttcttactgtgaaccacagagtggcagaccaaa

SEQ ID NO: 8810 - DNA, 121 bp, Artificial Sequence
  Synthesized
  misc_feature (61): n=a or c
actcagtgttcttcacccttcagtgagtaaagaagggggaaaaatcacatcactgaagcanatgagtttgtttcaaacttcttggaccatctcctttgcacattcccagtaagctgcttga

SEQ ID NO: 8811 - DNA, 121 bp, Artificial Sequence
  Synthesized
  misc_feature (61): n=t or c
tttttccttcgtaactcgcatagttttattatctcctctcactttttgtggaaataatccnagttactgagtggattacttgggatgttgaaatgccacgtggttactgctggaactggtt

SEQ ID NO: 8812 - DNA, 121 bp, Artificial Sequence
  Synthesized
  misc_feature (61): n=t or c
gaggtccagagatgtgagctgtctttacaaaggagacattttcttttagcatagtgtaagngaaagagagtttcagcatttatctcatttaaataacacagaagcccaggtattgcttgtg

SEQ ID NO: 8813 - DNA, 121 bp, Artificial Sequence
  Synthesized
  misc_feature (61): n=a or g
aataatccgaggattacactcaaaggatttcaatatttgagagtggattaggcagaatcanaaaaagtagtcattatacaggacaatatagagaactgcaatgcaaaagaagtcttaaata

SEQ ID NO: 8814 - DNA, 121 bp, Artificial Sequence
  Synthesized
  misc_feature (61): n=t or c
ctttggagatgggtgagcatacttcttttgtaacatcttcttgttacactggtcctgatgncattacacattacaatcctactacaactccttagactagctgaaaggcagtgcattacat

SEQ ID NO: 8815 - DNA, 121 bp, Artificial Sequence
  Synthesized
  misc_feature (61): n=a or g
tctagtttcatttctcggcgttatcagagcactcccacctctaagagaacatttaccattncttgtggtacttatttatttactgatgcctcgcactgatttacctcctcatggaaagaac

SEQ ID NO: 8816 - DNA, 121 bp, Artificial Sequence
  Synthesized
  misc_feature (61): n=t or c
acattaaatagctatctatctacctgaaaacataaaatgtttattaagtaagtgctgggantgagtgcttgaatttccctatgttgcttgcagtatccaaaatactaccttgatagaacat

SEQ ID NO: 8817 - DNA, 121 bp, Artificial Sequence
  Synthesized
  misc_feature (61): n=t or c
agatgactctggagcagtacctcccaggacaatactgtttttgtctgtaagggttttaagnacagtcgtagctggcgactgcagaactttgcgtgaaagcctcattctaccatcggttgga

SEQ ID NO: 8818 - DNA, 121 bp, Artificial Sequence
  Synthesized
  misc_feature (61): n=a or t
gtgtctacttcaaaatgaaaggaacgggaattttttaatgtattgattcatttatttaatnaacttcctcaaggctgcagaacttggtgccagaaacaattagaatacaaaatacatagat

SEQ ID NO: 8819 - DNA, 121 bp, Artificial Sequence
  Synthesized
  misc_feature (61): n=t or c
aaagcaaagtataaaaacagtgttggaacaaaagcgaccacattcacacttaatagtgcangtgacagattacagtacctacacatacaaaaacttaaaatgccatgacctcagaagcaaa

SEQ ID NO: 8820 - DNA, 121 bp, Artificial Sequence
  Synthesized
  misc_feature (61): n=a or g
ttttataaaaacacaattgtgtgaatcaccatcatgtgagtgattctacactgaacacagnaattacccttagaggactgagaacttaggtcattcatcttagaaaggcaagtaggagaaa

SEQ ID NO: 8821 - DNA, 121 bp, Artificial Sequence
  Synthesized
  misc_feature (61): n=a or g
gaggatacagtacagcttacatctgccacgtgagtgaaattggtggggaatgcagagaagnaaggggtgcaactcacctctaaggaagcaaatgtgatccccaccatcgtggctagaatat

SEQ ID NO: 8822 - DNA, 121 bp, Artificial Sequence
  Synthesized
  misc_feature (61): n=a or g
ctttttttttcttttactcatttacagtttaagtggggactggaaaaggggaagtaggaantttagaatagtattatgttaattattattacatatcaacttgcctgtataatattgacac

SEQ ID NO: 8823 - DNA, 121 bp, Artificial Sequence
  Synthesized
  misc_feature (61): n=a or g
caatttgttatgcctaaaagtttaaagatgctttttgcagattctcttaggcacaggaggnttttcaagcatgttgtagagaaacatgaattctcagagtgtgggcaaaatcatacaggtg

SEQ ID NO: 8824 - DNA, 121 bp, Artificial Sequence
  Synthesized
  misc_feature (61): n=c or g
ttcggtgaacaagtggaacgatctatagcaaatttctaaaaaaagcagtgccttctggagnaacaactgttagtgatgtttctgctgaaacgtggcttttaacaaaactaataaaacggta

SEQ ID NO: 8825 - DNA, 121 bp, Artificial Sequence
  Synthesized
  misc_feature (61): n=a or g
gatagaattcatccctgggagttcaactgcagtagagagtgagttgggtgttggggctggngtaggagatgctgaggctggtcaggacaagcagaatgataggtgagagctactgatggat

SEQ ID NO: 8826 - DNA, 121 bp, Artificial Sequence
  Synthesized
  misc_feature (61): n=t or g
gattgcagctctacaaacgtgggttgtttttaaccaaggccaaacaagcctgccctcttgntttttctgctatctcccttgtctggaggagcagaagtctgtactgtttgtgtgagtgcaa

SEQ ID NO: 8827 - DNA, 121 bp, Artificial Sequence
  Synthesized
  misc_feature (61): n=t or c
ggggattcctctgatgacttgagcatgggatgattcttcatttctgagaggaaggatgttngcatcctcaaatattgctttcaaagcatgaagtgatgggtgctcacacaatctggcttac

SEQ ID NO: 8828 - DNA, 121 bp, Artificial Sequence
  Synthesized
  misc_feature (61): n=t or c
atttcaagcccattttggtgtaggttggtgtagaaaaaaagctaagttgaaattctcttcnaggttctcattcagaatactgctctttcctcctactcgtctgtgcttttactgctttaat

SEQ ID NO: 8829 - DNA, 121 bp, Artificial Sequence
  Synthesized
  misc_feature (61): n=t or g
aaaaaagtagtcagatcatcgtctggacaaggagagattagagtgaattttggaatgaaanatcagatcttcttggacacctgggaaacttcaaaggagagattagctctaaaagcatgca

SEQ ID NO: 8830 - DNA, 121 bp, Artificial Sequence
  Synthesized
  misc_feature (61): n=a or g
gcaaattgcactcaaatgcaaagctctctgatcttttgagatatagttaacccatgtaacntcagagttagagggccagtttcaatcacaggttgattctgaattgtaaattattttatgt

SEQ ID NO: 8831 - DNA, 121 bp, Artificial Sequence
  Synthesized
  misc_feature (61): n=a or g
cggttgtaatggcactcataaaacaaaactggcaggctattgaggctgggcacttaaaccngttacactaattgtgcttgtacaaaacaggcaaactgcagctttttggagaagatggaaa

SEQ ID NO: 8832 - DNA, 121 bp, Artificial Sequence
  Synthesized
  misc_feature (61): n=t or c
ggagagaagcaacaaaactgagctgttctcacctctcctctttcatgtgcctacacgtgcngttgctgcctcgtgcatgcactgattctgttcctgcagttttaggtgagtcataaggaaa

SEQ ID NO: 8833 - DNA, 121 bp, Artificial Sequence
  Synthesized
  misc_feature (61): n=a or c
aaatattctctaaaaatgatccatatgacactagtttggcaaagtaagaacctgaaaaagncaacattcccagtctcctaatgaatgaaaactcttccatttgcctatctggtgatctagc

SEQ ID NO: 8834 - DNA, 121 bp, Artificial Sequence
  Synthesized
  misc_feature (61): n=a or t
aaggtaaagccagactattgctgcaagacactttttagggagtttgtcccaaaagtggcangcaactgacctctggatgttatgaacatcagaaagcagggctacttttcacaagagaaat

SEQ ID NO: 8835 - DNA, 121 bp, Artificial Sequence
  Synthesized
  misc_feature (61): n=t or c
tgctttgtgtacagatggtacaatgagtgccaggaaagagggcatgtgaatttttcaaggnagtcaagaagactttgagaaatacgcagaaataaagtgcaggaatttataggcatacaga

SEQ ID NO: 8836 - DNA, 121 bp, Artificial Sequence
  Synthesized
  misc_feature (61): n=t or c
ttttaatataaaatggttcacagagcgctgtcgaacatttaagtagcaactcgttaagctngggatgtttttgctcctttctgcatgcatgtggtaatcacggcgagttatattccacaga

SEQ ID NO: 8837 - DNA, 121 bp, Artificial Sequence
  Synthesized
  misc_feature (61): n=a or g
tgtgaccatctgctaatgagtggaagggctgaggggactgttggagcattgcttggccatngtgctttcctcctgcctcaccctgggcttttcctgcccacaggatgagcaatgccagcct

SEQ ID NO: 8838 - DNA, 121 bp, Artificial Sequence
  Synthesized
  misc_feature (61): n=a or g
gatatattttatgtacagtgtgttattctgaagtaacagtttagtctatccattttgaacnatgcgatgcaatgatttatttcagacttctagtcacttctccatgatttgggaaagttga

SEQ ID NO: 8839 - DNA, 121 bp, Artificial Sequence
  Synthesized
  misc_feature (61): n=a or g
tcagccagcatcacaaaataactttttttgctgtgagctgcaaggatctgactgtgaagtnccataaatagaagaactccactatacttctaccataaatcataatttgaaaaagatcttt

SEQ ID NO: 8840 - DNA, 121 bp, Artificial Sequence
  Synthesized
  misc_feature (61): n=a or t
agtttacactctggtttcctcagcttacttccaaggctttactaggaaaacaaaagtactntaaaacagtagtggatgagttaggtcacagatccttctctgcacagccctaagggcagca

SEQ ID NO: 8841 - DNA, 121 bp, Artificial Sequence
  Synthesized
  misc_feature (61): n=t or c
aagacaaaataaaaggacttctcctcttctcggggaagaaccacggaaatgtcccttatangccacgagggaactaaagatgtggttttgatggaaatagaagcagcagggtagggagaga

SEQ ID NO: 8842 - DNA, 121 bp, Artificial Sequence
  Synthesized
  misc_feature (61): n=a or g
tcctcgtgttagttttgattcatcacagattgagatacttgatagatttatttctattccnaggtccttactctagcagaacaaagggcttatggatatatgaggaatattgaatgctttc

SEQ ID NO: 8843 - DNA, 121 bp, Artificial Sequence
  Synthesized
  misc_feature (61): n=t or c
ttttagcagtagctatttctgcttagctcttctaactgttttggtagaaaatggaataganctagtgaaactttttacagttatagagtaaataaacacttattatgcatttcttcctcaa

SEQ ID NO: 8844 - DNA, 121 bp, Artificial Sequence
  Synthesized
  misc_feature (61): n=a or g
ggcctggaggatgtagtgatggaatagtaaaccagcaggatgtatttggactataacacanttttactcagtacaggtcctttcacattttgtttacagagtgaccaaaagctaataattg

SEQ ID NO: 8845 - DNA, 121 bp, Artificial Sequence
  Synthesized
  misc_feature (61): n=a or t
ttttcaaagatcttgtcaggtctggtttgaatatttttctagtataagagtcgtttctaanccccattgttaagctgttgtatttttaaaaaccttattatagattttaaaacaggttaag

SEQ ID NO: 8846 - DNA, 121 bp, Artificial Sequence
  Synthesized
  misc_feature (61): n=a or g
gtaatggtgttgcaggttatgataaaaaatgtgaaactgctgatggcaatctagaaagttncatatgattggttttgaaaactcttagatatggtaatctttacagagcatagctagatac

SEQ ID NO: 8847 - DNA, 121 bp, Artificial Sequence
  Synthesized
  misc_feature (61): n=t or c
cttccatctgttcagcacagatccatgcgatccttaccattaagcactgagatttcacttngtcccacaaaagaaatctcttgcaatatgtgaggagtgttacatccaggccagaatcttt

SEQ ID NO: 8848 - DNA, 121 bp, Artificial Sequence
  Synthesized
  misc_feature (61): n=t or c
tcactacacaaggccaagcatctaactagcccctttttatacaacaggagctcactctccncatacatcatacttacaggaactgcacagctgcatttcaacatgcagttaatatagacca

SEQ ID NO: 8849 - DNA, 121 bp, Artificial Sequence
  Synthesized
  misc_feature (61): n=t or g
cagaaccctctgccctgatctcctcagcatctatgccaaaaacatgtcttattagctcatncacagtgcaggacccgatctctgtgcgtgctgttaatagtcttataagcttcctgctgcc

SEQ ID NO: 8850 - DNA, 121 bp, Artificial Sequence
  Synthesized
  misc_feature (61): n=t or c
tccgcttggccaaggagaggtcttgttaaaatatgccacaggcaacagagccttgagggangcagtcttgagctctcttttgatatgcactgagattacaattagtatgtagaatgtaaag

SEQ ID NO: 8851 - DNA, 121 bp, Artificial Sequence
  Synthesized
  misc_feature (61): n=a or c
atacaggatgtaccccatgacaaattacccactggccatccctgctgctcttgtacttcanacagaggtgcagcatttgcacccaaatgattctgtggacactgctgcttggggatcacct

SEQ ID NO: 8852 - DNA, 121 bp, Artificial Sequence
  Synthesized
  misc_feature (61): n=a or c
aaggctattgagtgatttcctcctaaagctgcagctgaaaccatggagaaatgccttgcantgaacctatggccccatgctgcgtggttgctgcccgtgctgcactgcccatcacttgcct

SEQ ID NO: 8853 - DNA, 121 bp, Artificial Sequence
  Synthesized
  misc_feature (61): n=t or c
ctgccttttcaatgttgtgtcatcattttaactatacttaggctgtatttcataattttcntctagcacagaggtctgtgtaggttgtggcagattattgttaagtagtgttcatcgccaa

SEQ ID NO: 8854 - DNA, 121 bp, Artificial Sequence
  Synthesized
  misc_feature (61): n=t or c
tgcaaagctccccatgtaaatgcatgcttttattttcatcctgaggcagcattgtacttgntaactgtaagcctgacactaaccagtaaggtcatgtgaaaggtaacaaaccttcagtttg

SEQ ID NO: 8855 - DNA, 121 bp, Artificial Sequence
  Synthesized
  misc_feature (61): n=t or c
gctgttcgctgtgactccctgctccaaagacaccagagcgatgctgacatttgggagcacnggcggtttgctctcccgagcttgggatgtgaaccccgggggttcccggcagggtgcctgg

SEQ ID NO: 8856 - DNA, 121 bp, Artificial Sequence
  Synthesized
  misc_feature (61): n=t or g
cagggcatgtgatttcattcctagatatcccaacttgttcctctcatgagctctcagaaanctcagattactgagatcttccagggcaagcccaacaagattgaatcctatgtatatcact

SEQ ID NO: 8857 - DNA, 121 bp, Artificial Sequence
  Synthesized
  misc_feature (61): n=a or c
gtgttcaatgagtactaacaatggaaaagtggtttcaggaggcagaaatcccctgaggacntaagtacagtgaaatgacactgaatagtgggttaacgactgaagtctatgttctgtattg

SEQ ID NO: 8858 - DNA, 121 bp, Artificial Sequence
  Synthesized
  misc_feature (61): n=t or c
gtctctggagtctgtgtgccagccctgtgctgtgcctgcccgtctccttgctgtgaggtgngctgagtcacttctattgtaacatactttggatgttgagagatctaaataaatttaggca

SEQ ID NO: 8859 - DNA, 121 bp, Artificial Sequence
  Synthesized
  misc_feature (61): n=t or c
aatgaagattgacatactgtccaaatagggaaaaattttctatgcccttttgagcagttcnaagaaggaacagtactttcctgttagcccacactccaaatgctacacatataaataaaag

SEQ ID NO: 8860 - DNA, 121 bp, Artificial Sequence
  Synthesized
  misc_feature (61): n=a or g
gccccttttgaagacagtaatgccttgcaggttcctggcagcagtggctcattggcagccnacattgagatatggtggagatgagactccagcatgttccttgatatggaggatttggaag

SEQ ID NO: 8861 - DNA, 121 bp, Artificial Sequence
  Synthesized
  misc_feature (61): n=t or c
tgtttacacagatgctcacatgctagccaacacttcaccaaaacgagtaagttacgtgtgntacttactgcacaccatttgactgagtagtttcagtttgtagttcgcccttaacagcgag

SEQ ID NO: 8862 - DNA, 121 bp, Artificial Sequence
  Synthesized
  misc_feature (61): n=t or c
ccttgctggaaacagcactggagttctcagttggttccctggggtcaagctttctcaccantggtctgtgctatatcccagaatgccaacaaatatgaacacccatagatctgtgtagtgc

SEQ ID NO: 8863 - DNA, 121 bp, Artificial Sequence
  Synthesized
  misc_feature (61): n=t or g
gcttgttctctctgctggaagctggaagtactcaatggatctgaaaatgtattgacctatntagaaatttgagcctacatgaacttgcccaatttttgctagctgaattttgatgtttagt

SEQ ID NO: 8864 - DNA, 121 bp, Artificial Sequence
  Synthesized
  misc_feature (61): n=c or g
caaaatagctccctaaagagccagcctcagcgccagaatcagagctatgtccctaatgcangagcagtactgtcctcactggatattttgggatgcagctggccagcagaagcactgcaca

SEQ ID NO: 8865 - DNA, 121 bp, Artificial Sequence
  Synthesized
  misc_feature (61): n=a or g
ccctgtgtgagcaaaagctaaatgaacagtgtgataattcatttctgagtgaaccagatgngttaggacttgataaggtgccatgactcatgtcttgaaattgcttagtttcttagcaaga

SEQ ID NO: 8866 - DNA, 121 bp, Artificial Sequence
  Synthesized
  misc_feature (61): n=a or g
agccagcccatggtgacaaacagaaagagacatccaattgaaagttttccaggaatctttntggtatctcatcctggcaaaaattagtgttcaactgaccccaaataaattgtttcttctt

SEQ ID NO: 8867 - DNA, 121 bp, Artificial Sequence
  Synthesized
  misc_feature (61): n=t or c
gctagtctctgtattttgtacctatttcctgcatgactacaaatactatgatctacccttntctctttttagcataattgtcttctctagtgagaatatgaactcctgagcattaacaaga

SEQ ID NO: 8868 - DNA, 121 bp, Artificial Sequence
  Synthesized
  misc_feature (61): n=t or c
ttcaatttaaattaaacagaagcatttagaggtgatcttaatgaaagacaaaacaagctcnaggacagccagcaaaataaccatgaacttctgcaatatcttgtatttaatattacccatg

SEQ ID NO: 8869 - DNA, 121 bp, Artificial Sequence
  Synthesized
  misc_feature (61): n=t or c
tgtttgtgcattgtgcgctgaaattgcgtttggtgtttgtgcaatgtctaccatttatacngaaggctttaaagagatttctcccaggttaactaccgctcactgcttttccttaccgttc

SEQ ID NO: 8870 - DNA, 121 bp, Artificial Sequence
  Synthesized
  misc_feature (61): n=a or g
tacaattcaaaaatgtaacttcaaatctgaaacaaagtacttcctctctctttctcccatnatttcagtttgtcagcaaaaatacacccataaacccatcatgttcacatatgtgcataca

SEQ ID NO: 8871 - DNA, 121 bp, Artificial Sequence
  Synthesized
  misc_feature (61): n=t or c
ctgtatcagttcagcttctgcattttccaatattccaggaaattgagcatactgtttacantgctacacaaacacatccagaggaaaagtttaattacagagctcttcctcgcacactaga

SEQ ID NO: 8872 - DNA, 121 bp, Artificial Sequence
  Synthesized
  misc_feature (61): n=t or c
ctctagtaaaaatgcacttcaactctcattctgacagtgacttttcagtgactttacaaanagtgagggatactcctgtctccctttcccaatttgaataaaacatttcagacacagtaat

SEQ ID NO: 8873 - DNA, 121 bp, Artificial Sequence
  Synthesized
  misc_feature (61): n=a or g
caggcattgcgctactgctagcagattgcattacactgacactttgaatgcactttcttcntatgtttgaagcaacatttttttaaggactttttcttttcatcttaagtttgggacaaaa

SEQ ID NO: 8874 - DNA, 121 bp, Artificial Sequence
  Synthesized
  misc_feature (61): n=t or c
cgcctctctgatacgctcttgccaagaaatccttcctacgtagacaaaacttggtacttanacagttttaagtgcacaaaattccacagaagtatatatagatagtatataagtgtatata

SEQ ID NO: 8875 - DNA, 121 bp, Artificial Sequence
  Synthesized
  misc_feature (61): n=t or c
ccatgtacctgtttccagtctccagcctccttgcacagatttcctgtatctgagagtagcngaggtttaccttgacgtaatgggaggcagtgaaaagcagtgcttcctatcggcagctctg

SEQ ID NO: 8876 - DNA, 121 bp, Artificial Sequence
  Synthesized
  misc_feature (61): n=a or g
gctataaaaatttgcaaacagtagctcaaaggctttgcttggttcaatctcaaaagggtcnaacctttcagctgacttcacctatttaaaaaatatatatttcattggctgaaggagtacc

SEQ ID NO: 8877 - DNA, 121 bp, Artificial Sequence
  Synthesized
  misc_feature (61): n=t or g
aggatgcattttctctcatcttactgtcagttccctcattgctggtgtggtttttaccagnggctgcatctgcaccatgcctgacatccagtgagcagtcctccgaggtgtggaaaggctg

SEQ ID NO: 8878 - DNA, 121 bp, Artificial Sequence
  Synthesized
  misc_feature (61): n=a or g
cactaacagtacaaagccagccagcttttaaatcctgccaccaggatttaaaacggccacnttgtgccatactatctttggttttacctttgttgtccaccttttctttcacttcttgtga

SEQ ID NO: 8879 - DNA, 121 bp, Artificial Sequence
  Synthesized
  misc_feature (61): n=a or g
ctcaagtgctgtgctgaggcacccagaatgtgctactgatatggaagaagaaaattatagngaaatgttaaataaaatatattatagggaaatgttaagttttacacagttggagaactag

SEQ ID NO: 8880 - DNA, 121 bp, Artificial Sequence
  Synthesized
  misc_feature (61): n=t or g
aagtttgataaataggagaaagtgcttcatattcagcagtgtgagagaatggcaaggattncagtgggcttggtgaggtaaataatagaattgtttgggttggaagggaccctaaaaggcc

SEQ ID NO: 8881 - DNA, 121 bp, Artificial Sequence
  Synthesized
  misc_feature (61): n=a or g
gggggtttgcctgagggctacagaagagggaagctctgcgtaaggcaggcaggggtgaccnaactcattttacaaacaaatgggctagctagcgttttgccagcacccggggattgcacac

SEQ ID NO: 8882 - DNA, 121 bp, Artificial Sequence
  Synthesized
  misc_feature (61): n=t or c
aaactcctgatgttaacaaaaactccctgctatgtaaacaggccagatgctgtgggatgcngtctgcaggctcacgtaccctctgtgtgctgtgggagatgctggatcggcatctgtgggc

SEQ ID NO: 8883 - DNA, 121 bp, Artificial Sequence
  Synthesized
  misc_feature (61): n=t or c
atgactgcagaacttggaaaagatgccacagagcagagctgccaggacacaatccattcantggatgaaacaaacagtcatgagtgatttggtcatggaatggaagagctttacactggag

SEQ ID NO: 8884 - DNA, 121 bp, Artificial Sequence
  Synthesized
  misc_feature (61): n=t or c
cctgcctccttaaccatttatttgcttcctggaggctgttcagctcagggatgcaaagagntgctttgatttagattcttccagggtatctgtgacctgactgcagcagcgggtggcctct

SEQ ID NO: 8885 - DNA, 121 bp, Artificial Sequence
  Synthesized
  misc_feature (61): n=a or g
gttgctgcatctatccagcagctgtggggtggagcacattatgtagttagcattcacacancaaccctgcgtatcaggttgagacaggaaatggtaaatcctgtatcttgctggaatcaca

SEQ ID NO: 8886 - DNA, 121 bp, Artificial Sequence
  Synthesized
  misc_feature (61): n=t or g
aagctgggtccactgctatgcttgggatgtttgccccgcaaaggaactgcaggatttccancttgcagtaaaacttatcgctactagccattatagcttagtgtaatcattagaagccatg

SEQ ID NO: 8887 - DNA, 121 bp, Artificial Sequence
  Synthesized
  misc_feature (61): n=a or g
acactcttcatgccaaagtcttgttccccgctagagccagttgctcactaaagcctctgancttcaattaacaagcaccaggtaatttaacacttgactcccaataatccctttattttaa

SEQ ID NO: 8888 - DNA, 121 bp, Artificial Sequence
  Synthesized
  misc_feature (61): n=t or c
gatcttcagcagagatgacctaaaacttccagaatcggggacttaaaacagataagcaccngctctccactgaatatattctgattctaaaaaaaatatgcaactaagtagatattaatga

SEQ ID NO: 8889 - DNA, 121 bp, Artificial Sequence
  Synthesized
  misc_feature (61): n=a or g
ttatccattcaaatttgcccttaattaacaagatggcatctttgaaaacatcctaactganctcaaatattcaaataattacttttacaaacctgcaacaaacaccatgtcgataaaagat

SEQ ID NO: 8890 - DNA, 121 bp, Artificial Sequence
  Synthesized
  misc_feature (61): n=a or c
acaaaagattctgtccaacagattttctgtttgttggtaaggcccacagggagctatgganattaacaactactgatctggggagggcactgtgcaggcactgatatggacacatcaccca

SEQ ID NO: 8891 - DNA, 121 bp, Artificial Sequence
  Synthesized
  misc_feature (61): n=a or g
tggtgcacgcttaaaatggaagattttatggtagctgtgtggtcttttttaaagtgattcntagctatagcagaatatgatgcggagtggtgctcaagcgtgtaacagactggaaagtata

SEQ ID NO: 8892 - DNA, 121 bp, Artificial Sequence
  Synthesized
  misc_feature (61): n=a or g
aggattaggtggaaaaagctaggatgagttggtgactcttttaaaaagttgcaggaaacanaagtgaggactggattaaatcctactagcagggcagaaagggctatgagtgccagctagc

SEQ ID NO: 8893 - DNA, 121 bp, Artificial Sequence
  Synthesized
  misc_feature (61): n=a or c
agtttacagctgttctgtgaggctggagaggatcgaagtgttcagggtgcactggtaaatntggcctgacgaaaaagaacgaacttgcattattattttatcagttcttaaactgccttgg

SEQ ID NO: 8894 - DNA, 121 bp, Artificial Sequence
  Synthesized
  misc_feature (61): n=a or g
actagtaatgtcagtaatctgtttcactaataccatatttaaacatttcaaagagattctntgtcctcatctctggaaagcaccactgcaggagttgaagatacactgagaagcctcggag

SEQ ID NO: 8895 - DNA, 121 bp, Artificial Sequence
  Synthesized
  misc_feature (61): n=a or c
gtgtacttatttctctctgacagaaggattgctctctgtggcccaccagttacgcccatgnagaaaaacagaacagtctgtcctttaggtggtaccaggctgtataacagaacaataaaga

SEQ ID NO: 8896 - DNA, 121 bp, Artificial Sequence
  Synthesized
  misc_feature (61): n=t or c
ttcttccttaagtttggttgaacaataaaactgcctaagcctggcaaacttagaagcccanacatgcatttctagagtttattacacatgcagctcttctcacctttagtcattaggagtg

SEQ ID NO: 8897 - DNA, 121 bp, Artificial Sequence
  Synthesized
  misc_feature (61): n=t or c
ctgtaaaatatgacggtatttcctgtaatttttgggcttaaacaggaatactatgaccttntgaaacatttttgcctcaagcagtttctatactaaactggaaaaactacagtaatattaa

SEQ ID NO: 8898 - DNA, 121 bp, Artificial Sequence
  Synthesized
  misc_feature (61): n=t or c
cttccctatctgaatggaggtcagtctgtaaaagcctactgattagattcatttcattttnattttcatagcctcctaagattctcagcaatggctttaggaggaagaatttccattatct

SEQ ID NO: 8899 - DNA, 121 bp, Artificial Sequence
  Synthesized
  misc_feature (61): n=a or g
tcatgcattagtgagcacaatgcatgaggaaggggcttgacattggtccacttgccaacantgaacagaattcttctttgctgactgaaccacgtagtgattcctttctgcaaatatattc

SEQ ID NO: 8900 - DNA, 121 bp, Artificial Sequence
  Synthesized
  misc_feature (61): n=t or c
gtctctgcaaaataaaatgaattaaggctgcattagccagcgaggtttcacttcaaccatngtgatgtgactcgggtcttggcaaattttttcctcctcttttttaatggaattctaatta

SEQ ID NO: 8901 - DNA, 121 bp, Artificial Sequence
  Synthesized
  misc_feature (61): n=t or c
gaaaagaaatggggagtttattttctagcatgagttcatttgagatgatcatttacactanaaacttactgtgcaccacttaaatattgccccttcacccaataaggagtttttaaatgtc

SEQ ID NO: 8902 - DNA, 121 bp, Artificial Sequence
  Synthesized
  misc_feature (61): n=a or g
ctggcaacaagagcatttagtctttaaagtgctttatatccttgtaacagctcagggctanttctgctcacagtaattcagttaggaccaaattctaaaaagactacatctcttgccattt

SEQ ID NO: 8903 - DNA, 121 bp, Artificial Sequence
  Synthesized
  misc_feature (61): n=a or g
ggtagcagtctgaaacatgtagcagctctcagatgagctccgcaagatgtgctttcacttncccatgtgtatctctttgtttctgaatttaaaatgtggtacattggagtgaggaaaacta

SEQ ID NO: 8904 - DNA, 121 bp, Artificial Sequence
  Synthesized
  misc_feature (61): n=t or c
ttctggattgtgtcttcaactgaaaactcaggagtgactgcctcctactcaagtaggattnctgcatctgagtctaggcacaggtccgtggcgctgcagttggtggactgctttttgcctg

SEQ ID NO: 8905 - DNA, 121 bp, Artificial Sequence
  Synthesized
  misc_feature (61): n=a or c
cagtggaaggaagaactggcaaacgctgtggatgtagaatttaattaaccattctcatttntgtcttcaagatttctttccttttttacatcagaatttaattcccattttcctaattgtt

SEQ ID NO: 8906 - DNA, 121 bp, Artificial Sequence
  Synthesized
  misc_feature (61): n=a or g
gaaagctgaaatctgggcttgctacttactagctcagtaccaggtaaagcctgaagctagnttttaaagataagcttcttgcaaaaatgcaggatctccctgcaacagtgattgagtaaat

SEQ ID NO: 8907 - DNA, 121 bp, Artificial Sequence
  Synthesized
  misc_feature (61): n=t or g
gactctgctacaatagattgcaagcgctctacagtatctttccttgtagccttttaaaagnttcaccaagtgcacgtttgtagagtaacggggtataaagcctctaaccacagaactatcc

SEQ ID NO: 8908 - DNA, 121 bp, Artificial Sequence
  Synthesized
  misc_feature (61): n=a or t
gttctcacacatgaagtaaccgttcaggctcctgggaaatacatgagagggctctttcttnaacagtggcaatgcccagaccacactccttcctagggtacatgtaatgttgtatgtgttg

SEQ ID NO: 8909 - DNA, 121 bp, Artificial Sequence
  Synthesized
  misc_feature (61): n=a or c
tgtctgtgtttaacacgcaaatatgtcatttcttctcctgtgtttgacttcctcagcaagntttacaatattagatgctagtaatgtgtaatagaatgaatttagtaactgccagattaaa

SEQ ID NO: 8910 - DNA, 121 bp, Artificial Sequence
  Synthesized
  misc_feature (61): n=t or g
gcaggaagcctacataggaaaaacaaacctgctttaatcatgtgcccagctactgctgttntttcaaaatctctctgaacatttgtcagtatcaccttcttggtgatctgctctacaagcc

SEQ ID NO: 8911 - DNA, 121 bp, Artificial Sequence
  Synthesized
  misc_feature (61): n=t or c
gaaaatttggcttatgaattttattacttggttaagtttatatctttatatactctgcatnttaagttttagttaggggttgttccattttcactcagaggtactaatttgtttggatttt

SEQ ID NO: 8912 - DNA, 121 bp, Artificial Sequence
  Synthesized
  misc_feature (61): n=t or g
caatagtagaaaatttctgaataaattgacctggaaaaagtacatgtaaattggaaaaacnatacacttcattatgatataatgcactgaatgagcttgccttaaaggaaaaaataaatat

SEQ ID NO: 8913 - DNA, 121 bp, Artificial Sequence
  Synthesized
  misc_feature (61): n=t or c
cacagctacagtacaccccagtttctaaaacactgccatccaacatcttcataatgccccncaagcctggtgcctcccccaggagagtgctctcagatagcgacatcccagcaggacattt

SEQ ID NO: 8914 - DNA, 121 bp, Artificial Sequence
  Synthesized
  misc_feature (61): n=t or c
tgcccgaggccaggctgtgttcaatgactgctctgcgtcaggaagtccatcggggtatacngaaaggggaaatgcatccatggaaaacacgatggtggtttgcccttgttaaaagtgaggt

SEQ ID NO: 8915 - DNA, 121 bp, Artificial Sequence
  Synthesized
  misc_feature (61): n=t or c
cacggctgtttgtatgggtcaaaaatagccagctcagacagatgaaagcactgctgggtgntgggaggtggtacaaaaatcacagctttgctgttgaaaactgtgtgtttagaacactgca

SEQ ID NO: 8916 - DNA, 121 bp, Artificial Sequence
  Synthesized
  misc_feature (61): n=a or g
tttcatgaacatcagagctccagtgctagaagtagaagcccacttagaaacctatgattcnctgcaaattttctgaaatgcagtcactggtacatgaattgccctcaaatgtgccatctct

SEQ ID NO: 8917 - DNA, 121 bp, Artificial Sequence
  Synthesized
  misc_feature (61): n=t or g
attttagtgacaactaaaataaatggcgcttgaagattaccaccatcttcactactttacnttttctgtaaaaataatcctgacctgcatttcaaattctatttgcagttcaagatttcct

SEQ ID NO: 8918 - DNA, 121 bp, Artificial Sequence
  Synthesized
  misc_feature (61): n=t or g
gagaatcttgctgcatcactgttttaaattttgctaaatcacaataataataaaattgctncagggttaacacctcaaggaattattattggaactcttctgagattggtgcttcatgtaa

SEQ ID NO: 8919 - DNA, 121 bp, Artificial Sequence
  Synthesized
  misc_feature (61): n=a or g
gttcacagagtcatgtaacacctacagataagcagaacttgggttaccagagacaaaacantctaccattaaatttatccttaaacacaaactgaaagagtttcagctttgaaggtatcct

SEQ ID NO: 8920 - DNA, 121 bp, Artificial Sequence
  Synthesized
  misc_feature (61): n=a or g
cggaagaaatagctctagtggaatggaaagggctaaaccaggtcaaaatgctggaggattncagttcaaagcatgctcaaagagctttaataaagagaatatggaagggataccaaaacga

SEQ ID NO: 8921 - DNA, 121 bp, Artificial Sequence
  Synthesized
  misc_feature (61): n=t or c
aacacaatccttatgagccttctcacccacgatcagcacttccattttcacacaagccttnaagaggaaaagatggcaccttcagttgggactatttcaaaagggcctagcagcagctgca

SEQ ID NO: 8922 - DNA, 121 bp, Artificial Sequence
  Synthesized
  misc_feature (61): n=t or c
aagctccctgtaaccacaacttggctgactgtgccctcttcgattacattgtactttcttnctgtaaagagcaattctagtctgtaagttcactgtagcctttttttccatcctttcaagc

SEQ ID NO: 8923 - DNA, 121 bp, Artificial Sequence
  Synthesized
  misc_feature (61): n=t or c
gatggaaaaaaattattctgtcaaaatcaagaaaaccacatttccatcctcacagttctcntttggttcctttacttccattaagcagcatttcctcttccaggaggatggggaaaagcaa

SEQ ID NO: 8924 - DNA, 121 bp, Artificial Sequence
  Synthesized
  misc_feature (61): n=a or g
atgatgaaagaaaggtatttctcctcatctttgttgtattaactagtttcctttagcaatntaatgcagatagattccttaggtatatatcaaagatcaaatctgtctctttccttttaaa

SEQ ID NO: 8925 - DNA, 121 bp, Artificial Sequence
  Synthesized
  misc_feature (61): n=c or g
aatacgtaatgatagataaatatatctgtgtgtgcgtgagccagatcagatgcagaagtgntctgatgtaactcgggtgctgggactatgttctgatttatttttttctgctctttgagac

SEQ ID NO: 8926 - DNA, 121 bp, Artificial Sequence
  Synthesized
  misc_feature (61): n=a or t
ctcttaacaatgccccaaggaaacatactgtttttacttacctgtcttatttattcagtgnggactataaagcagtggaagaccaaaagcatttaccaaagatgtctttttaggtcagaag

SEQ ID NO: 8927 - DNA, 121 bp, Artificial Sequence
  Synthesized
  misc_feature (61): n=a or g
tgttccctcattttctgccactgatagaaattaacgaaccaacttgacctgagcctgactnaagttttgacttcagtctggttgttgacaagcctgcaattatatattcaagtttcttcag

SEQ ID NO: 8928 - DNA, 121 bp, Artificial Sequence
  Synthesized
  misc_feature (61): n=a or g
ttacattattgtggtggtttaataccagtgagcacctaagaaccatcatgccattctctcnctccctcttgacagaacggggagaaaatacaatttaaaaaattcatgggttgggataagg

SEQ ID NO: 8929 - DNA, 121 bp, Artificial Sequence
  Synthesized
  misc_feature (61): n=t or c
ctccttttccaggccaccctagtttaactcagggcacacagtgacatctccctcaaaaaanggagagccacatcactgaaagtctagagactttagtctctgttataaaatctgatctgtt

SEQ ID NO: 8930 - DNA, 121 bp, Artificial Sequence
  Synthesized
  misc_feature (61): n=t or c
acctcttgacagctgatctgcttccattttgttctcaaccacaaacagcagaactgttttncaactcaagaggagtgggagaccaggctgtaataatgggacaacctgaaatcagtaagtg

SEQ ID NO: 8931 - DNA, 121 bp, Artificial Sequence
  Synthesized
  misc_feature (61): n=t or c
gctggggtggctccctgttttggtagaggagtaacttctatctcagaaatactggatacanattattaggaaaagacgtggctaaatgtcagagattagacacattttcttagcattaatt

SEQ ID NO: 8932 - DNA, 121 bp, Artificial Sequence
  Synthesized
  misc_feature (61): n=t or c
gaggtaagagatacctgcgatttgtgggctctgtatattcagggtcactcaagggaataangtgtgggatgtctgcaaatgcaaaatgaattcaggactccggggctcagcttttgacaat

SEQ ID NO: 8933 - DNA, 121 bp, Artificial Sequence
  Synthesized
  misc_feature (61): n=t or c
atcaaagcagagcaatactaggcttcctccgtaagtgtactgcagaattcaaatgcctganttgatcctaattgcatcaaaaagagacaaatggctcctcacattaataatacccaaaaca

SEQ ID NO: 8934 - DNA, 121 bp, Artificial Sequence
  Synthesized
  misc_feature (61): n=a or g
aagtttttagatggccagaatttgcaggtaccacatgatggccacgctcgtattcccagcncaaataaccacctagacaggtgcatctgatttagctttagtcataatggttagaagaaca

SEQ ID NO: 8935 - DNA, 121 bp, Artificial Sequence
  Synthesized
  misc_feature (61): n=t or c
gcagcaggggaagagaagtggttgtggaagaaaaatctgtaagaaattatattactttaanattattgttcacaaaacaactgttttgtgtgtttctttttcttgtaaggctgcagaactt

SEQ ID NO: 8936 - DNA, 121 bp, Artificial Sequence
  Synthesized
  misc_feature (61): n=t or c
gatctaaaaaaccgcactctacatgatagccccaaatcaatttcccatcaccagttgcttnagaacacgatttgacaagttttttacagctgaccacagatgaaacatcctctgagagagc

SEQ ID NO: 8937 - DNA, 121 bp, Artificial Sequence
  Synthesized
  misc_feature (61): n=t or g
ggtgaaaatgggaaagaagaattccacaaagatctaaaagtttactatcataagacagctntgtcagtatccatgcatacggttgtataagcctgtgtttacattttttggttattaaatt

SEQ ID NO: 8938 - DNA, 121 bp, Artificial Sequence
  Synthesized
  misc_feature (61): n=c or g
caatgggatcagaaagtgaatgtattttgtaatcctattatgccttagaaatattcaaggnccacccacattagattgcaatttacagtctaactgttcttcctatatgtaacttgaagca

SEQ ID NO: 8939 - DNA, 121 bp, Artificial Sequence
  Synthesized
  misc_feature (61): n=c or g
tctggtcttaattgcctttgaatttcccattttattccaaggaacttcttggttgaatctnttttttaagaggttacaatatttcccttaaaagatattttggaatgtgtaatttttgaaa

SEQ ID NO: 8940 - DNA, 121 bp, Artificial Sequence
  Synthesized
  misc_feature (61): n=t or c
ttttatgaagcataataaaacagtttctcctgaatgtttctgaacaaagcttgtctgtttncccatcacaagcacaatgagattgaattttcaaatttcttgtctttctaatctattaaga

SEQ ID NO: 8941 - DNA, 121 bp, Artificial Sequence
  Synthesized
  misc_feature (61): n=a or g
taggtatcagtttgctggctgctgattcatgtttgtacttggggatataagcatactcctncataattttatcaaagctattttcttttttgaattgtgtgacatttttattataaaatgc

SEQ ID NO: 8942 - DNA, 121 bp, Artificial Sequence
  Synthesized
  misc_feature (61): n=t or c
tggcaaacttgcatcactgtaagaaatccaacaaaccatacttcagaaattataacctaangacaagagatgtacatttaggagacttagaaaggtctcgtatttcaaacaaaatttgcat

SEQ ID NO: 8943 - DNA, 121 bp, Artificial Sequence
  Synthesized
  misc_feature (61): n=a or g
gctttcttaatcttcacttccactttggcggtttctttgcatcaagactcaggtttggagngagaagtacaatcctttcccagagcagactgggtaggacaggatagaatagttcatttga

SEQ ID NO: 8944 - DNA, 121 bp, Artificial Sequence
  Synthesized
  misc_feature (61): n=t or g
ggtaaagcagtgggagagctaaatgagttggtggtggcagagttcttgtttcccttgatcngtgtagaccacagtaatactccatcactgtgtaggcctagtgctacatctgggtagtgtc

SEQ ID NO: 8945 - DNA, 121 bp, Artificial Sequence
  Synthesized
  misc_feature (61): n=a or g
agatagaaatagattaaagtgcaagaaaaacttcggaatggatctcatacttctaaattcnacttgatttataagtagtcatcactatactacaagggttccccaccaactcatctgcatt

SEQ ID NO: 8946 - DNA, 121 bp, Artificial Sequence
  Synthesized
  misc_feature (61): n=t or g
taagttctgtgtcttgcttctttgtccttcagaaatgctctgtttctttgctcagctgaanggcagggacgtcagcagcagggaaagctgagcagaagaatcagggctccaagctccttgg

SEQ ID NO: 8947 - DNA, 121 bp, Artificial Sequence
  Synthesized
  misc_feature (61): n=t or c
gtagctgtcctaaccatttttgcaaacctcagcatgctggcatcatgcttaagtcctggangtaatgcagaataactgttttgtgtgcaacttcttataaaggttttaccctccctcacag

SEQ ID NO: 8948 - DNA, 121 bp, Artificial Sequence
  Synthesized
  misc_feature (61): n=t or c
tgcccaaactctacaagttcagtagaagaaaccgtatcagtgggagattctactcgtatgncttaaaactatttagtgctttatatttaaagcgctcatggtcaccacacttacaaatgtt

SEQ ID NO: 8949 - DNA, 121 bp, Artificial Sequence
  Synthesized
  misc_feature (61): n=a or g
tttgcattgcttcgctcctcaaccaccaagactgggaatctgtctcaaagcactgatccgntctatcctccatctttaattcagtcaaaacttaaaataaacaacaggtaaatgcctctat

SEQ ID NO: 8950 - DNA, 121 bp, Artificial Sequence
  Synthesized
  misc_feature (61): n=a or g
gtggatctgaagtttgtgtgtagactagtttgcacacatctgtcatttttatatgtttacntttataaaaaaagagcagagaaaaagatctttactcttgaggaatagcatttttcccacc

SEQ ID NO: 8951 - DNA, 121 bp, Artificial Sequence
  Synthesized
  misc_feature (61): n=a or g
ctgtaagcttgcagagcacttcctgatgaagatgtcaaaatggcttttaaagtgaaaattnacataaactaaaatgactgttcaatggaaaactccatccttccctctatggaaggcagta

SEQ ID NO: 8952 - DNA, 121 bp, Artificial Sequence
  Synthesized
  misc_feature (61): n=a or g
ttgcagtcctaatttcttcctagagtctgctcagatgtagtttttcatttccattgtttgnggtaattaaaaaactatcagttactgtatttgaaagacatcccctcagaaattcccctat

SEQ ID NO: 8953 - DNA, 121 bp, Artificial Sequence
  Synthesized
  misc_feature (61): n=a or g
cgggcttttgcaaagcctgttggcgtcagaagcacttgcacaacttgtactacgtctactntatcagaaccgacagaactggcagctcttttaaaaaacaaaaacaaacaaacaaaaaaag

SEQ ID NO: 8954 - DNA, 121 bp, Artificial Sequence
  Synthesized
  misc_feature (61): n=t or c
ggataatggacaggtattgccttcacgtggtgctgtaaaggttgaagatgacactgcccangaataatcactgctaactagctaaccattctacttgttgaaagagttttgaaagtgatct

SEQ ID NO: 8955 - DNA, 121 bp, Artificial Sequence
  Synthesized
  misc_feature (61): n=c or g
aacttcatttgcagagaaatcagagtactttcagaatgaaagggacttctcagtctctganacacaactatacaagctgttcattgcttgaaagaaatccaaggatcaaaacattgtagat

SEQ ID NO: 8956 - DNA, 121 bp, Artificial Sequence
  Synthesized
  misc_feature (61): n=t or g
cacatgggtaaggtttgaagctttgtaactactgagtacttgactactcagactgaagacnatataatttctgcttccaccatgggccaagctgtggccttcctccttatatcctccttat

SEQ ID NO: 8957 - DNA, 121 bp, Artificial Sequence
  Synthesized
  misc_feature (61): n=a or c
ttttttttctgacaatgtctctgcacagaatattttcttccagttcctggagccaggtccnaacaccttttagtgtaatgcagtgggtctagcctaaaagtctgaggtttgttatgtttat

SEQ ID NO: 8958 - DNA, 121 bp, Artificial Sequence
  Synthesized
  misc_feature (61): n=a or c
caactaaattcattatgaatacactgctcactactggacacattaatgcaaatagactgtngaatagtctatgggctacagaacattgtagttttcatgactctgcagcattagaacaaca

SEQ ID NO: 8959 - DNA, 121 bp, Artificial Sequence
  Synthesized
  misc_feature (61): n=a or g
gcatacaacctctagtgctcctggaagacctacaaatttccctcacacctgtctctagggnctgctggtccttctattgctcacaaaaataggtaatagctttcccatacttagcttttct

SEQ ID NO: 8960 - DNA, 121 bp, Artificial Sequence
  Synthesized
  misc_feature (61): n=a or g
aggtggcttcaagtgttatacaaaagtaaccagggcagacagtgcttctccctgtgttccntgtctatcctcctctaccccctgctttagtaataaactcatgtagaattccccaacacag

SEQ ID NO: 8961 - DNA, 121 bp, Artificial Sequence
  Synthesized
  misc_feature (61): n=t or g
tgcccctcttgcacagtttcttaattcaggtacatttacttggtaaatgagactaattaancctctatacaatacctaaccccatgacaagttccagatctcagcagccagcaataagctg

SEQ ID NO: 8962 - DNA, 121 bp, Artificial Sequence
  Synthesized
  misc_feature (61): n=t or c
aagaaaattgaaaatgcaaatttagtcctgaatcactttcctccatctactggacactcangactgtaacatgtgaaaaaaaaagttataatttggacataaatgcttcaaatttcatgcc

SEQ ID NO: 8963 - DNA, 121 bp, Artificial Sequence
  Synthesized
  misc_feature (61): n=a or c
cagaactgtgtcagaccaccagcactgaaatgcatgattaacatggcatattttcaagtantctttaatggtgataaggaaataaatacaaataaggcagcaatcactgtggtttacatat

SEQ ID NO: 8964 - DNA, 121 bp, Artificial Sequence
  Synthesized
  misc_feature (61): n=c or g
taagcttttgttcttgtcttaatcctttcaatttatgtatctttatactgctgaggaattntctttcagcaacattagctgaaccattagtcagaaagtacctgattgagtaaggttgaga

SEQ ID NO: 8965 - DNA, 121 bp, Artificial Sequence
  Synthesized
  misc_feature (61): n=c or g
agtcacggaaacaaacttggacacctgatgtcaggttgtcttgggaagaacaccaagaagngggcactcctgcccatcactagaaaataacaccagcaaagcgatatttgccataaggaga

SEQ ID NO: 8966 - DNA, 121 bp, Artificial Sequence
  Synthesized
  misc_feature (61): n=c or g
acctaaatagaggaaggaaataatttcagatggcctgcaccattccattctgtccatctgnctcttagtctgtcagagacctctccataccattggttatagagacaattctacttagctt

SEQ ID NO: 8967 - DNA, 121 bp, Artificial Sequence
  Synthesized
  misc_feature (61): n=a or t
tctgttctagaaatatcaagttccaatttagctttattgactttggcagcatttgcagaanatctatcagataacatcgtctgtatccaaatcttctgatgaacttttcttatcgtcctca

SEQ ID NO: 8968 - DNA, 121 bp, Artificial Sequence
  Synthesized
  misc_feature (61): n=a or g
aaaaatctattcgtagagggttataaataaataaattactgtcttccctttatatagtacnctgatttcatattaagcagttactcacttaggattttcaaatggcacagccatttgagag

SEQ ID NO: 8969 - DNA, 121 bp, Artificial Sequence
  Synthesized
  misc_feature (61): n=a or g
atttttgtgtgtgtgcgcgtgtgtgactcattgtttttcttcattccatctcaactatgtntggtagtggataggccggacaaccgttgattttcatgtcactttgattgcagctacctga

SEQ ID NO: 8970 - DNA, 121 bp, Artificial Sequence
  Synthesized
  misc_feature (61): n=t or c
actagcagcccctaagcccagtatatatagctcattatggatcacagagttcctggtggtnctgtgtttaagctcccagccatgtacagatgcccttttctatgggccatatagaaagttc

SEQ ID NO: 8971 - DNA, 121 bp, Artificial Sequence
  Synthesized
  misc_feature (61): n=a or c
ttatttacagccacatcaaaaaaagtgaagctaaccaaaaaaggcaagctgtttttataanaaaattaaatcaggttttccagttcaaaactgacatacatattggccttctcaattctaa

SEQ ID NO: 8972 - DNA, 121 bp, Artificial Sequence
  Synthesized
  misc_feature (61): n=t or c
tcagaagtagattttgcacagtggagtcctgtagcacgtcactccaaatttttctgagatnttcagaaatgagtggaatgttgggaacaaatatttgtaaggaaatctgtagaatctatgt

SEQ ID NO: 8973 - DNA, 121 bp, Artificial Sequence
  Synthesized
  misc_feature (61): n=t or c
agctctcagcaatagctttgctagaccatgtatcgtctgtagggctcatatggaggtaccnaagagaaggacctgaataaaggcaccaaaggactagagcaaagcaggtaagcagataaat

SEQ ID NO: 8974 - DNA, 121 bp, Artificial Sequence
  Synthesized
  misc_feature (61): n=t or c
ttgcagggttcttcttactttcatattagcttatccactcatgaatgctgatgttacaaanttgtaacagagagccttgcttaattctcaaataaatattacagtattccttgtgcctttc

SEQ ID NO: 8975 - DNA, 121 bp, Artificial Sequence
  Synthesized
  misc_feature (61): n=a or t
ccactgctgttgcttcttcctgccagtgaggtaaatagtagccctgttctggttattctgnaacaccagagaacaattttctggctatggagtagtgatgggaagctcacagactaatcag

SEQ ID NO: 8976 - DNA, 121 bp, Artificial Sequence
  Synthesized
  misc_feature (61): n=a or g
cagaactagttaaaatacagaactagttaaagagagtaatgttttgtgtagagaataggantatctttcactagagaggttatttgtggtgaggaaataccgtaaatgcggtaatactcta

SEQ ID NO: 8977 - DNA, 121 bp, Artificial Sequence
  Synthesized
  misc_feature (61): n=a or g
cttcagagttaataggttttaagaaagttgaggtaaagttctacagattcttccagttgantatgtttaacctctttggtgattttcccacctctgatgctgttctttcattttcccactc

SEQ ID NO: 8978 - DNA, 121 bp, Artificial Sequence
  Synthesized
  misc_feature (61): n=a or t
gctttagagggcctgctgtcacctgtgtcattccaagtctggttaaggcagagtagagctncccaactgtatatctttcaggaattaaggtctgttttgaaatccaccatgggaaactagc

SEQ ID NO: 8979 - DNA, 121 bp, Artificial Sequence
  Synthesized
  misc_feature (61): n=t or c
acatctcaaggacagaaaatcaactactacacaattgagttaaacagctaggatgtaagantgctgtattaacaggtaagcctacccaaactaacacaatacaagaagtcaaggccttgtc

SEQ ID NO: 8980 - DNA, 121 bp, Artificial Sequence
  Synthesized
  misc_feature (61): n=a or g
tacaagcattgataggttctagttacatatgccaacactagggaaacaaattgagaacacngaggacttatcaggtatatatcatgtactttacattttaaatctgcagactgaggggaaa

SEQ ID NO: 8981 - DNA, 121 bp, Artificial Sequence
  Synthesized
  misc_feature (61): n=a or t
gataacagcataatgaacagctaagtttacagtgcagtgaagaaaacaagattggatcccncttctgcagtagaaaagtcaacataataataactatactaaatttaagaaatattgataa

SEQ ID NO: 8982 - DNA, 121 bp, Artificial Sequence
  Synthesized
  misc_feature (61): n=a or g
aaagaggaaaattgcctaactcaacctgatgttactcagagctaacccagcaaggaaatanggccagaaagaattacattccttcctttcatgtgtcctgacagaataccagggaggaacc

SEQ ID NO: 8983 - DNA, 121 bp, Artificial Sequence
  Synthesized
  misc_feature (61): n=t or g
tgtccatccattacacagttctaacatgtaggaggcttctggggactagaactatcaccanaatggtgcagaaactcagaacaaaggagcctgtaatagttcaggttatttttttggcagc

SEQ ID NO: 8984 - DNA, 121 bp, Artificial Sequence
  Synthesized
  misc_feature (61): n=t or c
ggagctgtgtggctgtggagaataaccattcctctcaggcagatgttgtggctgagagtantagattttgtctaagcaatatggtaaaactcagtttttagggtaagatggccaagaaaag

SEQ ID NO: 8985 - DNA, 121 bp, Artificial Sequence
  Synthesized
  misc_feature (61): n=t or g
gagagagctgtctcactgcagcatgagataaagttgattttaacaatgttaggcttggttncattcttgctgttaaaaactggaaaacagtatggaagggaatataaccactctgctagct

SEQ ID NO: 8986 - DNA, 121 bp, Artificial Sequence
  Synthesized
  misc_feature (61): n=t or c
agacaaaatggaggctcctcaccctgtagctttcaagatgtggaactccttgtcacagtgngtgaaggctgtgagaagtgtttaatctgatggaagagaatggctttgtaccttttaaaac

SEQ ID NO: 8987 - DNA, 121 bp, Artificial Sequence
  Synthesized
  misc_feature (61): n=t or g
tcattgaaacaatgtctccacacatatgagcaaaagtttccctgttatagctatacttttnctagagaaaaatcctccccagtgtgttttgtcttcatgcttgtttaacatatggcaagaa

SEQ ID NO: 8988 - DNA, 121 bp, Artificial Sequence
  Synthesized
  misc_feature (61): n=t or c
cataatgttaatttttaacttctagcttttgaggctaaacattcaaagtcaggcatatctntagagctgagtgacacttcccattcagattaattcatgctattcctgcagtgcttataga

SEQ ID NO: 8989 - DNA, 121 bp, Artificial Sequence
  Synthesized
  misc_feature (61): n=t or g
aggaaatagagttatttcaaaaatgctagtaaacataaggaagttcaaggacacatgactnctgttggacagtgttttcagtgtacttcattctgggaacatttgccttgttacccacagt

SEQ ID NO: 8990 - DNA, 121 bp, Artificial Sequence
  Synthesized
  misc_feature (61): n=t or c
caagttttcgtttgctgtgttgtcttgctgccttggaagccctgctggcaggagttactcnggggagaaatagggcaggtataggtttgtagccttactgacaacgtgaggaggtgtttga

SEQ ID NO: 8991 - DNA, 121 bp, Artificial Sequence
  Synthesized
  misc_feature (61): n=a or g
agatggaccaccaccaccaccacccctcccttgcctatatgtgcagttatgccactaaacnaagactcctgatttagtcaggcagaccactcctcagcagaaccctggtaccttttattct

SEQ ID NO: 8992 - DNA, 121 bp, Artificial Sequence
  Synthesized
  misc_feature (61): n=a or g
gggcttgaatgatgttgactgcagtcttaggttttgcgactcaacctaaggtgtgtataangcaggtttattttggaattgagattgttccacttttttcatccttttgcctggttttact

SEQ ID NO: 8993 - DNA, 121 bp, Artificial Sequence
  Synthesized
  misc_feature (61): n=a or g
gaattgagggcaccttgcaattttttttttctgtgaaagaaccacagtgtagcatccagancatttctgctgcagtgttatctatgcttgctgtgtcatgataaatctaggcaaaatgatt

SEQ ID NO: 8994 - DNA, 121 bp, Artificial Sequence
  Synthesized
  misc_feature (61): n=t or c
gtctgccacaggaatgtcacctatgtataccaatgccccctccaaggatcacaaagtattnagcagaggagcatgacaagaaatgtcttgcctctccaccaaaaatttttgaaatgtcaac

SEQ ID NO: 8995 - DNA, 121 bp, Artificial Sequence
  Synthesized
  misc_feature (61): n=a or g
cacttccctgcaaaccctcagatggttttccatgccaatttcagaatgtcaggtgcaggantcttcccatggctgccataacaacgtggacatgatgtccacagaagcacaatcccgggca

SEQ ID NO: 8996 - DNA, 121 bp, Artificial Sequence
  Synthesized
  misc_feature (61): n=a or g
taaagaggggcttcaggaaagctggaggggggactctgtactggggagtgcagtgagacanggctaatggccttaaatgtaaagagggaagattcttgttagatattaggaggaaattctt

SEQ ID NO: 8997 - DNA, 121 bp, Artificial Sequence
  Synthesized
  misc_feature (61): n=t or c
gctcaatttgatctagggaaacatgaaaagcaagcaagattcagtactgttacttaaagantgtgtatgcaatattactgtaggcaagaattaatatgtcaagtaattttaactacaattt

SEQ ID NO: 8998 - DNA, 121 bp, Artificial Sequence
  Synthesized
  misc_feature (61): n=c or g
tattcacaactgatgtagggagattaaatatatgtatggataaatatagtcaatcaattanctaataagaggttaaatgttactgacagaaggattatcaagagttctttccatattgtga

SEQ ID NO: 8999 - DNA, 121 bp, Artificial Sequence
  Synthesized
  misc_feature (61): n=t or c
tccctgcatagacagatacactgaagtcaagatcagacaaagtgaattagaattatgtatnacttagaagaaagacgagggagaaaaacacagcttctacattagagctatataaatggga

SEQ ID NO: 9000 - DNA, 121 bp, Artificial Sequence
  Synthesized
  misc_feature (61): n=a or t
gggaatctttaatccaatcatataatgtctagaaaaataaatgatagaaagatgacaaggncaagattatacatctgagaagcgctacaggtatcttagttaggcaatattcatagctgcc

SEQ ID NO: 9001 - DNA, 121 bp, Artificial Sequence
  Synthesized
  misc_feature (61): n=a or g
aaaagaggttttattgtgctctgtttttgctcctttcaatagctttggaaaattatgtatncatgggtattttcagttaaaaattataaaatatgattaaactattacttaaaactcaaat

SEQ ID NO: 9002 - DNA, 121 bp, Artificial Sequence
  Synthesized
  misc_feature (61): n=c or g
ctacatccaagtttttccatagctgaaagagcagctaggatacaaatctgataaaagcttnttaaagcattcttccagttccactcctggaaaggtaattcagctgtctgaacaaagttct

SEQ ID NO: 9003 - DNA, 121 bp, Artificial Sequence
  Synthesized
  misc_feature (61): n=c or g
taaatttactcagaaacccgtaactcccagttacatcgtgacactgaaaaccattaaaggnagtgcagccttttgaaatgtagatgcatctgcatttagtactgaagaggtgttcgaatag

SEQ ID NO: 9004 - DNA, 121 bp, Artificial Sequence
  Synthesized
  misc_feature (61): n=t or c
acaagtatatctacaaaaagaaaaccttgtaaagtgtgtgggagaagtggggcaggaaatnatgagaaaccaagttttggataaaaaatagaagagacagatgggaaatgggtggtataac

SEQ ID NO: 9005 - DNA, 121 bp, Artificial Sequence
  Synthesized
  misc_feature (61): n=t or c
cagcctacctttgctacaatgaattaaaaatataggaagtgaataaaaaatggtaaatggngtcaactggcattgtatcaactccaggaatgttcacagccactgcatgacctgcagccct

SEQ ID NO: 9006 - DNA, 121 bp, Artificial Sequence
  Synthesized
  misc_feature (61): n=c or g
gaaactaacagtctcttggaataatatatgactgttgtctaataactcaaatgcttttctncaaatgtttcccaaactgcagtccacacagacctattagtggtcaatatctgatgtcttt

SEQ ID NO: 9007 - DNA, 121 bp, Artificial Sequence
  Synthesized
  misc_feature (61): n=a or g
ttatggctgtgaaaccatgggagatgttgtgtgcacccattcattctcagtgggatcctancagtctcctaaagtctcctaatccagacaagtaaaggtaaggctttgagacatgcagaca

SEQ ID NO: 9008 - DNA, 121 bp, Artificial Sequence
  Synthesized
  misc_feature (61): n=a or g
tttgaggtagaaataggccccggactggtgtgcagcatccaccacacattctgatctgccngaagtgtcattcacagacttagctggagaagcacagggcaaggcctcagtgctggaacag

SEQ ID NO: 9009 - DNA, 121 bp, Artificial Sequence
  Synthesized
  misc_feature (61): n=a or g
tcacctggaatagagatggataaatggagataaacatgttcattacacactttcagtgatntgtaatactaacaaacctgcagtgatagtgtgctccctgagcaggtctgtcctatgcggg

SEQ ID NO: 9010 - DNA, 121 bp, Artificial Sequence
  Synthesized
  misc_feature (61): n=a or t
tttcttttttatctttcatgagaagtacagcaaaaagcttcaggtttcatgtcaaggtctngtcacagtaataagtctgaacaggactggttgtacagacagatatgaataaggttctttt

SEQ ID NO: 9011 - DNA, 121 bp, Artificial Sequence
  Synthesized
  misc_feature (61): n=a or g
aaaacagtgaagtttttcacagatggtgacagttagcagttaatctccaagagaatctccnagcaataatggggagagaaaagtgcttagaaagagtcagccagattgtagctcaaagaga

SEQ ID NO: 9012 - DNA, 121 bp, Artificial Sequence
  Synthesized
  misc_feature (61): n=a or c
ctcctgactttgctccatgttcagcagacagatgaattcacagtcaaacattttggggctntcttattactattgtcagtgtttctgtgctgcgaagaggttatggtagacatcctcccag

SEQ ID NO: 9013 - DNA, 121 bp, Artificial Sequence
  Synthesized
  misc_feature (61): n=a or g
cactccccccgttggggtgaaggggctgagctgagggggagtaacacttgatatgcacacntatcactcatccacgtattgcggttcagggtactacctctataaagggtataaactcctg

SEQ ID NO: 9014 - DNA, 121 bp, Artificial Sequence
  Synthesized
  misc_feature (61): n=a or g
ctggtgaggaaaagtggaatttgcagtcaatctaaatccaaccaaaaacagcttagactgnagtgggggaaaaaatctgttttggagaatttcataaccattggaaagctttgtcttgaag

SEQ ID NO: 9015 - DNA, 121 bp, Artificial Sequence
  Synthesized
  misc_feature (61): n=c or g
cttttttttcttttgaagaaaacatttgatcctacttattgcttcctctgtttacctattnttttgtatctgttgcactgcattatttttttttcatggcagaaggtatctttattttgct

SEQ ID NO: 9016 - DNA, 121 bp, Artificial Sequence
  Synthesized
  misc_feature (61): n=a or g
aaaccagtgtttctgagaggcaattgcactggacagagatgtatggcagaacaaccatacnaagaaggcacactggcctcagatgaagaggacagtgctcaattaggcaggattagggaac

SEQ ID NO: 9017 - DNA, 121 bp, Artificial Sequence
  Synthesized
  misc_feature (61): n=a or g
aggagagaaacatcattcttggttatgtcagaaagagatgtactgatataaatgcccaatncttgtttgagggtctttagctgtcagcaaaaaaatatataaaatttatacctcccctgat

SEQ ID NO: 9018 - DNA, 121 bp, Artificial Sequence
  Synthesized
  misc_feature (61): n=a or g
cacttcatcccagctcaatgtcagtacttcctaagagtaagaaatcaagcaaaaatggcangaaacccaggaatgagcaaggagctatggaaaaactcagaggaagaagtgtatggaatgt

SEQ ID NO: 9019 - DNA, 121 bp, Artificial Sequence
  Synthesized
  misc_feature (61): n=t or c
tagaggagttagactgggtgacctttaaagattccttccaaccagacgattctgtgactcnatggcttcattagtgctgagacaatggagtaaattactgtgtgctaactatacagtattg

SEQ ID NO: 9020 - DNA, 121 bp, Artificial Sequence
  Synthesized
  misc_feature (61): n=t or c
tgtattatggcatctatggacctcacctaaagttgaattctcctctgaataatctctgtcncatcaacacgtaacagaacaccactttacattttgtttaagaactgaagtcttttttgct

SEQ ID NO: 9021 - DNA, 121 bp, Artificial Sequence
  Synthesized
  misc_feature (61): n=t or c
agcgatgaaacagtgcaataagagaagaaaagatgggctgaggaaagggaatgaccctggntaacaaggccatgaggaaacaattcctaaagattttgcagtacaatgcaggagtccttgc

SEQ ID NO: 9022 - DNA, 121 bp, Artificial Sequence
  Synthesized
  misc_feature (61): n=t or c
caatttcttctaaaatacaaaacaacctttaaaatcagctacagacagttggcgaccaagngttactaaatgacttccaaagttctaatgtccgaatttttcatttttttaaggaaaagaa

SEQ ID NO: 9023 - DNA, 121 bp, Artificial Sequence
  Synthesized
  misc_feature (61): n=t or c
aacacatttatgaaaatgatgacgtgggaaatgaagtgtattagttagggcttcaaaatangtatacctgcatttgggttctttgagtacattttcaggctggaacaatgtctgaaaatat

SEQ ID NO: 9024 - DNA, 121 bp, Artificial Sequence
  Synthesized
  misc_feature (61): n=t or c
tggtaattcaggaggttttccagatctgtctgtggagaactatggcttgactgatatcacngtatctcttaaaaggagccagggttctgcaagctaacttgtttatacaccgtgtattttc

SEQ ID NO: 9025 - DNA, 121 bp, Artificial Sequence
  Synthesized
  misc_feature (61): n=a or g
aagtgtttattgataccacagctatgctcaggatggcctgtgttcaaataattatcaaccnggttttcagaatctttgtggctttccagtgtaaagattccaataccacattctttgttat

SEQ ID NO: 9026 - DNA, 121 bp, Artificial Sequence
  Synthesized
  misc_feature (61): n=t or c
taagaataattaggtatgatgcttctaccccaaaataaggaggtcttcagagctttttttnccccccctttattcatttccagtgtatttctctaaaaatgcaaacttcaacttttacttc

SEQ ID NO: 9027 - DNA, 121 bp, Artificial Sequence
  Synthesized
  misc_feature (61): n=a or g
caaagacaggaagaaatataatccatagggtgtaggaatgaaatagctgcagtcaggtagnaatctcagggtagagattctgcagagaaaactgtatttctttttgcttttatttacaagg

SEQ ID NO: 9028 - DNA, 121 bp, Artificial Sequence
  Synthesized
  misc_feature (61): n=a or g
gcagaagactggcttctaaatcaaaaggaggactggctgcatcattgaagatgcttgaagnaattctctaacatgccagaacctctcagttgacagtctgttgttgaatctatactaatgc

SEQ ID NO: 9029 - DNA, 121 bp, Artificial Sequence
  Synthesized
  misc_feature (61): n=t or c
cataaaatcaaaatgtctagtttgtttagaagcagcaagctgaatgataatgttaatgtantttgagaaacacagtggcaggcacttatgagaatgttacctttcctgctgatacaggtaa

SEQ ID NO: 9030 - DNA, 121 bp, Artificial Sequence
  Synthesized
  misc_feature (61): n=a or g
aagtctcagcacagcagcccgatgagaggcgatgccaggcaggcgacggtctgagaggagnactgaggcgcgagtgcagctgtggtggtgggttttgctgttgctgttattactaatgggc

SEQ ID NO: 9031 - DNA, 121 bp, Artificial Sequence
  Synthesized
  misc_feature (61): n=t or c
acaaattaatttatattcctttctttccttcattacaaagtctgcattaccctgtacacantgaaggaagtatcctgtggttgtcttatgacatcttattttatttatctttgaatttatc

SEQ ID NO: 9032 - DNA, 121 bp, Artificial Sequence
  Synthesized
  misc_feature (61): n=t or c
tgagaaacgcaagcttcttccaaacatagaggaaaatttaattcctctaataggccactgnagtgatttggaaaacagaaaacagcagcacctacttttcgaaatcattaaggttatactc

SEQ ID NO: 9033 - DNA, 121 bp, Artificial Sequence
  Synthesized
  misc_feature (61): n=t or c
ttcacaaacatcaggtgagaattagatacctcagatggtttctccaacatcattttaagcntgatgttttcagtctgtaaaaccctaaaaacttttcagagaaatgtggagacccttatag

SEQ ID NO: 9034 - DNA, 121 bp, Artificial Sequence
  Synthesized
  misc_feature (61): n=a or g
cttgtcactcacaatacagttgagaatgattccttgacctccacaggaacctgttcagccnttgctaaccacttttagagacaacagaaatgttacttataagtagttgaacctaaaaacc

SEQ ID NO: 9035 - DNA, 121 bp, Artificial Sequence
  Synthesized
  misc_feature (61): n=a or g
aggttgaattcatgtagaagtcacattaaataaaaacgtatctgttagctgtcagagtcgngatttaatgtatgagtataatgttcagatactgttggaagaatttgcttgtgttcatatt

SEQ ID NO: 9036 - DNA, 121 bp, Artificial Sequence
  Synthesized
  misc_feature (61): n=a or g
cactggccagccctacttagaatgctgtcccgctggttgtatttctcagtgtgtattttcncttcagccttcacccaaaccactatctctactgcatccagaatttgtatttttttttttt

SEQ ID NO: 9037 - DNA, 121 bp, Artificial Sequence
  Synthesized
  misc_feature (61): n=t or g
tagtgcatgaatcagaagcagaacatagcaggaaaggtggagcagactggcaactctacanatgctcatctttagtggcagcaaacacagcatggagttccaggcctttttgacaaagcct

SEQ ID NO: 9038 - DNA, 121 bp, Artificial Sequence
  Synthesized
  misc_feature (61): n=t or c
tagcacaccagggtatatgcagtggacatacatccatgtagaccacctcttaaacaggagngcaatacaagtggcagaggctatttcctcccacaggagaaggagactctgctgcctctca

SEQ ID NO: 9039 - DNA, 121 bp, Artificial Sequence
  Synthesized
  misc_feature (61): n=t or c
tgtggtatatattgcaaccagagtaattcagccactaccgctacagtttttacatcttgcngcagcactgccaactacacagatgcctcccgggctcacctcagtagttttccctacagca

SEQ ID NO: 9040 - DNA, 121 bp, Artificial Sequence
  Synthesized
  misc_feature (61): n=t or c
gttgctaaacgtaatgaagaatagatgaatgcaagacatttgagcacaaaatgtgactacnaaagttttcaggggaggtcagtaaaaaacagatggataacatttgtccaataaccatcac

SEQ ID NO: 9041 - DNA, 121 bp, Artificial Sequence
  Synthesized
  misc_feature (61): n=t or g
tagattgttcgcagatcaacaatcagcaaatgcataaaatgtgataataattattgttttngggcagttacctcactccaggtcactgcgtttccagtcgtaacagtatgtgctgagacaa

SEQ ID NO: 9042 - DNA, 121 bp, Artificial Sequence
  Synthesized
  misc_feature (61): n=a or g
ggaaaaagcaagcttccagtcctgatgagacagatgacaaaaatatgcaggatgacagacncagcaggtagtgtgttatctttgagaagcccctaagtcactgtgggaacaagcagagacc

SEQ ID NO: 9043 - DNA, 121 bp, Artificial Sequence
  Synthesized
  misc_feature (61): n=a or g
aggaagccataggccagatcaacgtgcactatgaatgagatctctgttgacctccgtggcngtaggctcattgacatcagaccttttcaagcaattcttactttctccccttcgtccttca

SEQ ID NO: 9044 - DNA, 121 bp, Artificial Sequence
  Synthesized
  misc_feature (61): n=t or c
tatctgagaagcacctatgctttatgaagtacctgattatctgagtagaaaatacctacanaactttcatcttgcaaaatcttgcaacatcatctgaaacaaaaacttttattctcctgaa

SEQ ID NO: 9045 - DNA, 121 bp, Artificial Sequence
  Synthesized
  misc_feature (61): n=t or c
agaataaaggaaggaaaggaaaaagtaagaaaaaaatacaatggaagctacaactaattanataggtagacagtctacctgatacatacagaaagaaaaacaagattttgagcatacattc

SEQ ID NO: 9046 - DNA, 121 bp, Artificial Sequence
  Synthesized
  misc_feature (61): n=a or g
tctgccagcctgccacagtcaactcaactcaaaatctgtctatctaattatcttagacaangtactatgcaaagcaggcagattcagcctcccagctgatctgataaacaatatctaaatc

SEQ ID NO: 9047 - DNA, 121 bp, Artificial Sequence
  Synthesized
  misc_feature (61): n=a or g
gcttgtgataatgtagtttgtcagttagctttgctaaaggcttatgcatctgtccaagaantttcagaatcatctttaattaaattcacatgcatcaagtattaatgaataatattaccca

SEQ ID NO: 9048 - DNA, 121 bp, Artificial Sequence
  Synthesized
  misc_feature (61): n=a or g
actgtattagaataaatatacctcataagaatgctaatgagttttgaaaacaagacaaaanatgtctgtaccataactggtgggattttgcagttaattccatcctcctattatttttttt

SEQ ID NO: 9049 - DNA, 121 bp, Artificial Sequence
  Synthesized
  misc_feature (61): n=t or c
gggctgcagatcagtttttatgttgcctaagacaattgcatgttatggagtatatagaatnatttcagcactgcttttcttcatggtggaagataaaactgtatataaaattctgacgggc

SEQ ID NO: 9050 - DNA, 121 bp, Artificial Sequence
  Synthesized
  misc_feature (61): n=a or g
acaattatgtttcaaaccctttgcttttccaagtaagactgcacagccatccttctgcttntgcttcttttatatctggcattagcagcaggatgttttggcatcatatccggcactgcaa

SEQ ID NO: 9051 - DNA, 121 bp, Artificial Sequence
  Synthesized
  misc_feature (61): n=a or g
gttcgcaaaagtcagcctggggatgtctctccctgctctatacagacctttgcctatgggntaattacttgtcaggtggttatttcctgttatacaggataggattcatctacaggatggc

SEQ ID NO: 9052 - DNA, 121 bp, Artificial Sequence
  Synthesized
  misc_feature (61): n=a or c
gatttccttaagaactgtcctccacaccatgattttcagccatctgcttttcattaatttnctgaaatgtggtagatggtttattccatgttagtcatttgccttggtcttgttggaggac

SEQ ID NO: 9053 - DNA, 121 bp, Artificial Sequence
  Synthesized
  misc_feature (61): n=a or g
agcacgagcatatgccttggacaaaagctggagatagccctgctcctttcaacatggcacngttacagattgatttaaacaggtcgcgaaactgtatccttagttatagtgggtcagaaga

SEQ ID NO: 9054 - DNA, 121 bp, Artificial Sequence
  Synthesized
  misc_feature (61): n=c or g
catgaactaagttacatatatgtatttttttttcctagttattctgctttacaacagattnagtttctgaaaagggactttcttaagactgtcttccaaaggtacagacattggagctggc

SEQ ID NO: 9055 - DNA, 121 bp, Artificial Sequence
  Synthesized
  misc_feature (61): n=t or c
ctgaaattcagaaaatttccaatataggttatataaaaaataaaggtaagacttatccttnccaaacactcctgttaatagacgtgtcataaacaattcaaaggagcaagaaatttaagat

SEQ ID NO: 9056 - DNA, 121 bp, Artificial Sequence
  Synthesized
  misc_feature (61): n=t or g
aataatggttgcttttttaaaaatgttgtcaagcatataaatgctgaatattatcagaatnagtattgtcttgctaatggataatctgtaaggctcttgctttataagaatttgttctgtt

SEQ ID NO: 9057 - DNA, 121 bp, Artificial Sequence
  Synthesized
  misc_feature (61): n=a or g
catctgtgaagtagcttttcatcttcctgtctctcaatggctggatacctgcatggggcanggatcccagagaggctctatgaatgcagcctgtctctttctcccagctgggcttccacag

SEQ ID NO: 9058 - DNA, 121 bp, Artificial Sequence
  Synthesized
  misc_feature (61): n=a or g
cttactggtggatgtcactgttctcaagtatgtagtagtagcaactggggaagttctccancacatatctaactacatatatgtatccagcatgcacagacttatagcgaattctgtctca

SEQ ID NO: 9059 - DNA, 121 bp, Artificial Sequence
  Synthesized
  misc_feature (61): n=t or c
gaggatgtcaatgcacatgccacggcaaacagcttcaggtgtcctatctcatacttggccntcagctgtctactctacccttctactctggtcaaagagatgaggcaggagggctctcctt

SEQ ID NO: 9060 - DNA, 121 bp, Artificial Sequence
  Synthesized
  misc_feature (61): n=t or c
aaatctgaggaacccagagtcacagcctgctatcacacatcccgtggtcaaagtttcttangttatttcattgatcacatgaaaatcattactgcttccaaccctgctacattatccagca

SEQ ID NO: 9061 - DNA, 121 bp, Artificial Sequence
  Synthesized
  misc_feature (61): n=a or g
agatcttacatagaagtgggcatgtaggcaggcaaaatgctgtctgggacagagtggcatngctaaactgctcaggctgcagctgaagcctttctctctgctgtgacccagtatgcagtta

SEQ ID NO: 9062 - DNA, 121 bp, Artificial Sequence
  Synthesized
  misc_feature (61): n=t or c
tgttaatatacttgctatagctatgtatggaaagttctggtgaaaagaaacttaagcatcnaaatcactttttcatacatactccttttcttgtttgcattttgactgtagaaagttaaga

SEQ ID NO: 9063 - DNA, 121 bp, Artificial Sequence
  Synthesized
  misc_feature (61): n=t or c
gcatatatatcttgcatatatctttatatctgtatctatatcaatgctcacaaatatatanatataagtaaatcttgcaacctgactgcagtatatcactttagcaggatatgggtgctgg

SEQ ID NO: 9064 - DNA, 121 bp, Artificial Sequence
  Synthesized
  misc_feature (61): n=t or c
gtgaataaagatgggcagaaacaggcggcacaaatgaatttaaggcttcattaagcatcantgtggcaattacacaagggagcatgtgcaacaatgattaatcttaatgaaaatattatct

SEQ ID NO: 9065 - DNA, 121 bp, Artificial Sequence
  Synthesized
  misc_feature (61): n=c or g
tccatcgtaactacactacttctacaccagtgaaggcaaagttgatgaagagcatttctgntcactgaggccagctggaatgtaatagcccattcctctactaaaatgctttccctccagc

SEQ ID NO: 9066 - DNA, 121 bp, Artificial Sequence
  Synthesized
  misc_feature (61): n=a or g
ctaaatcagttattgagtctgacttgtgaaatggtgacctctgaaatagtgctcaatgaanatcactcagctcactaaagtcacaaaaaatacccactgcaaatcttctcttaattttaat

SEQ ID NO: 9067 - DNA, 121 bp, Artificial Sequence
  Synthesized
  misc_feature (61): n=a or g
gaaggacagatgctctgtgtaggctgacctgagctggggttggagtgagcagcagagttgngcagcatctttcctagcagcctgtccatcctcccggttacttgcaagtgggttgtggcca

SEQ ID NO: 9068 - DNA, 121 bp, Artificial Sequence
  Synthesized
  misc_feature (61): n=a or t
taaccaagataagctttactccatctgctgctgtatgtgggcacaatcagatcacactacngggagctaacaaaaatgtaaaccagttgttggaaaaagaaagctcagccactcatgcagg

SEQ ID NO: 9069 - DNA, 121 bp, Artificial Sequence
  Synthesized
  misc_feature (61): n=a or g
catgaatctctgtttcattttaagggatgaatcacaacatggtttaattctttattcatcntgaccataacaagaatcactcaccaaacctgcatgccagcattcctgcatactggaaagt

SEQ ID NO: 9070 - DNA, 121 bp, Artificial Sequence
  Synthesized
  misc_feature (61): n=t or g
atctgtctgcagataagggccaagcagcacttgcattaacaaggaagcacagaagaaattntagctgccagttccgtctttgaaatcataagctttaatgcctttctattgcactcacgca

SEQ ID NO: 9071 - DNA, 121 bp, Artificial Sequence
  Synthesized
  misc_feature (61): n=a or g
ttagctactgtaggtgtgcttttagaaatcacttccatcgtcatccagctgaattttcagncctccgggactactcccagaccagtcacattatgtgagagctgctctgaaagtaatgctg

SEQ ID NO: 9072 - DNA, 121 bp, Artificial Sequence
  Synthesized
  misc_feature (61): n=a or g
tcagctcggcaccactggatctgcagccaagaagtgcaagaagatgtgaactgtccactcnttccatgtgaaaccagtggcccacctgccaagatcccagtcagccctgaataaaatgtgg

SEQ ID NO: 9073 - DNA, 121 bp, Artificial Sequence
  Synthesized
  misc_feature (61): n=a or t
actgcccagagtcttttggaagaacgctcatctcacaagtgccctaaataataaaagctcngtgcatgtgatatttataacgtttacaaaacttgcccatttttgcctgccctgtttccaa

SEQ ID NO: 9074 - DNA, 121 bp, Artificial Sequence
  Synthesized
  misc_feature (61): n=a or c
ttcaacaaactggaaagtcctcatgtttcctgtcacattaaacttcctctgggctttatangtaatctctggatgcagaaaatgttctagtgctttagctctgttctcaggattgcatggt

SEQ ID NO: 9075 - DNA, 121 bp, Artificial Sequence
  Synthesized
  misc_feature (61): n=a or g
actgcaagagggtgagaggaactgctagcagtgtagatataatgtggtacctggaaaagangtctcatgcccagatgtgcttatcctatgaatttaggtccaaaactcagtgtaaactgtg

SEQ ID NO: 9076 - DNA, 121 bp, Artificial Sequence
  Synthesized
  misc_feature (61): n=a or g
aaatggtcatctgctcatatagcaaatgaccagtttatgactagtctcatttcactctggntgtcttcaaggaattgactctgttgatctgaactatacgtggtccctcagtggtgtcttt

SEQ ID NO: 9077 - DNA, 121 bp, Artificial Sequence
  Synthesized
  misc_feature (61): n=a or g
attatttccattctaatttcaaatcattttagagcgttaaagccttgaggtaaaagctctnggccttattttcattggtgggaattctgcacataaaatacagcctttctcctcagtcatc

SEQ ID NO: 9078 - DNA, 121 bp, Artificial Sequence
  Synthesized
  misc_feature (61): n=a or g
ctaccagcctgacagaaacctctagacttgctgtagagaggactactgatggagataaganagctgctgacagtagccaccatttctcatcctctgattgtggatgttgaggataaatggc

SEQ ID NO: 9079 - DNA, 121 bp, Artificial Sequence
  Synthesized
  misc_feature (61): n=a or g
ttattaccatgatactggccaaaactaatcctcgtgattatggatgggctgagtatttttncattctgtatttaggagcatactttgccaaatacccatttgcagtatgtgtacagaaatg

SEQ ID NO: 9080 - DNA, 121 bp, Artificial Sequence
  Synthesized
  misc_feature (61): n=t or c
attacatgcatgtctgttacgggtaacagacttatcaatgatcagcccactgacagccctntctagagctgcatgcttcctacccacacctcgcccagtgctgaatgcccctctgcctcaa

SEQ ID NO: 9081 - DNA, 121 bp, Artificial Sequence
  Synthesized
  misc_feature (61): n=a or g
gcaaaacatcacactaacaagtaagttagctcatgccctgaccatttctatgtgcatactntgaatacctactctaaagggaatctgtaagtatgagctttctgtccaaagattcaggata

SEQ ID NO: 9082 - DNA, 121 bp, Artificial Sequence
  Synthesized
  misc_feature (61): n=t or c
caatctgctttgacactgctcccttgaaatcattggacttttggtatgttgtttgaattcnccatcagcaccctaaggtgctcacacaagaaatggagctactgatcgccattccaatggc

SEQ ID NO: 9083 - DNA, 121 bp, Artificial Sequence
  Synthesized
  misc_feature (61): n=t or c
acaatcccagctccctcagctgctctccataacatctgtgctccaagcaagatgtcaatgngcgatcttccttaacgtgaaggcacctctaggcaccttcacctctccctattgcatgttt

SEQ ID NO: 9084 - DNA, 121 bp, Artificial Sequence
  Synthesized
  misc_feature (61): n=a or g
ggaagcagggtccttctctgacaatagggcacgggaggaaagggaagcattcacaccaacncattacagccagaatataatcaagttgcatagtgcagcgtcacggatttgtcagccatga

SEQ ID NO: 9085 - DNA, 121 bp, Artificial Sequence
  Synthesized
  misc_feature (61): n=a or g
aaccaaaaaaatgatgcagtttgagcctaatctgcactattaatccccacaagtttcttcnttctcatgcacttgtgaacgagcacagggatcttttccactggcaggacaaatgtagatg

SEQ ID NO: 9086 - DNA, 121 bp, Artificial Sequence
  Synthesized
  misc_feature (61): n=a or g
actactgcacctgttggatctcagaaaaagtcagcagcaaacagccttatcaaggtattcnggcatcaaatgcagctttaacaactccacggtgagcggtgggacataaatcagccccact

SEQ ID NO: 9087 - DNA, 121 bp, Artificial Sequence
  Synthesized
  misc_feature (61): n=t or c
agagaacaccttggctaagttggccatggagccccatgcagatggacagaggggataagcncccttctggccaggttgggattgctgcttcgggatatgccatcagtggccaatcccatgg

SEQ ID NO: 9088 - DNA, 121 bp, Artificial Sequence
  Synthesized
  misc_feature (61): n=t or c
ggcaaacccaacatacggtatccagagttggagagccagcatggactgtgcaggccagtgncagcctctggtcctggcctgaatgggaaatccctacatactaataggtttaaaattatta

SEQ ID NO: 9089 - DNA, 121 bp, Artificial Sequence
  Synthesized
  misc_feature (61): n=c or g
ccccaaatgcccatttcaggggaaacacctttggttgcacagtgatgctgcgatgtgcgtnggtgtaaagcggctcctggaataggagaagacgaaagttgctcctgagttcgctgcctgc

SEQ ID NO: 9090 - DNA, 121 bp, Artificial Sequence
  Synthesized
  misc_feature (61): n=t or g
aatgggagcacggagagcagtacggcaccagccgctcagtctgtgtttaccaggttccttntaaagctctgccctgtgatttcttgctcagaggctgggaggttgaagggctttgtgttca

SEQ ID NO: 9091 - DNA, 121 bp, Artificial Sequence
  Synthesized
  misc_feature (61): n=a or g
cccagcagtcctattcactaagaagagggggaaaataaacttggtgggactccaccatgcncttgctgtgggagtaggtttgatcaattacttggcgttctgctccccatttctaattatt

SEQ ID NO: 9092 - DNA, 121 bp, Artificial Sequence
  Synthesized
  misc_feature (61): n=a or g
ggctatagttgtagaaatactttaggtgagcagcaaactcagattctaactctgagttcancattttatggaagagaataaagcaaagtttggggttgagtaatgtgcagttcaattaata

SEQ ID NO: 9093 - DNA, 121 bp, Artificial Sequence
  Synthesized
  misc_feature (61): n=t or c
caccaaaagagatgaggttctcagttaggtaaaggcagaactgaagttccagatttggctncccacagtacaaatagtaaaataaaattgttagccacaattgtactaaccattagacaaa

SEQ ID NO: 9094 - DNA, 121 bp, Artificial Sequence
  Synthesized
  misc_feature (61): n=a or g
gaataactgctagctcaagaagggagtcttcagactctgttgaaatcagtgtacagacctntaaacacctattcagttcagcaggggtagctcattctttccagtaggcacaaaatccaat

SEQ ID NO: 9095 - DNA, 121 bp, Artificial Sequence
  Synthesized
  misc_feature (61): n=a or g
agtcatatagaaaaaaggagtcaaatttgtctgttttctttgcagacagaaatggtagatncggaatagctgcctaaagggaaggtgatttgaccagcgtttccctctctagcataatact

SEQ ID NO: 9096 - DNA, 121 bp, Artificial Sequence
  Synthesized
  misc_feature (61): n=t or c
ttcccacatgctccttgtaaaacaggagctgtgctggcactttcgtttgtttggtcatcanagagttggatacacaggaagagtatcacggcatgcttataccacagacaagttcaaatcc

SEQ ID NO: 9097 - DNA, 121 bp, Artificial Sequence
  Synthesized
  misc_feature (61): n=t or c
tgtggccaaggataccattggccttagcagcagaagcacatttctaggaatgggaaccaancctgttgagccacactcatttatgagagcaggtgactatgtgtgattttcattgcagcag

SEQ ID NO: 9098 - DNA, 121 bp, Artificial Sequence
  Synthesized
  misc_feature (61): n=t or c
caagtcttgtgctattggtgttttatccttaaaaaactgcgcagtgtatttaaatgcccanagatatcagtcagacagtgctggggaacaatgaatttatttattgatttcaattaatttc

SEQ ID NO: 9099 - DNA, 121 bp, Artificial Sequence
  Synthesized
  misc_feature (61): n=a or g
cgtggttaaaatgaacagtggtcatgataaagctttccaggagaaaaacagaaatcaaccnaacaatactattgagttgcaaaatgcaagcaaatgctctgaaaaccaaagcaagtatgct

SEQ ID NO: 9100 - DNA, 121 bp, Artificial Sequence
  Synthesized
  misc_feature (61): n=t or g
gtttattcaaaagaagtatggtattaaagcaagaatataacaaaacctactgtcaaataancctgtcttcctttcctaggtcattttgccagcggcttattggtagctctcaacctaggac

SEQ ID NO: 9101 - DNA, 121 bp, Artificial Sequence
  Synthesized
  misc_feature (61): n=a or t
cacacaacccaacttggaaattctgatgtaatttttatccacaaaggaagattccttgtgnctttttgtttgaagatttacagctctgtcatttaatgacataacaagtttgaatacatct

SEQ ID NO: 9102 - DNA, 121 bp, Artificial Sequence
  Synthesized
  misc_feature (61): n=a or c
tctttgatctcatcaggtacaccggcactgaaacagccccagggatggtccaacatcttgntaacctgctgtggatactccatcccctcaaggcatcatcatagccagccttgggcaacct

SEQ ID NO: 9103 - DNA, 121 bp, Artificial Sequence
  Synthesized
  misc_feature (61): n=a or c
aacccaggcctttctatggtcttcataaattctccttatggatggaatttcaagaaagagntctataatagcaccacaaagctctgcttacatattttacaaaacactgtttaaaagaact

SEQ ID NO: 9104 - DNA, 121 bp, Artificial Sequence
  Synthesized
  misc_feature (61): n=a or g
ccagagggctcctcgttcctgcctgagccactgcaggaggaaaggaccagcacagcagccnggctgcagctggagtggactgacactggcagaagtgcattgcttgacctttgggtgacaa

SEQ ID NO: 9105 - DNA, 121 bp, Artificial Sequence
  Synthesized
  misc_feature (61): n=c or g
cacttccatacaagcatggttgcacggagaggttggcaaggatgctacctctgaggtagtngtaaaaggtggttatactgaggttttaggaaccaaaaaagagattgatatgcaaaggtgt

SEQ ID NO: 9106 - DNA, 121 bp, Artificial Sequence
  Synthesized
  misc_feature (61): n=a or g
ccaggagcagcacctccagcacgaggacctttgtggtatcccagctctcctgaaggcacanggccaacagcacataaccctccatacagactaacagagcagtagtagagaggagactgaa

SEQ ID NO: 9107 - DNA, 121 bp, Artificial Sequence
  Synthesized
  misc_feature (61): n=a or c
ggcagcggaaggtctgtgctgcctctcttagcagcagagcaatactgtgctgagttgaatnaggagggagtaaaagcatggcaacaagctctgacttctgaatgcagtgtaagcagactgc

SEQ ID NO: 9108 - DNA, 121 bp, Artificial Sequence
  Synthesized
  misc_feature (61): n=t or c
ggctctacagttcccagtcattgagcacaacaacatggctttatcttagccctgtcagagnttaatggtgagctctcctgaccagcaggctcacctttcctgataaaagttctcttttctt

SEQ ID NO: 9109 - DNA, 121 bp, Artificial Sequence
  Synthesized
  misc_feature (61): n=t or c
acacagaagcttggactcagctatctttcaaggttccttccaacttcagctcttctatgantctaaacaccagctatttttcttccagaaagagaaaacagcaaaggagcacctcagacat

SEQ ID NO: 9110 - DNA, 121 bp, Artificial Sequence
  Synthesized
  misc_feature (61): n=a or g
atacacccatgttttggcagttgcaggtgctggcagatcaggagcaagccttacagttctncttgctgccactggcagcttattttcttgttcagtcctgtactcccttgcaaaaggtgct

SEQ ID NO: 9111 - DNA, 121 bp, Artificial Sequence
  Synthesized
  misc_feature (61): n=t or c
atgtcaggaggaggtgtgggtgactcgaagtgacgcggtaactttctgtccttgcaggtangatggcaactcgctgttgagcagcattgagtgctacgatcccatcatcgacagctgggaa

SEQ ID NO: 9112 - DNA, 121 bp, Artificial Sequence
  Synthesized
  misc_feature (61): n=t or c
tgcaaaccctgcagcaaccacactgagctttgggtgcgatgtcttctcatctacagctccncctccaaaccaagagagcagagggaaacacctccccgggaaacagaacgagctgctgcag

SEQ ID NO: 9113 - DNA, 121 bp, Artificial Sequence
  Synthesized
  misc_feature (61): n=a or g
cacaaccaaacgcccactggagctttcactcacacacttacactggaaggtgaactgctcnctttctggctgctctcttgtttacccttcccagcctttgagctttgggccacaagagaag

SEQ ID NO: 9114 - DNA, 121 bp, Artificial Sequence
  Synthesized
  misc_feature (61): n=a or c
tcatgttttttcaaggaatcattccctggtcaacagctgcaatcacctcgatcacactttntttgtttgcttatacaggctttgcctttttagacaaatgagcccctgtgggtgtggtaga

SEQ ID NO: 9115 - DNA, 121 bp, Artificial Sequence
  Synthesized
  misc_feature (61): n=a or g
aaaccacatttcaacacaattagcagcagtgactctcatgagatccaggaatcgaagagtnagtgaccaaactacatccccagactgtgcagaaaacactcgggtctgcaaaacctgctct

SEQ ID NO: 9116 - DNA, 121 bp, Artificial Sequence
  Synthesized
  misc_feature (61): n=t or c
tcctgtgatttaagctaagatcatttgtttaaaggtcatccagcagcactaccctctttcnattctgatttgttcactgtctccataaccagctctgcaatgaaggcagtcgttgctggga

SEQ ID NO: 9117 - DNA, 121 bp, Artificial Sequence
  Synthesized
  misc_feature (61): n=t or c
gcacaagctccaaatgagagcacgtccctctctccagcttcccagagcgaaatcagtcctngttcttcggcagctcacactgaaagtgtgtgcacatccaccccgtgctccagtgaggaca

SEQ ID NO: 9118 - DNA, 121 bp, Artificial Sequence
  Synthesized
  misc_feature (61): n=a or c
agattgttttagtcacattggaaccatcacctgtagtcactcagacggtgtggattttgtnattatttaagtttagctaaacatatttagctctcaccatcatttgggctctaagtaaaca

SEQ ID NO: 9119 - DNA, 121 bp, Artificial Sequence
  Synthesized
  misc_feature (61): n=t or c
cataaatgagtttttcatgcattaaaatactcattagtccaccccaggcagaggccaagangcgctgttgtgaaatcatgatgtaataaaagctaatgagctctgcgtagggtttaacccg

SEQ ID NO: 9120 - DNA, 121 bp, Artificial Sequence
  Synthesized
  misc_feature (61): n=t or c
tcacagttgaagcctctcctgtcagagacgcagacctaagagctcaccacaaggaactcangttcactagaaaagctatctgaactccgtgtttgcatgaaagacaagggaaaagatttat

SEQ ID NO: 9121 - DNA, 121 bp, Artificial Sequence
  Synthesized
  misc_feature (61): n=t or c
ctaacacaatccagatgccatcagcagtttaaatgtcttcagaaaaggtcaaattatctangcttaagacccactaaacacacaggcactatcaccaaagctctacttacggatgtggttt

SEQ ID NO: 9122 - DNA, 121 bp, Artificial Sequence
  Synthesized
  misc_feature (61): n=t or c
agataagaggtaaatcctaagtgccaaagagtgcaaaatgaaatgtctttgcaaaagcagnttgtgccaaccaacaaaatgatcccaaaacactgcctgcacccacactgccatggcagct

SEQ ID NO: 9123 - DNA, 121 bp, Artificial Sequence
  Synthesized
  misc_feature (61): n=t or c
ccacctgtagggcaggccttggggctcacagcactgggagctgttgttctctgcagctggngtgggtctgtttccgtctccacttggcagctctcaaggtccattcccttcagcagtgtct

SEQ ID NO: 9124 - DNA, 121 bp, Artificial Sequence
  Synthesized
  misc_feature (61): n=a or g
gagcttgcacagcagctgctgcaggctcaaacaagggaaaaccagccctgagtgctccttnggggcggccacggtgcctgcctgcagcaccccctgacctgcaccacacacagacccagcg

SEQ ID NO: 9125 - DNA, 121 bp, Artificial Sequence
  Synthesized
  misc_feature (61): n=t or c
actgttgggatggacgggaaggtgtaatatcctcaagcgaggggtgctggggccaagctgntcgctgagtccctgtgccccaatagcaggggctgcaattatcctttggccctcgcacaaa

SEQ ID NO: 9126 - DNA, 121 bp, Artificial Sequence
  Synthesized
  misc_feature (61): n=t or c
aaaacaattggctgtggaaagcagcacagaaacttcacatcagaaaggctgagcagggtangtgatgggattagaagaaacaagcaggaggaagacacagaagcagttttcctttttgaaa

SEQ ID NO: 9127 - DNA, 121 bp, Artificial Sequence
  Synthesized
  misc_feature (61): n=t or c
aataaatacctttgttgaggtcaatgttttattaaattgcttaatatacctaaattgttanaactaaaaaaaaccagcccccaaaacttcagttctccccactctttttattctatccgtt

SEQ ID NO: 9128 - DNA, 121 bp, Artificial Sequence
  Synthesized
  misc_feature (61): n=a or t
gcaatctggttgagcagcatcacactgttaaaatccttgtattcagcacagtgcttgtatntagtgatataccttattaaaggtattttgcagttcaaaaaatagagtcctggaaatgagg

SEQ ID NO: 9129 - DNA, 121 bp, Artificial Sequence
  Synthesized
  misc_feature (61): n=c or g
ctgaggagtttctcacaggacattaagttgcttttctaaattggactgaagttttggcaantgagtgccatagtcactgctattacatacgctggggcagctgactggctaaatgagcatt

SEQ ID NO: 9130 - DNA, 121 bp, Artificial Sequence
  Synthesized
  misc_feature (61): n=t or c
acgttgcgtgctgaacacatttctccccagggttcttctgcacatcgtgtccaagtgccangaggaaggcctagaccactacttgcgctccttcataaaggtcagtcacggctcactgctc

SEQ ID NO: 9131 - DNA, 121 bp, Artificial Sequence
  Synthesized
  misc_feature (61): n=a or t
cccctccccactgtgccataagccacgtccctcaaaaaaaccccttttccagccaactggntttctccaacaagagcccgtgcttgcagcaagccaaggaaatgcaaaaatctcacacagc

SEQ ID NO: 9132 - DNA, 121 bp, Artificial Sequence
  Synthesized
  misc_feature (61): n=c or g
agggactggtaagaaggaaacacagccacacaagtcatttttcaccgcatcctccagtcanagcagagtgccacgagatgctttgcagaggctcagcactgcagcagcagtgtgggtgcct

SEQ ID NO: 9133 - DNA, 121 bp, Artificial Sequence
  Synthesized
  misc_feature (61): n=t or g
ctcctgcaaagctgattgcagttattctgttatttcttagatgccttttgacaatgcttanaagtaatctgctggctccatgctagagactgaagaatggcacagtcatatttccttgact

SEQ ID NO: 9134 - DNA, 121 bp, Artificial Sequence
  Synthesized
  misc_feature (61): n=a or g
agtgctaatttactgcagttattttccagaagtgctaccttagtaaaataacatcagcctntgagacacatccttccctgtgtctttcctctcctgacccaagaaggaggcagaatggtag

SEQ ID NO: 9135 - DNA, 121 bp, Artificial Sequence
  Synthesized
  misc_feature (61): n=a or g
aacaataaagaaacaaagaatcagtgaagtatgtaatggaaaatattttccagattttaancacatccagtcccacagagattgtagcgctcaattccctgggttccttttcacactttgt

SEQ ID NO: 9136 - DNA, 121 bp, Artificial Sequence
  Synthesized
  misc_feature (61): n=t or c
tctgctccaacttgttttcccatgccctggaaagctttgtccttctattcaccgtgaagtntgagcttttgaagatgacacagcacactgtcgtccttctctggaacgtgcatacttttgt

SEQ ID NO: 9137 - DNA, 121 bp, Artificial Sequence
  Synthesized
  misc_feature (61): n=a or g
ccaaaccatgccaccactccccaggccaggtgagtgacacaaaagagccattaaaatactnatggcagaaagcttctgtacctggaatgccatgagccccagtacccacagtggtgctgca

SEQ ID NO: 9138 - DNA, 121 bp, Artificial Sequence
  Synthesized
  misc_feature (61): n=t or c
gtgatttaacagaattactagaaacataaattctcaaaggcacaagatcactctgtgcctncttcaggttgacttcagaagtgtaacatttgtgttttgttcttttggccatcctcatggt

SEQ ID NO: 9139 - DNA, 121 bp, Artificial Sequence
  Synthesized
  misc_feature (61): n=t or c
acacaaggaagtttcatcaaatttgtgaggtaagtccactttgtcttcctattagattcanagcatatgaattagaacaaatagtgtataatctcaactgtgaaatcagcaacaatcagga

SEQ ID NO: 9140 - DNA, 121 bp, Artificial Sequence
  Synthesized
  misc_feature (61): n=t or c
ttaatcttactgcaggtcctacttcaatccagtatattcatatggtgaaatcactctggtntgatgaacaaacataagaagggaacagaacagacatgagacaaagtacatgtgtcatgaa

SEQ ID NO: 9141 - DNA, 121 bp, Artificial Sequence
  Synthesized
  misc_feature (61): n=t or c
tactaagttaggaatattgtagatttccccctcacctcttcaggaaaatgttgtggaatcnataaaaccttccaataactaaaagttaagcattgaaatatgagagttatattttttaata

SEQ ID NO: 9142 - DNA, 121 bp, Artificial Sequence
  Synthesized
  misc_feature (61): n=t or c
tagacatggaacaggaaaggaaaaactcaatttgtgtttggaacaaaactatcaaacagcntacgtgttcactgccaaagcttttctgttactgtactgcttcacaatgacagcagcataa

SEQ ID NO: 9143 - DNA, 121 bp, Artificial Sequence
  Synthesized
  misc_feature (61): n=a or g
tccatggaagaatacattttaaacatgacttgccatactcttgtgttggtggttacctcantatggtggtatttcaccgtatttcttctactttacaagtgcaagatactggcttgcatta

SEQ ID NO: 9144 - DNA, 121 bp, Artificial Sequence
  Synthesized
  misc_feature (61): n=a or g
gccacatgtaacgtgacagaatttaaaagtggccagaacacttttaatttacagcctttgnacagcaatgccttttcccactggcctttcatgtgcaagaacctatatgctggctgctgtc

SEQ ID NO: 9145 - DNA, 121 bp, Artificial Sequence
  Synthesized
  misc_feature (61): n=a or g
gaagccttgtcttctctctaaaatgaagcacaaaccttacggtaagaggatgtttttcatntggcaacctaaagcttagagcacttagctgaaaccctgcaacgtgggtacaattttttcc

SEQ ID NO: 9146 - DNA, 121 bp, Artificial Sequence
  Synthesized
  misc_feature (61): n=t or g
gaagcagctgagtaaacatacaaaatgatcccaacagttctgtttgaaaactcttcagagnaaacctatgtttcccccatccctgctgaagctctaagctattcagtgaatagagataagt

SEQ ID NO: 9147 - DNA, 121 bp, Artificial Sequence
  Synthesized
  misc_feature (61): n=t or c
gggtttttaacaacctcagcgtaacatttgctatttaaatgttgcttggcccagatcttcnggtctcaatatcacaaaaataaatggcaaaacattacgaaagtagtcatatgagaagatc

SEQ ID NO: 9148 - DNA, 121 bp, Artificial Sequence
  Synthesized
  misc_feature (61): n=t or c
aaatcatgtcacatgaaaattcatttcagtggcaatacttgagcaaggggctggcatggtntcccacataggcatatgcacagaaggtcttctaaatcttttatctttcctgagccacagt

SEQ ID NO: 9149 - DNA, 121 bp, Artificial Sequence
  Synthesized
  misc_feature (61): n=a or t
aagtaacccaaccctaccctgagattagaggactcagtcctggtctcattcacactcgganaagccaaaaataaacctcctggaaattgggaaatctaacattttggcattgatttcctaa

SEQ ID NO: 9150 - DNA, 121 bp, Artificial Sequence
  Synthesized
  misc_feature (61): n=t or g
gtggatacacaagggtgaactattttgagtactttcctttgggatgatttaaaatcagcangttgctaagctatcagctacagtcacattgtggtgagactcagaccttctctgtggttaa

SEQ ID NO: 9151 - DNA, 121 bp, Artificial Sequence
  Synthesized
  misc_feature (61): n=c or g
gtggcacagcgctgttcccaaagcatgccgctggagagagcagacccaaaacgcaatttcntatataaaacctgtctttgaagagcatcccttctacccacccaaccatctttgaaaaata

SEQ ID NO: 9152 - DNA, 121 bp, Artificial Sequence
  Synthesized
  misc_feature (61): n=t or g
atatattccagaaaataatcatttaaactataatagcagtgtatggtatttagacaatttncttttcaaaatggtctatttactaagttccaaacacaagcaacagttgcatcatgttaca

SEQ ID NO: 9153 - DNA, 121 bp, Artificial Sequence
  Synthesized
  misc_feature (61): n=a or g
ctaagctaacagccagaggaagtgaagtcacgtggcgcgtaaacagcttaatcatccagcnagaaacaggtctactctgctctaatagccaattaccaatagccagccctaagaaaagcat

SEQ ID NO: 9154 - DNA, 121 bp, Artificial Sequence
  Synthesized
  misc_feature (61): n=c or g
acaacatcattcttcagctctgtgaagggcctgtttttatgtctgggactagcttttgtanctgtgaaatgatgtctgcaaaaccagtgcacagagtagttctgaactcttcagaagtaaa

SEQ ID NO: 9155 - DNA, 121 bp, Artificial Sequence
  Synthesized
  misc_feature (61): n=t or c
ccccgttaaacaacttgagtgtcaccttgggggtttctctgcaccttctctgctggaaagnagggaaaatgggatgcggctctgaaatggtgaaccttgcctgagaatgtatctactccta

SEQ ID NO: 9156 - DNA, 121 bp, Artificial Sequence
  Synthesized
  misc_feature (61): n=t or c
tcccgctgaccgccggaagcagaagggagccggctgctgactttcctaaatattgatgctntagaaaacgactatttcgtgcttcgtaaacagctgagtgaggggcacgtctcattcgcca

SEQ ID NO: 9157 - DNA, 121 bp, Artificial Sequence
  Synthesized
  misc_feature (61): n=t or c
cctccactgcctaaaagctctgacacttctgtatgtgccctgcaacccacactgctcctgntttatgtaagctggaaaaacaatacaaaaaggcatgaataccttggagcagggaccatat

SEQ ID NO: 9158 - DNA, 121 bp, Artificial Sequence
  Synthesized
  misc_feature (61): n=t or g
atagggaaagagaattcagagcttcaagctaactcacagcttgtgttcttgtggaacttgncaacaggacaagaaataagaactctaaagctgatctgatccctaataattacagaagtat

SEQ ID NO: 9159 - DNA, 121 bp, Artificial Sequence
  Synthesized
  misc_feature (61): n=a or g
gcttactgtgtacgtttactttaacatgcagaaatcatccttctgagttcatgattttgcncagtgtttgcctcatcttcctagttcttcctacccagtgtgaatgccactgtcttagtag

SEQ ID NO: 9160 - DNA, 121 bp, Artificial Sequence
  Synthesized
  misc_feature (61): n=a or g
tagacctcactctacaagacatttattaggctcagagatgaaagaagagcacttcaatttnaaatgcagatagcactctcttttccacacttatagaaaactagaaggaaaaatctgagct

SEQ ID NO: 9161 - DNA, 121 bp, Artificial Sequence
  Synthesized
  misc_feature (61): n=t or c
tctgctcctaacccttgaatctttacagatatggtttaactttagatttaaaggattaagnttatctctggagtaaacctgctgacaattaacattctacatgaaacaaacattctgtccc

SEQ ID NO: 9162 - DNA, 121 bp, Artificial Sequence
  Synthesized
  misc_feature (61): n=a or g
cagagacaagatctctggggatattaggagatatccaaacaaaagcaagctcgtgtttgcnggatcacagagtacaaggtgagctgcaattaggtgactctccccatagaatgaaggaaga

SEQ ID NO: 9163 - DNA, 121 bp, Artificial Sequence
  Synthesized
  misc_feature (61): n=t or c
aatgttcctgactgatgatccttttgtgcagaatatcaaatttccttccagctgtcctagngcagactgagcatattgtgcttaactcctggcataagcaaatgcaacgtgaaaaagctgt

SEQ ID NO: 9164 - DNA, 121 bp, Artificial Sequence
  Synthesized
  misc_feature (61): n=t or c
tgcaagcagtattgagcttgtgcatccccattacttttgttacttctaaaatcagagctancacggtgttgtcttggacgaggtccaggatgtcttgacactgacaagtgaaaggctaaga

SEQ ID NO: 9165 - DNA, 121 bp, Artificial Sequence
  Synthesized
  misc_feature (61): n=a or g
tcaaacccatctcctgcctgggtccagaagggtggttttcttactctgacctgttcttcanggccctctggtagcatcagtaatttcatcaaatggttggatttgtattcttgcctgtaat

SEQ ID NO: 9166 - DNA, 121 bp, Artificial Sequence
  Synthesized
  misc_feature (61): n=t or c
cttcctgttcctcgtctaaagcacagtgacctacacttctaaaactgatttccagtgcctnccactttgggatatgcagcttttgacctcttgagtgtgttgggtttcaaggagctgatgt

SEQ ID NO: 9167 - DNA, 121 bp, Artificial Sequence
  Synthesized
  misc_feature (61): n=a or g
gtatggtttgatcaggtccatatccagagctgcatactgttgcagcacaggtgatttttcnttagtctaccgccagggatgatgccaggaatactgctggctagcagtttctactggttgc

SEQ ID NO: 9168 - DNA, 121 bp, Artificial Sequence
  Synthesized
  misc_feature (61): n=a or g
ttggacaatagccaaagtcaggccaactttccttgcttgacaagatacatatgttttgctnttaatatttacagttaatgcttcttcactgctgacaagccacagagccaaagatttcatt

SEQ ID NO: 9169 - DNA, 121 bp, Artificial Sequence
  Synthesized
  misc_feature (61): n=t or g
tcacatctagatactgtttttacaatacagataggtgtatcttctcttactgtgaagctcnaggttttattttgaaagcaagtgatttggtacaaatgtcacttgaacaactttatatttg

SEQ ID NO: 9170 - DNA, 121 bp, Artificial Sequence
  Synthesized
  misc_feature (61): n=a or c
cctcttcatgactatttgtatggacaagttatttccactttgttcacctcagtatcttgtnagacggtctgtaaaaacaaactcatatcacaggggtactgtaaagtctgttttattgata

SEQ ID NO: 9171 - DNA, 121 bp, Artificial Sequence
  Synthesized
  misc_feature (61): n=a or g
tttttttttttttttttggtcatttgagtaaaacaggcgtacagtctttcccataaacccntactacacaacttgtgttctagagaaggtgctcttgtgagtttgggatttgacatgggca

SEQ ID NO: 9172 - DNA, 121 bp, Artificial Sequence
  Synthesized
  misc_feature (61): n=a or g
ttttttctccatacagttaatagctccccctttctctcagtccccctctatgcagaaaacntaaaaataagttctgtgagagttatttttgctggcaaaataacaatgtggtttaagtgta

SEQ ID NO: 9173 - DNA, 121 bp, Artificial Sequence
  Synthesized
  misc_feature (61): n=t or g
tggctgactcagtttgcccagcgccatcacactgcacatttcacacagattagctaggatnggcaaggagctagtgccaagcttcccacgttatctgaaaaaggctttgctctaagacaat

SEQ ID NO: 9174 - DNA, 121 bp, Artificial Sequence
  Synthesized
  misc_feature (61): n=a or t
gccaacctaggctgccatgactctccatcaacaaccaactgctgtcactcatcactttgtnggtgtaacaagagacatgggcagctggacatgagaaaggcaggctttggtcagatattct

SEQ ID NO: 9175 - DNA, 121 bp, Artificial Sequence
  Synthesized
  misc_feature (61): n=a or g
tgccacccacacctatgcatctccatgcgggacaggaattaccagcactggctcatggctngtccactgctgtcaactatggtcatggcaggcctcactgctcaggcttccatggggaatt

SEQ ID NO: 9176 - DNA, 121 bp, Artificial Sequence
  Synthesized
  misc_feature (61): n=t or g
attcacttaagtcatgcatttcttacatttacttgtggaagaaagttctcccttgagtgtnagctcagaactttcccataatcatagcacttaggagttaaaagagaaatttccatgtagg

SEQ ID NO: 9177 - DNA, 121 bp, Artificial Sequence
  Synthesized
  misc_feature (61): n=a or g
atacgctgtatgttacaggaggaaataaaaatttgaaaatggatagtgatggcatgtcacntctggagaaacacagagaacaatgttgattcacactgtctcgttgctgaaatgtactttg

SEQ ID NO: 9178 - DNA, 121 bp, Artificial Sequence
  Synthesized
  misc_feature (61): n=a or g
ttaaactgatttcctactagatgaagtttctcctgttttagtgctagtgtgtatgctgcanttttcttgcacagttcttaagttgaaattctaatgacatctccattttctaatttatagc

SEQ ID NO: 9179 - DNA, 121 bp, Artificial Sequence
  Synthesized
  misc_feature (61): n=t or c
gatgctaagcttgtttatcacagctgccttccatgacttctcagccagaaacgaattcccntctcacaacaatgaaacgctctgtgccacctgcccgcatgtgagcacagccaggcacctg

SEQ ID NO: 9180 - DNA, 121 bp, Artificial Sequence
  Synthesized
  misc_feature (61): n=t or g
tctgaaaatgttctgccattgttatatttatcctctgctttttttttagtgaaaaacttgnaattatttcatcttaatcagactctgctgaggaagaactaaagaactaaagtcatatttc

SEQ ID NO: 9181 - DNA, 121 bp, Artificial Sequence
  Synthesized
  misc_feature (61): n=a or g
ctttttttgggcaaccttactgccttgtcagcttatttaattttcaacttgcaagttttcnatgttctttgcataaatgttgcttcctcccacttagtacacttccatgctttctttgagc

SEQ ID NO: 9182 - DNA, 121 bp, Artificial Sequence
  Synthesized
  misc_feature (61): n=t or c
attttgtctcattattttaaaaatgtggtgctcagacagcagataaatcaagaaaagtgcntgccccaaagaaattgcttctgacattctaaaacaaggactcaagatggtcgggtttcct

SEQ ID NO: 9183 - DNA, 121 bp, Artificial Sequence
  Synthesized
  misc_feature (61): n=t or c
tggaacggaaaagccttatctgcaagaggaagtgataactgatttccctgtgagtacatangatttttattaatctatttatacatttataagtacagtgggttacatttgattattttat

SEQ ID NO: 9184 - DNA, 121 bp, Artificial Sequence
  Synthesized
  misc_feature (61): n=a or g
agtttattgtaaatagaggagtcagtattcctcacatatgtgaactttgtagtttctgacngcccttgtaaaaataatcctgttttcctcaaaacgtgagtgtttctgggctctcaggaag

SEQ ID NO: 9185 - DNA, 121 bp, Artificial Sequence
  Synthesized
  misc_feature (61): n=a or g
cttgtaacagaaaaaatagctatttagttttggtattatcacttcattcctgggtaaccantggctaagtggcacacaacaagttttttcaaaagtatatgcaagttcatgtcagcaagga

SEQ ID NO: 9186 - DNA, 121 bp, Artificial Sequence
  Synthesized
  misc_feature (61): n=a or g
aaggtactgccttgtgacctgtgcatgtgtacctagtgccattagcactacagataaaatnattcaaagagctacaacctgttctgacagcagatgtttcagagagatgaatgtgataact

SEQ ID NO: 9187 - DNA, 121 bp, Artificial Sequence
  Synthesized
  misc_feature (61): n=a or g
tgcataccaaattacctggtgtcctaggagttacagaatactattcactcaaacaggaaancaactcattgctaccatccagcccagagtgatcctagcttctccctcttggcactgagct

SEQ ID NO: 9188 - DNA, 121 bp, Artificial Sequence
  Synthesized
  misc_feature (61): n=a or t
agcaacagaaagtaaggaatgtaagactacaagaaagatcctactcaaaaaactttcatgncagtaatcaaaccaaacagttttaagagaagaatgcattgtgatctatgaagaacgtagt

SEQ ID NO: 9189 - DNA, 121 bp, Artificial Sequence
  Synthesized
  misc_feature (61): n=a or g
gttttcaagtgctgtttatgggtcattctgcactagatgggatcatacatcattcacaacncgtcacttagattctgttaaaaacataaattagtatttgcccataaaacaaaagaagaaa

SEQ ID NO: 9190 - DNA, 121 bp, Artificial Sequence
  Synthesized
  misc_feature (61): n=t or c
aaggaaaaagtaataataagcatgcttatttttttcatataaaaatgacacacagagtgancgttaagagaaatgcagaagtcaagatcagcagaaaagattcttgcaataataaagtgaa

SEQ ID NO: 9191 - DNA, 121 bp, Artificial Sequence
  Synthesized
  misc_feature (61): n=a or c
gggtattcaatgttaccaagatggctgctggtattctgactcatattatgacttgccttgnaataatgttacaaagttgatgaggtaaatgtaaattattgtgacaaacatacgttgttaa

SEQ ID NO: 9192 - DNA, 121 bp, Artificial Sequence
  Synthesized
  misc_feature (61): n=a or g
cagcacagagatgggcaggttacctctggtgaaattactgtcctgattgttcacgtgcatntggtgactgttgagtcatagtctgaaccactgattgaacatctgggaaaaggacctagtc

SEQ ID NO: 9193 - DNA, 121 bp, Artificial Sequence
  Synthesized
  misc_feature (61): n=a or c
ctattagaaaatcaacaaatacacaagactccgtgcctatgttttaaccattagcatcttnatgatcagaacttgaaggtttcttacaacttctatgcacactgtgactccaggaacaaat

SEQ ID NO: 9194 - DNA, 121 bp, Artificial Sequence
  Synthesized
  misc_feature (61): n=a or g
gctcaaatatatcactacaaagacaggtgtgtgtctttattagattcaaaccatgcaaatntagaaataacattttacacaaactatgttagtttcttccatgaactgtgaggctgaaagt

SEQ ID NO: 9195 - DNA, 121 bp, Artificial Sequence
  Synthesized
  misc_feature (61): n=c or g
tttttaatagtccacgaacccccagagaagcgggacatctgttggagtactctttcagtanacatctcaagtggccagctaacctgctggggaatggatcatcctgcagagggtgaatcat

SEQ ID NO: 9196 - DNA, 121 bp, Artificial Sequence
  Synthesized
  misc_feature (61): n=t or c
actggtcacacaaacgactgaaatatgaactaagttctgacacttcctcaaaatattctcntagccttcagtagctcgtatcataaggccactctccgagtaaaatgttttcttctagttg

SEQ ID NO: 9197 - DNA, 121 bp, Artificial Sequence
  Synthesized
  misc_feature (61): n=t or c
taaaaattataaaggaaaatgcctttgatgaaaatatgaaatgtggcagactatgaagtgngtttatacatttttctcactttgaaaccaataggagttatgtaacttcccacctttcaat

SEQ ID NO: 9198 - DNA, 121 bp, Artificial Sequence
  Synthesized
  misc_feature (61): n=t or c
cagtgagatggtagagagatgtgatcagctccctgattttaaggccaggactgattccaangaaaatggaagctcctgccaaggagcttagtgttgtcaggtcctgggcattaagccactg

SEQ ID NO: 9199 - DNA, 121 bp, Artificial Sequence
  Synthesized
  misc_feature (61): n=t or c
gtaacaggtattccatttgcatctctcacatcctaagttacatgctgtatttgctctgtantgcctagtcagactcttgcagagtaatgcttggggaaggaaatattttgtgtgttcatgc

SEQ ID NO: 9200 - DNA, 121 bp, Artificial Sequence
  Synthesized
  misc_feature (61): n=c or g
ggcggaatgaagataccaggtaacatagatagcatcactgagtaaatttctaccatacctntttcagtaggagtttagtttaccagaaattattacagaaccacagaatcatagaggctga

SEQ ID NO: 9201 - DNA, 121 bp, Artificial Sequence
  Synthesized
  misc_feature (61): n=a or g
aagaacctcaaaatggacgcaggtccttctgttcaaatcctgggacagaaaagtatcagcnctccacaaatcgctcattttaacaccaagctgcctcgcatcaacttattttatagtcatc

SEQ ID NO: 9202 - DNA, 121 bp, Artificial Sequence
  Synthesized
  misc_feature (61): n=t or g
acagagctgtgaaatactaacagcagccagaagtaatttatgaatattgaattgcacggtncagtatgtcaagcaaaaatacagcaagaactcccttggaagcttttttgcctgctgcagt

SEQ ID NO: 9203 - DNA, 121 bp, Artificial Sequence
  Synthesized
  misc_feature (61): n=t or g
ttattacctaaattcctctatgcagagatgttggtcttactccaggcaggaaagagtagtncttggtcaattaagccatttcaatggacgaatacatttgatttcctctgcacataaagct

SEQ ID NO: 9204 - DNA, 121 bp, Artificial Sequence
  Synthesized
  misc_feature (61): n=a or g
ggaagttgtaacagcagcagcatcatcaaacggcagtcatctcagtgtccattgttgaaanggaagaattacttatagtacagttctgattcatattttccttttaccattatcaaatctt

SEQ ID NO: 9205 - DNA, 121 bp, Artificial Sequence
  Synthesized
  misc_feature (61): n=a or t
caaaaatctttgactgaggctttgatgagaataaagtgcctttagatagctggggacaaantcaattgtcaaaactgaacgtcattcaagcattcaccccaaacctcttctcttatagcat

SEQ ID NO: 9206 - DNA, 121 bp, Artificial Sequence
  Synthesized
  misc_feature (61): n=a or g
aatattgaaagagaagatgatgagatctgctttgatcctgccagcttatgctgatggtaanttatcaaaaagcagatgaactgaggtcagagttcactgctaataacgagatctgaggctt

SEQ ID NO: 9207 - DNA, 121 bp, Artificial Sequence
  Synthesized
  misc_feature (61): n=t or c
ttccctggatattaacccaggacttacaggtcccagtggaataactgcctgctttggcttntgccatcctgcaaaaatcatggagctcacctggtttcaaaatgattttacataaaacttc

SEQ ID NO: 9208 - DNA, 121 bp, Artificial Sequence
  Synthesized
  misc_feature (61): n=a or g
ctgggaataatagtaacaatcaactaatggccatttcaggctttttagtgctgtaatgganctttctgtaagtgtgtgcacctagcagcgacaagactactccaattattttaggagggaa

SEQ ID NO: 9209 - DNA, 121 bp, Artificial Sequence
  Synthesized
  misc_feature (61): n=a or g
aagaagaaaatatactagagtgggattgatattctgcaccaaggtaataaatatacgaganacctaaccattttaagaccctgctcccacaaggatctcaaatcctctcctcttaataagg

SEQ ID NO: 9210 - DNA, 121 bp, Artificial Sequence
  Synthesized
  misc_feature (61): n=t or c
atgtatggatagtaactatttgtatataaatgcttaaatacttaaaagcataaagtcgttntagttttggtttatgaaattactgtccgggaagtcctgtgacaaatcagggtttccacta

SEQ ID NO: 9211 - DNA, 121 bp, Artificial Sequence
  Synthesized
  misc_feature (61): n=t or c
gttcttttatggccatctcaaaatctgatccaactttgaacatctgttcattccccccttngcttctctgcagctcgctacctgttcagcttcaatttcttgtagctctttcttacgctgt

SEQ ID NO: 9212 - DNA, 121 bp, Artificial Sequence
  Synthesized
  misc_feature (61): n=a or c
tgggctgtgggattggagccgggtgaggagagccgtgcttggtgctcacggcaggctgagntggaaagacggggcttcccacgttaacactccgtgagctgcatcaaacagagttatcata

SEQ ID NO: 9213 - DNA, 121 bp, Artificial Sequence
  Synthesized
  misc_feature (61): n=t or c
tgcagcttctccttccatcttcttatcacctcctaaagaaaggattacagtcacagttacnagtgtagtcttaacaaaatgacataagcatagacaaaccttgcaggttattaaacaacat

SEQ ID NO: 9214 - DNA, 121 bp, Artificial Sequence
  Synthesized
  misc_feature (61): n=t or g
ctgattgaaaaagacatttattaagatatcatggtatacaacaaaatgctaagctatgtanattacatcctgcattctttaaaacaccctacaagtatacttgtttatacttacttaaata

SEQ ID NO: 9215 - DNA, 121 bp, Artificial Sequence
  Synthesized
  misc_feature (61): n=a or c
gcatcaaaagcaaagtttggaacagattttcttaagtgtttctaatggatctaacgttttntctcataaaataggaactcctatttcttaaacacacagaagcaaacaaatgcacacaaat

SEQ ID NO: 9216 - DNA, 121 bp, Artificial Sequence
  Synthesized
  misc_feature (61): n=t or c
cagagcgttgccccaaagcagttgctctcctcacggctctataatatttagaggagagagngctaattaaacttaaatactcaggtcaaatactaatgctaattgagttttaaatcatgag

SEQ ID NO: 9217 - DNA, 121 bp, Artificial Sequence
  Synthesized
  misc_feature (61): n=t or g
gagttttgagtgacttcttatgttgatgtctgtgaatgattattattttcatatgggacangcatagagaaaatcttgaatatacacctccccgggtgaattcagttttgtacagctgcaa

SEQ ID NO: 9218 - DNA, 121 bp, Artificial Sequence
  Synthesized
  misc_feature (61): n=a or t
taagttgacctggtgctcggcatgattagtacagcatagtttgtgttgagagtagtgagcnaagtattgcagctctgcatctagagaagggctttttgcaaatacagcactgtcaacactt

SEQ ID NO: 9219 - DNA, 121 bp, Artificial Sequence
  Synthesized
  misc_feature (61): n=t or c
gaacccaatgtactctctgagttaaaattgacgatcagagcacaaccagactcaaaacacnggtggatgtgtttctggaggtaagcaaacctctgtgttttatactttattttctgcactg

SEQ ID NO: 9220 - DNA, 121 bp, Artificial Sequence
  Synthesized
  misc_feature (61): n=t or c
tgtattgttttttaccttctgtatttgtttagtattttactttaacctgataaaattttanaatgatcctcttttggtaagtcgtagagaaacaggcttacaaaacccttcagagactcat

SEQ ID NO: 9221 - DNA, 121 bp, Artificial Sequence
  Synthesized
  misc_feature (61): n=c or g
tgctctggtttatttagagcattaaaatgtagttatctaaaatgtagttatcttcctggtnatcacttacatcaacacttaaaaacattcggacaagcacagtattgtaactgttgtgtat

SEQ ID NO: 9222 - DNA, 121 bp, Artificial Sequence
  Synthesized
  misc_feature (61): n=a or g
gtcaacaaccctggtttgctagcatactacccaggagacacacaaagaccaccccagtttntggactcctcagcagtgcgtgctgacaccgcggccctcagtgcttccaggttcccagtcc

SEQ ID NO: 9223 - DNA, 121 bp, Artificial Sequence
  Synthesized
  misc_feature (61): n=t or c
gatgtgcaggccccaggctgcaaattgtcctccttctaaacccttctgaaacattgctgcnaacagaagcttaccaacaggtaagctgtgttgcagcagctgtactgcactgaaataactg

SEQ ID NO: 9224 - DNA, 121 bp, Artificial Sequence
  Synthesized
  misc_feature (61): n=t or c
aattgactactttgatcagaagttataaggaattaattgatgctcacttaccatttcttcngtcatgttaatccacaaccatccaaaaataaaggttttaaaacaaacgagtgtgcaagtg

SEQ ID NO: 9225 - DNA, 121 bp, Artificial Sequence
  Synthesized
  misc_feature (61): n=t or c
gtcttggacacagctgctgcatttggaggcaaggagggcatgtttagtttttcagcatctntgcctcccagccaagggagaaaccatccatccccaccgcccatccccacgtgctggagct

SEQ ID NO: 9226 - DNA, 121 bp, Artificial Sequence
  Synthesized
  misc_feature (61): n=t or c
gggtcagtaatttagtgcattatattaagcttactttgtttttcttgtcagaatcctactngcttctgagctttcagtatcctgttttgagtcagaagttgagagaaatgtggtctttaac

SEQ ID NO: 9227 - DNA, 121 bp, Artificial Sequence
  Synthesized
  misc_feature (61): n=a or g
cagggtcttcccagtcctctcacagccagagaaaacaaatgggctttttaatgtgtcctgnaagttggtaaactataactcgtttgtaggggatggggagagcaagttcccagggtgggca

SEQ ID NO: 9228 - DNA, 121 bp, Artificial Sequence
  Synthesized
  misc_feature (61): n=t or g
gctttagctgtacagagcagagcaacagaaataccaagcaagtattcatgaacacaccgtngaggtctgccggagaatggacagagatctggatgacatgaagagttcaggatatgccatc

SEQ ID NO: 9229 - DNA, 121 bp, Artificial Sequence
  Synthesized
  misc_feature (61): n=a or g
ctctgtagtaatggtaatgagtggatttacattatgaattttaagaggtagttttaacctngtcttctgtatttcagggctttgatgtattttacagttgtgcttttaatgttggttttct

SEQ ID NO: 9230 - DNA, 121 bp, Artificial Sequence
  Synthesized
  misc_feature (61): n=t or c
cacagctcaagagattaacttttcctagatggttagagaaattgtgcctaatctatctgcntgtatccaaagtgctggttaagtagatggttgaaccactaagaacttgtttatctatgcc

SEQ ID NO: 9231 - DNA, 121 bp, Artificial Sequence
  Synthesized
  misc_feature (61): n=t or c
tgaaaattttggtcagaggtcaaaacagcagggctcattacagttgaaactcttcactcantgatgcaatggcatttatttatgcaacaggaaaaagcaagaacagctgaccatcatatca

SEQ ID NO: 9232 - DNA, 121 bp, Artificial Sequence
  Synthesized
  misc_feature (61): n=a or g
attggtacagacatcatgttttgtcgtggttaatgttcttggtagaataaagaatcatggnccataagaaggacagtatgcccacatttattttgtggttaccagttgttctaagacaggt

SEQ ID NO: 9233 - DNA, 121 bp, Artificial Sequence
  Synthesized
  misc_feature (61): n=t or c
atcttaatgagaataatgagatgtctttataagaaggtgtttctctgcatttaagaccttnagtgccatcctttggctagaaagtcatgctgcccatgagccttatcagtaaattcattca

SEQ ID NO: 9234 - DNA, 121 bp, Artificial Sequence
  Synthesized
  misc_feature (61): n=a or c
gtccattacagtcccggcacagtataatgaagggctctggcctagcccgagagggtgcttncactcctgattaacttcaagtccaagtggtagtaatttatcatggcacatgagcacatct

SEQ ID NO: 9235 - DNA, 121 bp, Artificial Sequence
  Synthesized
  misc_feature (61): n=a or g
tttattttgctttattttattcaagatttgttctgtgcccctgcagaaaagatcagaattnaacttgagtttttaattgttttacgtatacaaagaaagcccatgtagaacaggaagaagg

SEQ ID NO: 9236 - DNA, 121 bp, Artificial Sequence
  Synthesized
  misc_feature (61): n=t or c
tgatatccctattaaatgccttgagaaaggcttgggagactacttaaacaaatgctttctnctttgcataggtaactaaatctattatgtccataaaagcacagtgttactgagagtagag

SEQ ID NO: 9237 - DNA, 121 bp, Artificial Sequence
  Synthesized
  misc_feature (61): n=t or c
tctctttggtactaaaggagcatcgtttaaagctaacagaaaagcagtctgtcactccttnctgattcacactgccattccttttccttttatatcaaataacatctgatgtgttgagcac

SEQ ID NO: 9238 - DNA, 121 bp, Artificial Sequence
  Synthesized
  misc_feature (61): n=a or g
aggaacattaagctcttttaataggctttttgacaataattgatcattactgtaatggacngtgctttgcttggttaattgttgttcttcagtgcttaaaagaagtcagtgacttcatcag

SEQ ID NO: 9239 - DNA, 121 bp, Artificial Sequence
  Synthesized
  misc_feature (61): n=c or g
caacaacttgatgaggagactaggatagcaagagtttcaagactgcacagtctctctacanttattgcagccagggctgggtatgcagggtttttaaatcaagccccttcttcagctagat

SEQ ID NO: 9240 - DNA, 121 bp, Artificial Sequence
  Synthesized
  misc_feature (61): n=t or c
attaacagttcagttcttagaaagaataattggaatctcagcttgaaggtcagttttgaangtcccaatgggatcagatacaaatcagactctcaaatgcaggaaaaagaatgccagctac

SEQ ID NO: 9241 - DNA, 121 bp, Artificial Sequence
  Synthesized
  misc_feature (61): n=a or g
ctagatttgcaggtagtaataatgttggggcacgacaaatcatagtgtgcactgcaagaanattcagtactggtagagacaggcaaactatttcaaaagaagtaaaatcaaaccacagtaa

SEQ ID NO: 9242 - DNA, 121 bp, Artificial Sequence
  Synthesized
  misc_feature (61): n=a or c
aaggtgtgtggattgtttttaactaccatgatagggcatgtttgattatatttagaaaaanttgtgttacttaactatactaaaaagagcacaaaaagccttaacaggccctacctgaatg

SEQ ID NO: 9243 - DNA, 121 bp, Artificial Sequence
  Synthesized
  misc_feature (61): n=t or c
catctcaaaggcttccatcagcttggcaggtcagatgttaactcaataatatcattgaaanggcgctatccaaaacaccatcattgtacaaaacgtaagtgcttttaacgcttaccattgg

SEQ ID NO: 9244 - DNA, 121 bp, Artificial Sequence
  Synthesized
  misc_feature (61): n=a or c
aacttctaaaaaataggtaaattgactgattaagacaaattcaagcactattttatcaacntattgcttctagttttggtttaaaattgttatcttctcagccagtcatctaaataatggc

SEQ ID NO: 9245 - DNA, 121 bp, Artificial Sequence
  Synthesized
  misc_feature (61): n=a or t
ggctacaagtcaggagacttctcacctgaaaaaactcacgttatatttcaagttgcacacnctcggtatttctcgctatggttttccttcccttttactagaagacaaaaggaaatccatt

SEQ ID NO: 9246 - DNA, 121 bp, Artificial Sequence
  Synthesized
  misc_feature (61): n=t or c
ggtaggatggatcctaaattgaaactcttaatatgctacatgctataagaaggaattatanacctccataactgtaacgtattgagaaatctacaataaatctatttacgctgtttggaaa

SEQ ID NO: 9247 - DNA, 121 bp, Artificial Sequence
  Synthesized
  misc_feature (61): n=c or g
catttcttctggttctctcatgagaaacaatttcataacgtaccggagcagagcaacttanaactacagtaagtttacttcctccctgattggaggctttgctatctgcactcaccatctt

SEQ ID NO: 9248 - DNA, 121 bp, Artificial Sequence
  Synthesized
  misc_feature (61): n=t or g
tattccaagacaacaacagataggctacagacaatgtttttgttttgtgtattttgaagtngttttatgcagacaggtttttactattctgtacaattacttctcagtcactttcgttctt

SEQ ID NO: 9249 - DNA, 121 bp, Artificial Sequence
  Synthesized
  misc_feature (61): n=t or c
atatttcaggattacttctagtagtttcttggaaggggccaaactggaatcacagatctcngttgtacctcttcaggtgcttgtgggtgttcagatgagtgtcacattgtcccagttttgt

SEQ ID NO: 9250 - DNA, 121 bp, Artificial Sequence
  Synthesized
  misc_feature (61): n=t or c
acaacagcattctatgattctgtgactctgtgtaacacatgccagggacagcaaagtggangcaccatgttgctgtgaacaaagagagaacaaagcataaaatttgttaacaacttgtaaa

SEQ ID NO: 9251 - DNA, 121 bp, Artificial Sequence
  Synthesized
  misc_feature (61): n=t or c
cttcctgttgaagcaagatgtccattccttcggggcttccttgcactgtcatctctttgtngtgccaggtcaggaacaagaagtggctcagctctcccacatgtgattagccaactgtggg

SEQ ID NO: 9252 - DNA, 121 bp, Artificial Sequence
  Synthesized
  misc_feature (61): n=t or c
tgtgataaatagttcgtggaaatagcaaaaggaaatgttatttcatacatcaagcaccatnaaggggtgggcatgagtagaatcctttggaagtggtgaaatactggaattgagacctcat

SEQ ID NO: 9253 - DNA, 121 bp, Artificial Sequence
  Synthesized
  misc_feature (61): n=a or g
gcacacctcttttttttctattttcaaacagggtgtcaacttgaaacctctaaaggaattncaacattgcccctaacccctcggcacagcacccagtgtttccttacccatcccttcccct

SEQ ID NO: 9254 - DNA, 121 bp, Artificial Sequence
  Synthesized
  misc_feature (61): n=a or g
agagtggtgttatttcagtagggaccacagcactgcagaacagtggttttattaaaaagancagaatgcaaaagcaggttgcactgtttggagtgagacactggatttccattgtgctgcc

SEQ ID NO: 9255 - DNA, 121 bp, Artificial Sequence
  Synthesized
  misc_feature (61): n=t or c
acaaaagtctcattccactttttgcatgttgaaaaccaactgctggtttgtgtatgttatnctttcagccagttctgctgttggcatggtattttacctctctgcttgtagctaccaaggc

SEQ ID NO: 9256 - DNA, 121 bp, Artificial Sequence
  Synthesized
  misc_feature (61): n=t or c
caattagttgaatgatggcacatcactccagttcttcatctgtctctggctttgcattaanggaagatgaaagctaatcagtgaacctacatggcaacaagacgaatgctcagctgtggca

SEQ ID NO: 9257 - DNA, 121 bp, Artificial Sequence
  Synthesized
  misc_feature (61): n=a or t
gctgtggactccggtctgtgttgcaggagaacattgcacagcaattgcatttagtgtgtantgatctaatttaattcgctcccatttagggtttttagtttttgtttgagcttgatttcct

SEQ ID NO: 9258 - DNA, 121 bp, Artificial Sequence
  Synthesized
  misc_feature (61): n=a or g
atcccatagtgtcctccccaagccgcaatgtgtatttcagcactacactgtggcacagcanaagttagaattagtccctgccttcccaaatggattgcattgtttccctcactagtcagta

SEQ ID NO: 9259 - DNA, 121 bp, Artificial Sequence
  Synthesized
  misc_feature (61): n=a or g
tagtctgctgcacttaatgggcccttttgcttccctggttagatgcctgtctgtccctgcncaggtgagaacatgaattttgtctcccttgcatgtgagtaaccaaaattccatacaggag

SEQ ID NO: 9260 - DNA, 121 bp, Artificial Sequence
  Synthesized
  misc_feature (61): n=a or g
agaagaaccgtttctagtttatttctgaagctttctttgtggaaagaattccttgagtacnaataaaaatgttttactgtgactgcttcatcattacatacagattcctttgcactaactg

SEQ ID NO: 9261 - DNA, 121 bp, Artificial Sequence
  Synthesized
  misc_feature (61): n=a or g
actgtatgaagctatggcataacaaacaaacaaatattgagaggctcaagagttttgaaangcattggagttaggaagcattttagataatgagagtcatcatttttccattttaatgcag

SEQ ID NO: 9262 - DNA, 121 bp, Artificial Sequence
  Synthesized
  misc_feature (61): n=a or g
gagggaatatcatcctgatacacaatctggttgggaaacttgttgactcaacccttcctcngtatcttccatttgaaaattgccaattgcctcttacacctactgaggtggaaatttttca

SEQ ID NO: 9263 - DNA, 121 bp, Artificial Sequence
  Synthesized
  misc_feature (61): n=a or g
gggtcctgggttagctgtgcccggcagctttgggagcggtttgcgtgccggtggtggagcntgtaatacaaagaaatgagagtaaagcgactctcacccctccggcgctcccccacagccg

SEQ ID NO: 9264 - DNA, 121 bp, Artificial Sequence
  Synthesized
  misc_feature (61): n=a or g
gagaagctcttggactacaattgtaaatatgttgttaattgtcagaagaaatctcacaccntttcccatacagctttggatggggccagtggacatagtaaattccttaagaaggaaaatg

SEQ ID NO: 9265 - DNA, 121 bp, Artificial Sequence
  Synthesized
  misc_feature (61): n=t or c
taggcaggctgtacaaagcatagtccagtttccatgtttattagcttgtaaggtttgtaangacagccaaaagacaggccctggctgcaggggaaggaagggaactggcagagcgctatct

SEQ ID NO: 9266 - DNA, 121 bp, Artificial Sequence
  Synthesized
  misc_feature (61): n=t or c
ttcatgaatttcttggcatcaaactaacagcaagtattctagttaaccacactcaaacaanctgatttcagacaaatattactcttattcaatcaatgatcaaatatggtaaaattacttg

SEQ ID NO: 9267 - DNA, 121 bp, Artificial Sequence
  Synthesized
  misc_feature (61): n=t or c
gcacagaagttactagtttagtctcttcttgaaaggaaaaccacataactactcatgtttnactcaagaaagagaacagagacatctacacatctggacagactgcataagaaaatgtctg

SEQ ID NO: 9268 - DNA, 121 bp, Artificial Sequence
  Synthesized
  misc_feature (61): n=t or c
cctaaaatgaggtgtcaagggcactgcttagacatacgcaaaagtaggtcttagatgatanggagcaggaaaatggtgaagtgagataaaggaatttagaacttctaagagactaaatggc

SEQ ID NO: 9269 - DNA, 121 bp, Artificial Sequence
  Synthesized
  misc_feature (61): n=t or c
gacactgtacacacattgcaataatatgatgcattggcaagtgactgcggacaatgtttcncatttaattaatacagggctgcacaccattcatccttcacatccagggattcagctactt

SEQ ID NO: 9270 - DNA, 121 bp, Artificial Sequence
  Synthesized
  misc_feature (61): n=a or g
tgtccatccacaattcatcagtgcagataagtcttacccttgctcatttaaataagttctngaatccttgctagcagaaatatatctttttaggaacttaggaaatgaactgtgacccatt

SEQ ID NO: 9271 - DNA, 121 bp, Artificial Sequence
  Synthesized
  misc_feature (61): n=a or g
ttgacagggtttggaggaggtgcagaaatgtttgtgctcatctatcagaaaatgtagtccncccatccagcagtgtcaaaacagccaggctgtgcatcctggagtgtgctgatctctgcca

SEQ ID NO: 9272 - DNA, 121 bp, Artificial Sequence
  Synthesized
  misc_feature (61): n=a or g
gaatttgctgcaccggcaccaaattttcaactcctgctggtaatgttaacccaagaaggcncagccagggcttctgcttcatgcggcctctacttgggcgagcgctccttgctagaggctg

SEQ ID NO: 9273 - DNA, 121 bp, Artificial Sequence
  Synthesized
  misc_feature (61): n=a or c
gagagctgtactttcagtgaagatgtgagtatgggatacccatctaaaaccttgatccacncaggatgaatccctgtcacagctcttctcagtttcttgtccagtgatctctgcgagtagc

SEQ ID NO: 9274 - DNA, 121 bp, Artificial Sequence
  Synthesized
  misc_feature (61): n=t or c
ggaaccagatgcactcaactggagtgccgaagttaacagtggattttcaccttgtgttctntgtatttgcctcttccaatgcttcaggcagcagttaaaactaggttagatgagctgggct

SEQ ID NO: 9275 - DNA, 121 bp, Artificial Sequence
  Synthesized
  misc_feature (61): n=t or c
ctgaaactagcattgttgctttccactacaacctcctccttttgtgtacttgttagcatcntcacaccattccagactgcgcagtagtgtgcgtgtgtattttaaaaaagaaacggttatt

SEQ ID NO: 9276 - DNA, 121 bp, Artificial Sequence
  Synthesized
  misc_feature (61): n=a or g
tgttcttactgaacttggactccatcctgcacatgcttatgcatgtgcccaattgtgtgcntgttacttggttaaggctgagcatgcataccagcctgtgggacacagggaccattataga

SEQ ID NO: 9277 - DNA, 121 bp, Artificial Sequence
  Synthesized
  misc_feature (61): n=t or c
atgcctcctgtgagccttgcattttaccagaggagaaagtttctaactcaaaggctgccantcaaccgtgtgtatgcacatttacatttattgcagaaaggccttgttttgaatgatatta

SEQ ID NO: 9278 - DNA, 121 bp, Artificial Sequence
  Synthesized
  misc_feature (61): n=c or g
actgcctagctacccacttcctggaacatttctcaaggcagttactttgagtggagagatntatagagatgaaaaccccagatgccatgttgctcaaccaaggactggcagtgtagagctg

SEQ ID NO: 9279 - DNA, 121 bp, Artificial Sequence
  Synthesized
  misc_feature (61): n=a or g
caagtttatctatcaatccctctgtgtggcaactaaacaaaaccaaacgataaaatatgtnaacattccagtgtaaagatcatttactgcagatgctttcttgtcttttgaaaaaggtagg

SEQ ID NO: 9280 - DNA, 121 bp, Artificial Sequence
  Synthesized
  misc_feature (61): n=a or g
tttcctttgctgcttagatatccccttgcacagcatgtcttccattttaattttaccaggntgcccattttacaccttcatttttggacttacgaaactttcttggaaaaaacagctcatt

SEQ ID NO: 9281 - DNA, 121 bp, Artificial Sequence
  Synthesized
  misc_feature (61): n=t or c
tgcaaaaaattaaatgggtgcaatatgtcataaagataaggggatactacaatccctctgntcccaaaagcacaccctaaaaaaatccctgatatgtttagcattaaagggaagagaccat

SEQ ID NO: 9282 - DNA, 121 bp, Artificial Sequence
  Synthesized
  misc_feature (61): n=a or g
ttatcagctgtccttcaagatgtttgtgagccactgtgtgcagcactgcaggatagggtangtgttaggaaattaatttagtaaagagaaatacttacagttcagtcatgcggtagacaaa

SEQ ID NO: 9283 - DNA, 121 bp, Artificial Sequence
  Synthesized
  misc_feature (61): n=t or c
agggaggctacttttcctggtgtgtgctgtggcttaacacaggcagctgtgagagcttacntgtatatctaggaaaaggagtgcttagtggtgcttcttttctcttgtaggagagaaagaa

SEQ ID NO: 9284 - DNA, 121 bp, Artificial Sequence
  Synthesized
  misc_feature (61): n=a or c
catttctataaataacctttattttctttttcgtccctttcattggaaaaagaaacgtagnatcaacaggaacacttcaggtccattttaacagcctacgctcaagtgtgaatgcaaaatc

SEQ ID NO: 9285 - DNA, 121 bp, Artificial Sequence
  Synthesized
  misc_feature (61): n=t or c
tctccacatctttgagaaagtcctgcccacactggccaccactgaacagacttaagtgcangtatatgcataacagctttcctcgagaatacagtgtctatcagaaatcactattggcatg

SEQ ID NO: 9286 - DNA, 121 bp, Artificial Sequence
  Synthesized
  misc_feature (61): n=t or c
gcacacatctgctggaaaaatattgtgtatagatatctgttttcctaacagcagcctcccnggacctctggatcaagctggtttccctaggcacccatctgtagcatcagacttcttttct

SEQ ID NO: 9287 - DNA, 121 bp, Artificial Sequence
  Synthesized
  misc_feature (61): n=a or c
catcacgaccctctgccagcactttgcttcagtggcttctcaaaatatgatggctggaaancatttggttcgactacccagagttttggtagcaaaattctctatctttccccgtcaggga

SEQ ID NO: 9288 - DNA, 121 bp, Artificial Sequence
  Synthesized
  misc_feature (61): n=t or c
actgaaatcctacataaatgacaagcaactcgcagaattagtgtggctgaatttactcccnctgctttcagtacttggccttattgaccagcaaaagcagggcaactgcttctcctcttgc

SEQ ID NO: 9289 - DNA, 121 bp, Artificial Sequence
  Synthesized
  misc_feature (61): n=t or c
attctgaaaactggacatacttttagggcaggcagcaagaaatctatggtgctgacagagnctggcccttagtgcatattccttgtggtttaggtacagataagaatagctgaagtatgga

SEQ ID NO: 9290 - DNA, 121 bp, Artificial Sequence
  Synthesized
  misc_feature (61): n=a or c
ctgttcatcaaaagtgttaaccagaagagtcgtgtttgatggtgtggcccacaccatgccntgaacacagattctgatctctgctaccaacaggaactgctgtgtagctggaaaacagagg

SEQ ID NO: 9291 - DNA, 121 bp, Artificial Sequence
  Synthesized
  misc_feature (61): n=t or g
atgtccctgcccctcagaggcaggtggccctcccagagcggttcgcattcattcagcagcngggtcaagtttaaaaatctgtctctcaggtgaatggccgatggcctttacaatacaaaat

SEQ ID NO: 9292 - DNA, 121 bp, Artificial Sequence
  Synthesized
  misc_feature (61): n=t or c
catgtctcacatcagcagcccaaggtttaaatagcatcactctaatggaagaacaaaactnacgtagaattgttaatgactgtattcactgcatcaactagattctgtgtcgtcagtgtgc

SEQ ID NO: 9293 - DNA, 121 bp, Artificial Sequence
  Synthesized
  misc_feature (61): n=t or c
cttgtatcaatctgtgacaacaaaccagggattttcagcatacattttttgtccattatcnaaaggggaaaagacacactgtcttgaattttagacataatttatatagtttcatacctgt

SEQ ID NO: 9294 - DNA, 121 bp, Artificial Sequence
  Synthesized
  misc_feature (61): n=t or c
agtgggtacagatgagccgtcacagctaattacagcatccagacaccttctttagttactntcaagcttgaacatgctaggacagattaattacctataatcttataagtcaggatatctt

SEQ ID NO: 9295 - DNA, 121 bp, Artificial Sequence
  Synthesized
  misc_feature (61): n=a or g
cagtgtctggtattgagttctctagtaccaactgaggattttcactgttactaaagtacanatgtctcagtatcaaaatcatgcactttcagatgcatcttttccagtgctttgtaccgaa

SEQ ID NO: 9296 - DNA, 121 bp, Artificial Sequence
  Synthesized
  misc_feature (61): n=a or g
tattttgagactctcatcatcatggaaaactgcacgcatatcattagtaaaacatgattanacatcattttctctgaattaagtcagagttctcattttttgaagtagaaaagatatttag

SEQ ID NO: 9297 - DNA, 121 bp, Artificial Sequence
  Synthesized
  misc_feature (61): n=t or c
agtatctttggtcattacattgttgccacggtgtatttgttcaattatcactcaaagcttnagtgagaagcctctccagtgtgtatgcctgctgcagttattgctgttacttagtatagta

SEQ ID NO: 9298 - DNA, 121 bp, Artificial Sequence
  Synthesized
  misc_feature (61): n=t or c
tttgaaaggaggagtgggttaggggagaaagacaaacacatttaagactgttacagagaangctcgctgccctgggacaaacactgaagtatgcagctgattcagcttgtgtagaaacaaa

SEQ ID NO: 9299 - DNA, 121 bp, Artificial Sequence
  Synthesized
  misc_feature (61): n=a or g
cagtgagcaaatcagatggatttaggctgtttctaatggtatttgtttttaagtggctacnctgccagctgtgacagcaacaccacttcggtaattgggacttagcagcttttgcacctga

SEQ ID NO: 9300 - DNA, 121 bp, Artificial Sequence
  Synthesized
  misc_feature (61): n=t or c
atatatagaacgtgtgcaatcttctacagaagataaagaactgatataacatgaagcaatnttgctgaactcacagcataagataaatgtagtaagagtaaacagtaaaaataaatgtagt

SEQ ID NO: 9301 - DNA, 121 bp, Artificial Sequence
  Synthesized
  misc_feature (61): n=t or c
agggggccctcaggctgattcctagccttgggcgagctccttggcaacttctttgctgttnttatcgcagccctctggcaatagtaggtatgatgtgggtgtttcttctctcatcttccct

SEQ ID NO: 9302 - DNA, 121 bp, Artificial Sequence
  Synthesized
  misc_feature (61): n=t or c
gtactttctttggctttgtggatttcacatttttctgaatttgtaagaatatcagcagctnagctcatttcacagtcaaataccacgtatctacttacaaatagtttgtgttgggacacat

SEQ ID NO: 9303 - DNA, 121 bp, Artificial Sequence
  Synthesized
  misc_feature (61): n=t or c
attagttactgctttggttatttgttaaaggtggcttgcttttaagcaaacagaaaattgnaaataactggaatcaaattttttgctatttatgtagcatcacttttatgaacttacctta

SEQ ID NO: 9304 - DNA, 121 bp, Artificial Sequence
  Synthesized
  misc_feature (61): n=c or g
ctcaccagctgggaatgtacttcacaaaagccaatatacactgcctcaaataatctagcanattaatctcttgagttcagagatttaagttaccctactggaaacaggtaacagactgtac

SEQ ID NO: 9305 - DNA, 121 bp, Artificial Sequence
  Synthesized
  misc_feature (61): n=a or t
aggtgctgagttgttctgaagatttttgccttttgtgcttattggcaagtaaccaaagaanagctcttctttggtgcatgctgaagtgttttgctgtaaatgtgcattagtcttatcctac

SEQ ID NO: 9306 - DNA, 121 bp, Artificial Sequence
  Synthesized
  misc_feature (61): n=a or t
aaaaacaagagctggaatgctgagctgcacctgtatcagccttagtaaatcaaaattcacngaagttgctacttcaaccaaattgcttttatacattaaatgttaagatgactgtctggta

SEQ ID NO: 9307 - DNA, 121 bp, Artificial Sequence
  Synthesized
  misc_feature (61): n=a or g
atactgttccttctctagtacatttctaaattactcagtgctattacctaacaacctggantattttagtaagttacctgattaattgcttaaagtatttgcagaagtcaggaaatgaagc

SEQ ID NO: 9308 - DNA, 121 bp, Artificial Sequence
  Synthesized
  misc_feature (61): n=c or g
gttacaaaatagaagattcaaagttgcctatgtttaatccacaagggagtgaaatgtaaanactaaagagacattaagttgtcaccatcattattaggctaagaaactgttaagcagtgct

SEQ ID NO: 9309 - DNA, 121 bp, Artificial Sequence
  Synthesized
  misc_feature (61): n=t or c
atccagcagaaacatgataaaagcacagcgcaatacaaaaagcagtaagatcaattgaganaaattacaagccaagcaccactgcagtcttcataaagaagaaagagcagtggttcacatt

SEQ ID NO: 9310 - DNA, 121 bp, Artificial Sequence
  Synthesized
  misc_feature (61): n=t or c
cacctctggaaccacccagatgagagcggctgcttggcctgtcatggctttcccttccttnatcttcatcagcagcgagtggctgctattaattgctattagcggtgataaccactggctg

SEQ ID NO: 9311 - DNA, 121 bp, Artificial Sequence
  Synthesized
  misc_feature (61): n=a or g
ccttaagtgaacaaaattatgtacttgcatgtttgtagaatcgagaccttaattagctctnggttaatttcccttcttcctaattaaaaacacagaggtcaattaaggatcaggtgagact

SEQ ID NO: 9312 - DNA, 121 bp, Artificial Sequence
  Synthesized
  misc_feature (61): n=a or c
tgctgaaaacatgaaccatgcagagaaatcaccagatagccactgtgttccaagagccttnaggctcctctgtcaaactgacactcaagaatatgtttgttttagcaagggacagaatatt

SEQ ID NO: 9313 - DNA, 121 bp, Artificial Sequence
  Synthesized
  misc_feature (61): n=t or c
acccaaaaatgcttgaagcagcctttttttttttttgttatcctcaaaggcacaactgacntttacagatcagatggccaacacaatggaacaaaaactggactggtacactctgagagtc

SEQ ID NO: 9314 - DNA, 121 bp, Artificial Sequence
  Synthesized
  misc_feature (61): n=a or g
agttaagtatacacacaagaccactaagacttgacactgtttcctgcattgatttgcctcnttcatgctcttacagtgaaaaggctacagatgagaggaggagcgaaaggtgctggcaagc

SEQ ID NO: 9315 - DNA, 121 bp, Artificial Sequence
  Synthesized
  misc_feature (61): n=t or c
aagtaataagtgccactgtactccagcataggtggaaaaggtacgtgttatattctgtagntactaatggaccaggagtcctgtccttattgccttccacattttacctgggggaggaaag

SEQ ID NO: 9316 - DNA, 121 bp, Artificial Sequence
  Synthesized
  misc_feature (61): n=t or c
ttcttcagtgaagctaaccatctctgccctagttaagtttcacccttgtattttcctgcangctagctttctgggaaagcatgtttctaggaaagacaggctgtaactaacgtccataatc

SEQ ID NO: 9317 - DNA, 121 bp, Artificial Sequence
  Synthesized
  misc_feature (61): n=t or c
tctatgattctattaatatcttataatgttttctaagtgcataaacttcaaaggttattgnagatgtttttctgtgaataactctttgttcccttactatttctaagcagctgattagaag

SEQ ID NO: 9318 - DNA, 121 bp, Artificial Sequence
  Synthesized
  misc_feature (61): n=a or g
aattatttaaataattttgccataaggaagatttctgttgcttcataaagttgaacattanaaaatactttattactgtaaagaagatcagttacaagcacaggttgctcataaaggatgt

SEQ ID NO: 9319 - DNA, 121 bp, Artificial Sequence
  Synthesized
  misc_feature (61): n=t or c
agtagaaagtataattgacagctctcttactgacaaagtcacagatataatcagaagactngaccagtaatgtgaagaacaccagttgatacatataattagttgctctgaagtattagta

SEQ ID NO: 9320 - DNA, 121 bp, Artificial Sequence
  Synthesized
  misc_feature (61): n=t or c
accttaagaaaggaataattatcattgtctcagcaaaccaaaggggggatttgctatccanggattcagtgatctaggacccagaaaccagagcaggatgcactcagaaatgaagcggtca

SEQ ID NO: 9321 - DNA, 121 bp, Artificial Sequence
  Synthesized
  misc_feature (61): n=c or g
cacctggtggacagacaacaaaatatacagctaatgcacatccatcaagtaatatacatanatatactttaaaatacaaactgttacaaattgcttttgtttactttaagtcaatgaggaa

SEQ ID NO: 9322 - DNA, 121 bp, Artificial Sequence
  Synthesized
  misc_feature (61): n=t or c
tgaaccatagcactcctgaatttaggaagctgttttatgtcttcgtgccatgtttccacangtccacacacaggctgaggacagccacatgaataaagctctgaggttagagagcactttc

SEQ ID NO: 9323 - DNA, 121 bp, Artificial Sequence
  Synthesized
  misc_feature (61): n=a or t
ggataaagatcaatatgacaagctttcagatgtagcaatctgtcaatactttccagaccanccccacagtaacaaagacagaggcattttcaagttgtaaccgagattagtctccatatgt

SEQ ID NO: 9324 - DNA, 121 bp, Artificial Sequence
  Synthesized
  misc_feature (61): n=t or c
gcacttgtatgtttacttttatctctatttggttagtggaaatcaaagcttaaacgtgctnaatgcctaacactgaatagaaagcttcaaaatgtaaattcaatcacagcacatttaagaa

SEQ ID NO: 9325 - DNA, 121 bp, Artificial Sequence
  Synthesized
  misc_feature (61): n=t or g
aaatgaactatttttcctctctttctgcccataccaattttcttcatttaatgctttcatntacagcttttgtaagtagatcattcaatttgcattctagttgtccagttcaactgtagta

SEQ ID NO: 9326 - DNA, 121 bp, Artificial Sequence
  Synthesized
  misc_feature (61): n=a or t
agaagagttgaaactcccatagattgagataaagtgacaatggaaatttcacaacatagtnaaggacacattttaggcttgcactaacactatgttgaatattgttttatctgttacaagc

SEQ ID NO: 9327 - DNA, 121 bp, Artificial Sequence
  Synthesized
  misc_feature (61): n=a or g
tccagttatactgctgtgagactgcacctgtaagtaaaccacggttggtacaggggtgacnctatacagaatgcaaggctaagctacctaacttcctcctgagctacttttcctctcaaag

SEQ ID NO: 9328 - DNA, 121 bp, Artificial Sequence
  Synthesized
  misc_feature (61): n=a or g
ctcgcctgtcttaagctctcttactctctccagaaatccatactttatcaaaactaaacanagcagattctttctcttcttctctctacttcttcctccacaaaagatgaagaggaaaatg

SEQ ID NO: 9329 - DNA, 121 bp, Artificial Sequence
  Synthesized
  misc_feature (61): n=t or g
aacaagatctcaaagacaggcaattatttttccaatatatctcttgctctgaaaggaaaanagttttcttttcgagttgcaagttattcccatctctcatgctttaccatagaggttgggt

SEQ ID NO: 9330 - DNA, 121 bp, Artificial Sequence
  Synthesized
  misc_feature (61): n=a or g
gttggactcttcaatgccattaaattttgttaatgacttactaaggtcagggtttcacttntgtttacatttgtattgtatttgtattggactttcttttggtgatactctgagggtggga

SEQ ID NO: 9331 - DNA, 121 bp, Artificial Sequence
  Synthesized
  misc_feature (61): n=a or c
aaagggcaactcaggctgacacatatctgtgtacatacaggtcagataccacagacttgtncttgcaactctacgattcctgaatgagtaaactcagtagttatgtttgctaataaaccta

SEQ ID NO: 9332 - DNA, 121 bp, Artificial Sequence
  Synthesized
  misc_feature (61): n=a or g
tacaggtattgtagggcattcatgcagaagaaagaagaaaaactacaactagttacctatngaagaataagtgaaaacttatcagtccatccttcatatggtatcctgtagtgctgctaac

SEQ ID NO: 9333 - DNA, 121 bp, Artificial Sequence
  Synthesized
  misc_feature (61): n=t or c
tccttcactattttgggggctctgatggagagcaaggaaaatcccctcagttgcccttcangcatcacataatgctgtacatgactgctgctgttctttgttgctttagattactgagcac

SEQ ID NO: 9334 - DNA, 121 bp, Artificial Sequence
  Synthesized
  misc_feature (61): n=t or c
cctccattaaaggaatttaggaaacattaactggatatcttgcatttccatgactgtcaangcattaggtaacctgctgtcattgcccattttttcttacctaatatgctaatattcaaat

SEQ ID NO: 9335 - DNA, 121 bp, Artificial Sequence
  Synthesized
  misc_feature (61): n=t or c
ctcccccttcaagaacagtcatttcccacacaccccctttattagacattttattagatangtaactctaaattgtttggaacaggactggaacatacaaatctttattttactgtttatc

SEQ ID NO: 9336 - DNA, 121 bp, Artificial Sequence
  Synthesized
  misc_feature (61): n=a or c
attgtatgtatctctgtgagtgtgtggaggagcattcattaatatacaaaagaattaaganattttcatgcaagcctctccttcctccttattccctaagcattttgagatatggactgtg

SEQ ID NO: 9337 - DNA, 121 bp, Artificial Sequence
  Synthesized
  misc_feature (61): n=t or c
atggttaagtgacaactgattttcagcagctaacaaccatattgaatacttaattcagttnagcataagggactagatgttttgcagtgtttaagaacggcttgttaagcttgctggcctt

SEQ ID NO: 9338 - DNA, 121 bp, Artificial Sequence
  Synthesized
  misc_feature (61): n=a or g
aggtcttcagttcagatacagtctaatgcttttcagagaattggtcgaaatttgggtacanaaatgaggtgaataggagcaaaaaatgagattttttttttctcaaaaataattcatttta

SEQ ID NO: 9339 - DNA, 121 bp, Artificial Sequence
  Synthesized
  misc_feature (61): n=a or g
tataagatagtgacagaatattaccatatagatggtaatgagttgcactaacagtatgctntaaaatcttattcagtaattggtaagtacaaattcgtacattcccaacgaaataacggat

SEQ ID NO: 9340 - DNA, 121 bp, Artificial Sequence
  Synthesized
  misc_feature (61): n=a or g
ttcctatccatagacagttcatttcttagaatcatcaatttttatgccagactgaaaacgnagacctaaaaactcgctttcaaaatctacatttgctttctatacttagttctactcattt

SEQ ID NO: 9341 - DNA, 121 bp, Artificial Sequence
  Synthesized
  misc_feature (61): n=t or c
gcggtgctgggagtgctggtcccatagtactcctggggagaggtcactccaacacccatancacggctacaggtgctggatgcagagtaaaagagcaggactcgggagcaggaggagtatt

SEQ ID NO: 9342 - DNA, 121 bp, Artificial Sequence
  Synthesized
  misc_feature (61): n=t or c
agctaattttctttggaaaaataaaagggtgtagaaatgcattttagagagatatttctgnttctgcccttaatttagtccctcataaaactcttcctcagagatctgaacttcctataat

SEQ ID NO: 9343 - DNA, 121 bp, Artificial Sequence
  Synthesized
  misc_feature (61): n=t or g
cttctgtggcagctctaatgaactccattttattgatcagacagacactagctaaactcanaatgatagacaatcaaaagcaggaagttgataatcagtagcataatcaacttggaaacag

SEQ ID NO: 9344 - DNA, 121 bp, Artificial Sequence
  Synthesized
  misc_feature (61): n=t or c
agctattgaagactccgatcttataaaagcatagcctcttccttaaagagtttgagatatntccttctaattgcacaggttagtgttctttcacagcagagtcagaggtgtgtaggtgtat

SEQ ID NO: 9345 - DNA, 121 bp, Artificial Sequence
  Synthesized
  misc_feature (61): n=t or c
gaagtgcgtgattagtgccaagtcagtgtattcatgttgttctaacaatgtgacatgacangtttttacttggagataatgttttttgttgaatagctgctgtgacagaaaaatcagacaa

SEQ ID NO: 9346 - DNA, 121 bp, Artificial Sequence
  Synthesized
  misc_feature (61): n=a or c
gtattagatataaatacaaccaagaagaaatatgtagttcatctataaatatattctttancaaatattcccaagctagagagaattactgggagatttctatattctgcatgctttactt

SEQ ID NO: 9347 - DNA, 121 bp, Artificial Sequence
  Synthesized
  misc_feature (61): n=t or c
ttgaccattcaagtatctaatatgaagggacaaattattatcttcctcatccaatttctcnttcggaagttgattaggtagcaatgttaagaaactataaacctgctttcaggcaagctgt

SEQ ID NO: 9348 - DNA, 121 bp, Artificial Sequence
  Synthesized
  misc_feature (61): n=c or g
cttttctgctgctgtgaaatcatgaatttcagttgctgagattacgatctgtgggacacantaaatgggatgtaaaccacaatgctgatgttagctggctgctcggctgaagtgccttgcg

SEQ ID NO: 9349 - DNA, 121 bp, Artificial Sequence
  Synthesized
  misc_feature (61): n=c or g
aaccacattttccaaatatgagcccacttttctcaattatagcctgaaaaatggcaagatnctacatgatgctgtttgtagtgcttaaatgcacaaccaaattatttcaaactagtactaa

SEQ ID NO: 9350 - DNA, 121 bp, Artificial Sequence
  Synthesized
  misc_feature (61): n=a or g
caggggtagggtattaaacaaccatatagatgctcatgtacagttacagacagacaaaacnagcacatgagtaaacaaattgatgcatcaatgagttgcattgtgtctgccatagtcatat

SEQ ID NO: 9351 - DNA, 121 bp, Artificial Sequence
  Synthesized
  misc_feature (61): n=t or g
ctaaatggcccaagggcagcttcacagcagtcagaacagttgctgaatatttttggtgaantagctcgaggttcagatattttccaccactgccagatataatcataactctttacaaagt

SEQ ID NO: 9352 - DNA, 121 bp, Artificial Sequence
  Synthesized
  misc_feature (61): n=c or g
atacaaaatctttcccttttttaatactgtgattctcacagtagagctgaagatatacatnatccaatactgaggtggggtttattttccatggtaaagtaaattaaatgaaaaaacagcc

SEQ ID NO: 9353 - DNA, 121 bp, Artificial Sequence
  Synthesized
  misc_feature (61): n=t or c
cactttatcacacagtaacgagcattccaagcagccctcttggctctgtttgctatgggcncagggcacaacccaacatttatcttgaacaagttgtgacagaggccttcttcatcagatt

SEQ ID NO: 9354 - DNA, 121 bp, Artificial Sequence
  Synthesized
  misc_feature (61): n=t or c
tgctgcagggaagacagagtcccctctgagcttgtgtttgcccagggacatacaggaattnggctacctgcaagaatcatcagataataaccttcaccttgtaaataaaatggctagtaaa

SEQ ID NO: 9355 - DNA, 121 bp, Artificial Sequence
  Synthesized
  misc_feature (61): n=a or g
atctactaggagcacaatacaccaaagcctgcacacagaagcctgtattgctgttgcttcnagctgaagtgtcctcctgaaacatcagtgtgagcaaagccaaggcaggaagcactgggga

SEQ ID NO: 9356 - DNA, 121 bp, Artificial Sequence
  Synthesized
  misc_feature (61): n=a or g
acatacctttttaatgcttttttggcacacacccattaattgctcactgaaaaatctgggnagggtatgttgagggttgttttccaccattttacttatcctaattttccctaacttttgg

SEQ ID NO: 9357 - DNA, 121 bp, Artificial Sequence
  Synthesized
  misc_feature (61): n=t or c
agagagaataattgctgctgattatctcttgtcaatgcagtaagaatagcaggtaaagcangggaaaaaaaatgctgcatagtacaatagaatagtatacacacaataaaataatagaatc

SEQ ID NO: 9358 - DNA, 121 bp, Artificial Sequence
  Synthesized
  misc_feature (61): n=c or g
accctgcagaatacagatataggctgacagcagtggtacaattagatctatggaaattttntcacaatcttatttggccctaggtcatttgttagaatatgaatgaacttaatgattaagt

SEQ ID NO: 9359 - DNA, 121 bp, Artificial Sequence
  Synthesized
  misc_feature (61): n=t or c
gaagggcttcttgtcattcactccaagcaaaaaaagcttcttctggaaaaatgtacatgcnttaattttccctgctaaataaaattacaccatgtatttcaagtgtactgagggaacccac

SEQ ID NO: 9360 - DNA, 121 bp, Artificial Sequence
  Synthesized
  misc_feature (61): n=t or c
catttgtgtgcttgcacaaccatgtgcatacgcgttcaaatttattgaattaagggaagangcaggagggaggaaaacattacccaaaatgtgtgtatggtttgcagagttcttctcacat

SEQ ID NO: 9361 - DNA, 121 bp, Artificial Sequence
  Synthesized
  misc_feature (61): n=a or g
acaagctctactgacctatgtgagacaaggtcactactgagctcatagcaggaacagttcntataaacaacaccctttgccaccaacattattctactttagcattttcccttctgtattt

SEQ ID NO: 9362 - DNA, 121 bp, Artificial Sequence
  Synthesized
  misc_feature (61): n=a or g
tctgtgaagacaccattgctgagatttttcttgccttaagctaccttcatctgagatgtgnaaaatggcccttggggaaagtggaaaagcaacacaaagcagcagcagcgatgataattct

SEQ ID NO: 9363 - DNA, 121 bp, Artificial Sequence
  Synthesized
  misc_feature (61): n=t or c
tagtcacctttacatcctcttggtcagaaacctcaagcaactctaagaaaagttcaactanacttttctgtatgttgcttttactaataatttctactttactgaggcccttcatttgaag

SEQ ID NO: 9364 - DNA, 121 bp, Artificial Sequence
  Synthesized
  misc_feature (61): n=t or c
ccaaaaaatagagctccctatttaaaattcttcttgtccagttttacaatggcaaggatangttatttttgcttcgtaccatgctgggagtgagatctctggcacgttttgaaggggtaga

SEQ ID NO: 9365 - DNA, 121 bp, Artificial Sequence
  Synthesized
  misc_feature (61): n=a or g
tgatgtctgtttttgttctcacaactataccacatttcaagagagcttggctgtccattgntcatcattaaaatgcattgttttatttcagaaatcagatcactgtgctatcaagtgttag

SEQ ID NO: 9366 - DNA, 121 bp, Artificial Sequence
  Synthesized
  misc_feature (61): n=a or g
ggaactttcttaatttctttagtaatttccatgaattttcaatatctccagattttatctntctctaatgcctatgtttcactaatatctcagtcctgtgagagagcatagaacctcagta

SEQ ID NO: 9367 - DNA, 121 bp, Artificial Sequence
  Synthesized
  misc_feature (61): n=t or c
gacatctttatgagacaaattatagcataattggaattcaaagataagctttagagtgcangaattcttctccaagtttgaaatagaagcatcaaacttcaaagttaataagaattgaaac

SEQ ID NO: 9368 - DNA, 121 bp, Artificial Sequence
  Synthesized
  misc_feature (61): n=a or g
acatttctgacatcaagtccctttagggaaaaccagcaacaatgatggtcatattaaatgnctgaatccactaacagctcttactccaaaatcaactgtttgtgcctttgggttttagaag

SEQ ID NO: 9369 - DNA, 121 bp, Artificial Sequence
  Synthesized
  misc_feature (61): n=t or c
gaaaacttaaaaatgctgtcagtaaatgggaaaattagaaggaagcacatgaagcagctcngaaaagctgttctttgcactgcactaacatacaggttgccttaactggaggcttgtctga

SEQ ID NO: 9370 - DNA, 121 bp, Artificial Sequence
  Synthesized
  misc_feature (61): n=t or c
gcatacctcacagttcaatgctgcacatctgtgcttcttaaaaacaccataagaattttgnattatgaatattttcttatcaaggtacagaattaaaaaaaaacctcagatataaaataaa

SEQ ID NO: 9371 - DNA, 121 bp, Artificial Sequence
  Synthesized
  misc_feature (61): n=t or g
tcaccaagttctgaattacagcctttccagagtaatttttgtggaaaacttttgtaaacantaattttactcaagcaagttgtggcattaaaactgttgtacaatacttgccccactgata

SEQ ID NO: 9372 - DNA, 121 bp, Artificial Sequence
  Synthesized
  misc_feature (61): n=t or c
ctttgaggttccttccaacccaagtcattctatgattgataaccatcctttcagaaaaccnaccttccaccacgagtttgtcaaatgtttgtcctttccctcagataattgtgatgatgtt

SEQ ID NO: 9373 - DNA, 121 bp, Artificial Sequence
  Synthesized
  misc_feature (61): n=a or g
agctaagaggatctgactgctctccataaacacacagagaaggcatgcaccagggagtgcngagagctatttaagctgaaggacaatgctggcacaaaaatacatggatataagctggcca

SEQ ID NO: 9374 - DNA, 121 bp, Artificial Sequence
  Synthesized
  misc_feature (61): n=a or c
aatttgattttggaaataatcacctttatgctttctcgcaagaacagggctgcatgaaganccccctccagctgcaaatcacagaaagtaacatatcagggcaaagagagagttgctgcaa

SEQ ID NO: 9375 - DNA, 121 bp, Artificial Sequence
  Synthesized
  misc_feature (61): n=a or g
aatgagagatttgttctgagagaaaattcagttatttcctgggagctgttctttgtaattnctttatactggccctgactcttcctattcatttgattgtttgttgcagtgaccttcaact

SEQ ID NO: 9376 - DNA, 121 bp, Artificial Sequence
  Synthesized
  misc_feature (61): n=t or c
gctgccactgtactgcagtctatgcaagccgaggctcaccctgctgatttcagtactcctncctcttccctgcacagagaggtgtgggtactttgctgagatcagttagctgggctggcca

SEQ ID NO: 9377 - DNA, 121 bp, Artificial Sequence
  Synthesized
  misc_feature (61): n=t or c
ttagaaaggttttagctctgaattaagacaaagagcctattttaaagaaacccagctctanacagtatgtacacactgcatatcaaccataacaaatgatttttagaatacttaacagaaa

SEQ ID NO: 9378 - DNA, 121 bp, Artificial Sequence
  Synthesized
  misc_feature (61): n=t or c
cagcatcagggaactgtgttaattgacaacatacctattcccgaaatgaatttctatctcnagttggtaaaacaatgttttagaagtcacttttctgagtggggttggtattgctgacacg

SEQ ID NO: 9379 - DNA, 121 bp, Artificial Sequence
  Synthesized
  misc_feature (61): n=a or c
gggaagaggagacaatgggaaaggacttggtgctggaatcctgtattctcaccctgagtgnggtggatttgcactgccatgcagctggtggcacagcagggtacgagcccagggacagcag

SEQ ID NO: 9380 - DNA, 121 bp, Artificial Sequence
  Synthesized
  misc_feature (61): n=t or c
agagttaagaaaattggtgcagaatgagaggacattgtctcattatttctttgtagcaaangcaactaatacctaaaataagaataacaggagaaattatttatcactaatcattctgaaa

SEQ ID NO: 9381 - DNA, 121 bp, Artificial Sequence
  Synthesized
  misc_feature (61): n=t or c
cctccaagctttttgctgctattttttttctagattatcatgcttattttaaacaatgccnaatgctcactgcagtgctgactggagttttggtggtgattttggcagatatcgcttctgt

SEQ ID NO: 9382 - DNA, 121 bp, Artificial Sequence
  Synthesized
  misc_feature (61): n=a or g
aacagttgacctgtccgtaaaatagggtagctgatatttatccatgtctctggcatgtgantcattaattaatatttacaaggcagttggaggtcttgggatgaattgctttgcaggtaca

SEQ ID NO: 9383 - DNA, 121 bp, Artificial Sequence
  Synthesized
  misc_feature (61): n=a or g
ctgaagaacagcctctaacttgccctgaagaccatcaccaaaacttccaaatttaggggancttcttgttccttcttgacccttctgtaggacacctctcctgagatccaggtggatggag

SEQ ID NO: 9384 - DNA, 121 bp, Artificial Sequence
  Synthesized
  misc_feature (61): n=t or g
aatgggtgactgacagttaactcggatcaattcatcactgctgaaaaagaaggtaagagangctataacttggaaagctagtggaaagttttattatgcttaatctggatataagtgcatg

SEQ ID NO: 9385 - DNA, 121 bp, Artificial Sequence
  Synthesized
  misc_feature (61): n=a or g
acttttctgaatgccaacaagcatctccagttgtttaggccaagacgtgccactccccaangtggcactggtattgtggtaccagtgctgctaatgagaaatgagccttgttgtcctggag

SEQ ID NO: 9386 - DNA, 121 bp, Artificial Sequence
  Synthesized
  misc_feature (61): n=a or g
agttcatgactttaacatggcattgtggtcattcagaagtcggtggcccatttctcaaccnatcatcatataaggctttgactaatcactggtaacaaggcagtagatgttctgattctgt

SEQ ID NO: 9387 - DNA, 121 bp, Artificial Sequence
  Synthesized
  misc_feature (61): n=t or c
gtaaggtaagaagtgctagtgatctgaccattaggaaaagaaaggaagatgtatttagttnggtaggaaaggcttagatgatacttgtagtcatgtctgcaagctgtttttcccatattct

SEQ ID NO: 9388 - DNA, 121 bp, Artificial Sequence
  Synthesized
  misc_feature (61): n=t or g
ttcccaaggtccttttgaaattcagtcctttcatttccctgaaatgctgctctgagttcanactttcaaagagacagagcttgggttcagatggtgaaaaaagaggaattatggtgcactg

SEQ ID NO: 9389 - DNA, 121 bp, Artificial Sequence
  Synthesized
  misc_feature (61): n=t or c
tgttggctccagaaggagggagggatgtgtcattgccatcatcctcacccttttgtgttanggccagcagcgatctctcactacatatgtcccataaagcagaaccaaagagcagatgctc

SEQ ID NO: 9390 - DNA, 121 bp, Artificial Sequence
  Synthesized
  misc_feature (61): n=t or c
tgtagacaggctcttgctttctgagagcactaactcacactctgaggtagtagtgtccttnttccatgctgtggtgagctaaccacagagctctccatccgtcctaccaccacagcaacct

SEQ ID NO: 9391 - DNA, 121 bp, Artificial Sequence
  Synthesized
  misc_feature (61): n=a or c
agaaagtccagagtagtgaaatggaaatgacctagtgttgtggaaacagaaccaaatctcntatgggtctacgggatgtcagctttccagtaagcacattttacttaaaatgcagcttctt

SEQ ID NO: 9392 - DNA, 121 bp, Artificial Sequence
  Synthesized
  misc_feature (61): n=t or c
aatttatttacctactcactagcccagacgtacagaataaccagtgagtaaccatccctcnctcctgcaaggggaattctcctcctttagaaaatgcattgaaatttatgtctgtaaaggc

SEQ ID NO: 9393 - DNA, 121 bp, Artificial Sequence
  Synthesized
  misc_feature (61): n=a or t
aagaagaaaagctcagtgcttgtctaaccaaatactttcatgctgttctttcagttatacngcagtgatcaccacccagttcacctcctctaccttcaaaaaatctcactctatacaaact

SEQ ID NO: 9394 - DNA, 121 bp, Artificial Sequence
  Synthesized
  misc_feature (61): n=t or c
ccatgacagttcacaatctgagatatggatattagtaagtcttgcgctttgacctcatttnttttccctcggtcaaagccttaaatataaataaacacaaaccatttacaaccttgacatt

SEQ ID NO: 9395 - DNA, 121 bp, Artificial Sequence
  Synthesized
  misc_feature (61): n=c or g
ttcaggcaagccaggtgccatgaccacttccctagggagcctgtttcaagtctggccaccntatggtaaggaaccttctcctaatgtccgatctgaacattccctgtcacagcttcatgca

SEQ ID NO: 9396 - DNA, 121 bp, Artificial Sequence
  Synthesized
  misc_feature (61): n=t or c
taagttgtagtttcagcagtgatttttacatttagaatttgtttaatgacaaattactgangttaataacagccagaccaaaagattgtcaagtttatccagcacagcaacatctgactgt

SEQ ID NO: 9397 - DNA, 121 bp, Artificial Sequence
  Synthesized
  misc_feature (61): n=t or c
aaaagtagagagaaatggaacaaatggaaaagtcagagaatttctgacttctcttccttcnctgagtatgcgttaacagattgttccagaacctgagctctaatattaaacttgtttctat

SEQ ID NO: 9398 - DNA, 121 bp, Artificial Sequence
  Synthesized
  misc_feature (61): n=t or g
atatcaagtgggtcacactctcagtggatgaaagtagaacttcaatggatccaacatacgncacattttgatgaaacaattatctttctgatagttccaccctacataaatggaaatgcag

SEQ ID NO: 9399 - DNA, 121 bp, Artificial Sequence
  Synthesized
  misc_feature (61): n=t or g
aacaaagtccactgtgaaaggtactcttctctcaattgccttactaatagttaaactgtgnctcaaggtgcattctaatataagtgcctgtcatttagatgaatgaaaatgactttctatg

SEQ ID NO: 9400 - DNA, 121 bp, Artificial Sequence
  Synthesized
  misc_feature (61): n=t or c
aaggagcatttatcaagctcccatctgaacagagaagttctgtagttgcagaacacactcntctgaatgcaaatcacttctctgtctcacactgagagcattcactcttcagatgaagtct

SEQ ID NO: 9401 - DNA, 121 bp, Artificial Sequence
  Synthesized
  misc_feature (61): n=t or c
aatgaatgttcagaatgactttgttattctgcaagtaacgtttatatgaatttgctctgcnggtgatgacgtggcacgtttccatcccataggagtcaccctgtgctttgttgtaacccca

SEQ ID NO: 9402 - DNA, 121 bp, Artificial Sequence
  Synthesized
  misc_feature (61): n=t or c
atgagtgtgtgtagatgtttaattcacctcttcctttcccaaatgttacacatccttaacntgtgagctctggatgacctgcagaaacagcatgcacctggtactgctagctaatcccatc

SEQ ID NO: 9403 - DNA, 121 bp, Artificial Sequence
  Synthesized
  misc_feature (61): n=a or g
tgtaatgagttaaaatagctgctttttagatgccttcggtttgtctcagtgctgcaatttncagaagtttgctttaattgtttaattatctccatgacattcatgatgagtgacgatacaa

SEQ ID NO: 9404 - DNA, 121 bp, Artificial Sequence
  Synthesized
  misc_feature (61): n=a or g
aagtggaaaaagacaagctctcatctaataatgttcctattaatacacttttctgtgtgtncttttgctttgaacatataacagtaatgaaaaaatacagtggtagacacttgatatttgt

SEQ ID NO: 9405 - DNA, 121 bp, Artificial Sequence
  Synthesized
  misc_feature (61): n=t or c
ccttagcaggtaattaacttcagcactttattataccttggtcctacttcttgcaaagacncaacagttattataggtggattgtgtttgttcagctagaggcacagctttgctgtgcacc

SEQ ID NO: 9406 - DNA, 121 bp, Artificial Sequence
  Synthesized
  misc_feature (61): n=a or g
ttttatcattttacctccacagaaggcctttccataaattttttagaagtcaatcctaaancttttatttacatcacatagatgtgtgtatctcactatatacacttaaaagtataaaact

SEQ ID NO: 9407 - DNA, 121 bp, Artificial Sequence
  Synthesized
  misc_feature (61): n=a or g
tgtaatacgttcgttttcagcagtcactagcagcagtttacatcacctctgtgaggtcggnctgacgcctcaaattcagagagcagcatgcctgtggttacttcactgatagggtagtaaa

SEQ ID NO: 9408 - DNA, 121 bp, Artificial Sequence
  Synthesized
  misc_feature (61): n=t or c
ctgtgtacggaaggcctgagcggtgtcatgctacctgaaaatctaaacaggcctgtgcaangtgtaattgctacaggtgggagcctgttcccagctgctatctttctgagaggccttcagt

SEQ ID NO: 9409 - DNA, 121 bp, Artificial Sequence
  Synthesized
  misc_feature (61): n=t or c
ggaaacctgtttcacataagaagatgacatgttaaatgcataagatctttatatctgctcngactgtacttgaggaagaaagggcagagttatgtacacaggtattctttaaagattcaca

SEQ ID NO: 9410 - DNA, 121 bp, Artificial Sequence
  Synthesized
  misc_feature (61): n=a or g
gattaaaagaagcctaaatatgtgcatctgaatcttcacctagctctgcaaacatgccctngataaagattttatggtaatgcagtctactttataaaatctgcagagtcccactgatatt

SEQ ID NO: 9411 - DNA, 121 bp, Artificial Sequence
  Synthesized
  misc_feature (61): n=t or c
cccataaagagttcatttcttccaacaaagttccaagttcttgcttcccactcaagtgttntcctttgcatctcacacgctacagtgtcacaaccctgaggaaggacccacattcccaacc

SEQ ID NO: 9412 - DNA, 121 bp, Artificial Sequence
  Synthesized
  misc_feature (61): n=c or g
ccggccctgaaattttgtttcaactatttttaaatagtaaacgaccgcagttgaggcacanggagcagccgggcgctgccggcgaggtgctgcacggggacaaagcggcaattaaatctca

SEQ ID NO: 9413 - DNA, 121 bp, Artificial Sequence
  Synthesized
  misc_feature (61): n=a or t
ataagtgcagtcagcccacaggaaggctcagtaaggcagcctcaaacaagagccattcccngccatcaaaccaggctttactcaggtgtgaaaccttcaccctggagcttggctcgctgtt

SEQ ID NO: 9414 - DNA, 121 bp, Artificial Sequence
  Synthesized
  misc_feature (61): n=a or g
ataaagacacagaactcctgagaagaaatgcagtttcacagaatacatctttcttttctcntgggcttaaaagattgtggttaagggcaactgtgctgtctctaacagtttcctggagagc

SEQ ID NO: 9415 - DNA, 121 bp, Artificial Sequence
  Synthesized
  misc_feature (61): n=a or c
tatcagttgtccttccttaggcacttgaaaaatcaaatactgacctgtagaattactaaantgcatgttagaaggaacataattatgctgttctgtctactggactgtgaaatagtgacaa

SEQ ID NO: 9416 - DNA, 121 bp, Artificial Sequence
  Synthesized
  misc_feature (61): n=a or g
caagcatcttgataaggtatttggtatggaattaatgctgtaagaagcctgcttgctatantattaactgtttgaaaacaaaaagtatatttgaaggcaatctttaaaaccttttgggaaa

SEQ ID NO: 9417 - DNA, 121 bp, Artificial Sequence
  Synthesized
  misc_feature (61): n=a or t
tttttccatttcttaattattaaagttagctatggagggagaggcgcttattaacctgtcntctccacagtttgatcttaagatagaaaataatcaagaatgccattattgtctagtctgg

SEQ ID NO: 9418 - DNA, 121 bp, Artificial Sequence
  Synthesized
  misc_feature (61): n=c or g
cattgctgttgtatggtgactgatcaaccacagttcaatgcttgaagtagatagcttgaantagatagtagagagctcaaatggtttcctgcgtggtgtcagaggtatccatgcctcccag

SEQ ID NO: 9419 - DNA, 121 bp, Artificial Sequence
  Synthesized
  misc_feature (61): n=t or c
aaaaatgtttaatcaatgtagcatgcaattactcttacttgcacatttttcattcataacnggagtttgtattttttggaggattaaaggttgtaaggtgagccatctcagcttgcaggat

SEQ ID NO: 9420 - DNA, 121 bp, Artificial Sequence
  Synthesized
  misc_feature (61): n=t or c
cacatccactaacagcagtgtaattaacaacagaaagcaaagcaatggtgagtgaggctcngtatgatattagaaatagcttgaagtaagcagcatgttatttcaggccttgtatccactg

SEQ ID NO: 9421 - DNA, 121 bp, Artificial Sequence
  Synthesized
  misc_feature (61): n=t or c
agtttgaaggaaaattctgaatatcccatgtcacaacagtactaccacataacctaataanttgtagcttcacatacagtgcctctaagtggtctaagatctcttcttggctctagcctgt

SEQ ID NO: 9422 - DNA, 121 bp, Artificial Sequence
  Synthesized
  misc_feature (61): n=a or g
taaagatacacaaaacgtaaaagcgaaaggacttaagaagacggaaagtggaaattcttcntaagcagtaatcattttctttctgatcattaacataaacattgttcaagtgcggttggtc

SEQ ID NO: 9423 - DNA, 121 bp, Artificial Sequence
  Synthesized
  misc_feature (61): n=t or c
aaaatcaggaaatctgcatgcccaacagctggctgaagatttgtgtcaaaagttggatttngctttccatttactcacacttggattgtataaatcctgttcactcacgaaagaaacacag

SEQ ID NO: 9424 - DNA, 121 bp, Artificial Sequence
  Synthesized
  misc_feature (61): n=t or c
acagagtggaaaaggttagagtcctcccatcctgctttactgccaagaaatgctgctctgngcttatgtgcttcagaaacaccaggctttgcagaggggtttgtgaggaaagaggaaaagg

SEQ ID NO: 9425 - DNA, 121 bp, Artificial Sequence
  Synthesized
  misc_feature (61): n=t or c
gcaattaaaattcagacttctcactggtaaaccacttcgggtaggggcttgcttcaatccngtacactccaacgtttcaggcgttcctcggtataaaagcagcatcgcctctaccagagga

SEQ ID NO: 9426 - DNA, 121 bp, Artificial Sequence
  Synthesized
  misc_feature (61): n=t or c
cagtgatatctttttttccccaccaatgcaaatctattgcatatgccttctgtagagttantctcatgaccagaattagccctcactcccacctacctcattcttagctatgtggggcttt

SEQ ID NO: 9427 - DNA, 121 bp, Artificial Sequence
  Synthesized
  misc_feature (61): n=a or g
tacctgccttcaggaaggctctgaccaggcttgagcagccctttcctctaagcctgttccncctttgtagaggaaaatcagagtgcgttgaaatttcagcccagggagttaatttctcttt

SEQ ID NO: 9428 - DNA, 121 bp, Artificial Sequence
  Synthesized
  misc_feature (61): n=a or g
ccaggaagaaaactctaaaaataaaaggaaataataaaaatcacatggccacattaattancttggtggtgataagtcagtacttcaataaataaatcttgcattatcacaatggtcacag

SEQ ID NO: 9429 - DNA, 121 bp, Artificial Sequence
  Synthesized
  misc_feature (61): n=a or g
gaaagtttgagcataaagagattgggcaacactcagaggtaaggtgaagtcagaacaaagnaggtttctgtttaagatgctgaactgtgactcagaggaaccgaattttcttcctgcatcc

SEQ ID NO: 9430 - DNA, 121 bp, Artificial Sequence
  Synthesized
  misc_feature (61): n=a or g
atggcgtatagctataagggtagagtggaggtggggagtatcacaaaaaaagtggtgacanaaggctgagaggaggaatctcttacccaggatcaacaccatccatcagagcatttaacat

SEQ ID NO: 9431 - DNA, 121 bp, Artificial Sequence
  Synthesized
  misc_feature (61): n=a or g
tttcttatatgttactgagcttttgcctttgctgtgtacctttccttcatttcataaaacntttattccatgggatactaataactcagcctggagaagaaagggctccaaggagacctta

SEQ ID NO: 9432 - DNA, 121 bp, Artificial Sequence
  Synthesized
  misc_feature (61): n=a or g
aacttagttctatgacaaaagcatggtgctcagaaacacagagaagtaaaggcaggctgtngagtttgcttccctctgaatagggcaaggcaggactatccaaaaccccatgctaccttac

SEQ ID NO: 9433 - DNA, 121 bp, Artificial Sequence
  Synthesized
  misc_feature (61): n=a or g
tttgcgttcgtctgtattgagctccaatgctgcgaggcccaaagaatcatatatctcagangtcatgaaaaagagataggtctgaaaatcccaagtctcttcctggtgtgtgcagattgca

SEQ ID NO: 9434 - DNA, 121 bp, Artificial Sequence
  Synthesized
  misc_feature (61): n=t or c
atgtttctaagcagccacaaagagacatttgtctggccataacgccgcggcagaggtcacngtgtagagtaatagagagacatgtaatacagttttactctttcctgttctgaggtaatcg

SEQ ID NO: 9435 - DNA, 121 bp, Artificial Sequence
  Synthesized
  misc_feature (61): n=t or c
gtctgttttcttctgttaaaataggtttttctgcaaatgcacaggaaagctaatctctgcncagaatgcaagaaggacctaagcctttatgccttaagtatgtatagggtgacacagagag

SEQ ID NO: 9436 - DNA, 121 bp, Artificial Sequence
  Synthesized
  misc_feature (61): n=a or t
aggaaatttgaacaaacttgtataaattgttctcaatggctctgttacctgatctgtttantcaaatttgacttgcttgcagtgaacttcagttctcctgaaagatattttacttgcaaga

SEQ ID NO: 9437 - DNA, 121 bp, Artificial Sequence
  Synthesized
  misc_feature (61): n=t or c
aattttctgcgttagtttctatcaggctgcaatgaagtacagctcaccaagggacgcaggnttactcccacctaaccttaacatttcatagaactgttaaggttggaaaagaccaccaaga

SEQ ID NO: 9438 - DNA, 121 bp, Artificial Sequence
  Synthesized
  misc_feature (61): n=t or c
gttactcttatattgaatacttatctcataagtctgcctgcagcaactgtcttttgagttnttcagtctctaccttcaacctagtcttttacttttgagaccaggcatgacttagaggtac

SEQ ID NO: 9439 - DNA, 121 bp, Artificial Sequence
  Synthesized
  misc_feature (61): n=a or g
aaaaaacaaaagcaaccaaacctggggcagactgtaaaatgagaatcttcatggttactcntccaactatgaaagctgaagttttaggctgtaattagaccacaacacgctgccatgagaa

SEQ ID NO: 9440 - DNA, 121 bp, Artificial Sequence
  Synthesized
  misc_feature (61): n=a or c
attaaatatgtatatacacttctcagcttgacagagaaataaaaataatcagtcccattanaatctacattgtgtgtcctatgctgacatatttgaaaggcagaactaaaatggttattgg

SEQ ID NO: 9441 - DNA, 121 bp, Artificial Sequence
  Synthesized
  misc_feature (61): n=t or c
ggactagcattgctgagatctatacccagctcttgttctgccacctgaaacaattattctncttcccaaatttttttacattgttttatactgtacttatatattccattgattattacaa

SEQ ID NO: 9442 - DNA, 121 bp, Artificial Sequence
  Synthesized
  misc_feature (61): n=a or g
cattccaggtctgaagtgtaacgtctctcccagtcctgtggagacgggtttgttgctgacntgtggatgatgatgcatatggttgcatctgatgcattgcatatggtcatttgaatgggcc

SEQ ID NO: 9443 - DNA, 121 bp, Artificial Sequence
  Synthesized
  misc_feature (61): n=t or c
agaatatagaacaaaggttgtgaagaagcctgcaaagcaaggaagatgtgcacgctcaaanagtcttctaaaactcttcttgcagatgaatgatggttttggttgcctgtatgtggataaa

SEQ ID NO: 9444 - DNA, 121 bp, Artificial Sequence
  Synthesized
  misc_feature (61): n=t or c
ggtcctgacatttggggctagaccagaaaggaacagagacttctgtttaaacaaatagctntgtcactccttgaacttgctgtagatctcctgcctcaaagtgatcatatgtttaattcaa

SEQ ID NO: 9445 - DNA, 121 bp, Artificial Sequence
  Synthesized
  misc_feature (61): n=a or g
agcagaagtatcacacggcagagacaggagcctttctacagcatcacaaggctgaagccancctggctccggttcttggttgctgtggtaacagatttggcatatgccggcccttcagctg

SEQ ID NO: 9446 - DNA, 121 bp, Artificial Sequence
  Synthesized
  misc_feature (61): n=t or c
gctggtatcagtgcctctgtggtttggggattgctggaagtctgaatcatgggtcttttcnctcctgtgaaaacgacttttatgtcatttgctactgtaccagtacccaaagcccacccaa

SEQ ID NO: 9447 - DNA, 121 bp, Artificial Sequence
  Synthesized
  misc_feature (61): n=t or c
gacacgagttatcaagagttctgacagaactataatgtaaatagaaaacagatgagaatgngtggagatggcttaccataacaagtcagccccatcagaagaattcaggtgaactgacata

SEQ ID NO: 9448 - DNA, 121 bp, Artificial Sequence
  Synthesized
  misc_feature (61): n=c or g
ttaaatagttgtcatctacgcaagggggacggaatggtcaaaggaacacaacagacaccangacaagctggcttggccagctgacaagcgctccactgaggcaagtctgaacatgaggaaa

SEQ ID NO: 9449 - DNA, 121 bp, Artificial Sequence
  Synthesized
  misc_feature (61): n=a or g
aataggagcctttctcgtgtgttgccgcaaaaaaaatggaaagagtaaggctagaaagaanggaggcaaattgcttggagtaaaggcagcggtaaatgttaacgccgagttatcatgatgg

SEQ ID NO: 9450 - DNA, 121 bp, Artificial Sequence
  Synthesized
  misc_feature (61): n=a or g
gtaaaggcagcatgtaatttgccattgcaggttggttgtgcacagtacaggagtgggacgnggacaaaaagtttctgagactgctcaggctcaaaccaaattatttactttcccaggctcc

SEQ ID NO: 9451 - DNA, 121 bp, Artificial Sequence
  Synthesized
  misc_feature (61): n=t or c
taatacaactgttagaaagggctatacaaagagaaactggacaaaatgcctctactaatantatctcaggaaatgtggttatgatccaatagctaaagttctgagtcaatgacataacctg

SEQ ID NO: 9452 - DNA, 121 bp, Artificial Sequence
  Synthesized
  misc_feature (61): n=a or t
ataaatgcattctgcagaagttagagaactggatgtgctgctttctaaaacatccttgacnttgcagaaggtcaaagatcaagtgctacataacttcagtggtcctttcagatctgtgaaa

SEQ ID NO: 9453 - DNA, 121 bp, Artificial Sequence
  Synthesized
  misc_feature (61): n=t or c
tcatgtttcctactggacacaatgagcatgtctatagatgtcaaatcgctagccatacctnctatcttagtttccactcaatatacagcataactggatttcagagaatacaagaccatta

SEQ ID NO: 9454 - DNA, 121 bp, Artificial Sequence
  Synthesized
  misc_feature (61): n=t or g
cagctcctttaacaaattcccacatattctgatcaagatattcctattaacacttgacttngtatatgctgctttctgatttggacagaccagaatcttttgccaggtttgagatttgttc

SEQ ID NO: 9455 - DNA, 121 bp, Artificial Sequence
  Synthesized
  misc_feature (61): n=t or g
ctttctccaacagatttttagctcttgtacactgaaaacttatgaaggtagaaaagttacnggaaatagctcctgaacgtcaagattttatgcaaactattttgctctacatcatccaaca

SEQ ID NO: 9456 - DNA, 121 bp, Artificial Sequence
  Synthesized
  misc_feature (61): n=a or g
caacgtcaataaacacacttctcatttataaagttaagaaagttttaatactttgtaaacntagttcactctgtaaagcagagggatcatcacaaagaagtattctgtgacattaacacag

SEQ ID NO: 9457 - DNA, 121 bp, Artificial Sequence
  Synthesized
  misc_feature (61): n=a or g
ggcatcagaccacacatccctctgatttgaccctcactgttttgagggtgagtataagagncagtggtcactggcatagtgctgctgcctgcatgagcagtcccctgagtacctacttcct

SEQ ID NO: 9458 - DNA, 121 bp, Artificial Sequence
  Synthesized
  misc_feature (61): n=a or g
aattatacaacaaacagttataccgatattcctttagaaatctacaaccagtgaggtactnataaatatatatttatgtggggatatttcatatactaagattcagccacgtgcttttgca

SEQ ID NO: 9459 - DNA, 121 bp, Artificial Sequence
  Synthesized
  misc_feature (61): n=t or c
gacttaagcttcttgcagatgctgcattatgtcctcagaaaaaaaatgcaagtacttttgncacttttttcctgtcctcttgtgacggatgtatacagtgtggttggaagagccaaatgca

SEQ ID NO: 9460 - DNA, 121 bp, Artificial Sequence
  Synthesized
  misc_feature (61): n=a or g
cttgctgctcagaggggtctggaacttggtataaaagacatggcaggtcaagaatgaaacncactggcagaattgcatgcatgaaatttgtatggcaattaccccaagccaggacagccag

SEQ ID NO: 9461 - DNA, 121 bp, Artificial Sequence
  Synthesized
  misc_feature (61): n=t or c
ttgccctgggtcagccctgccttagccacaggctctggaaagtgctgtagttctctcctcngtttcaaggatgagaactctgccagggtttttttggaagtctgtgtggtttctacgttgt

SEQ ID NO: 9462 - DNA, 121 bp, Artificial Sequence
  Synthesized
  misc_feature (61): n=c or g
acatcattatgtatgttgcctgaggataggattaaaagaaatttctgaagattgcatttcnttacatggtattattctatgcaaggcaggacaataacaaaagtctaaagtgactgctgaa

SEQ ID NO: 9463 - DNA, 121 bp, Artificial Sequence
  Synthesized
  misc_feature (61): n=a or g
cttgtattcattgtattagaaagagtctggcaccagccaaagggcatcgaacgaatcctcnggaaaaacaggttgtcattgagggatacaaggatgggaaactgaaagagtcagggccaaa

SEQ ID NO: 9464 - DNA, 121 bp, Artificial Sequence
  Synthesized
  misc_feature (61): n=t or c
acaaggcagtcagggagacagaagcagtagtatagccctagcctggtttgagcactgttantgtagtgtttctgcatccacctctctctcctgaataaagaggatcactaggtctttcata

SEQ ID NO: 9465 - DNA, 121 bp, Artificial Sequence
  Synthesized
  misc_feature (61): n=a or t
cattcatttcctttacgtggctgaaatggccaaaatatgttctttagtggtgcatgggaancttctaccataaggtaattgcagctacaagggtagtccatgaatgcattacaaactcttc

SEQ ID NO: 9466 - DNA, 121 bp, Artificial Sequence
  Synthesized
  misc_feature (61): n=t or g
tgagacttgagttttgaaagggagcacacctggacaaggtgtaacaagagaggtcaagcangtgacagctcggagctgtgggactgcccccgccaatttaaaatgttaattatcttgggtt

SEQ ID NO: 9467 - DNA, 121 bp, Artificial Sequence
  Synthesized
  misc_feature (61): n=t or c
atgaataaattcattaaagctcctgctatattcacatacaggaacaaagtaactctatttntgttatcaactatacttactgaagttgtaacatgctacttacgaagcctacaagttctga

SEQ ID NO: 9468 - DNA, 121 bp, Artificial Sequence
  Synthesized
  misc_feature (61): n=a or g
gcttgaagaatattacaaaatattttcatttttctggttactctttcgtcaaagggtcacnctgaaacagttcacagtaatctgaaaagtgaccagactgacacaagtggtaggagcaaca

SEQ ID NO: 9469 - DNA, 121 bp, Artificial Sequence
  Synthesized
  misc_feature (61): n=t or c
agtaatttcattaaaattgttcaacaaaataacagtgtagtataaaaatggaagaagacanagatgtggcaacactccaggggaggcaaacccttgccaacttgtaaagctgacaaattta

SEQ ID NO: 9470 - DNA, 121 bp, Artificial Sequence
  Synthesized
  misc_feature (61): n=a or g
tttcagttattctgcaaaatgaaccgattccttcccatgccgtgctgcatcccacatgtcngtcgcagcatctcagacaagttgcatacacattcagaacgtgtgtagatgtgccacaggc

SEQ ID NO: 9471 - DNA, 121 bp, Artificial Sequence
  Synthesized
  misc_feature (61): n=t or c
ccactgcagtgattgtagctgctgcaagagctaaactaaatgcagtatcttgaacaaaagngtatttttgttcatagttttacacaattgaagcaatcattcatctccagttaaaattctt

SEQ ID NO: 9472 - DNA, 121 bp, Artificial Sequence
  Synthesized
  misc_feature (61): n=c or g
tatctttatcttaccctcgaatggtgtgatcaagcgtgtattgatcctgagaactggctanagtagtcctgctttctgagactactgtttgaaaagaacaactgtaggaagggaaaagtaa

SEQ ID NO: 9473 - DNA, 121 bp, Artificial Sequence
  Synthesized
  misc_feature (61): n=c or g
atctgtatttccactgcttgcaaagatgctttggaaaggatttttctaaattcttccagancaatacaaacctgcagctacaggagagggctgcagagcatacctaaggttcttctccctt

SEQ ID NO: 9474 - DNA, 121 bp, Artificial Sequence
  Synthesized
  misc_feature (61): n=a or g
tggtataatggctagagtaaaaagttactagtttttaagaacatactaaaataaaagcgtnaacttacagacttacctgcagagagttgttttagtgtctctgtttctgagcattcaaaac

SEQ ID NO: 9475 - DNA, 121 bp, Artificial Sequence
  Synthesized
  misc_feature (61): n=a or g
agttttctatacgtaaagatttctttcacttgcatcctttcctaagggactctggtgaagnaatgaccattttaatctgctgtgcattacacaggaatcaaagagaaaaatggcaaagtgg

SEQ ID NO: 9476 - DNA, 121 bp, Artificial Sequence
  Synthesized
  misc_feature (61): n=a or g
tgatattttaccttcttcagaactggatgaaccgcagaatatcagtccagtcatctggaangctttgaaacatgattctttggattttagtgagttttgtgcaactttcattaggaaagta

SEQ ID NO: 9477 - DNA, 121 bp, Artificial Sequence
  Synthesized
  misc_feature (61): n=t or c
tttactctctctttctcacagcctctctctcgcacacacgcacatacccacaaacgcatanagaaaaggcacagagccgtggtggttgcactggaatatgcactgggtttcccgggacaca

SEQ ID NO: 9478 - DNA, 121 bp, Artificial Sequence
  Synthesized
  misc_feature (61): n=a or g
taaagattttttaattaattttttttaacactttcctttctttctgaattgatgaatatgnagcttactgcttctttttaagatatctgccagacaaggtgatagacctttgtttcagaaa

SEQ ID NO: 9479 - DNA, 121 bp, Artificial Sequence
  Synthesized
  misc_feature (61): n=a or c
aaaagaaaaataagagtgcatcagtaaaattcctttctctttagtttgatgctaaggtatnatggcagactatattgaaggtcttgctgaggttaaggtaaacaacacccctgttcttgac

SEQ ID NO: 9480 - DNA, 121 bp, Artificial Sequence
  Synthesized
  misc_feature (61): n=a or g
tcctttaatcagtatttcacaagaagagatcacctgtgaaattgcaaatgtgcttcagaanggttagaataaagttggcatgcagggttcttgctcatctctgcattggaaattaggagtt

SEQ ID NO: 9481 - DNA, 121 bp, Artificial Sequence
  Synthesized
  misc_feature (61): n=a or g
gaggatatacacattacttttcttacccaactggtcttcacatactccattcacagtgccntaaagttcaaatccagacagagagaggtagtgtgtttgcccactggcattctttcccatc

SEQ ID NO: 9482 - DNA, 121 bp, Artificial Sequence
  Synthesized
  misc_feature (61): n=t or c
attttgttttgtttagccattctttctttgtcctatcacctttttcaggatcttggtatcntttaacccttgtatttgtcctttctgctaccatgttgctcactccatagtttcaaagtat

SEQ ID NO: 9483 - DNA, 121 bp, Artificial Sequence
  Synthesized
  misc_feature (61): n=t or c
gtattattgtcaagttcacttgtagaaaacagattggttctgaaaactaatgcctgtcttnctacagcagagagtgtttttttttgattagtgaaatgttcccttggtggtacttcagtgc

SEQ ID NO: 9484 - DNA, 121 bp, Artificial Sequence
  Synthesized
  misc_feature (61): n=a or g
gaattctcgttacatgaaaagacagaaaaatttacagggattccagaaacatatactgctntaagcgtgttatgaaaatgacgatgatgcgtcagttctaattaatatatacttattaaaa

SEQ ID NO: 9485 - DNA, 121 bp, Artificial Sequence
  Synthesized
  misc_feature (61): n=t or c
tagagatattcttccatgcattccatttccttgcctaggtaaatgtgcaagaagcaaaagnctgaggtaatgtcatgtttaacaggctaaattcctgccatgaagtcacagccatgattct

SEQ ID NO: 9486 - DNA, 121 bp, Artificial Sequence
  Synthesized
  misc_feature (61): n=a or t
ctcagatatgctcagaaaggatcaatgaaggctatgttctcagattccctcttgtcacaanctaacttggtcagaacacgggtacgaactgctgggaagcccatagtaacacttccatgag

SEQ ID NO: 9487 - DNA, 121 bp, Artificial Sequence
  Synthesized
  misc_feature (61): n=t or c
ggccttatcccttccattggaacctgttttttgttgctgcagctcactttttgaaatgagngacagaagtctttctcactttagtcgataaaatacaaaaaataaaaaataataaataaat

SEQ ID NO: 9488 - DNA, 121 bp, Artificial Sequence
  Synthesized
  misc_feature (61): n=a or g
gtaacgtcagtgaaattgatagctacataaccagccatctcaccactagccagaataagancaaatgccaggtaagatgtgcaagcgtcatgcctatttagctgctatattcttaaaaatc

SEQ ID NO: 9489 - DNA, 121 bp, Artificial Sequence
  Synthesized
  misc_feature (61): n=a or g
tgtcctgagagcccctgctggtgtgcatggaagaacaggcagagaatgaggcatcagaatnctgcatatcctaccacacactgctaatgaacccaactgctgtgtttgcgaatggaagcag

SEQ ID NO: 9490 - DNA, 121 bp, Artificial Sequence
  Synthesized
  misc_feature (61): n=t or g
agtagctgtgtctttgattccatacctgcttgggtacaaaaatgactcaagcaacagcagngtgacacaaaagcagggaacatctgacccaacaatgtctagagcctgagagaatatacct

SEQ ID NO: 9491 - DNA, 121 bp, Artificial Sequence
  Synthesized
  misc_feature (61): n=a or g
aaatcttccttgccagtgaaataccctgcttccctagtgctcctctgctcaattcaagagnacctccaaatcctgcctgtgtaaggtagcagggccatgcagcggggcagctcctgctaat

SEQ ID NO: 9492 - DNA, 121 bp, Artificial Sequence
  Synthesized
  misc_feature (61): n=a or g
gtctatttgcattccctaagcatttgatccccaacaattctgctgcatcatataatgcttnatggtttatccagtcttgactgttctcagatccacagacattaatctacacccatagtta

SEQ ID NO: 9493 - DNA, 121 bp, Artificial Sequence
  Synthesized
  misc_feature (61): n=a or c
tccacaaagacaacaattcaactgccttttttacttcagcacttcacagatatcctcaacnttttgttttaaacaccagaaaactgattcctatctagtcccataagattcaaaggatgtt

SEQ ID NO: 9494 - DNA, 121 bp, Artificial Sequence
  Synthesized
  misc_feature (61): n=t or c
catgcagaagggctagcatttgtgccttttacttctgataaatatacagatcacgttttanacaacatccagctcttcagcaaaagcaggaaagtgactgtaaaacgtagcagttcagtat

SEQ ID NO: 9495 - DNA, 121 bp, Artificial Sequence
  Synthesized
  misc_feature (61): n=a or g
agtagggtagaacatagtaaggtttttagattatgattcattagaggagtggtcttgatgnttagggattatctttaggttagctgtgcattgtgcacttttcccaagagaagtcttcagt

SEQ ID NO: 9496 - DNA, 121 bp, Artificial Sequence
  Synthesized
  misc_feature (61): n=a or g
tccaggcttggaataggtttattatctttcagtgtcatcagtaacacaagtgtataatttngaggctatttcaacgtgaaatgagttgattatctcactcttgtccttactgaactcttgt

SEQ ID NO: 9497 - DNA, 121 bp, Artificial Sequence
  Synthesized
  misc_feature (61): n=t or g
taacaaaactctgcctggctatttatttttcatatgacttcatttgtttgtaagttgtgcngttgatatggtgatacttcagaaatcagtcaagtgttgccaatctgttgtgtcaggaatt

SEQ ID NO: 9498 - DNA, 121 bp, Artificial Sequence
  Synthesized
  misc_feature (61): n=t or c
cccatctttccatgtcaagaagcacttacctcatagctgtctgttccagggatagatttanccagcgcagaggaaacagtctcttcttgccacctcctaatattggcagaaccaggtagtg

SEQ ID NO: 9499 - DNA, 121 bp, Artificial Sequence
  Synthesized
  misc_feature (61): n=a or g
taaatttcttacgggtttacaaacatacagaaaaagatacataatgtgcacaccatctctntcttgcattctggtaccttatgtactcactgccacatgcctggggtaaactgtgcttgac

SEQ ID NO: 9500 - DNA, 121 bp, Artificial Sequence
  Synthesized
  misc_feature (61): n=t or c
atttatgagaaacacatcctggaaaactagttctgagtttcagaaaggccccagtacactncagtttgagttcaatgtataaaagaaagtgtgcattcacaccaccaaagatatgtgtaag

SEQ ID NO: 9501 - DNA, 121 bp, Artificial Sequence
  Synthesized
  misc_feature (61): n=a or g
acatcatgaaacaacttcgcaatcagggattgggggatggagaatgaggacagagaatggngatggagggaatggagaatgtctgcaagcatcccatggttgacaaaaaggggtcagagaa

SEQ ID NO: 9502 - DNA, 121 bp, Artificial Sequence
  Synthesized
  misc_feature (61): n=c or g
tatctccaaatgagacagcacctgtaaatttggagcaatgctccagctagcataaaaatanaaaatacattttgtcacatgataaatgtctaggaattttttataaaatttctaatactga

SEQ ID NO: 9503 - DNA, 121 bp, Artificial Sequence
  Synthesized
  misc_feature (61): n=a or g
atcagctgctggatgggataacctacagacatttccctgtacgtgtacaggattataggcnaagcatgctgcagctagctatacctctattgttttgatccccttctcccaggtgtgaggc

SEQ ID NO: 9504 - DNA, 121 bp, Artificial Sequence
  Synthesized
  misc_feature (61): n=a or t
ctgcattgtgacacggaactgatataagacaaagatcctggatttatttagaatttccatnaaaatgagcattaaagaaagaattagcttccaagttttgccatgttctgcttaagaatac

SEQ ID NO: 9505 - DNA, 121 bp, Artificial Sequence
  Synthesized
  misc_feature (61): n=a or t
cataaaactaacttcttatgaagttagttcccagggtaataaagaagcatttaaaagcttngggatttttctctgtactaagtgagaacatttcaaagcatttgaaatgcttgtatcttaa

SEQ ID NO: 9506 - DNA, 121 bp, Artificial Sequence
  Synthesized
  misc_feature (61): n=a or g
aaataaacaaatttcattaaaaaaataaaataaccacagtcttttcacagtgcccaatttnggcatttttcaggtacactgcactcatactaatagctctaaccaataaactcctgaatgc

SEQ ID NO: 9507 - DNA, 121 bp, Artificial Sequence
  Synthesized
  misc_feature (61): n=t or c
tgccctggcagcagataacatcagggacagcgctgaggtgccagggttcaaatagactgangcagcaacaacccaaatggccccgatgcaaaccagcaggactcttcccagtcctcacacc

SEQ ID NO: 9508 - DNA, 121 bp, Artificial Sequence
  Synthesized
  misc_feature (61): n=a or g
tggtctcattttgcaatgattttttttgtgaacagtgactatgatatagtgaagtctatcncttgcatgtggaggtacagtcatatcaagttttagaggataccagctagggaattgatgt

SEQ ID NO: 9509 - DNA, 121 bp, Artificial Sequence
  Synthesized
  misc_feature (61): n=t or c
tctgttaaaaacaactaaatacagtcagccttttggatgctggggaaagcttgccaaatgnacggaatctgcacagctcaggtaccctcctcctgtggccttctggagaaagccaacttct

SEQ ID NO: 9510 - DNA, 121 bp, Artificial Sequence
  Synthesized
  misc_feature (61): n=a or g
tgcaatttggtgttcaaaaactgccttatcaacagaacatctgagggaagagccatctgcnctgcaaagggtgctcacagtcctgctcaggctgagcagaatggatagagggagagaaggg

SEQ ID NO: 9511 - DNA, 121 bp, Artificial Sequence
  Synthesized
  misc_feature (61): n=a or g
aatagagacaagaaaagccgacttcatctccactttcacttagacacctgtactagttggncttgatatatacttgacaaaggggatctatttcttttcccaaaaacagtattgatagcag

SEQ ID NO: 9512 - DNA, 121 bp, Artificial Sequence
  Synthesized
  misc_feature (61): n=t or c
ataattggtacattgcaaatttggatgccattaagaaggaacattttagaacagtaatctnagtggttaaattaatattggagaacatgaatacttctgttagaagggcctttctgtcttc

SEQ ID NO: 9513 - DNA, 121 bp, Artificial Sequence
  Synthesized
  misc_feature (61): n=a or g
agagcccatctcctctcccctgcaggaagcacacaggcctttcatgtatttctggccaaanaaagagatgtgggcaattaaaacaacaacatcactgcaccaaggacacgttcacatgtgt

SEQ ID NO: 9514 - DNA, 121 bp, Artificial Sequence
  Synthesized
  misc_feature (61): n=a or g
tacagcatgaatgcaacctgaagactacataaacaaatacatgttccttggagaaaggggnaaagcataaacattatcttttagttaacctttgctgtgcaaatatcatttattttatgtt

SEQ ID NO: 9515 - DNA, 121 bp, Artificial Sequence
  Synthesized
  misc_feature (61): n=a or g
ctgaatggccttcaaagagctgctgtagatccatgttgctgcatactattgccctcagtantgttctcacacctgtggtgtcactgtaggggatttttgagtcattcaggaatgaaaacgg

SEQ ID NO: 9516 - DNA, 121 bp, Artificial Sequence
  Synthesized
  misc_feature (61): n=t or g
gtaggatatatttttttttaacttcttgtgtaatactgtggcatgcaggagtcttaaactnacccggtaagtgaagcaaggagactacaaaaacctgaagtcaattaccagtttttagcac

SEQ ID NO: 9517 - DNA, 121 bp, Artificial Sequence
  Synthesized
  misc_feature (61): n=a or g
tgtcagtggtggtaacttttggtgtagaaatgttgcactttattttcatatactgtgatgntgcaactgtgttagtgttttttttatcacaggggtactgcatatgatgcatttttaatag

SEQ ID NO: 9518 - DNA, 121 bp, Artificial Sequence
  Synthesized
  misc_feature (61): n=a or g
caaaacagggcagtgggtcttagcatgccttgaagaagctctgtatttgcctatgcccttntcagtatgagaagtctggggctgtcatgcctctatattaaaaataggttgttacaagctg

SEQ ID NO: 9519 - DNA, 121 bp, Artificial Sequence
  Synthesized
  misc_feature (61): n=c or g
atctactgaaaaaactgaacaggttggattgtcttaaagaggaatttccaaatacacaganagttcttaaagattttctaaagcctatgcatcttacaaaaagtgaatgaaacaaactgaa

SEQ ID NO: 9520 - DNA, 121 bp, Artificial Sequence
  Synthesized
  misc_feature (61): n=t or c
tcatttgagactgattcaagtacagcaggaatgaagaccatgtgagtttgtgaccatgtgnctgaacaaagtggggacaggtttagtatactacacagcctatctacttcatattggctgt

SEQ ID NO: 9521 - DNA, 121 bp, Artificial Sequence
  Synthesized
  misc_feature (61): n=t or g
ccccactgctccttccctaatcaacttgtccccagatgtgaggtgtgctctctccctttgnccacaactccttcagggcgtacacactttctcccactgtgcaacattttctgccctttct

SEQ ID NO: 9522 - DNA, 121 bp, Artificial Sequence
  Synthesized
  misc_feature (61): n=c or g
acctcagagaggttagaaacatagacctcgactgctagaatcatgtgaagcatgatttgantccagtccagacttcagtcctgcaggccctaggagagctaacacattcagatccccaggc

SEQ ID NO: 9523 - DNA, 121 bp, Artificial Sequence
  Synthesized
  misc_feature (61): n=a or g
aattactttcccctgcggcttgcatagtaaaggtgcatggttaaggtgcagctactaaacnagagtagcttctaaacaaagatatagaatatttataccatacttatttctccttcttcat

SEQ ID NO: 9524 - DNA, 121 bp, Artificial Sequence
  Synthesized
  misc_feature (61): n=a or g
gaagtcttacatcagtaacgtatcaaaagaatgaatcttggacaaattaatctggctttgnccttagagttctgcatggttgttggtacccatcctaaacagacgtttcaaatgtccgaat

SEQ ID NO: 9525 - DNA, 121 bp, Artificial Sequence
  Synthesized
  misc_feature (61): n=a or t
tagggtgagtgctagaatgacggagattttattcgctcagctcccacgcttgtcctgctanatctgtgctctgcctcaacagatgggctgtgtagtctgttcccttcctgagctgtgccca

SEQ ID NO: 9526 - DNA, 121 bp, Artificial Sequence
  Synthesized
  misc_feature (61): n=t or c
ttttgtgtgtttgtttgttttttaattaattatttttattacaaaagcctttggttaatgntctgtgggtctgatttgcagagctgccgagcaccctgctctctgattgcttttaactgga

SEQ ID NO: 9527 - DNA, 121 bp, Artificial Sequence
  Synthesized
  misc_feature (61): n=a or g
ctcagtgcttttgctgtttttcttccaactctggcacctcatgatggaaataatttgaccnagattacagagggtgcctgtgataaagacaagtaggtgcttctgaagagtttgtggctct

SEQ ID NO: 9528 - DNA, 121 bp, Artificial Sequence
  Synthesized
  misc_feature (61): n=c or g
tttgcaaatagaccaaaatgttgatgatttttgagcaatcttcaaactgtcctcatattcnttaatcacaatgggaagcatggctccacacgtttcgctgttcacagtatttagccagtgt

SEQ ID NO: 9529 - DNA, 121 bp, Artificial Sequence
  Synthesized
  misc_feature (61): n=t or c
gcaaggttcctccttcttgttttaactcagcctgtatccaaattgcattgcactgaggctnatctctgcctattcattgtctcaaatcttcaggctctgactagttaccatggcactgaat

SEQ ID NO: 9530 - DNA, 121 bp, Artificial Sequence
  Synthesized
  misc_feature (61): n=t or c
gctgcaattcaataaatattggggatgaatagtggaagaaaaaactacagtattgagatgncatttgtcttaagcatgcaggacttcctttgtttaagattagactgggaaaatcctgatg

SEQ ID NO: 9531 - DNA, 121 bp, Artificial Sequence
  Synthesized
  misc_feature (61): n=t or c
ttggatgccataatgaacagccgcattttcttacctagaaggaagcgatgaattgctgagngcaggagtaagatgtccacatgcaccctcccaatccctctcacaacccaatgcatataaa

SEQ ID NO: 9532 - DNA, 121 bp, Artificial Sequence
  Synthesized
  misc_feature (61): n=t or c
ttctcaaaatatgtaaatcaaatgcataaatacatttcactccaagacagtaagtgctcancacctctatatttaattctaagcaaatataatcctctattacggcagtgttccatacagt

SEQ ID NO: 9533 - DNA, 121 bp, Artificial Sequence
  Synthesized
  misc_feature (61): n=a or t
ccattagagaagatgttcattagcaccagttccagtaacaagtcctgaggaatgatcagcncaaaaaaactcaccaccagggcctggtccaaggtagctcacccacaccatgggaagatgg

SEQ ID NO: 9534 - DNA, 121 bp, Artificial Sequence
  Synthesized
  misc_feature (61): n=a or g
gcttataaagatgttttccagagctttcttgggctccagctgacatgactgtagtaagatncagggcagcacggagactcaagtgtactcttgatatccaagcaaagttgtgtgtgagcag

SEQ ID NO: 9535 - DNA, 121 bp, Artificial Sequence
  Synthesized
  misc_feature (61): n=a or t
cttccggctgagatgggcattgccagctgcaggagcgggacttgagcttctcctgggatcngtgaaagtcttccttgctggattagtggctgctttgccaatcctgtctgtgtagatgctg

SEQ ID NO: 9536 - DNA, 121 bp, Artificial Sequence
  Synthesized
  misc_feature (61): n=t or c
atgctacattgcttttctactcccttatacatgtattctgattcatctgtcctactgaagngttccagtaggttttcccttgtaaatgtgctcttggagagaaaatctcacagaattggtg

SEQ ID NO: 9537 - DNA, 121 bp, Artificial Sequence
  Synthesized
  misc_feature (61): n=a or g
tgatgaacatccatactacactgacatccctctccactcctaaagttcaaacagcaaagcngtacaaaatcccatctcccttgcataattacagccttgaagaggcagaagggactccacg

SEQ ID NO: 9538 - DNA, 121 bp, Artificial Sequence
  Synthesized
  misc_feature (61): n=t or c
cacgtaagttcttacctctacgttatagaggaacctgaagttgctgggtgtctgtgatgcnctctgaacagcctgagccaatgcaacagctcctttaccaccctctgcccagtgagtgcac

SEQ ID NO: 9539 - DNA, 121 bp, Artificial Sequence
  Synthesized
  misc_feature (61): n=a or g
acaggaattgtctggttgttttatcttgggcattttaaaaatgaagtttgattggagaaantaaactccagtctgaagggaaaatgagataaagagcagattatgtaattcagaacaaatg

SEQ ID NO: 9540 - DNA, 121 bp, Artificial Sequence
  Synthesized
  misc_feature (61): n=t or c
acccccctttcttctggttttgctgacatctgaggtgtctcgcagtaggcaagtgctgtanggtaccatggtgagctgctgggagcctacggcagccaatcagtaagaacagccactctcc

SEQ ID NO: 9541 - DNA, 121 bp, Artificial Sequence
  Synthesized
  misc_feature (61): n=t or c
gaaacaacaacatgatgcagatgcatcttcagctgcaggaaaaagaacataaagtagcagntcacattaacagtagaactcgcttgaatctaccatactttaattaaaattacactgttgt

SEQ ID NO: 9542 - DNA, 121 bp, Artificial Sequence
  Synthesized
  misc_feature (61): n=a or g
taagcaactggaatcaaaatgagcagtggtgttttgacttgtgtgttacagcaataagcanaggcagcagaggtttattcatacactatatactgctttgcatagatatggcagcatctca

SEQ ID NO: 9543 - DNA, 121 bp, Artificial Sequence
  Synthesized
  misc_feature (61): n=a or g
tcctccaccagctaagccagcactgctccaggcatcacaggagccttctcctattcactcnatctgaactccaaagcctgttagtttatgccaaataaacccatctactctgctgatcaaa

SEQ ID NO: 9544 - DNA, 121 bp, Artificial Sequence
  Synthesized
  misc_feature (61): n=t or c
ttgaactcacacttatctttggtcatctcctcactgataaggaggacagaaataaatgatnagatggaatgcacagtaaagactcagcaaggggcaactacaaagctaaaattaagatatt

SEQ ID NO: 9545 - DNA, 121 bp, Artificial Sequence
  Synthesized
  misc_feature (61): n=a or g
gcagcaccaaacaagctgaagctcccgttctcctattagtcagaaggaattctgccctccntactcactgcctttatgaaaaccaaccacaaagcttccagcagggacaaaagctctttca

SEQ ID NO: 9546 - DNA, 121 bp, Artificial Sequence
  Synthesized
  misc_feature (61): n=a or t
catattggtacatcgctgctctctcagtgctctgaacactcacagctcaaaatcaccactnttcaattattcttttggcttttgtcttttcctgcttcaacgtgggcttgggttacaacgg

SEQ ID NO: 9547 - DNA, 121 bp, Artificial Sequence
  Synthesized
  misc_feature (61): n=t or c
gcaaggggagcccagctcagaatacgactggagggcaaaaaatgaacatgctttcagtganagttttaggccatagaagccgcaggaaggacacaaaagtcgttatgagaaaaccaagcaa

SEQ ID NO: 9548 - DNA, 121 bp, Artificial Sequence
  Synthesized
  misc_feature (61): n=a or g
gaacaccagaaagctgctcatggggagaactttttctcacaagaactatggcttgtaagcnggatctctggaaggatgaggctagttttaagttgccccacttttagtaaaaacattgcaa

SEQ ID NO: 9549 - DNA, 121 bp, Artificial Sequence
  Synthesized
  misc_feature (61): n=t or c
cccttagctcagtgcagattctgcaagatgggattgctgaagtctttgtccatctgaggtntgggtatccctgaggttagaaattccacctctctacgtatgcgtttcagtgtttccagtt

SEQ ID NO: 9550 - DNA, 121 bp, Artificial Sequence
  Synthesized
  misc_feature (61): n=t or c
acgctggggcaagcccatactgcttgagatctgctcatttctgcagtgcccatcacctcantgtccctttcattcctgctctgcctcagcccaaatgcatggggatgcagaagagaccatg

SEQ ID NO: 9551 - DNA, 121 bp, Artificial Sequence
  Synthesized
  misc_feature (61): n=t or c
gttttaaacaggttttcaacacttgaaattaagttttcaagagtgtttttgttctttaccnagacatcatgttttcaggggagttttgagaattggaaatacattctagcagtaggactgc

SEQ ID NO: 9552 - DNA, 121 bp, Artificial Sequence
  Synthesized
  misc_feature (61): n=t or g
tgtccaaccacttgtcccagttctcatgctacatacaaacagacaaaacacaaatgaaatncagttgcagctttgatagcccagccctgcttccacgcaggcagcacaccaggatgtcaca

SEQ ID NO: 9553 - DNA, 121 bp, Artificial Sequence
  Synthesized
  misc_feature (61): n=t or c
taaaggccaaaatcctttttcaggagcaataactttcctgacaataaaagcaggcatatcngaataaaccagaccttagtgtgctcttggaagagagcatcacgtgccacttcatctttta

SEQ ID NO: 9554 - DNA, 121 bp, Artificial Sequence
  Synthesized
  misc_feature (61): n=a or c
tacttatgtgtaacactttaaacttacatcttatccaaagtatactgacaaatacatgttnatctcatggcatcagcttaattagttccctaattatttgcaaagtaggcaggaagcttcc

SEQ ID NO: 9555 - DNA, 121 bp, Artificial Sequence
  Synthesized
  misc_feature (61): n=c or g
atcatctcagcctatttctattaagtctccgatcagattcctgcaaacagactgaatgttnaagccattaacgtggtctatctttccactctggggatatttacagcatcaattatctcaa

SEQ ID NO: 9556 - DNA, 121 bp, Artificial Sequence
  Synthesized
  misc_feature (61): n=a or t
tccttcactgatgcattttttcagaaatatacatattctagttgtttacttaaacagattngggggtttcatcacaaaaataaagacatcttttattgcagtgcttctgtgtcctatgagc

SEQ ID NO: 9557 - DNA, 121 bp, Artificial Sequence
  Synthesized
  misc_feature (61): n=a or t
tgctcctcctgatccacctcccctcagcatgaggaaatggccacttccaagatctgcttcnttgaagcttcacccacatctgccatttgctgacctacataagatgcccaagatgaatcct

SEQ ID NO: 9558 - DNA, 121 bp, Artificial Sequence
  Synthesized
  misc_feature (61): n=a or c
tgactgtggagcaatcacagcgctgctgcttgccatctattcctacttggccctcccatcntaaaacttaacctttcctctttcaaaaatgcgtaactcaaaacactgagctttttcatac

SEQ ID NO: 9559 - DNA, 121 bp, Artificial Sequence
  Synthesized
  misc_feature (61): n=t or c
cagggttctcttacatgtgagctgaattaatggtaagtataaacctgccttaggagagggntaggaagttcagtgaaagtttctgggttgcgttgaggctttaggtaaaaactattacact

SEQ ID NO: 9560 - DNA, 121 bp, Artificial Sequence
  Synthesized
  misc_feature (61): n=a or g
gcccaaaagaaataacagggcaatactgccctcatgtctgtagctttaacagttcctacancacaccatgaaacccatacaagagagtacataccggataaatgttgcctttaaccatata

SEQ ID NO: 9561 - DNA, 121 bp, Artificial Sequence
  Synthesized
  misc_feature (61): n=a or g
tgaaaagagggttctgtttgtttgttttacagaaaggccttctgcaagaaaaacaacagcncattaacagaagacaacattcacaatgagattccgtatctaattagcaccatttctggtt

SEQ ID NO: 9562 - DNA, 121 bp, Artificial Sequence
  Synthesized
  misc_feature (61): n=a or c
aggtggtcaaagtgacatctctggagctgttcacgccaacagatgtcactgagcatcacanagtcaccaagccatgccgtggtttcactgaagaagcacacaggatcaggttgcagaattc

SEQ ID NO: 9563 - DNA, 121 bp, Artificial Sequence
  Synthesized
  misc_feature (61): n=t or g
acccccttgggaataaaacctcagataatccatatccccaaatcacctggaataggctcancagcactgagcacgcaagaatagaaatagtatgcagtcactgctttctgctgccactggc

SEQ ID NO: 9564 - DNA, 121 bp, Artificial Sequence
  Synthesized
  misc_feature (61): n=a or g
cggaccaggctttggaataagactgaagattcagtgaaagcaggaatgtaagctggaaccnattcaaagtggagtttgtggggggaaaaattcagttaaggtttgagtctcaactggtctc

SEQ ID NO: 9565 - DNA, 121 bp, Artificial Sequence
  Synthesized
  misc_feature (61): n=a or t
ataaaagcactcattaagtgatttcatttaacacaaattctttcttaataaagaatgcagntctacagctagtgcttaaaagcatcaatgtgaagggtttatcctccaagactagccagaa

SEQ ID NO: 9566 - DNA, 121 bp, Artificial Sequence
  Synthesized
  misc_feature (61): n=a or t
gaatataagcacgtgtcaactgcatgctgtactggcgagcttgccacagtccctcctcctnggactttaagtaatgctgtccaagaaccagactgttttgtgtgctctgaactcagattac

SEQ ID NO: 9567 - DNA, 121 bp, Artificial Sequence
  Synthesized
  misc_feature (61): n=t or g
ctctatccattgtgaagctaatcactatgctaaagaaatggaatctttggctgcatagganaaatctataagcacaacttctttctgtacgtcaaaataacacccttttctccagccctac

SEQ ID NO: 9568 - DNA, 121 bp, Artificial Sequence
  Synthesized
  misc_feature (61): n=t or c
agatgagcattaggcagtaagatcttatgatgaacacaccattctggaaaaacttatttgngtttttgaaagcaaaaataatagctaacagaaatgaaaatatgacaataaacttctaagt

SEQ ID NO: 9569 - DNA, 121 bp, Artificial Sequence
  Synthesized
  misc_feature (61): n=t or c
cttccattgtgctacagaagtacagtgaaatggacacagctctctgggagcctgctgacangctgtaggttgtctttgcgctgacacaacgctaatgcacatccagtctggttgagtccac

SEQ ID NO: 9570 - DNA, 121 bp, Artificial Sequence
  Synthesized
  misc_feature (61): n=t or c
tgtccagtcacagaccatttttttccatcactttttaactccagaaagatgatctataacngcacttcagaggaagaagctctgtccattctctaaaatgatttttttacttgtttactct

SEQ ID NO: 9571 - DNA, 121 bp, Artificial Sequence
  Synthesized
  misc_feature (61): n=t or c
ggaaattcattgcaagtatcacaatacaaaaagaacatttatatttcacatacattgttgnggctagtaacactttaagagataacacaatttactcataggtactttttcatagttcact

SEQ ID NO: 9572 - DNA, 121 bp, Artificial Sequence
  Synthesized
  misc_feature (61): n=a or g
tgctctgtttcctacctccacagaatttctgctacaacagctcttataaacattgctgctnaaacttaaaacttgtagttaggtgcctgcattttgatgcacgaaatgcttttagctgtat

SEQ ID NO: 9573 - DNA, 121 bp, Artificial Sequence
  Synthesized
  misc_feature (61): n=a or g
acgcgcatctatcctgaacagtggtagttttgctgtggcataagccacagagaacagtttnaatctaatctttgcctgtcttgccatccctgtctgctctgatgtcagctgtctgctggaa

SEQ ID NO: 9574 - DNA, 121 bp, Artificial Sequence
  Synthesized
  misc_feature (61): n=a or t
agagcgttcttatgagaaatgaaacaggctcatttttaaataaccagcgctaagcagaagnaatattgctcagttgttccttggagacttttattctcttatttctcatttttatattact

SEQ ID NO: 9575 - DNA, 121 bp, Artificial Sequence
  Synthesized
  misc_feature (61): n=a or g
ggaaatgttcacttcaagaatgacctcttgttctctgtgattcagttagtttccctgcctntgcttcatcccttcaagccatttctgttaagtaaacttctccagaagactatgttctttc

SEQ ID NO: 9576 - DNA, 121 bp, Artificial Sequence
  Synthesized
  misc_feature (61): n=t or c
aaaaaaggaactgatcaaaattgagtataatttccaaccacttccaattttcaaagcatgncatctaaaagttaaaataacattttttcttaagatctcacattttttaacaatggtagct

SEQ ID NO: 9577 - DNA, 121 bp, Artificial Sequence
  Synthesized
  misc_feature (61): n=t or c
tacatgatttaggaatcattgtcttttctttattggcggtgtaatatgcagaggttttatngatcaaaagtaagcatagcctgctaccaccctggaaaacggcacctgtgcatcttatata

SEQ ID NO: 9578 - DNA, 121 bp, Artificial Sequence
  Synthesized
  misc_feature (61): n=a or g
aaaacattcaacattagcacttgactctgaattgacaaaacttgtttggtaccatttcatntttttgagcaagttagattttaaatagtatttactcaaattagtgcatgaatgaatgtat

SEQ ID NO: 9579 - DNA, 121 bp, Artificial Sequence
  Synthesized
  misc_feature (61): n=a or g
ggcaagggctgtgtaacagagcagtgacattgagctgtcaaactacgatacgctaggtccntgttatccagcattttgaaatgtcaaatttgaacttttcaatctagtttttggtttcatt

SEQ ID NO: 9580 - DNA, 121 bp, Artificial Sequence
  Synthesized
  misc_feature (61): n=a or g
ttggagaccacaccattcccgtacttttatcattttagattactgcttgagattcctactnctaacaacagaccagaagcaatactgtcctgcactactaacctgtttagccttttagcct

SEQ ID NO: 9581 - DNA, 121 bp, Artificial Sequence
  Synthesized
  misc_feature (61): n=a or g
tactgcaccaatataaaaatatcaattaaccaagagtatcatagtaatcaacatgttttcnagcagctttgctaatatttcattgatgccctccctttgcaagcataggaccaatatgagc

SEQ ID NO: 9582 - DNA, 121 bp, Artificial Sequence
  Synthesized
  misc_feature (61): n=t or c
caggtttttcttttgttctgtgtttcacatcttcatagacaataactggttttggaaaagngatgacccttcaggagtttctaccaacttaataggttctaccctaggaaagagaatggat

SEQ ID NO: 9583 - DNA, 121 bp, Artificial Sequence
  Synthesized
  misc_feature (61): n=a or g
atctcctagttagaccatcagaaaaacaattaaaacaaccacattgattgtaattaaaacncttccctctcaacatattttaatgagcaagtgctgcaataatgtttctgagcctagaaat

SEQ ID NO: 9584 - DNA, 121 bp, Artificial Sequence
  Synthesized
  misc_feature (61): n=a or g
cagttgctgtgtttgtattctgtatccagcagaaccacacacagctgcatatgcagagganaatccacaggactgctggcatttaattgccttcagttaagaggttgggttttaaaacaga

SEQ ID NO: 9585 - DNA, 121 bp, Artificial Sequence
  Synthesized
  misc_feature (61): n=t or c
tataataatgtacagctcctgcatatgcttttcttcaacagaattcaccttgctttcccangagttatcattactccgatgttactgatgacaaaacacaagcagagggcagtgctctaca

SEQ ID NO: 9586 - DNA, 121 bp, Artificial Sequence
  Synthesized
  misc_feature (61): n=c or g
caatattagaagtatatttcttttgtattggagaatagctggaaaacgagtgagtaggtanaccgtgcatcttgtgtaactctgctggattaaacaattttcacaacatccttaggtaaaa

SEQ ID NO: 9587 - DNA, 121 bp, Artificial Sequence
  Synthesized
  misc_feature (61): n=c or g
aaaacatttgtatttcattcgctgttttacaattgaatctgcatccagaattacaacttantttctttttcctgtcaccttagtggcaatatttaaacaattcctttatgtgaacatgcat

SEQ ID NO: 9588 - DNA, 121 bp, Artificial Sequence
  Synthesized
  misc_feature (61): n=a or g
ggagacctcattttgctgtcactactagatactgctctgttaccgtgagaagttttagtcnctgttagtgattcatagggtcaaaattgttcttagggtagaaataggaaaggtgtagaaa

SEQ ID NO: 9589 - DNA, 121 bp, Artificial Sequence
  Synthesized
  misc_feature (61): n=a or g
attttgaaattaggttgtgaaattttctttgtcatttaatcacagggttttattgcagttntggaagaatgataatgaaattatattatttttcagcatttttcatgtgtacaatacagga

SEQ ID NO: 9590 - DNA, 121 bp, Artificial Sequence
  Synthesized
  misc_feature (61): n=t or c
gtcaaatatgataaaaatcaggcaatccagcttctagatttccatagaaactttatctganatgacttctgttttttatgttatacctggaatactaatctgtcacggactacgttttgca

SEQ ID NO: 9591 - DNA, 121 bp, Artificial Sequence
  Synthesized
  misc_feature (61): n=a or g
ccaatcagtagaaaaaggatttatcttccagttcaggtgtattcagtataaagtgagtctngggattgtggcagtccttacttgagagctgtccattatgtgctggccaggcacttgcata

SEQ ID NO: 9592 - DNA, 121 bp, Artificial Sequence
  Synthesized
  misc_feature (61): n=a or t
aaatgaagtgcttcagataagaggactgaactggagccgtaatgtagtggttcaccttttntacttgatctcttggaaacctaacatatgcttttttgtttttcatgcataattttttccc

SEQ ID NO: 9593 - DNA, 121 bp, Artificial Sequence
  Synthesized
  misc_feature (61): n=a or g
gctcattgggtacggcttgggcagtggggtggcatcttgttgagaccaaggaccctacagngtttccactgcacctcagttggagtcatcccatcctgcatgctagcaagatggtatttat

SEQ ID NO: 9594 - DNA, 121 bp, Artificial Sequence
  Synthesized
  misc_feature (61): n=a or g
gtctaaaacatccttcagactgagttgtttcttcagttggtgaacagcttctgagtgtacntgtacagccgagcagttcagctcagggatgtctggaatgtcacagtgctttcaggcccca

SEQ ID NO: 9595 - DNA, 121 bp, Artificial Sequence
  Synthesized
  misc_feature (61): n=t or g
taatcctgtttaacatactgtatttatttcactacgccatttttactacaagatctgtcanttggattttactgactacactgacacagtcatgaggttttcagagaaatgccatcccctg

SEQ ID NO: 9596 - DNA, 121 bp, Artificial Sequence
  Synthesized
  misc_feature (61): n=c or g
taattgaaacaaccttttgcttatttgtatccatgttattttggtgcttgtaattttaatntattagcatgtatttagggtgttttgcaatatgtggtgatctgtcagattgatcataaat

SEQ ID NO: 9597 - DNA, 121 bp, Artificial Sequence
  Synthesized
  misc_feature (61): n=a or g
ccttggatcactcagaatctgccaagcacaaggacaccaaaattgcactctgggaacttcntcttggtgcaaacactcacagtataaactcatctcctcgtctgacataaatattgtgagc

SEQ ID NO: 9598 - DNA, 121 bp, Artificial Sequence
  Synthesized
  misc_feature (61): n=a or g
ctcgctgttcttttttttttgtgttaacggcaaaaaaaggggttattttttctaatagacnaatggtatgcacactaattaaagcttcacaaaccatcagtgccaagaaaatatagtcatc

SEQ ID NO: 9599 - DNA, 121 bp, Artificial Sequence
  Synthesized
  misc_feature (61): n=a or g
tcaagtgcattttgttctgttctttactagacaaaaccttgtgtaatatcttagacttacntctttcttccttaattttaagggactctctaataaatgatgtgttgtagtgtgattatga

SEQ ID NO: 9600 - DNA, 121 bp, Artificial Sequence
  Synthesized
  misc_feature (61): n=t or c
tccccgagccgaaataagctaagccctcgcctcgtttatagccgagattgaaattccacanataatcaaaagttggattttgtcctgcgggcaccggataacttcatatgcgtgttttgta

SEQ ID NO: 9601 - DNA, 121 bp, Artificial Sequence
  Synthesized
  misc_feature (61): n=t or c
acctaatgaatttacacattatcacctgtctttgtttgaaatctgctaacggaaatttgcnctgtgtactgcatgcaggatgaaagtgtgttagcagcaataatccccatcctgcaggctc

SEQ ID NO: 9602 - DNA, 121 bp, Artificial Sequence
  Synthesized
  misc_feature (61): n=a or g
ttcaaaattggatttttcaggatgctgtgtgttgttggggtagctcacaataacactgtcnccacagtagcatgattgaaatccctgctgcagggagctgtgccacagatgtgtcagggag

SEQ ID NO: 9603 - DNA, 121 bp, Artificial Sequence
  Synthesized
  misc_feature (61): n=a or g
agagactgttgggctggcaacacagctttatagagaattaatatgcgttccttacatggcnaagtttgttatatttgctaaaatgaatgaccctgtggaatccaatttgcgttgcttctgc

SEQ ID NO: 9604 - DNA, 121 bp, Artificial Sequence
  Synthesized
  misc_feature (61): n=t or c
gccctctgatcaccttagtggcctcctctggacaaatatgtcctttgtgttcagtaaaagngaatgctctgagaaattgaactaacatttctttgcccgaagatgtagcactgccatttta

SEQ ID NO: 9605 - DNA, 121 bp, Artificial Sequence
  Synthesized
  misc_feature (61): n=t or c
aacttagagtaattactcacaaagctcttgtggaatgaaatttgactgcttgatatttaanaaacagaggtctgcttatcttataaaaagtaggagattgttgatttcacggcagtactgt

SEQ ID NO: 9606 - DNA, 121 bp, Artificial Sequence
  Synthesized
  misc_feature (61): n=a or g
aatagaaagaatgaaagattggcgagcgtgatgagagaagggcaagtcacaaagcagaagntttaattctttcatcagcatgtgagttactttgacaaagcagtaccagagctgttgagca

SEQ ID NO: 9607 - DNA, 121 bp, Artificial Sequence
  Synthesized
  misc_feature (61): n=t or c
ggtgaatgcttgttttagggtgttacatgctgttagcttcaatttccgtgtgcgtacaaancttattttggaaacaactgttaaagggcatcttcccctgctgctttgtttaacagaagga

SEQ ID NO: 9608 - DNA, 121 bp, Artificial Sequence
  Synthesized
  misc_feature (61): n=t or c
agtttaaggtggtcacagagctgcactcttgagcaaactataaaatctgctctaccactcngtgcacagaagggagaaaataaggtgaggaaatgaatggcttcatttcgtgtctttactg

SEQ ID NO: 9609 - DNA, 121 bp, Artificial Sequence
  Synthesized
  misc_feature (61): n=a or t
gggaagaaggatgagagagaattaagacacaaaagatctatttccagtcttctcattactncatgccagaagtgaaaagtggattttgatccaaagtatttaaaactggatatcgttcatc

SEQ ID NO: 9610 - DNA, 121 bp, Artificial Sequence
  Synthesized
  misc_feature (61): n=a or g
tattgcaaaggagcaaatctgaaataagagttactaaaagtactgtgctcttaaggttaanaaaacatcagtctcaagacaatgacttcatacaaaatgattagtaagacctaatgaaatt

SEQ ID NO: 9611 - DNA, 121 bp, Artificial Sequence
  Synthesized
  misc_feature (61): n=a or g
ttccactgtattgaattttgaggaaagagcttcttaaaaatgcctgtgatcaaaaacattngtatcagtgaagtaacatttgtgggaaggaagaaaaacgtgtcagtgtgtgcaggcaggg

SEQ ID NO: 9612 - DNA, 121 bp, Artificial Sequence
  Synthesized
  misc_feature (61): n=a or g
gggcaggagaaggggcaaggaaatgaagcccggtgcgcagcaggcgttacagaagtctcanaaggagatgtcacagctggatttccagaatgtggctgctgcagtggacttcgtggcgttg

SEQ ID NO: 9613 - DNA, 121 bp, Artificial Sequence
  Synthesized
  misc_feature (61): n=t or c
tgccaggaacaatacaaagataacagttgggatcttggggtcagtagctggttgattatgnctttgataaggagggtattaccctgcattttaaccagacaatgcaatctggatgcctaat

SEQ ID NO: 9614 - DNA, 121 bp, Artificial Sequence
  Synthesized
  misc_feature (61): n=a or g
gcaatgctctctgctttctcctgacccccaaggctgctgcgttgtaacactttcttatacntactaacagcgtgcagaagcaggtgaatctttgagtttgtgcaagtcatttacacgtggt

SEQ ID NO: 9615 - DNA, 121 bp, Artificial Sequence
  Synthesized
  misc_feature (61): n=a or g
tacaggtgctcttgaaaagtggaatgagaaagaaattgggccttggctgcccatcagtggncaaagcaggggggtaggcagcctttaatcttgttggcttgaatatctgtcttgacgacca

SEQ ID NO: 9616 - DNA, 121 bp, Artificial Sequence
  Synthesized
  misc_feature (61): n=c or g
tccttgcccgaggtgtgatggatgctgaagtctcgtctttggctagtaattgggatttcantcattctgcaggcaaatttgctacttgttcctgtggcaaggatgctacaggcagagttag

SEQ ID NO: 9617 - DNA, 121 bp, Artificial Sequence
  Synthesized
  misc_feature (61): n=t or c
aattctacctcttattatttcaagaaatttggattccacagttgtttgtgctcctccttanagtgctccagcatggagccagtccttttagcctttcaccagtgttcttggcattgtaaca

SEQ ID NO: 9618 - DNA, 121 bp, Artificial Sequence
  Synthesized
  misc_feature (61): n=t or c
aaaaactcacttagaatcataaaaggcataagagagacagacaggcatgtctacaacaagnaacactttaaaaatgctagtctacagtggttaggctgcaaagctcactgcatacatatag

SEQ ID NO: 9619 - DNA, 121 bp, Artificial Sequence
  Synthesized
  misc_feature (61): n=a or g
ttgcaacctttatattttcctttggacaacaggtagcaaatcagttattctgtttgtaacnggagaaagtaatgagtaaaaaagtaaaaaaataatgagtaataaagacatggtatgtata

SEQ ID NO: 9620 - DNA, 121 bp, Artificial Sequence
  Synthesized
  misc_feature (61): n=a or g
ctgtcccagtgacctgagtggcacagagcagacaaactgctgcctgcccatcagcattctncagtcagaagtacagctcagtcagttttagcaccatacttcctagcttctcctgcatcag

SEQ ID NO: 9621 - DNA, 121 bp, Artificial Sequence
  Synthesized
  misc_feature (61): n=t or c
catacgctccataggcttacacgcaaaaagcctgagctgtgtttcatgaggcaaaagaaanaaacgggcggcagaccattttccttcctacatgaggcactatctagaggagagggagcag

SEQ ID NO: 9622 - DNA, 121 bp, Artificial Sequence
  Synthesized
  misc_feature (61): n=a or t
acaggacacagaacaaaacaaaaacctacttcaataatgttattatattatcaataagacnacttctggatatttctgtggaagataaattggacatacaaattcttatctcttccttgat

SEQ ID NO: 9623 - DNA, 121 bp, Artificial Sequence
  Synthesized
  misc_feature (61): n=a or g
ggggagttccctgtatggggaatctagaatttgctgtctgatagttttggggatgaggggncaagcattttgttttctgttctggatgttattgtgaggctgtggaatgtttttatggtaa

SEQ ID NO: 9624 - DNA, 121 bp, Artificial Sequence
  Synthesized
  misc_feature (61): n=t or c
ccaggaactccaaatgccatgggtcacagactctagattgatcttattacacagggatcanagagaactacctggctctttgacaaaatgtaagagcaagttttaaagtacactattcatg

SEQ ID NO: 9625 - DNA, 121 bp, Artificial Sequence
  Synthesized
  misc_feature (61): n=a or t
aaaatgggagataactcagacaaggtttttaaaaaacttgatacctttttcacataaatanttttctacataactgtcatcaaaacgtgactggtgtggaagattgcattttagagttgag

SEQ ID NO: 9626 - DNA, 121 bp, Artificial Sequence
  Synthesized
  misc_feature (61): n=t or g
aaaggtttcaggagaaagctaaattttacttctttgttcttgccaattaaattctggtttnatagccattgtagaagtgtagaagcaaactcctgctagtgagttgcagaactacccttag

SEQ ID NO: 9627 - DNA, 121 bp, Artificial Sequence
  Synthesized
  misc_feature (61): n=a or g
tgacatgaccttagagaaatttaaatacacaagttcctaaatacttaagcatttcaagacnaggaagtgaacttacagtataacaaaacaaagctgtataaaacaagtgctgcacccttca

SEQ ID NO: 9628 - DNA, 121 bp, Artificial Sequence
  Synthesized
  misc_feature (61): n=a or g
aatagttgtaaagacgtactacatacagctctggaacagtccgagacatcaaaacctcagntacagacgtagtggaagatacaagaattccatatcttgataaaggacatgatatctgtga

SEQ ID NO: 9629 - DNA, 121 bp, Artificial Sequence
  Synthesized
  misc_feature (61): n=a or g
ctacaggaattctaatcaggctgtcttctaactttttactggcattcaccgatataacacnactgggttttgttcatctatgaaagaagttctacaaaatctgtcacagtatatgaacatg

SEQ ID NO: 9630 - DNA, 121 bp, Artificial Sequence
  Synthesized
  misc_feature (61): n=a or g
tagttgcatcattaggctaaataaataagttgttcactgctttctatttgaccccacagcntatggaaagattgacagtcacaagtcaggcccaggagctttgtaatgagtagtgtcacta

SEQ ID NO: 9631 - DNA, 121 bp, Artificial Sequence
  Synthesized
  misc_feature (61): n=t or g
aacaaactaggcaagagcagctggcaagcacagagttctagacacctcacacacagtcagnagccttgaactacactacacagtgagacaactgtttagtacgttgaacaatattgttatg

SEQ ID NO: 9632 - DNA, 121 bp, Artificial Sequence
  Synthesized
  misc_feature (61): n=c or g
gagtgaattgcctgatccctgtgcctccaatgctttgttgacttgtttttgaattcttgtntagaataaagagattacagtagattcttccccttatctgtgtggcagaaaacagctcaag

SEQ ID NO: 9633 - DNA, 121 bp, Artificial Sequence
  Synthesized
  misc_feature (61): n=t or g
gagagtatttggttatattcacaggcagtacaagtgtgattcttttttgtttactaattgnctgtagagtattaaaggtaattggaaagtcaaaggtcagcgtgtctgttgaatcaaggtc

SEQ ID NO: 9634 - DNA, 121 bp, Artificial Sequence
  Synthesized
  misc_feature (61): n=a or g
gcaggtggagaggggaccagtagaataaatagccagattgtatttgaaagcagaagcactngaaactgtgaatttttattttagaagtggactttgggctttctttgtgttaatctatgat

SEQ ID NO: 9635 - DNA, 121 bp, Artificial Sequence
  Synthesized
  misc_feature (61): n=t or g
ttctgccacctctgtgtcaattgcaatactttcttaggctgtgatgtgcaacaaatgcagncaagtttggcatcataattgtttgtaagcccagataaaataaaactaagtttggaaatgc

SEQ ID NO: 9636 - DNA, 121 bp, Artificial Sequence
  Synthesized
  misc_feature (61): n=a or g
atatttatttttgtttacagggaagaggacttctcttctttatgctaaaattgccatttgntctttaccttcctaacgctaattgtccagaacgtgatatggtcggagttggtggagcctt

SEQ ID NO: 9637 - DNA, 121 bp, Artificial Sequence
  Synthesized
  misc_feature (61): n=a or g
cttgttactactgggtgttgatgccacaagtttctgagaagatacagcagtttgtggcatntctgtcttctgatctcagggtcacatgcaaggaaataagcaagtgaggggaaaacctaga

SEQ ID NO: 9638 - DNA, 121 bp, Artificial Sequence
  Synthesized
  misc_feature (61): n=t or c
gggaagaatgtgaggctttatgattagccttcctcaccctgctgtaggtgttaaatttatngtacgtacactcactgcagcatgtgagtgtgctgtcaacccacagaatagctcctgcatg

SEQ ID NO: 9639 - DNA, 121 bp, Artificial Sequence
  Synthesized
  misc_feature (61): n=a or t
atcatcaaggttcatcaatgaccatgcagctacaagggtcaggcaaggacgagtaatgacntctaatcaaagaacagtaactgcatctgagccttgcctctctgcctgtgtgtagtatcta

SEQ ID NO: 9640 - DNA, 121 bp, Artificial Sequence
  Synthesized
  misc_feature (61): n=a or c
catcagttctcactgtatgcacaacatacacatttcaagaactttaacatactaagcccangggaacagcaagttgttaagaagtcaggatttgaagttattgaggaatcccacaacaatt

SEQ ID NO: 9641 - DNA, 121 bp, Artificial Sequence
  Synthesized
  misc_feature (61): n=t or c
ctcacttttgtccagattttcatgcacactgctatgatttcctccacatggatatacccgnctgaccttttctaactgttttgcttgatggagttgaggtaaatcgtggtattaattagca

SEQ ID NO: 9642 - DNA, 121 bp, Artificial Sequence
  Synthesized
  misc_feature (61): n=a or g
ttatgtgttttttttgccgccttgctctcataatcttcttcacccttggtatcagccagcnttctgaatggagtttggtctgtgcatttcaatgcctatgctttcctgcagggaatgtatc

SEQ ID NO: 9643 - DNA, 121 bp, Artificial Sequence
  Synthesized
  misc_feature (61): n=a or t
cggtcttgggagagaacagctgattcctttaaagccaactggatgatgcaaaacagaaccnatgctgatctgcaaccattgatactagctttatgctgcctgataattctgtctaccctga

SEQ ID NO: 9644 - DNA, 121 bp, Artificial Sequence
  Synthesized
  misc_feature (61): n=a or g
taagcagacctagaagctgtgtttattttcagatcgcattctgaagtgaaaagcaagtgcncatttctgcaggaaagccaagaaagtttggaggatgaagtgtttcaagtggacattttca

SEQ ID NO: 9645 - DNA, 121 bp, Artificial Sequence
  Synthesized
  misc_feature (61): n=t or c
atcaaagccatcagcacttccttatccatagaaaattaacatatttgaggtttcaaatcgnatctctggggacttcccatccgacaaaaacgttaattcttatgacttttccttcctctta

SEQ ID NO: 9646 - DNA, 121 bp, Artificial Sequence
  Synthesized
  misc_feature (61): n=a or g
tactgttttgcagagaagatcagacaatacctaaagagactgttggaaaagagaattcaangaggattaggaggtgaagatgatttcagtacacttggactcattcataaactagatggtg

SEQ ID NO: 9647 - DNA, 121 bp, Artificial Sequence
  Synthesized
  misc_feature (61): n=a or t
tgatatggtaatgctgagagttctgtaaataaaatatgattgaatgctatgaagccacttntttggtatgtatatgtgagcctctgccagtatagctgtgccaatgtagactttttaagaa

SEQ ID NO: 9648 - DNA, 121 bp, Artificial Sequence
  Synthesized
  misc_feature (61): n=t or c
gtggccacccagctctctccctttgctcctgcaggccatgaaatcacaagaccaacaggcngtgtctgtcttcctcagagattactaaggcgagtcattagcgcatagccagacatgggtg

SEQ ID NO: 9649 - DNA, 121 bp, Artificial Sequence
  Synthesized
  misc_feature (61): n=a or c
ggtttagacatcattacaaaagtgaggaggtcccaggctgttacatcaaaactcacagtcnctggtatggaaggcaacaaggggaaaattaagactacattgcagcaatcaatctattttt

SEQ ID NO: 9650 - DNA, 121 bp, Artificial Sequence
  Synthesized
  misc_feature (61): n=t or c
tattggagtagtgtagttgagagctccctgtgattctgcatgtggctgaccagttcttcangtctgtcttattcctgcttctccccctgctgtactgtctgccctgttctgcctgtacttc

SEQ ID NO: 9651 - DNA, 121 bp, Artificial Sequence
  Synthesized
  misc_feature (61): n=a or t
atgctgcaggcttgtccgtcctggggaccccgtggcatttcagggctgtgtaactccagcntttttttttgctcctgtttccaggctgtgagctgactgccagcaccaagtcctacacgtt

SEQ ID NO: 9652 - DNA, 121 bp, Artificial Sequence
  Synthesized
  misc_feature (61): n=t or c
aaatggtcagaaaaaggctcataggatgaaattaaacaggagaaaatgtgtggtatttgcntgctctgatggagctttgtggaggaagacctggaaaaatggtgcagctaactgtatgtat

SEQ ID NO: 9653 - DNA, 121 bp, Artificial Sequence
  Synthesized
  misc_feature (61): n=t or c
gatgggctggttgatggttttttggaaggcctcctgctgcagctgcatgaggatgcggttngcttgctgcctctcggcctcccgctcctccgctgtctgcctcctaggagaaaggcagcca

SEQ ID NO: 9654 - DNA, 121 bp, Artificial Sequence
  Synthesized
  misc_feature (61): n=a or g
cccattgctttgggcagaatgctcactgttccagcccatgcttctcatggctgcatcgccngccagtcccacgatgccagagctagtctggtgtgacttgcaaggaaggaaattgtgaggg

SEQ ID NO: 9655 - DNA, 121 bp, Artificial Sequence
  Synthesized
  misc_feature (61): n=t or c
cactgtgagcctgccctcacttcccttcccagagaaacaccttttatctcactgcagttgntgggagcagtgttgtaactaccgaaagctcagtcctaactattctcacagaccctgaaag

SEQ ID NO: 9656 - DNA, 121 bp, Artificial Sequence
  Synthesized
  misc_feature (61): n=t or c
ttcatgctctgttgatcttatatcatctgttttcttaatagtgtgcatgcttaatgtggangtgggtcctcgtctgtttcttttccagttcctgccctgctcccaggaaagccacaggaac

SEQ ID NO: 9657 - DNA, 121 bp, Artificial Sequence
  Synthesized
  misc_feature (61): n=a or g
tgagagatgggctgctgaactgggctgtgagggtggcactccttcagaaagcatcaaagcngcgtggtggtgctcaacagctgtgggacatttgaaaggagatgtcttatggctttgtatg

SEQ ID NO: 9658 - DNA, 121 bp, Artificial Sequence
  Synthesized
  misc_feature (61): n=t or c
cgaaaccaaaacttccatcatttgctgattttgcatttcttagggaaattgacttccattncgcatctctcaagtggaatgaattttcctgaaaaaatgcattcatcgagagatcccaata

SEQ ID NO: 9659 - DNA, 121 bp, Artificial Sequence
  Synthesized
  misc_feature (61): n=t or c
aaaagtctgagatgataaagcaaaagtgtttgtcacaacagaagtacttttcattacaggnataggattttcctgaaccaagatatcaaagctattaatactctcacagaggaataatttt

SEQ ID NO: 9660 - DNA, 121 bp, Artificial Sequence
  Synthesized
  misc_feature (61): n=t or g
atgtccagagatgctcctcctttgtctgcagcagctgtattctgctggtcttctgataganttgggatggggagtagcaaaagaggaagagaaaggaaaaatcttacactccaagggttgc

SEQ ID NO: 9661 - DNA, 121 bp, Artificial Sequence
  Synthesized
  misc_feature (61): n=a or g
gcttataaagaggataaattcctctgtgccataacaaaatagaggttgcacttagaatagnatgtgagtttaagcacttattggttgaatgaggcatggtttgggaagaaatctatcttgt

SEQ ID NO: 9662 - DNA, 121 bp, Artificial Sequence
  Synthesized
  misc_feature (61): n=a or c
tccatgtgaggaactgagaggttccttcattatctgggagctgcatgaggatgcagctggncaaacccagcagggaaggtgctgcatgctgggggtcagcagtgccctgctggtgggcagt

SEQ ID NO: 9663 - DNA, 121 bp, Artificial Sequence
  Synthesized
  misc_feature (61): n=t or c
gataaatacatatgtaaatatttcttgacaacagacaaataaaggaatggctaacttcttncacacaagttcttggaaattatgagcatggaaaataaggaaaaaaaaacgtttcgtctgc

SEQ ID NO: 9664 - DNA, 121 bp, Artificial Sequence
  Synthesized
  misc_feature (61): n=a or g
aatcgtgcaagtattggtgagcagatgctgtttgcagtgtaaatagcttagtggcagtccntcctggcacctgtggggaatcttgtgatgcatgaagggaaggaaatatgaaaagtggctc

SEQ ID NO: 9665 - DNA, 121 bp, Artificial Sequence
  Synthesized
  misc_feature (61): n=t or c
atcttctatggctcgataccgcacctacaaatttgaacagaacaaggcaatgtattacacngtggggagttatggccttgctgactgttttgtcccaaaagtcactcaaagcatcccatta

SEQ ID NO: 9666 - DNA, 121 bp, Artificial Sequence
  Synthesized
  misc_feature (61): n=a or g
ttgagggacacttctagaaaattcaagtaagcactcatcatttacctgataagtgaggatngagaatttggtgcattatttatccattaatgatagaaagagttaattaatgagagagtcc

SEQ ID NO: 9667 - DNA, 121 bp, Artificial Sequence
  Synthesized
  misc_feature (61): n=a or g
tgtggcacaggcctgtggctaccatcactggggaagctgttctggtattaacagcagtggnagatttttaccagttgaggtaagttctagaaagcagataagattcagggataaaaaagca

SEQ ID NO: 9668 - DNA, 121 bp, Artificial Sequence
  Synthesized
  misc_feature (61): n=a or c
tttttcaagtgaagctgctttttgagctcatgctataacagcagttgtgtggcatgccccnaaaataccaggattttcttagttagattgttttacatgtttcttcttttttttttttggc

SEQ ID NO: 9669 - DNA, 121 bp, Artificial Sequence
  Synthesized
  misc_feature (61): n=t or c
ggttcttactgctgcacactgtgtcgagtatgtgcatgtcctttgcttagggcagataaangtatgaaaaacaaggttttacatgaaaatatgcgcatatattttaaaaaaacagctcttg

SEQ ID NO: 9670 - DNA, 121 bp, Artificial Sequence
  Synthesized
  misc_feature (61): n=a or t
tggaaggcagatttgaattgctcactctcctctcgatactttacctacaaaaaaattaacntggtattagtagcatgttggtacagactaaacacatcactcccaggaggagaagggagac

SEQ ID NO: 9671 - DNA, 121 bp, Artificial Sequence
  Synthesized
  misc_feature (61): n=t or c
ttaccggcttcatcgtacacagatgaagacatttaacattgtctttgactttatcagcaantggaacgtaagtaggatggctaaaagattgccctaggaagccaaagctccactattctta

SEQ ID NO: 9672 - DNA, 121 bp, Artificial Sequence
  Synthesized
  misc_feature (61): n=a or g
catgaaaataaaatggcaacaggagcatactctgcttgggtatccatcttactgcagcaanggctggttccactcccagtgtgtgagcttagccacagagagtaaacttactcacctgagg

SEQ ID NO: 9673 - DNA, 121 bp, Artificial Sequence
  Synthesized
  misc_feature (61): n=t or c
aaagctcttttcaatgcatttactgtgattcattccgtcatgaaatatcaggccttgctcnggttaagctcagctaaccatgaactcagacatacagatgctatcatattttacggtgatc

SEQ ID NO: 9674 - DNA, 121 bp, Artificial Sequence
  Synthesized
  misc_feature (61): n=a or g
cctgcaagcagggtgcaggctctggcaggctaggacaacttataggggttctcttactggnttgtaggagggataaaaaacattggtgagagttttcactgggctattgtgtcatcagctc

SEQ ID NO: 9675 - DNA, 121 bp, Artificial Sequence
  Synthesized
  misc_feature (61): n=t or c
tattaagctctggctgaatattatattgaatcttatggtttactacatgctccagtacttntctgcacagtttcaggttttttttcccttgtcatagtaacttccttttctcatcaagtat

SEQ ID NO: 9676 - DNA, 121 bp, Artificial Sequence
  Synthesized
  misc_feature (61): n=t or g
gatgcaggtctgatctaacaaaaccattcagtcaatccatgatactccatatgcctgtgangagattaatgcgttatccagagaccacactagagcagtgccacaccccaaatgtcctaga

SEQ ID NO: 9677 - DNA, 121 bp, Artificial Sequence
  Synthesized
  misc_feature (61): n=c or g
gaaggaatgctaggaaggaggtacacttaatagagatccttttttctggtggtgaatgatntgctcacagatgtacagtaacactttttttcccttattatatattctaatttcttatttt

SEQ ID NO: 9678 - DNA, 121 bp, Artificial Sequence
  Synthesized
  misc_feature (61): n=t or c
tccatgtgacatttattctgaagactgtggtccagaaactaatatcaggacacagagaggntttggaactacatctgtgcaaaaacctgcaccaaaaaaactgctcctctttttgtaagaa

SEQ ID NO: 9679 - DNA, 121 bp, Artificial Sequence
  Synthesized
  misc_feature (61): n=a or c
tcagaggtgctgatggtagaagggcagaaaaataaatgtttggttccagcatggtcatgtntggccccagaaataccatttccaccatttgtttttaccttgattgaatggagtgtataaa

SEQ ID NO: 9680 - DNA, 121 bp, Artificial Sequence
  Synthesized
  misc_feature (61): n=a or g
ggacttcgataacattgagctggttgattctctccatgccttaggaccgagctctccaganttgaagaatcgtgaccccaaagcgaatgttcgaagaaaatctaccgattcagtgccagtt

SEQ ID NO: 9681 - DNA, 121 bp, Artificial Sequence
  Synthesized
  misc_feature (61): n=t or c
tgtacagcttgcactcattttgtcctgtagtatgagtctaagcgaacaagcagttcaatcngatcaatatattattttcaaatgacttatcaggcgacacagacattaaaacagaatgtga

SEQ ID NO: 9682 - DNA, 121 bp, Artificial Sequence
  Synthesized
  misc_feature (61): n=a or c
atggtttggtaaaatttatctgcttacaatagtactacaaaagggcatctactagaatccnttcgatacaccttcatgcttcaataaataggcagcctttctgaaggagattggttgatgc

SEQ ID NO: 9683 - DNA, 121 bp, Artificial Sequence
  Synthesized
  misc_feature (61): n=a or c
cattaacctactccaacagaaaatacgtgcagccatttagagacggagttgaacactgaanctgcttccacctcctgactcacggatccacagcaaaagctacagccaggagggagctcgt

SEQ ID NO: 9684 - DNA, 121 bp, Artificial Sequence
  Synthesized
  misc_feature (61): n=a or t
tcacggtttgaccatggtgaggccagcagcagggttatgccttcaagaaataaaaagttcngaagttcagaatttctttcattgaaataacgttcgtgcttggtctgatttttaccttagt

SEQ ID NO: 9685 - DNA, 121 bp, Artificial Sequence
  Synthesized
  misc_feature (61): n=a or t
gacaaatgggctcttaggagtttgtcagtgtattgaggtgcgtaggtgagaacgtaaatantttttctgaattaatgaagctgaagtgatttggtctttgtacgtaagatactccacatcc

SEQ ID NO: 9686 - DNA, 121 bp, Artificial Sequence
  Synthesized
  misc_feature (61): n=a or g
gactttaacaggaatttttttctgggaaaattctgtgggtttccctgcccagatataaaanctgcacagatttgcactgtcttgagaagaagggagggaacgaaggatgaggtttaattag

SEQ ID NO: 9687 - DNA, 121 bp, Artificial Sequence
  Synthesized
  misc_feature (61): n=a or g
ctttaaaacacctctaagaccaaatccagaggtgctgaggaactctactcttaggagactnaagtagatgttgtgtctttggagcttcttgaaacagtgctttacaaaatcagagctcttt

SEQ ID NO: 9688 - DNA, 121 bp, Artificial Sequence
  Synthesized
  misc_feature (61): n=c or g
ttccaacccccacataattcatagttcatatttattaaccgcagctggaagcaggcatcanagcttaggggtagatcttctggtttgctaggtgaaaaccacgtatgttcaaatgaggcat

SEQ ID NO: 9689 - DNA, 121 bp, Artificial Sequence
  Synthesized
  misc_feature (61): n=a or g
gcagcacaaagagccaggccagtcagcatagctcagcactgctctctgcaaagatgtcacngcagcgccatgcctaaccaaagtgtggacagcaaccaatgagccttcaactgtgggcctc

SEQ ID NO: 9690 - DNA, 121 bp, Artificial Sequence
  Synthesized
  misc_feature (61): n=t or c
cccactaaaggtgccagggcaccagcagcacagccaggcactgctggaaattgaggcttanatcctgatgttctggtgagcacagcattgcacgaacctggatcaccaggtgatggtgatg

SEQ ID NO: 9691 - DNA, 121 bp, Artificial Sequence
  Synthesized
  misc_feature (61): n=a or t
gtcttcaagctctaaaaataaacactgcaatgtgtcactgccattcatttgcatgtaggancaacagagtctaaaggctgtctatgtttgggggtttgctttaagagatttcagtgatttt

SEQ ID NO: 9692 - DNA, 121 bp, Artificial Sequence
  Synthesized
  misc_feature (61): n=a or t
gcagcatcagtctgtatggcttcttccgccttggatccccgggagatgaggacatagcccnctttgtgtctattctgtggctcagggcagcctggtctggtggttggagaccctgcacata

SEQ ID NO: 9693 - DNA, 121 bp, Artificial Sequence
  Synthesized
  misc_feature (61): n=t or c
ccagttcctgctcactggggtgccagaggggacagcccatcccagcactgcccattcctgntgcacccaaggacacagggccaaccatcatgcttttgctcagttagatcagttatcatcc

SEQ ID NO: 9694 - DNA, 121 bp, Artificial Sequence
  Synthesized
  misc_feature (61): n=t or c
cttttcctgcttacaggtgggctgctttacttccatgctattcacttctcagtggaggatngttatgttcaaacatactcaggttagagctaccaaaccaggagctgtgaagcttagtact

SEQ ID NO: 9695 - DNA, 121 bp, Artificial Sequence
  Synthesized
  misc_feature (61): n=a or g
cttcatttatcaattgatttaagcattttcactcagataaagtgctgccccatttgctttncgagtgaccctacagaacccaataagggccacagctttatggaagagagctgatgcaatg

SEQ ID NO: 9696 - DNA, 121 bp, Artificial Sequence
  Synthesized
  misc_feature (61): n=a or g
aaaagagagctctgcctcaattcatagtccaactatgcgttcagtgtatatttaagaatgntagtgctgtcttccagcactgctgcccatagtacttggaaatatatcctttcagtatgtg

SEQ ID NO: 9697 - DNA, 121 bp, Artificial Sequence
  Synthesized
  misc_feature (61): n=a or g
acatcaccttctgctcttcatgttaatttagcataacaggttttgaaatcttatggcaacntgaggcatttcaggtgaccttctgcttattagattgggtggagccgcagcctccgtagga

SEQ ID NO: 9698 - DNA, 121 bp, Artificial Sequence
  Synthesized
  misc_feature (61): n=a or c
gatgttttcatacatcagaaataaaggtcttctctaggttctgtttaaagtacaaaaggtntctcttctcaaaatcacagagttgcagagtttggaagagatgctgagagataatcagtcc

SEQ ID NO: 9699 - DNA, 121 bp, Artificial Sequence
  Synthesized
  misc_feature (61): n=t or c
agttataaagtagactctgtgcagtcttctgtagatgctttctctgaagtaaccagagagngtttcccgaaagcgaccactgcaccacagcctctgtgacttttctatgcctctgggagag

SEQ ID NO: 9700 - DNA, 121 bp, Artificial Sequence
  Synthesized
  misc_feature (61): n=t or g
ttgaacgaagcagatgattgaagggaataggagtgattctgattttctttctatacaaganaaacaaaattgttattgtgtatgtatataaaatcactgtgtttcagaagcagggacatac

SEQ ID NO: 9701 - DNA, 121 bp, Artificial Sequence
  Synthesized
  misc_feature (61): n=a or g
tttggtatgtgttgctgtaatttctgtaatcagtaaagacagcatgtagcttgtgttctcnggaccaaacagcacagtatagatggctgtggggctgctgagatgaaagaaatttggcagt

SEQ ID NO: 9702 - DNA, 121 bp, Artificial Sequence
  Synthesized
  misc_feature (61): n=a or g
gccttagtgtctttgttgcttgattgtttgaagaaggaaaaattacatttcaagactagcngcgtgcacaaagcccagaatacacgtggtgggctttggttaggtgacttaaagctgaaca

SEQ ID NO: 9703 - DNA, 121 bp, Artificial Sequence
  Synthesized
  misc_feature (61): n=c or g
cgtctggggagttacctagcagtcacaaattctagatagactaaaaagagaataaccacanagcaaagcaccaggaagaaatgagaagaaatgagaaatgagcagttgcctgccttttttt

SEQ ID NO: 9704 - DNA, 121 bp, Artificial Sequence
  Synthesized
  misc_feature (61): n=t or c
tactttagtatctcatattctgagacaaaaaaaaaaaatcaagatccagattttgagagantcaagcttttaacatagcaatatatgaaaatgaattgccactctgaggcaaaatcaggtc

SEQ ID NO: 9705 - DNA, 121 bp, Artificial Sequence
  Synthesized
  misc_feature (61): n=c or g
tgcaacatcagattgatttttagaaagatacataagccaagatctgttctcacccaatccnacttctacagctctcttggagtcacaacatccttagagttggaagggacctctaaaggcc

SEQ ID NO: 9706 - DNA, 121 bp, Artificial Sequence
  Synthesized
  misc_feature (61): n=t or c
tatatatatatatatacatatatatatttatgtgtgtgcaaatttcttggttcaattagcnctgattttaatgccccgtattaaagtgggaaggcaaaggcaatctgggttttagttcaag

SEQ ID NO: 9707 - DNA, 121 bp, Artificial Sequence
  Synthesized
  misc_feature (61): n=t or c
ttaccatactgtcttgaagaagatggtcctatcagcactgtggaacacatgattttgctangctgtctagtatatggacctgtttacaaagtgctaagcgtaggaattcactcatcctgtg

SEQ ID NO: 9708 - DNA, 121 bp, Artificial Sequence
  Synthesized
  misc_feature (61): n=a or g
tagaaacgaaggttatatgtaattctatggaggtctgtttgagagaggatgcatgcttgcngtatgaaggcacgtcaaaataatgggatgtcgtcacagtttatttcttcatgtgcctgtg

SEQ ID NO: 9709 - DNA, 121 bp, Artificial Sequence
  Synthesized
  misc_feature (61): n=t or c
gaaggacgcactgcttacaaggtatagagcagggaacactaagctgaccagtcaagcaagntggccacctgagaactgaaatgcccctgtcaaacatgaaaatcacaggtatgctacagca

SEQ ID NO: 9710 - DNA, 121 bp, Artificial Sequence
  Synthesized
  misc_feature (61): n=a or t
aaaagctcattgcaattggatatgaaaaggaagcatacaaaggaacgatggaagatgtgcntccttctgctattgtccacactgaattggggatggatgaaaatatctttgcttctcccac

SEQ ID NO: 9711 - DNA, 121 bp, Artificial Sequence
  Synthesized
  misc_feature (61): n=t or c
actatttcgtttatacaacaagaaagaattgcaaataaatagaaaatgggctgttcgtggnggaccaaaataaaggctttttcctcagctcagatcccagataacaaatctcatctgatgg

SEQ ID NO: 9712 - DNA, 121 bp, Artificial Sequence
  Synthesized
  misc_feature (61): n=t or g
cttccttcagcttccagctcctggagtcagttgaccaaagggagagattagcttacatgtnttctccctccctcccttagaaaaaaacacctttgtgtgaatggaaaggccattttatcac

SEQ ID NO: 9713 - DNA, 121 bp, Artificial Sequence
  Synthesized
  misc_feature (61): n=t or c
aagattagtcttgctttacgcacgtatgtaaggataagagtctattacagtattataatantcaagtctttagtacagtatttcttgctagctttccttagaaatagtgatcatatgaata

SEQ ID NO: 9714 - DNA, 121 bp, Artificial Sequence
  Synthesized
  misc_feature (61): n=t or g
caatagctggaagcaccaagctgcttggagtagcatcttgtacccattgacacgatttgcntacttggatcccatttcttaaaaacaagaaacaagatgaccttgctttaacataagaatg

SEQ ID NO: 9715 - DNA, 121 bp, Artificial Sequence
  Synthesized
  misc_feature (61): n=t or c
ttaagtcatgcaaggcaaagagaaggaaatcttaatgatttgagtttggttgtgtattatnagacttgtttagaactgaaaattccttgcacttctggaagctgaaagcctgtcatttgct

SEQ ID NO: 9716 - DNA, 121 bp, Artificial Sequence
  Synthesized
  misc_feature (61): n=t or c
aacaactaaatgtaaggtgtacactttgcattttattccagattcccagggccatctctanttaagacaaggcttgacttgcaggaatcatcactgtctcagagtcattttctatgctttc

SEQ ID NO: 9717 - DNA, 121 bp, Artificial Sequence
  Synthesized
  misc_feature (61): n=t or c
gagaacagaaacaaagagaggaagacatgggacaagctcacagtgctgggttgagcaacgnaaggtttccttaacccgtgcccctgaaaccagatggcaagccaaagttttctctgacaag

SEQ ID NO: 9718 - DNA, 121 bp, Artificial Sequence
  Synthesized
  misc_feature (61): n=a or g
gctgtgcagcagagcactgtgctgctgagtgtccttggcagccctgttacaaacagctganagtacacacagaactgtggagttttatcagaggacatgggtttatcagaggaatccgctc

SEQ ID NO: 9719 - DNA, 121 bp, Artificial Sequence
  Synthesized
  misc_feature (61): n=a or t
tacggtggcttagggaggaaaatgtggaagcagtaaggaatacagatttgtacacaagtangaatgctactgagtatgcactcatcttacctgtctttaatcaatatttcttctgagttgg

SEQ ID NO: 9720 - DNA, 121 bp, Artificial Sequence
  Synthesized
  misc_feature (61): n=a or g
gcaacttggtggagtcataatccaggggcgagaaggattttctggggcttgtttttgaatntatgacgtttttaagtattcagagttacttgaagagctctcagaacaaaaaaaaaataga

SEQ ID NO: 9721 - DNA, 121 bp, Artificial Sequence
  Synthesized
  misc_feature (61): n=a or c
taggtggaactctctgtgtgaatgagctgtcttctctgagatcagtagtttgtatgcctcncatgactgttctcctggagaaaatctctatagacctttgctgtggtttgtctggagataa

SEQ ID NO: 9722 - DNA, 121 bp, Artificial Sequence
  Synthesized
  misc_feature (61): n=t or c
aggagaaggtaaccaggaggatgatatttttcctattaaatatgctggagggtttttatcntggaacagaataaaatcctaaatatccttgcttattattttgagtgcttgttttttaccc

SEQ ID NO: 9723 - DNA, 121 bp, Artificial Sequence
  Synthesized
  misc_feature (61): n=a or g
tctcccctggttctccacaaagaacacacattcatcacaaagctgggtatccaaaacaagnaacgctgctgttgactgtgtctgaaaatatgcatcagtgctcatcccaggatcctcttca

SEQ ID NO: 9724 - DNA, 121 bp, Artificial Sequence
  Synthesized
  misc_feature (61): n=t or c
aaggctatgtctggttttgatgtttcgtcactaagctaccatggtccattaaaatcgttanaaaaggaatttatgctctaaaaacaactaactgcagtgctaacaactaagaggaaacagc

SEQ ID NO: 9725 - DNA, 121 bp, Artificial Sequence
  Synthesized
  misc_feature (61): n=t or c
caccacattattaaacaaatctgtttgtgttctcttaaacacaaaggctcttaaagccccnattttccagcaatctagtttcctgctgttgtaggaagtctggttgtaaccagaacacagc

SEQ ID NO: 9726 - DNA, 121 bp, Artificial Sequence
  Synthesized
  misc_feature (61): n=a or c
tttatttaagctgtttcagaagtcagactgcattcatgtaggggaaatcaacaccacacantcaaagccaaatatttttactgaacataatgttgtatgaagcatgagttgttttccatag

SEQ ID NO: 9727 - DNA, 121 bp, Artificial Sequence
  Synthesized
  misc_feature (61): n=a or g
aacaatgcatttgttacctgataatcagcaagagtcaaagagtcccagtgtagcattctcngcagatccagtagtgtgtttactgacagggcttgtttggaaacctcttaaaagtctgcta

SEQ ID NO: 9728 - DNA, 121 bp, Artificial Sequence
  Synthesized
  misc_feature (61): n=t or c
cataataagacacaaataaatacttcccaaagtcttatatggaaagaagaaaacactgcangcacatgtactcctgaacacacagctgaacaactctctaataacctaaacatattccctc

SEQ ID NO: 9729 - DNA, 121 bp, Artificial Sequence
  Synthesized
  misc_feature (61): n=t or g
ctcactatacatagaattaattaatcaaagttttctatcttcaaattagagatcaagctangtgtgatacgttcaatgtacaggttttgtacagagatcagtgagagaattaagggctgga

SEQ ID NO: 9730 - DNA, 121 bp, Artificial Sequence
  Synthesized
  misc_feature (61): n=a or g
caccgcactgccagtgagggggctgggagcacacaagcagagaacagtaccagtacagctnactcaaacaggccaaaggcatgttccataacacatgatgccatgctggataataaagctt

SEQ ID NO: 9731 - DNA, 121 bp, Artificial Sequence
  Synthesized
  misc_feature (61): n=t or c
atgtaaagcaaaaatgaactgaatagggaggctttattactgtatttcttttaaacctatntctctttttaggaagctttgcctcgaaattaccattactgtatatcagcttacaagtgat

SEQ ID NO: 9732 - DNA, 121 bp, Artificial Sequence
  Synthesized
  misc_feature (61): n=t or g
ttgcttggttaaaaagaaaagtcaaaaacagagcaaggagaaaaaaataacggtttagtanagagacagaaccacacttcatttaacaccatggagtcctgtgcatacatcagcagtggga

SEQ ID NO: 9733 - DNA, 121 bp, Artificial Sequence
  Synthesized
  misc_feature (61): n=t or c
tgttttcctccgtaatgtagctggagcttggttttttgtttagcattcagagggctgcctngcaggcagtgtttcctatcacggacccttggtgcactcctttccagctcactgctcagag

SEQ ID NO: 9734 - DNA, 121 bp, Artificial Sequence
  Synthesized
  misc_feature (61): n=t or c
cagccacagcttcagctgtgatctctttggttttgcctcatgacagagaatgaacttttcntctgccatccactctcaagcccatggccatagcctggggatattctcaaccaagcagctg

SEQ ID NO: 9735 - DNA, 121 bp, Artificial Sequence
  Synthesized
  misc_feature (61): n=t or c
gaactgaattgttcgtgctctatttctctctgcaagaatagtgttctgtgcactgggtgantgcagcagctgatcaacctgctttgtgcagtaaaggaagacaggcaggaggacagggatg

SEQ ID NO: 9736 - DNA, 121 bp, Artificial Sequence
  Synthesized
  misc_feature (61): n=t or c
cttccttgttgcctcggtgtattttttttttcctgcttctgcatatgtagaggtgcacttnccttatgaattgtacttgcgcataacatgaaaaatcctgggcaggcagtgcgtgttcttc

SEQ ID NO: 9737 - DNA, 121 bp, Artificial Sequence
  Synthesized
  misc_feature (61): n=a or g
ctttaaatgagagaaaaagagaaagctggtttccaggagaggtaagcactgctattaacantgttagtgtttggagttctgtggcgttgtttatactatttttctgtttacatcagtagtt

SEQ ID NO: 9738 - DNA, 121 bp, Artificial Sequence
  Synthesized
  misc_feature (61): n=t or c
gttccaacatctattctgttgtcttttggtcagaaaaaaaactgatagatgcttcttcatncatggtcatgtagggggatcctagacaccatcctttatcattgttgtgcaagataatttg

SEQ ID NO: 9739 - DNA, 121 bp, Artificial Sequence
  Synthesized
  misc_feature (61): n=t or c
catgacacaaagtggcaaagaataagcctgtgagccaagagagttgtgtatttcccatgancactggcacccagtttctcatgttcctcagtacccctatttgtagaacagagataaaaat

SEQ ID NO: 9740 - DNA, 121 bp, Artificial Sequence
  Synthesized
  misc_feature (61): n=c or g
catatttcactgtaggtaattcaatccaattaatgctgatgaagaaacccttaatgccaanccatattcagcagacgtgcactaatacactttgaactgttaattctttttagatgaagtc

SEQ ID NO: 9741 - DNA, 121 bp, Artificial Sequence
  Synthesized
  misc_feature (61): n=a or g
cacaataggggtaacttacttcataatttcagtctagattcttctagtgctagcttttctnctcagatcatgggatcatagaataattaacactggaaaagacctctgagaagaagtttct

SEQ ID NO: 9742 - DNA, 121 bp, Artificial Sequence
  Synthesized
  misc_feature (61): n=t or g
tcaactgaatcatggcaagtgttggaattgtagaaaagacttggaaaaatggtgtaactanttttttgttacttattgaatatgaattatttactatttagcaaaaaaaagcacattgcag

SEQ ID NO: 9743 - DNA, 121 bp, Artificial Sequence
  Synthesized
  misc_feature (61): n=t or c
tccttttgaaactggaaataaaattgtgtataactacgtccactcctggtcttcattctanatggactttcagtctcgccttgctatgcaggagtgagttaaaacactcaaaaaatgactt

SEQ ID NO: 9744 - DNA, 121 bp, Artificial Sequence
  Synthesized
  misc_feature (61): n=a or t
gggattagaaagcattcatgatggggaaaacaatgtcctctctcctagggttcttgcaaantgatgcccacttaaatttctttagtacaaataaactttaaagcctcctttttcccccttt

SEQ ID NO: 9745 - DNA, 121 bp, Artificial Sequence
  Synthesized
  misc_feature (61): n=a or t
tgagctgccaccagagcaggatgggagctcacaagcactttcagagttccaacatcaaaancccaaattcaccagagcactccccacatgagctgtgtgataagcctgaaaaacaggctcg

SEQ ID NO: 9746 - DNA, 121 bp, Artificial Sequence
  Synthesized
  misc_feature (61): n=t or c
actaatctgtctttctacaattcacagtgggttttcaccgccccatgggtgaagacaaagnatgtcttccttctaagagtagctaattagagaccactggacatggcaaagccaagctcag

SEQ ID NO: 9747 - DNA, 121 bp, Artificial Sequence
  Synthesized
  misc_feature (61): n=a or g
taaataagacttttttggaatacttgggtgtgtgctagaacattcatgtttacattgctantgcaatgtactgttattacttcttccagttataaaaattggaattttgttgaataattct

SEQ ID NO: 9748 - DNA, 121 bp, Artificial Sequence
  Synthesized
  misc_feature (61): n=t or c
aaatatcctccggaagcaacctctgatctctctaccaagtcctggctccaagtgtttgccnatgtaggaaagaagcaggtatctagtcacttagccacaaccttctgagccatccaaaatc

SEQ ID NO: 9749 - DNA, 121 bp, Artificial Sequence
  Synthesized
  misc_feature (61): n=t or c
acccagtgctcaaagcctgagaataactcgcactaaacgaaagatataaatttaatgattnctgatggacttagacacaactgattgtggagtaaatcagttgactccagtaaagtcttag

SEQ ID NO: 9750 - DNA, 121 bp, Artificial Sequence
  Synthesized
  misc_feature (61): n=t or g
atttatttttgttgaaaaaaatgggatctataaattttgtattatctcagcaataatgttntggtgaggtggtgggtcatgtataaagcagagctccctgctgctctgcaggttggctgtg

SEQ ID NO: 9751 - DNA, 121 bp, Artificial Sequence
  Synthesized
  misc_feature (61): n=a or g
gaattttttctgtatctttttttttttttttttttggtgaagccttaggaaatgcgtttcncttgaagttttctctggacagccttggaaaaaatctgtaaagtgtagggttctgcctagt

SEQ ID NO: 9752 - DNA, 121 bp, Artificial Sequence
  Synthesized
  misc_feature (61): n=a or g
gctgcttttcttcagtgcaatgtgagtagtatagttcccgaaagcttctgtgcacagtacntggtggaagaccatcagcttaaaagaagttagaaaacagtgcacaaatgaagtaatcctg

SEQ ID NO: 9753 - DNA, 121 bp, Artificial Sequence
  Synthesized
  misc_feature (61): n=c or g
aggtggtgtgctcagaattacatacgctctaccacctaagctgactgtgagctgaaccttnatttccttcattccagactaacggttcagttaagaaacttggaatgattgactttggact

SEQ ID NO: 9754 - DNA, 121 bp, Artificial Sequence
  Synthesized
  misc_feature (61): n=a or g
aaagatgtcaaattcaaatctattggccaggaattcctatgtgacagttccagtataaatnaagaggtcctgcaggcaaaaactttagactactagaaattaaatgccttaatgaataaag

SEQ ID NO: 9755 - DNA, 121 bp, Artificial Sequence
  Synthesized
  misc_feature (61): n=a or g
ttcccaaaatatagggtactgtccataaatactgtaaaaagaacggtttcctataacagantggaattcatccacaaaacagtgacttttgtagttaagcactgataccacagattacagt

SEQ ID NO: 9756 - DNA, 121 bp, Artificial Sequence
  Synthesized
  misc_feature (61): n=t or g
cagcatgttttaacagcaatttcaggctggtaatgcaacagcaaagtattaaatttagcanagggagcctttgttaactatatgcttatttcctttcccaaacccattgcagatcaggaga

SEQ ID NO: 9757 - DNA, 121 bp, Artificial Sequence
  Synthesized
  misc_feature (61): n=a or t
atctcctacattgtagggtcacatttcatcagggagaggtggattgtttctggactgaacnacttgatagtaataatggtgaattgacttggtgtcttaacagcttttgcaaacagagtag

SEQ ID NO: 9758 - DNA, 121 bp, Artificial Sequence
  Synthesized
  misc_feature (61): n=c or g
tgacccacctttaaagggaactctgttatttgcctcctaatctctgcctgaagctgcaaanagtttctccaaagcttttgaggagaggtgcctctttgaatatctcttctgtctttctaaa

SEQ ID NO: 9759 - DNA, 121 bp, Artificial Sequence
  Synthesized
  misc_feature (61): n=a or c
gacaacttctacagtttttagctaataattcttaaatgtttttcttctaattttatagtancttttcagtctgcagctgtatgtaaattgaagattcctccaaacatcattaatgattcca

SEQ ID NO: 9760 - DNA, 121 bp, Artificial Sequence
  Synthesized
  misc_feature (61): n=t or c
cttcctgattgttgatgtaggtactatagtctctaagcaacctgtttctggtgtattggcnggtcattttatgcaactccaatctgatacgtaaatatgcagtgaagaatacaaattgagt

SEQ ID NO: 9761 - DNA, 121 bp, Artificial Sequence
  Synthesized
  misc_feature (61): n=a or g
ccttcgcattccctacagtgttaggggttggaggtggctgggaggggggtttaaaagcccnctcttgagagaaatcaaatgtgggcagactcctgctcgaggaaaagtttcgctgcgaatc

SEQ ID NO: 9762 - DNA, 121 bp, Artificial Sequence
  Synthesized
  misc_feature (61): n=t or c
gtcaggaatttttaaataatttcattgtggatcaaaggagaagtggagaaactaactacanggttaaggtcatccaccacaactaaaagaaaaaaagtcctagcctgaaccagggccttgc

SEQ ID NO: 9763 - DNA, 121 bp, Artificial Sequence
  Synthesized
  misc_feature (61): n=a or t
aagtttccatttagtcactagattccatactgaagcaaagatgtgaagcaaactcctttgntctaaatcagtatggaacatgggactgctgctttgttttgatggattttgatcttttgta

SEQ ID NO: 9764 - DNA, 121 bp, Artificial Sequence
  Synthesized
  misc_feature (61): n=a or t
catcagttttgagacaagttgggtgtgcttgaaggaatctgctcttccgtgatttcccttngttctgttgtaccatattgctgattagagggagcttaaaatcaaagaattacagaattgt

SEQ ID NO: 9765 - DNA, 121 bp, Artificial Sequence
  Synthesized
  misc_feature (61): n=t or c
tcaacatttttgtagttattcaccctctgccaaagcacacacgtgactggggcagcagaanggtagcagtaaaatctagcaaagccaacaaacaaaggcagcacaaagtcaatgtctttga

SEQ ID NO: 9766 - DNA, 121 bp, Artificial Sequence
  Synthesized
  misc_feature (61): n=t or c
cccagtctttctgagcctctttgcttggtatttttactgttgtgaagctgagggtaacttntcctgtgcctgctctgcactctgtgctttgtcagtactgggcgatgcactatgggcagtt

SEQ ID NO: 9767 - DNA, 121 bp, Artificial Sequence
  Synthesized
  misc_feature (61): n=a or t
catgtgtcatccagagcaggagcaccaggctcatctttgctgtatttctctagtctacccntactgatgaaattacaggtttactgtgggcatataccagctctggtgagcatgtgcccag

SEQ ID NO: 9768 - DNA, 121 bp, Artificial Sequence
  Synthesized
  misc_feature (61): n=t or c
ctccttggatgtgaagtaagaagttgctctaactgagctggtgctgacctcccagctgtgntgcaggctcctgcccacaagccaagagccttcttatgtagcagacataaaatacggtaca

SEQ ID NO: 9769 - DNA, 121 bp, Artificial Sequence
  Synthesized
  misc_feature (61): n=t or c
gtgcactgtcataagagtatgctggatacctgcactgtcatttggaaagtgtgaattttangtcagctgtggagaagctttctgaaacagaatttaacattgaggcaaaagaagctgttgt

SEQ ID NO: 9770 - DNA, 121 bp, Artificial Sequence
  Synthesized
  misc_feature (61): n=c or g
ggtggctgtgcaattttatgaattgatgcatgcagaaaaaggagcaaaacattaggggtangctggcactgaagattatagaaatgcacctaaagacagtctgtaagacagaatttctata

SEQ ID NO: 9771 - DNA, 121 bp, Artificial Sequence
  Synthesized
  misc_feature (61): n=t or c
tcaaagaaagaaatctttgagggaaaaacagctgttccctgatagcgtgcagtttacaagntggctaaccagctactgcagtatcttatttttgttacaaggtaatgcaagtatctggatg

SEQ ID NO: 9772 - DNA, 121 bp, Artificial Sequence
  Synthesized
  misc_feature (61): n=a or t
cagttagtctgacttaatccacttcataatttaaaaacttaacttccccaaaaaggagacnctaattcatgtttccccatgttgtatcaggtatgtcactattgtctaattaaatcagcaa

SEQ ID NO: 9773 - DNA, 121 bp, Artificial Sequence
  Synthesized
  misc_feature (61): n=t or g
tttatgtcacagtagctaagtgttgctggcaaaagataggagcaaatataaagccaatttnaaaaaatcatacatcgtttaaacagagagagaaaggaaaaggaccataagtatatagtag

SEQ ID NO: 9774 - DNA, 121 bp, Artificial Sequence
  Synthesized
  misc_feature (61): n=a or t
aggtgtttttccacactttatagggttttttcctcccgttttcaaggatgatgcacaaatnaactctgttactgtttaaagattgtgggatacttctgaagttgtcacattaacactggag

SEQ ID NO: 9775 - DNA, 121 bp, Artificial Sequence
  Synthesized
  misc_feature (61): n=a or g
cagcatgtgtggctgtaatttgggtaacttattgtccaagaagcctttgttttctcggatnctgtgcgttagtgacattcaagttttatactctgcgcatctcatttcttttaatggttca

SEQ ID NO: 9776 - DNA, 121 bp, Artificial Sequence
  Synthesized
  misc_feature (61): n=a or c
aggaagaaatagtgtaataagagtagatgcctcatattttcctcttacttgccatcatccntgatgtgtaaacagcccagtgacttggacagagacccacaatttgagatactcaggtgca

SEQ ID NO: 9777 - DNA, 121 bp, Artificial Sequence
  Synthesized
  misc_feature (61): n=t or c
tcctcggtggagctactgggagacactctgtgccatagcagaaccataacttacagttcangtgaccaccagtccttcacaaatactataacctataaaaactcaaaatacgagtaaataa

SEQ ID NO: 9778 - DNA, 121 bp, Artificial Sequence
  Synthesized
  misc_feature (61): n=t or c
cggatctacagtgaccggctgcaccacgtcgttcatcaggaacaagcgctgcgcgtcctgnaggactctctcggtcaggttctcattcgggctgtcatcgctcagtgtcccacactaaaca

SEQ ID NO: 9779 - DNA, 121 bp, Artificial Sequence
  Synthesized
  misc_feature (61): n=t or g
aaatacctgttctgaagctatatggacctatttctgtgcagtgctaacttgaccacacatngattgcttcccttattgcctcaagatggtctcttaaaaattctcttaatccagctaacta

SEQ ID NO: 9780 - DNA, 121 bp, Artificial Sequence
  Synthesized
  misc_feature (61): n=a or g
ctgaaccagatgggtttatccgcaccgcgctcctgagaaggagtgcatgctgctagctctnctgcacagacaaggaacggagacactgaaaagacaaaagggttttcctggggaaactgca

SEQ ID NO: 9781 - DNA, 121 bp, Artificial Sequence
  Synthesized
  misc_feature (61): n=t or c
ttgcatcccagggtcgtaataacgtatcctggtgacactgaaacatggagatgtaaacaangaggagacagaaggacgttgacccaagtggctgagtttgaagcactgccattccagagca

SEQ ID NO: 9782 - DNA, 121 bp, Artificial Sequence
  Synthesized
  misc_feature (61): n=t or c
tagcacctaatcaggctactgctagaacagctcaccctttatgttctgcagatactggctngagctgtgaaaaccaagcatccaaacttgttggtatttgtgttctacgccaaatcttcat

SEQ ID NO: 9783 - DNA, 121 bp, Artificial Sequence
  Synthesized
  misc_feature (61): n=a or g
agcagtgcaaatccttgctagagggacacaccacaccagtgtaaagtgtggcttatcatcngtgcagtttagttcaaattacacaactctattaagctgtgctagcatgagcctctgctta

SEQ ID NO: 9784 - DNA, 121 bp, Artificial Sequence
  Synthesized
  misc_feature (61): n=a or g
gctctaccgttctctgtttgtcaaagttaattctgattcaatacatcaggatggggaatgntttcattccctgttcaaaggttttgttcatttgcatctcaaaagacagtattaaccccaa

SEQ ID NO: 9785 - DNA, 121 bp, Artificial Sequence
  Synthesized
  misc_feature (61): n=a or g
ttaccgtgaagactcagtgagttcttactgagttactggtgacatttgaagtcaaccattngggtgttatctgtcctggggaaacaaagcaaaggaattttcagggggtggcatgcatcac

SEQ ID NO: 9786 - DNA, 121 bp, Artificial Sequence
  Synthesized
  misc_feature (61): n=t or c
gcgaaagattacggtaaaaccatcaaacgatggatttgtcattacttcttgtcgtctgtgnctctgtttcagtttaagattaccactccaactcaaatagcagtctcatttcccctaaaac

SEQ ID NO: 9787 - DNA, 121 bp, Artificial Sequence
  Synthesized
  misc_feature (61): n=c or g
gcccgcaatgcagtgggcagcagctttgtgcagaatgtagggcaccaggaaagctggcatnccctctgcagtactgagcctccatggtgggtgaggattcaggctaagacattgcaccagc

SEQ ID NO: 9788 - DNA, 121 bp, Artificial Sequence
  Synthesized
  misc_feature (61): n=a or t
ggctctataaacctggggcccatcctgctgaattgagtggagacagttgaggaattttctnaaagcttgcttttatataccctggtaaactgcacatcttacctggtgatttcctttttgt

SEQ ID NO: 9789 - DNA, 121 bp, Artificial Sequence
  Synthesized
  misc_feature (61): n=t or c
caagcaactccacttcacgctgacattagagaaccatgtgtcccatccagcacgacaaacnacacacaggtacctgatggacagtgaattaagacataatcaatgatgcaatgttaccata

SEQ ID NO: 9790 - DNA, 121 bp, Artificial Sequence
  Synthesized
  misc_feature (61): n=t or g
ggcaccttattttccatgcacctttccttcctgggctctgggagcccaaggcacaaattcngcttccaggtacatcgacctaaccattctcaagctgaattttgctctgtcctttagtgcg

SEQ ID NO: 9791 - DNA, 121 bp, Artificial Sequence
  Synthesized
  misc_feature (61): n=a or c
tggaatatacagaatcatttacagcttccctgctaccaatccctaaacaaatacaaacaanaaccagtagcaggtcatagccactgcaatttatttttttccttccactgaaagcatgtag

SEQ ID NO: 9792 - DNA, 121 bp, Artificial Sequence
  Synthesized
  misc_feature (61): n=a or g
cctttttattcaaataaactatttctatgtaaatcggagttacgctaatcaaaactccccntcccaaaatgtgcaactttctcactcagaagtcactgtaactcgcatgaatggtcccgcg

SEQ ID NO: 9793 - DNA, 121 bp, Artificial Sequence
  Synthesized
  misc_feature (61): n=t or c
aactttattattttgccagtaattttatgtatggcactaaatcactgtgttatgaatgttngcattgcattctttttagcttttgtattttgtagatcaaattaaacaaaacttataaaaa

SEQ ID NO: 9794 - DNA, 121 bp, Artificial Sequence
  Synthesized
  misc_feature (61): n=t or c
gccttgcaggcacacagggtacatccagtgcaagggggtaacatttttcagacaaatatcnttgtcgggaaatgtcatactgggacaacgtgtagaaatatctgaaaattcaggtcaaatt

SEQ ID NO: 9795 - DNA, 121 bp, Artificial Sequence
  Synthesized
  misc_feature (61): n=t or c
agcattttctggagctggaaaaatttatctggctagtttgcagcagttggtgaaattccanatgcagtcctcatgggtgcatgccctgggttggcttcagacacagtcacttctagtgact

SEQ ID NO: 9796 - DNA, 121 bp, Artificial Sequence
  Synthesized
  misc_feature (61): n=a or t
cttcctaagtctagataatgaatcaaataattaattatctcatcaaagcaattagtcagcnatggtgacagaataacctgaggcccaacctacttttgaagagacaaaaccaaattgcagt

SEQ ID NO: 9797 - DNA, 121 bp, Artificial Sequence
  Synthesized
  misc_feature (61): n=a or g
gcccgtacagcagtaatagctgtccgagcaatgatggccgttgagtacaaccagtattatntttgtttaatggaacgtcggagctccaatcacatttaattatactcaaactgtttgttcc

SEQ ID NO: 9798 - DNA, 121 bp, Artificial Sequence
  Synthesized
  misc_feature (61): n=a or t
acatgggcacagttatgcagcactttcagagggatttctggaagtatatcccatctgtatnctagggcaaccaaggctacctgggcgaggcagcatgctggggtgggtgaagataaactat

SEQ ID NO: 9799 - DNA, 121 bp, Artificial Sequence
  Synthesized
  misc_feature (61): n=t or c
ttggggctgtgagtgatggatgacactttcctgaaaggacaccataatcttaagtggtccntgagagaatcagacttaatgctgtatttctaaggtaatgatttatagtaggaaaattatt

SEQ ID NO: 9800 - DNA, 121 bp, Artificial Sequence
  Synthesized
  misc_feature (61): n=t or c
attaaatgcagaatagcacaatcactcttctctcatgttatcttcaagtatttagtatttnggcagggctcaacataaacctttaggcattatctgcagtcatctgttttccagtgggtta

SEQ ID NO: 9801 - DNA, 121 bp, Artificial Sequence
  Synthesized
  misc_feature (61): n=t or c
tttccccttttggccatagcccaggtttttgtggtgaagatgcctggatttaaaagctgcntttgcagtggtgctgggaggtgtggcgctaaagcaaacttcgctgtattatttttggttc

SEQ ID NO: 9802 - DNA, 121 bp, Artificial Sequence
  Synthesized
  misc_feature (61): n=t or c
tcatctttcctgctgtctatctcctgtgtagacaggtggcttcctagcagagttcttgtgnttcatacatgctgtctcatactccctttcatacctatatactttagggtaatttcaaaga

SEQ ID NO: 9803 - DNA, 121 bp, Artificial Sequence
  Synthesized
  misc_feature (61): n=a or g
aaacattagaacaaatttcacagattgccctgggatcttcataagaggtactaaagtacangcattcagaaaggaactctgaagacatatcattaagatcacagaatcacagaatcactgt

SEQ ID NO: 9804 - DNA, 121 bp, Artificial Sequence
  Synthesized
  misc_feature (61): n=a or g
gcacctgtcatggtacaaagaaaagcagaaataacagaccttcatcctacactgaaatgcngcggacacaatgcatacatagcaccttaaatagcattaaatgtgtatgcagtgtaactgc

SEQ ID NO: 9805 - DNA, 121 bp, Artificial Sequence
  Synthesized
  misc_feature (61): n=a or g
tccatgattaatggccagcagcagagcttgaaagcttaaatgtttgcgaatgcaagcatgnaatgaaattctaataacactacaatgatgtggatttatgaggtgtgttggctgctaagga

SEQ ID NO: 9806 - DNA, 121 bp, Artificial Sequence
  Synthesized
  misc_feature (61): n=t or c
tttcagataagaactctattagaaaacagcaaagtactataaacacatatacagtgagagnaattttaattcttaaagctttaaatatttaaagtgatttctgtatgtacatttttttcag

SEQ ID NO: 9807 - DNA, 121 bp, Artificial Sequence
  Synthesized
  misc_feature (61): n=c or g
gcctagaaaatagagcgtgccagtgtgtaacataggactgaaacatgatgcttgtccctcnaagaaagtcagtcttactgtacaaaaacaagcaaacaaaaaaaggctgttttctattatt

SEQ ID NO: 9808 - DNA, 121 bp, Artificial Sequence
  Synthesized
  misc_feature (61): n=a or c
gtcacttctttgactaagcagtgactaatctgcttcctcctattctgaagcaaagcttttntttcctttttttatgtacatccagagagcacaagacagtaacagatcatacaggaaagtc

SEQ ID NO: 9809 - DNA, 121 bp, Artificial Sequence
  Synthesized
  misc_feature (61): n=t or c
cgtgtttgtatctgtatctctctgtgattcattacacattccagaaagcacatgcaactgngttgtttcctgctacaacaaaacgtacaatgtgtttctttattaccaggacagagttatt

SEQ ID NO: 9810 - DNA, 121 bp, Artificial Sequence
  Synthesized
  misc_feature (61): n=t or c
cgtgctgtcggtaaagctttgagtgccccgagcttgtgggggtgaaacgcgctctgtagangcgcgttgagtcgtcccaaagtgtgtgaggccggcgggtgccaccccgatggcggcactg

SEQ ID NO: 9811 - DNA, 121 bp, Artificial Sequence
  Synthesized
  misc_feature (61): n=a or g
tccctgcaaccccatacgcttctgtctgtcatgtaaaggtgagagtcatggggtttctgcnctattttcttagaactaaattttcattgacctttggcagaaaagtttctttaactgcagc

SEQ ID NO: 9812 - DNA, 121 bp, Artificial Sequence
  Synthesized
  misc_feature (61): n=t or g
cacccattgacctattgcaattctaattagaagtgcaaaatgttctaaagtcgatcacagntgaaactttgtaaacaaagttgttttgcaaaattttgcttacagcaaaatgtaatattct

SEQ ID NO: 9813 - DNA, 121 bp, Artificial Sequence
  Synthesized
  misc_feature (61): n=t or c
ttctgcatgtgaatttggaagatgttgcctcagacaaataaaggcttgagacctaaagtcnttcaggtttttcttgcttgatttgcagacttttaactaactttgtatcagttagcattaa

SEQ ID NO: 9814 - DNA, 121 bp, Artificial Sequence
  Synthesized
  misc_feature (61): n=t or c
aaggcaaagattttttcccttccaagccccctagcccagaaatgctccttcccactctganagaagcaatactggttactttgcctaacagccatttagtagcctccttaaatattcttga

SEQ ID NO: 9815 - DNA, 121 bp, Artificial Sequence
  Synthesized
  misc_feature (61): n=t or c
agcacagtgctgaattgtgccagaagacagcctggagttgtagctggggtgctcaatcccnggtgaatgctgtgctttctttaatgtgattttctggttttctgtgagcaccatctgcttc

SEQ ID NO: 9816 - DNA, 121 bp, Artificial Sequence
  Synthesized
  misc_feature (61): n=a or c
aggggttaccttttaccttctcttgatgtaacatttaaagtatatatctcactgagaaaangctaactttgctgccagtggaataccagaatatgtttaaccccagttatctactgctcag

SEQ ID NO: 9817 - DNA, 121 bp, Artificial Sequence
  Synthesized
  misc_feature (61): n=t or c
acattcacaatatagatctagggtgtatcttttgatctacaatattgcaaaataggtagancaagtatcgggttacataaatagccagaaaaaagtaccaaatgttatgactgcaactgaa

SEQ ID NO: 9818 - DNA, 121 bp, Artificial Sequence
  Synthesized
  misc_feature (61): n=a or g
gcttttgagagcagagtttgcagagctctgttaaacagctcatatacagcaacaccctagnaacctgaaggctcctaaaacatttaatacattcatattctctgaaaaaagaagaaaaata

SEQ ID NO: 9819 - DNA, 121 bp, Artificial Sequence
  Synthesized
  misc_feature (61): n=a or c
atactgcaagttttttttttttgtttgtttgtttgttttggttgttttctataaacagtanaaagatctgctattgaacacaaaccaccccagaatcactgcacccaacatctggagagtg

SEQ ID NO: 9820 - DNA, 121 bp, Artificial Sequence
  Synthesized
  misc_feature (61): n=c or g
ggatttcaggccatcgtgcttcctgtgaacatgctattcccacttttcactactgggagantggatctgaagtttgcctaaacaaaagtcaactccttccccacaatctccagagaaatag

SEQ ID NO: 9821 - DNA, 121 bp, Artificial Sequence
  Synthesized
  misc_feature (61): n=t or g
aagcaatcagatgtttaccacctaccagctgctgtaggagagggaaactcctactgctttnctgcccaccaaagttggacctctgaaacaccaaagcctccttattctgctttctgccagc

SEQ ID NO: 9822 - DNA, 121 bp, Artificial Sequence
  Synthesized
  misc_feature (61): n=a or g
ttgccagaaaagtaaaatctcccttgcccatttagcagccacattacacctttagttggtntctgagctctgacttcacttcagcccaattcaccatgctggtgctgtgttatatacctcc

SEQ ID NO: 9823 - DNA, 121 bp, Artificial Sequence
  Synthesized
  misc_feature (61): n=a or g
atgtataccctgtgagaaggtattctctattgtatatatgtattctctaagacttcagatnatcttggctaaaaaggaagaagttaattttattgttaaacagcccattttatttaccgtc

SEQ ID NO: 9824 - DNA, 121 bp, Artificial Sequence
  Synthesized
  misc_feature (61): n=t or g
tccttccttctttccctccagtatctgtattttgccacaaatcatttaactactcaaactntcctgaaaagtttaactactcaagctttcctgaaaagtattcctgtttgcttggcttatg

SEQ ID NO: 9825 - DNA, 121 bp, Artificial Sequence
  Synthesized
  misc_feature (61): n=a or t
attacattacatcctatgtatttatttgcagcgctgtatttgtctaacaacaaattactancagaaattggtctcatctcatggcactgcaagtgtgcaccattttattaaaccaacaaca

SEQ ID NO: 9826 - DNA, 121 bp, Artificial Sequence
  Synthesized
  misc_feature (61): n=a or g
cctctgaaggattttcacaggccaaaataaatatacagaacatttctttctcgccttttcnacttctccccactgctatactttatttgaggacatacgcaaacatacaatctctctctct

SEQ ID NO: 9827 - DNA, 121 bp, Artificial Sequence
  Synthesized
  misc_feature (61): n=t or c
caccacagactcctaccaagttactggttctagcgctaactgcactactgaatttctctcnttcctacacttctcttgcagtctttcttcaatacaggcaagctaatcagttgcttagaca

SEQ ID NO: 9828 - DNA, 121 bp, Artificial Sequence
  Synthesized
  misc_feature (61): n=c or g
agagatacctatatttgaatgagtcatttccccacaaatgtggtgttaggtgcacatacantcctaccaacacttcttactacattgcttaaaatttgctccatgcagcaaccaaactatt

SEQ ID NO: 9829 - DNA, 121 bp, Artificial Sequence
  Synthesized
  misc_feature (61): n=a or g
cgatttggaaagatagacatttgttgtcttctctatctgcaagatatctgtacatgtaagnatagtgttagtaactgtgatgattttctgaaaatgtgtcctcctcaagcatttttgatga

SEQ ID NO: 9830 - DNA, 121 bp, Artificial Sequence
  Synthesized
  misc_feature (61): n=t or c
cgattatttagactacaaatattaggcagggctagctggttgggtactggagaaagactcntttaaatcttatttttatcccgttgaaaaaaaatggggtggaggggaaaaagcatctgtc

SEQ ID NO: 9831 - DNA, 121 bp, Artificial Sequence
  Synthesized
  misc_feature (61): n=t or c
gcttagctgtaatcagaaaactagcttatattaccacagcctggagcgacaaaacaacacnccatgggcaaccagggtaatgttttcaggtaggaactccaagaccaaaaaatagtttaat

SEQ ID NO: 9832 - DNA, 121 bp, Artificial Sequence
  Synthesized
  misc_feature (61): n=a or g
cgtaactaaataattgttttgatgagagttactaaaatattcatctgaaaacatccttatntcagtttcaaacacatacggcgtccactagttttgccttctttcagcttttataaacctt

SEQ ID NO: 9833 - DNA, 121 bp, Artificial Sequence
  Synthesized
  misc_feature (61): n=t or c
ttaccagattagaaatgtttctttggcaagagcactgtaaaggtctggatactacagacantgggatttgccacaagattttgcatggacattttctacttttactttataaatattattg

SEQ ID NO: 9834 - DNA, 121 bp, Artificial Sequence
  Synthesized
  misc_feature (61): n=a or g
ataaaaacatctcttacacaatgtagatagagcaagcatagaagcacaaagcagttgggtncactagcatgtaagtctgggggtctgggttatctccacgttttctgaagtgctgcctttc

SEQ ID NO: 9835 - DNA, 121 bp, Artificial Sequence
  Synthesized
  misc_feature (61): n=t or c
ttaggctggattacagaatttgagttctgacttttactctgtttgggttttcatgtggtanctgattgaaaatgaacccaaacttgaaagagagaaatgagaactcgtcgaccacattcta

SEQ ID NO: 9836 - DNA, 121 bp, Artificial Sequence
  Synthesized
  misc_feature (61): n=t or c
tgagtaggacactcagaaaccatcgcaagcaagcaatgaataaactgcattgaaaggccgnagtggtggccctgttaagcagcactgtgttctcatgcctggaaatgagaaagtgtctaaa

SEQ ID NO: 9837 - DNA, 121 bp, Artificial Sequence
  Synthesized
  misc_feature (61): n=t or c
ccttgatgctgattactgctggagtcagggaaacagcaactccacatccttcagattcctnctgacagatgcttcaacaaaaacacctttaaaatgaacattaattttatatatagacaga

SEQ ID NO: 9838 - DNA, 121 bp, Artificial Sequence
  Synthesized
  misc_feature (61): n=a or g
agctgaatcaccttttgaatgttatcctcaaggctgcaaccagacctgtactcattggccnaaatagtttgcatggttagcagtcagttggcactgactgctgaagttaattggttttcag

SEQ ID NO: 9839 - DNA, 121 bp, Artificial Sequence
  Synthesized
  misc_feature (61): n=a or g
ttcctgtgctcgctcgcctgccgctaattgcgaggctgcccagatacataactgcaatcantgctgctgagaagtaaaggaggatagagaaacgatttgggaagcaaacagcgagtgctgc

SEQ ID NO: 9840 - DNA, 121 bp, Artificial Sequence
  Synthesized
  misc_feature (61): n=a or c
agccatacatttaaagtttggatatctgatcttacatgttttattcattcttgcacctccntggctttattttgtattcttcagttctgaggaacgtgttattctaaaaggagcagttaat

SEQ ID NO: 9841 - DNA, 121 bp, Artificial Sequence
  Synthesized
  misc_feature (61): n=a or g
cccacacagacatcattagagcacacacatacatgtgtatccacgtaaatgagcgcgtatntgtataaatacatgcgtgttgagagctgatctatcatctctgctaacttttttaatttaa

SEQ ID NO: 9842 - DNA, 121 bp, Artificial Sequence
  Synthesized
  misc_feature (61): n=t or c
aagaagtagatggtatttccccaggcagcagccccagcaacacaaaacatctctatgcaanattaagtaattactattaaagttcccccagtgcaacttcatttcctaacggcatcgcccc

SEQ ID NO: 9843 - DNA, 121 bp, Artificial Sequence
  Synthesized
  misc_feature (61): n=a or c
ttgtttcacagtggacaagtatgagagtaaagagtatttacataaaattacgtaatcactntgcagttttctcctggaaataacagttcagtatagctggataggccaatgactatttaac

SEQ ID NO: 9844 - DNA, 121 bp, Artificial Sequence
  Synthesized
  misc_feature (61): n=c or g
tgactaaacacagtgttccagtggccatgtagttcagttgtttggactggtccatgtgatncgcttctacgttatgcatggaaaccaggagtaaggtaggactgaggagcagtctgccatc

SEQ ID NO: 9845 - DNA, 121 bp, Artificial Sequence
  Synthesized
  misc_feature (61): n=t or g
aagctggttatattttactgcacacatattttatcaggcaccttctccatgtaaaacaagnaacaggtgcacacacagatacatcagcttcaactgtggattttgcaccattgccaattat

SEQ ID NO: 9846 - DNA, 121 bp, Artificial Sequence
  Synthesized
  misc_feature (61): n=a or c
tgatgtgtgctgagctgttctgcccccctctttgcataatgctcagaccaagtccttcatntcaaactgaggcttcgggggtacttcagcctgctctcttaatagctgtaaattcacatta

SEQ ID NO: 9847 - DNA, 121 bp, Artificial Sequence
  Synthesized
  misc_feature (61): n=t or c
acctatttctgggttgaagctgaattccccccaagaactaccatccttccagatctgcatngcaaacttcaggctgtagattactcaaatattattgactatgttacagagataattccct

SEQ ID NO: 9848 - DNA, 121 bp, Artificial Sequence
  Synthesized
  misc_feature (61): n=t or c
atgatgttttgccttggagttcagatagttttggagtcagatgggggattgccacatatgntgtgcagttttcacaattgtgatcacaaagaagttgttacagcctcagattccacactga

SEQ ID NO: 9849 - DNA, 121 bp, Artificial Sequence
  Synthesized
  misc_feature (61): n=c or g
tcccagaaacatagtaaacacttggaaaacttcaccttatttttaattttgttagcaacantaagaccacgttctcaacctttactaataccacagacaaaattcaacatgaaattttaac

SEQ ID NO: 9850 - DNA, 121 bp, Artificial Sequence
  Synthesized
  misc_feature (61): n=t or c
atgcttcatgtgcttgtgtgtaattaaaagaaactcctactacaaaatcagaagaacctgngttaaaagcctgaaaacttaatgtttttatggacaaaaacacattaactgaagtgcgtct

SEQ ID NO: 9851 - DNA, 121 bp, Artificial Sequence
  Synthesized
  misc_feature (61): n=t or c
ataccttaggaaacactttcaaataaacaacaaatgcaatgttcactttgataaacaatanagaaacctatgccaaaataacaatagcactaaagatgtaagtcagtttcatcagtcaaaa

SEQ ID NO: 9852 - DNA, 121 bp, Artificial Sequence
  Synthesized
  misc_feature (61): n=a or g
aaaaatattcagatgtgtcatctctccaacctcttccttgggtgtgctggtactgtcattngaagtccaaagatcccttttctgtaccttgtggagatgtttgttttccccttcatagcac

SEQ ID NO: 9853 - DNA, 121 bp, Artificial Sequence
  Synthesized
  misc_feature (61): n=t or g
acggacccaagaaaacccttaagtgcctgaagtagtcccttaaaatctccactagatattntggtgcatcagcatcatgtgagacagcactaaatgccttttctcttaggcatctgagcat

SEQ ID NO: 9854 - DNA, 121 bp, Artificial Sequence
  Synthesized
  misc_feature (61): n=t or c
tacatacaatcatctaccaagagaaagaatttaagaagcagcgcaggcaggttgttttgtnaggaaaagtgagccagaagtccaaagccacaggaaggcaggcagagctgtgcactgtgcc

SEQ ID NO: 9855 - DNA, 121 bp, Artificial Sequence
  Synthesized
  misc_feature (61): n=a or g
cattccctttttgcagccctcgcaaactgctctctttgcatcttgcacctcttgcttcccncacactttgcatcctgcgcttggctgcatcttgcaccccttgtgccctgtaccctttgca

SEQ ID NO: 9856 - DNA, 121 bp, Artificial Sequence
  Synthesized
  misc_feature (61): n=t or g
ttgtatttagcctactgaccatgtgttggtcagtgtgttagaaggttttaagaacgtggcntataggtctttcattaaaggcacttagcatagggaaaacaacccttaagctaaggcttct

SEQ ID NO: 9857 - DNA, 121 bp, Artificial Sequence
  Synthesized
  misc_feature (61): n=a or g
tcatgccgtgcatatgctgggcccagcatgagggttgatggatttgtgctggaaggagccncgcttaccggttcttacaccagttgcccaaaatatgttaatccaaggccacgaatagaaa

SEQ ID NO: 9858 - DNA, 121 bp, Artificial Sequence
  Synthesized
  misc_feature (61): n=t or c
cctgaactggttaactctgaacatgcaaccgttacgaagatgctggttgaaccatctgtangatcttcgtgcctctgcatcagagctttgccccatgctgacccatgcctgccctgctgga

SEQ ID NO: 9859 - DNA, 121 bp, Artificial Sequence
  Synthesized
  misc_feature (61): n=a or g
ttgccatgaagccggatggcgtcatgagggtgtttgctttgcgggctgggctgggcacacngctgcttgagggtggtgggaagagcagacacaacagcctggagacgtttcctaaacgtca

SEQ ID NO: 9860 - DNA, 121 bp, Artificial Sequence
  Synthesized
  misc_feature (61): n=t or c
gagacaggtcctgttcatagtgtactggatataacatttcagttaccacccatgcacacanatatatatattagtaggcaaccaagatgtttagccctagtactagcataggagaaaagaa

SEQ ID NO: 9861 - DNA, 121 bp, Artificial Sequence
  Synthesized
  misc_feature (61): n=t or c
gaataacccaaacaaagaagaaaacagggcattttcaattaaactactcatgtccaagaangcagacatggcactacaggaaaggaaaaggtgcctgcaagttttaatcaagccagaaccg

SEQ ID NO: 9862 - DNA, 121 bp, Artificial Sequence
  Synthesized
  misc_feature (61): n=a or g
ctttgcactccaagacatctgtttcagggaataataaagctgggcagctctcaagctgtgngcttgcaatcgccttctcctttgtgttcacgagcttcacagtgtctgtgcttgtgctgaa

SEQ ID NO: 9863 - DNA, 121 bp, Artificial Sequence
  Synthesized
  misc_feature (61): n=t or c
taccacagccactgtacattccatatttggctccttctgacttccacctgttcagaccaangaaaaaaggactttgagggcagcatattcccagcacagtgctgttgctgtgaaactgtgg

SEQ ID NO: 9864 - DNA, 121 bp, Artificial Sequence
  Synthesized
  misc_feature (61): n=a or g
ttccttgctgcctgtgtttaagcaggcatctaattgcaatgggatttcacaggcgcttgcnaatgtgtattactatgctgctggcttatctttgtgctatataacatatttgcagctaaat

SEQ ID NO: 9865 - DNA, 121 bp, Artificial Sequence
  Synthesized
  misc_feature (61): n=a or g
tccagttcctacttcattttcactttgtgacagttcttctgtaacccctttttctatctcnattttcatttcagcacttcctaaaatctctgtttctgctgttttattaggtggggaagtc

SEQ ID NO: 9866 - DNA, 121 bp, Artificial Sequence
  Synthesized
  misc_feature (61): n=a or g
ggctggcagtaaactcaatcctgtttagagactgcacacagtccatgatgaccgaggtccncaagatacttcactatttttattttccagaagctaaatactgagcaaaagccaaattgag

SEQ ID NO: 9867 - DNA, 121 bp, Artificial Sequence
  Synthesized
  misc_feature (61): n=t or c
agctgtccatgcacttttgtgtacataaaggatatgcttatacttggaaataaaaaaatangcagcattctgcagtcaatctatttgtcatctctttcttcagaatgctaaactttctcac

SEQ ID NO: 9868 - DNA, 121 bp, Artificial Sequence
  Synthesized
  misc_feature (61): n=t or c
gttcgttatttctgctttaaagccatgaaacggattcatttttctttataaactagagtanaggaagtgcatttgaagaaatcagcactaaaaatggtcctagttgaacttctacttattt

SEQ ID NO: 9869 - DNA, 121 bp, Artificial Sequence
  Synthesized
  misc_feature (61): n=t or c
ttgaaacaacaggtagtaaaataaatctgtaatattccaagtgcactgtagaatatcctcnggtgaagttatcttgtgatgaatctttaaataattgaaaaactatttggaaaagaacttt

SEQ ID NO: 9870 - DNA, 121 bp, Artificial Sequence
  Synthesized
  misc_feature (61): n=a or g
atgtaaatcaatgcctattcatggaccactcagttttttcagcacaaaacctccaaacacnggaaaagctttttgatgttctaacttgtagctgagagctcagtattgagacttgctaatt

SEQ ID NO: 9871 - DNA, 121 bp, Artificial Sequence
  Synthesized
  misc_feature (61): n=t or g
gtgtcttcataaagggcaaaaagcataagatgtgagttatggccccttaaaacaacaaacngtgacatcttgtttatgacacgtagaatagccctagaagcaggcaggttctctatataaa

SEQ ID NO: 9872 - DNA, 121 bp, Artificial Sequence
  Synthesized
  misc_feature (61): n=a or g
gaaggaacaaaattctccttacaggttctttgcaacactaggtgaagtatttacaggtagncaaagaataatataaagaaagaagaactaagctgttaaacttacccaactgttgacagag

SEQ ID NO: 9873 - DNA, 121 bp, Artificial Sequence
  Synthesized
  misc_feature (61): n=a or g
atagtgggtgttgattctctattctgcctatagatatgtgatggggataattaagagactntcccctaagaatagtgggctggagcagttgctggaatggtttatcttgcctgtgactggc

SEQ ID NO: 9874 - DNA, 121 bp, Artificial Sequence
  Synthesized
  misc_feature (61): n=t or c
tctccagtaagagtctgcctccatgttacagaaaaggaagccttgggatacaccacagggnctacagttcatccccatttttgtgcactgagagctttaggcattggctaacacccacctg

SEQ ID NO: 9875 - DNA, 121 bp, Artificial Sequence
  Synthesized
  misc_feature (61): n=c or g
gtcttggcatctatgtgaacaacagataaagactaaatattcatgctgtaaattgttgtgnatgggttttacaagtaaactggttatgaggtacttttctgatgttttgtttactcacatt

SEQ ID NO: 9876 - DNA, 121 bp, Artificial Sequence
  Synthesized
  misc_feature (61): n=t or c
aaatgtactggtttaaaacacttgaaagactacgtgtggctgaaccacaagtgctcagganggcaaatgaagcgctgctttcaggaacttgaaggagcacaaattttaataagtaacatag

SEQ ID NO: 9877 - DNA, 121 bp, Artificial Sequence
  Synthesized
  misc_feature (61): n=a or c
taaaactattgttttattgaataatttgtgtgttcttgtacaactgagaaagctggaaatntgctactgccgtagcaggatattcaaggcacagtgcaatgattatatggttagtgcatcc

SEQ ID NO: 9878 - DNA, 121 bp, Artificial Sequence
  Synthesized
  misc_feature (61): n=a or g
aacactgtaatgatgcttttcagtattcaatctgtaaaaacctgtaagtactgtataatcngtcagcataacttttctgaaaatccagagtaactataaccttcatttcataggcaaaacc

SEQ ID NO: 9879 - DNA, 121 bp, Artificial Sequence
  Synthesized
  misc_feature (61): n=a or g
aactaagggaaataagactgcatgtcagttttgatgaaaaaacacttcatcatctttttanaatgtatattaacttcagattctgttcagcctcatcctctctgataaattaaaatgacat

SEQ ID NO: 9880 - DNA, 121 bp, Artificial Sequence
  Synthesized
  misc_feature (61): n=a or g
atcaagtaaacaaacttgaaatccagccatcacctgaatactttctgcagagctgaagagncatttacataacagagtattgacatgagtacttgaacaagtccaccaagaactgtcaaaa

SEQ ID NO: 9881 - DNA, 121 bp, Artificial Sequence
  Synthesized
  misc_feature (61): n=a or g
aagagccagcacttctgatcagtgccagtgctgctgaggcagaacttggcaagatttatangctgcaggagtttgcacctcttttcttccccttctccccttcactgtctctgtaaaatgt

SEQ ID NO: 9882 - DNA, 121 bp, Artificial Sequence
  Synthesized
  misc_feature (61): n=t or g
acagtaggaaaaaaaaaaaaaatagagcaaagggaagctgtaagaaaagccctggaaaaanaagttattaagtaaaaacagttgctgtctacactccctgtagtaatccgggatatgtttt

SEQ ID NO: 9883 - DNA, 121 bp, Artificial Sequence
  Synthesized
  misc_feature (61): n=a or t
ctcatgttacactttcactgctgaaaattccttacttgagagataaggttccagaaacganagagacttactagtgagattaatccacatcccagtaagtttcctacaccagtcttgtagg

SEQ ID NO: 9884 - DNA, 121 bp, Artificial Sequence
  Synthesized
  misc_feature (61): n=t or c
ccacagtcagaaggtgggtatcagcaccctccaggatcagccagtcctttcatgaggcagnataattgtggaagtgaagtactgaatggctgcacagaaggaaaaaaaatatgcaattttt

SEQ ID NO: 9885 - DNA, 121 bp, Artificial Sequence
  Synthesized
  misc_feature (61): n=t or c
agagactgtaggagttgaactataagtgggtatatgttgaagaatttatccatcctctatnatataaacttacagattttccttctcatattacatctgcttttgtggttttctttcaaca

SEQ ID NO: 9886 - DNA, 121 bp, Artificial Sequence
  Synthesized
  misc_feature (61): n=t or g
agcacataacagaaagtttaaatcaccggtaggcagtaataaaatatcttgaaggaagcanttggaaagcatctggaaacacagcactgaaggccggtgtggtgcagcaggctgaaggggg

SEQ ID NO: 9887 - DNA, 121 bp, Artificial Sequence
  Synthesized
  misc_feature (61): n=a or g
agctggctctctttcccctttccatttcagggctgtaatatgtatgccgccctgcccagcnccattgccccttggatgaaggctgggctgtgctttagtttaatgttctggggaacgcaaa

SEQ ID NO: 9888 - DNA, 121 bp, Artificial Sequence
  Synthesized
  misc_feature (61): n=a or g
tggtgcttgtgcctcagtgctgagtgagtacagagttatggaagggagccccgctgctacntattaacatcccgtcacagggtcctctttctcctctgggtgaggtaaaggtctctgagat

SEQ ID NO: 9889 - DNA, 121 bp, Artificial Sequence
  Synthesized
  misc_feature (61): n=a or g
gcactgcctttacctacactgtatgatttaacagagttgaaagaagcacagagatgtgacncgaagcgatcacctgcactgttccctataagaaactggaggtaacaaaaggaaaaaaaaa

SEQ ID NO: 9890 - DNA, 121 bp, Artificial Sequence
  Synthesized
  misc_feature (61): n=a or c
tagttaatgaaagatgtagcatctccgaagtaactgaggcctcatccccaaattttagagngcacctttttctgggaaacagcataaacgtacagcaaagtcatttcaggaaataaaggtt

SEQ ID NO: 9891 - DNA, 121 bp, Artificial Sequence
  Synthesized
  misc_feature (61): n=a or t
agagctttcataaagttttgttgtctcccaggaagcaacaggccacacagttcttaaacangtttcaggaactgatctgtactcagaaatgctctagtatcaatggaaatttgcctctaat

SEQ ID NO: 9892 - DNA, 121 bp, Artificial Sequence
  Synthesized
  misc_feature (61): n=a or g
ttttttaacctgccatctttgccacacagccttaaaggcttgtgtacaaaggtaggatacntaccaagtccacacagatgaaaacaaagcattaattcacatttcaagaaaggaaagtaag

SEQ ID NO: 9893 - DNA, 121 bp, Artificial Sequence
  Synthesized
  misc_feature (61): n=a or c
ttgtcatctttgctgttcctagtgaggtgcagggaaatgactcacggcgtggtgtgtcctnctttgggtacttcaggcactgaggtgcttccccaggcctttgacagtcaggtcttgaaag

SEQ ID NO: 9894 - DNA, 121 bp, Artificial Sequence
  Synthesized
  misc_feature (61): n=c or g
tgtgctttccagggccaagcagaagtcttctgctgggttttcttcttatagtcactgaaantggctcacattgaagtgcagccagcttttagcatcaacttacatgaatgcagacactcgg

SEQ ID NO: 9895 - DNA, 121 bp, Artificial Sequence
  Synthesized
  misc_feature (61): n=a or c
gctggtttcataattagggtcctatagtaaataaaaaaatcataaactctgtgctgagggnatcatttaagctggagggcctgctgaggactacaagcagtgaggtaggagtcagcaggcg

SEQ ID NO: 9896 - DNA, 121 bp, Artificial Sequence
  Synthesized
  misc_feature (61): n=t or c
gtaataacaaaagtatctcttgaggtcacctgcctcacttcataaatgatatgcttgttcntatatttcaggatattttctaatagatcttacatagtacttgaagtcaactgtccctcat

SEQ ID NO: 9897 - DNA, 121 bp, Artificial Sequence
  Synthesized
  misc_feature (61): n=a or c
aacaatagtggagcacaaaaggaattggcaataactgcttggttgggcaatggcaaattcnctgcgaaatagggaataagtttcatgaatataacttatctaataaatgccaaatattttt

SEQ ID NO: 9898 - DNA, 121 bp, Artificial Sequence
  Synthesized
  misc_feature (61): n=a or t
gaaaagatcaacctgttcccagtcagcccccatctgtaagcttccttaatggttaacagcntataaccagtgtttcaggcagagagggattttataatatgttattttttatgatttttca

SEQ ID NO: 9899 - DNA, 121 bp, Artificial Sequence
  Synthesized
  misc_feature (61): n=c or g
taacacaagacatcaaagttaaaagctgtacatgataacaaacctgtgctttacgtgtatntggtgactgaggaaaagggagtgataccttgtaggaactgtattatatacaaacttaaca

SEQ ID NO: 9900 - DNA, 121 bp, Artificial Sequence
  Synthesized
  misc_feature (61): n=t or c
aaactgtaagaatttagtatattgagtgttatcagtttcaacctgggggattgtagcttcnagaattctgtacattttaggaaatagggttttgaagctggtgacaaacacagaaccataa

SEQ ID NO: 9901 - DNA, 121 bp, Artificial Sequence
  Synthesized
  misc_feature (61): n=a or g
caaaagagcaatttggtacactcacaagaatagactaaggaaataaggatgaaaatgaaancgttggaacagaaatcaccaagttaaactcaacaagaccgaaaaactcagatggagtagg

SEQ ID NO: 9902 - DNA, 121 bp, Artificial Sequence
  Synthesized
  misc_feature (61): n=t or c
cgtatagtcctcatacatacagaaaatgtactaaagaatgaggtactatgtaagtctagtnttaataaggcttatctatagcaagtaaacttctacagttttcctcacttagctatgtaac

SEQ ID NO: 9903 - DNA, 121 bp, Artificial Sequence
  Synthesized
  misc_feature (61): n=a or g
gtccttggtgggattttgcagtgatagcaaacatacgcttgtttgcagtggaggcagcatncatgtcctatggtgaaagaatgctagttcatggtgaatacatttgataatttattcacaa

SEQ ID NO: 9904 - DNA, 121 bp, Artificial Sequence
  Synthesized
  misc_feature (61): n=t or c
tcttattaaaaggggaactcttgatatctaaaggttatatgcttctccaaatgtttttaancactgcaagtaaacacgatttaatagccacttcttttctttgtactttacacgcaacttc

SEQ ID NO: 9905 - DNA, 121 bp, Artificial Sequence
  Synthesized
  misc_feature (61): n=a or g
cacaagaacgctttccatggctataagaactggcttacagctgaaaccttaaaggggaggnccctaacggtgtgcttttccttaacaaggtggaaagagaatgcaatcattttgaaggatt

SEQ ID NO: 9906 - DNA, 121 bp, Artificial Sequence
  Synthesized
  misc_feature (61): n=a or g
gcattctgtgctctcccagagaagtctccacccatagtctattaagagaaaacaccatcanaagtaaggtgcagctcaaaagcaaagcaggcaacctgattttaatcccaagaacatacta

SEQ ID NO: 9907 - DNA, 121 bp, Artificial Sequence
  Synthesized
  misc_feature (61): n=t or c
agccccagcactgtggcagtgtcctaacaatcattgaagaaggggactgggttacactganggatgtgttcccacaggggcatcacttcctcccagcaaatgctagcagggatctcagaat

SEQ ID NO: 9908 - DNA, 121 bp, Artificial Sequence
  Synthesized
  misc_feature (61): n=a or g
acacaaggagcagaagataaaccaaactcaagcaaaacattagcaaaattgaaaataaacntgttctgccagaccttggttttggcgtatgtgattctgaagtggagtatagtgaaggaga

SEQ ID NO: 9909 - DNA, 121 bp, Artificial Sequence
  Synthesized
  misc_feature (61): n=a or g
ccagtactttgtttggataatcctacatttcagaactgggttttgtattcttgcagctatntatttgatgtagtgccagaaggttgtatgccaaatcacaaatatagaaggaagatgaatt

SEQ ID NO: 9910 - DNA, 121 bp, Artificial Sequence
  Synthesized
  misc_feature (61): n=t or c
tcatttgggcttgtctttcaaggaactgtcaggaaacatcccagtacaatgtatgctttgntgtgcacatactgcaaaactgcagacagacttctaccagtatatgtgacactaagaagat

SEQ ID NO: 9911 - DNA, 121 bp, Artificial Sequence
  Synthesized
  misc_feature (61): n=a or g
tgtttctatttgttcttgtacaactccatgggcgtttatggagagggacttattcccaccngcactatgcaggacaccaacactgagcatctcctgggagccagggaggtggcaaacccta

SEQ ID NO: 9912 - DNA, 121 bp, Artificial Sequence
  Synthesized
  misc_feature (61): n=t or g
ggctttcaagcatcttcaaacagagcggggtcttgtagtggccccatgtgttttgaaggangtttctgcccctgactcatccagcagagaaagcaggaaagggtaatgcttcccagcacct

SEQ ID NO: 9913 - DNA, 121 bp, Artificial Sequence
  Synthesized
  misc_feature (61): n=c or g
tgcaggtgtgagaacagaaagaggggtataccatcagcaaatctctgcatcttggttgggnttctcactgtcagccattgtgacagcaatgccaacactgccccaagcccttgacatagaa

SEQ ID NO: 9914 - DNA, 121 bp, Artificial Sequence
  Synthesized
  misc_feature (61): n=t or g
aagccacacgctacaaacccacattactaatttatctggactaaaaggaatgcatctctangaaaaggacatgaccagcagccagtagatgcatggattaggaggagtgcccgttccatac

SEQ ID NO: 9915 - DNA, 121 bp, Artificial Sequence
  Synthesized
  misc_feature (61): n=a or g
tgacccagtttcttctcagcttccaaacctatatttgcataatattctcaaattctattgncagaggcttcaaggtaaaggaagaacaagatataaagtgtatctgaaacttataaaagat

SEQ ID NO: 9916 - DNA, 121 bp, Artificial Sequence
  Synthesized
  misc_feature (61): n=t or c
aaacactgaccgttgtagcacaaggggtaatcattgtgttctccattaccagcaacactgnagaactgttaccagtaatgatacccatcacagaacactgtagctgggtgatttaaaggag

SEQ ID NO: 9917 - DNA, 121 bp, Artificial Sequence
  Synthesized
  misc_feature (61): n=t or c
gcatcagtgccacatacattgtgaacgtgtacggtggttttcaaaattcctgtcactgttnctactttaacagaaaaattccatctgtaggtggaggcctttgtttttgccacctagagcc

SEQ ID NO: 9918 - DNA, 121 bp, Artificial Sequence
  Synthesized
  misc_feature (61): n=a or g
ttgttttagatgtagaatactgaagtatttattagcaattagagagcaccttgaagtagcncaatctcacatgtaagcacatcattctttaaaaaaatacaaatatagcttaattatttaa

SEQ ID NO: 9919 - DNA, 121 bp, Artificial Sequence
  Synthesized
  misc_feature (61): n=t or c
attcctctatatcttctctaagtctctgtggagactaaagtagaaatcacttatttgcggntgagaaaatagcatggactgctgcattaaattttaaataaactctgctcacaagatgata

SEQ ID NO: 9920 - DNA, 121 bp, Artificial Sequence
  Synthesized
  misc_feature (61): n=a or g
actcttaacaaccctctgctaaatcacgtccctttgttctaatatgaaataagctgtgctntaagaagtcttctaagctttttggatttctaatgtgggataaggttcaggaaaacagtta

SEQ ID NO: 9921 - DNA, 121 bp, Artificial Sequence
  Synthesized
  misc_feature (61): n=a or g
aatcaagacctacaatttcacaattccacacaaaaataaattagactttacgtcattctcntgatgagaaatacaagttctgaacaacttcactaacatctgagcccaaacagatcttcac

SEQ ID NO: 9922 - DNA, 121 bp, Artificial Sequence
  Synthesized
  misc_feature (61): n=a or t
ttgcatttcttctgtcagcagcacctgtgtgcatactgtgaggtgaaaatttgttcttagnagattaataaatcttctgtcagctgtgtcactcccctcccacagctcgtgtccagctgcc

SEQ ID NO: 9923 - DNA, 121 bp, Artificial Sequence
  Synthesized
  misc_feature (61): n=a or g
agttgtctgccttcctgtccatttatctctgcattcagatgggtcctacaacacggctacntaagttccaatctctcaaagacccttcctttttttgctcattgttgccatttcattacta

SEQ ID NO: 9924 - DNA, 121 bp, Artificial Sequence
  Synthesized
  misc_feature (61): n=a or g
gcttatgtttctaaagacattttttgagattgccggaccaaacttccctcaactgtctctntgctgaacccataaactcacattctagccaaacacaactgctgtaaaaagcatccattct

SEQ ID NO: 9925 - DNA, 121 bp, Artificial Sequence
  Synthesized
  misc_feature (61): n=t or c
tggatgtgagaagattgttgttgtatgactgcatgtatcagcacaaggaacaagatcttanccactagtgccggcttagagcaaggcccagagcctcctgtgtgtgtgcatgtaaagaagg

SEQ ID NO: 9926 - DNA, 121 bp, Artificial Sequence
  Synthesized
  misc_feature (61): n=t or c
actgtaagtacgtgttctgccacacgttcagcttactcctctatctgcaaagacttcacangttgactcgttttcaagagatgtctcacagttgtacagaacagtagatgtgtggtcaggt

SEQ ID NO: 9927 - DNA, 121 bp, Artificial Sequence
  Synthesized
  misc_feature (61): n=t or c
gatcattttattaccactccctctctttcctaatccatttattacttctgaactttagcanctatagtctcaaaccacttctcaagaaaagggcaaaagataatcatatgaaaactaaacc

SEQ ID NO: 9928 - DNA, 121 bp, Artificial Sequence
  Synthesized
  misc_feature (61): n=t or c
ttattttcaaactccataaatgttgcctgaagatcttatgcagtgcagacagcagaggcangcattttcttagctggacaattttgactgtaatttatttaggcacaaagcaatacacaca

SEQ ID NO: 9929 - DNA, 121 bp, Artificial Sequence
  Synthesized
  misc_feature (61): n=t or c
aaaaagctttcatttctacttcacagaagtacctcggtgaaaatcatagagaaagcaacangtcaatgggcccaaagtggtgtgcttcatggcctggaagggttgtagcctcctcacacag

SEQ ID NO: 9930 - DNA, 121 bp, Artificial Sequence
  Synthesized
  misc_feature (61): n=c or g
tttactaccgacaaactccagaagaagattttgaagttctctgggcccgtttgtcaggttncatagcggtacataaattatccaagctcagccagaacagacacagactttccaggaagga

SEQ ID NO: 9931 - DNA, 121 bp, Artificial Sequence
  Synthesized
  misc_feature (61): n=t or c
gaaagtgtctcatgctcatgtattgccaaggagagtcctttatgcagtcctttatccacantttactgccacaagaagatgctcgctcaggtgctggatttatctagtactaagctgtaac

SEQ ID NO: 9932 - DNA, 121 bp, Artificial Sequence
  Synthesized
  misc_feature (61): n=t or c
tactcttgataaaaataaagatctgaaggagagtctccctgaagatattgtcatcttccantttttgatatagatggctttatttcaatttcctttttttttttttttgttttttgttttt

SEQ ID NO: 9933 - DNA, 121 bp, Artificial Sequence
  Synthesized
  misc_feature (61): n=t or g
aagtgttaatatacctagcgttctctgacagtcttattctttgttttttggaatagaacanttgtttgacaaaatatatggccatctttattgtgaatgctaagtcacatgcttctcctta

SEQ ID NO: 9934 - DNA, 121 bp, Artificial Sequence
  Synthesized
  misc_feature (61): n=t or g
gagagccttgtgcttggctggtgtggcaagctcctgaaggagctccgtagccacagcaatnttgttggttgtgtttgtctgagggctgggtagtctgatacctgctaagtaagttgcctcg

SEQ ID NO: 9935 - DNA, 121 bp, Artificial Sequence
  Synthesized
  misc_feature (61): n=t or c
acagagtacttcactgccttcttctgtttaggttgtggctgataccaacatcagtgccatngctacccaattggagagcatgtctgcaggatgtaacgtcaactcttcttctgagcatgct

SEQ ID NO: 9936 - DNA, 121 bp, Artificial Sequence
  Synthesized
  misc_feature (61): n=t or c
acaaatctagccccaaaaaatgcaataaacatgcacacatatacccagagcacataagagntggactaagaccacaccagatgctttgcactaatctgcctccactcactggaaagccact

SEQ ID NO: 9937 - DNA, 121 bp, Artificial Sequence
  Synthesized
  misc_feature (61): n=t or c
ccattaagacaaagccaacccatctttaagatgcactgtaagaagattacagctattgaangttataatgtaaactgaaaagcctgccaggctccagctagtggtgtacagtaaaagtgat

SEQ ID NO: 9938 - DNA, 121 bp, Artificial Sequence
  Synthesized
  misc_feature (61): n=a or g
tgaatagactctatgaaaatgtgcggctgtgactacagacatatcccccttcacagcggtnttctgctgcttccccctgaccacatctgtcaccctgaagcccaaccttatttacggcagt

SEQ ID NO: 9939 - DNA, 121 bp, Artificial Sequence
  Synthesized
  misc_feature (61): n=t or c
acttgtttgtttgcatctgtgcccacctacgggcacctggggcattgtgcttaggaagctnctctgcagagtttgcagcatccagtctttcctacagcaaatgctgtggagcacagctctg

SEQ ID NO: 9940 - DNA, 121 bp, Artificial Sequence
  Synthesized
  misc_feature (61): n=t or c
gttccatcaggtatttataggactgtagagaaaagtaggaggagggtgagtcctcgtgcantctggagtgatttctgcctgtgtcaggtcatggcattcgtccttgttccaacttgctggg

SEQ ID NO: 9941 - DNA, 121 bp, Artificial Sequence
  Synthesized
  misc_feature (61): n=a or g
gaggatccttctacccatactctagctttgcctgctttcagcaaatagtggcactttcacntattatgggcacgaagtgggtagggtttgttttattcctggcatgaaattcatcactgat

SEQ ID NO: 9942 - DNA, 121 bp, Artificial Sequence
  Synthesized
  misc_feature (61): n=a or g
agagctgctgagctcacatgctggggataagtgatcagtgctgctctgggaaggagttccntgcaggagattcaaagcacagtgcttgtcccatgaacatagttcggtgtagggcagcaaa

SEQ ID NO: 9943 - DNA, 121 bp, Artificial Sequence
  Synthesized
  misc_feature (61): n=t or c
agcaaaatcctttgctactgtgttttccagtgggacccaccatgtaccccaaagcacaagnagtgcagtgaaagagaacctactcctacagggataattctgttgtgttggatgtgcaagg

SEQ ID NO: 9944 - DNA, 121 bp, Artificial Sequence
  Synthesized
  misc_feature (61): n=t or c
gctgatggttttgctgctgtgttattcagatgtgtgggaaaagcaccagctaaaggtgccngagccaaggtgctgagggccaaagagcagggaaacacatgtggccatgcaaaatggcagc

SEQ ID NO: 9945 - DNA, 121 bp, Artificial Sequence
  Synthesized
  misc_feature (61): n=t or c
tattgcttctttttttacaacaactaggcaaacatcaataatttagtctgatctatagcanaggaaaggtaattaacaggaatttgctggcccattaagaatgtatgaacagaggctgtct

SEQ ID NO: 9946 - DNA, 121 bp, Artificial Sequence
  Synthesized
  misc_feature (61): n=t or c
ttgtgaattgagtacaaaatgtcggacaaagtggactggatttgtcagctctttcagttanggcatcaatcagttatgctgttctctacctaaatatagaaaaagatactatcacagaaag

SEQ ID NO: 9947 - DNA, 121 bp, Artificial Sequence
  Synthesized
  misc_feature (61): n=a or g
gtccctattcttcttttgctttaaatcattctgtacttgactgttaagcatccttttaggngccttcactcttttctcttggttgtgtttcccacacaaacttgcatctctatgttctcag

SEQ ID NO: 9948 - DNA, 121 bp, Artificial Sequence
  Synthesized
  misc_feature (61): n=a or g
tcgcctgcagaggtaaaggcaggacagtgggcatcagatggtgaattgccttgttcttacnctgtaggaaccctgtgttcacaaaccaccattcactctttagattacttcactcaataat

SEQ ID NO: 9949 - DNA, 121 bp, Artificial Sequence
  Synthesized
  misc_feature (61): n=a or g
acaggcatatgcaaggggcatgtttgcttgccaaacttcacagaggatgaagagggaggtntatgtatgtgtccagacattttgtgaacatgacgttgtttctatgaggttctgaggcata

SEQ ID NO: 9950 - DNA, 121 bp, Artificial Sequence
  Synthesized
  misc_feature (61): n=a or g
tcagaagtggaagtttgctggaggaaaagaaaaggccaccctgtaacattcattacatgtnagcagtttgctctggtgcgaggaaaaatgcacggcctctatcatggtcatggaatgaact

SEQ ID NO: 9951 - DNA, 121 bp, Artificial Sequence
  Synthesized
  misc_feature (61): n=a or g
aggtgatgctgggtgctcagatgcaagctagccaagatgtgggtaagcaggaggagcccanggtgtcaaaccaccatgctgggcagctcttcagctggcacagctcagcttagctccagag

SEQ ID NO: 9952 - DNA, 121 bp, Artificial Sequence
  Synthesized
  misc_feature (61): n=a or g
aatgatgctgtccctcaaagcagtgccagtggtgaaggcagagcagtttgaggcccgaagncacacacagccccacagcagttggagtctaatataagtacagaagcatcctttccttttc

SEQ ID NO: 9953 - DNA, 121 bp, Artificial Sequence
  Synthesized
  misc_feature (61): n=c or g
aagagtggaaagatgatcttaaagtaggaatccttattgaaaggtatggtgaacacatttnataagacctatctattttaattaaaagatgatattttcctttcccgttagttttacagac

SEQ ID NO: 9954 - DNA, 121 bp, Artificial Sequence
  Synthesized
  misc_feature (61): n=t or c
tggttttaaggaactataatgatattggctaggcatcaagtacaaaaagttaacttggcantgctaaggtatagtcccctctgtcagatagcaaatggacagctttttacttcacagatgt

SEQ ID NO: 9955 - DNA, 121 bp, Artificial Sequence
  Synthesized
  misc_feature (61): n=a or g
cccagcaaaaataccagcctctgagtctgtactgacttatacatgtagctaaacctaagcntgttacatagctcgctcttaagtgtttgcataattaaaacttagggttttttttcctcaa

SEQ ID NO: 9956 - DNA, 121 bp, Artificial Sequence
  Synthesized
  misc_feature (61): n=t or c
tgtgagcagccaccccagaagtttcatgagctgcatcgaggtactcagtgacataatccanactggcagatttctcattctcgtgctgtctaggtcaagctgctcactaagcttagggcaa

SEQ ID NO: 9957 - DNA, 121 bp, Artificial Sequence
  Synthesized
  misc_feature (61): n=t or c
agaactgtgcttctacccatctgtggaaatagttttctcacgatgttgctgcatattaatntcactgcagcttgtaacagcctgtttatcctgtttgctattgtctttgccattctgatga

SEQ ID NO: 9958 - DNA, 121 bp, Artificial Sequence
  Synthesized
  misc_feature (61): n=t or c
aactcatattcagcactaccttattctgcacctaattttaggatggtaaatttgtcagagngctctaattgaggagcagaagacaccagttccatgtaattctttaaaagacccagaacaa

SEQ ID NO: 9959 - DNA, 121 bp, Artificial Sequence
  Synthesized
  misc_feature (61): n=c or g
aaacccaagtatagaactgttagcaaagcaatacatagtgctgtgaagctcataatatagnaagttacttacgctggtggactgtctccacaatacttcccaattcttttagcatcgttga

SEQ ID NO: 9960 - DNA, 121 bp, Artificial Sequence
  Synthesized
  misc_feature (61): n=a or g
gcgatccgtgggtgttcaagctctgacaccagtctggctatgctgtagcctcgaggctacntggtgtgtgtggacattttctaccacagttagctggctctgatagcatcacgttagtcag

SEQ ID NO: 9961 - DNA, 121 bp, Artificial Sequence
  Synthesized
  misc_feature (61): n=a or t
aacagatcattgtttgtttctgcttcagtgctttctctccaatcttcattgtcagcattgncatatgttctactgtaatatagatttccctaaacttatttgatatttagagatatggggt

SEQ ID NO: 9962 - DNA, 121 bp, Artificial Sequence
  Synthesized
  misc_feature (61): n=a or t
tgacactctgttatggagaggagatgttgatgaccaaaaatgaattcttccttcttttctnttggctggtgggctgatggatcaattattcccacagctctaattatagttcatagaatgt

SEQ ID NO: 9963 - DNA, 121 bp, Artificial Sequence
  Synthesized
  misc_feature (61): n=a or g
aagatggtatcaaaaaaatccagacctgattaaggtaacacggctttactacctgtcggtntcccctctgtttggcatatgtgggctgtaatgttcttcctttcattgcgcaaaacacagt

SEQ ID NO: 9964 - DNA, 121 bp, Artificial Sequence
  Synthesized
  misc_feature (61): n=t or c
ctctaaaacctgcttaaaccttgtgctgttgagcaagagaaagatctcaatgtcactttcntattattggtcaacatatgactaagctgtatgtttgcagtgataataggtgtaatataaa

SEQ ID NO: 9965 - DNA, 121 bp, Artificial Sequence
  Synthesized
  misc_feature (61): n=t or c
aatcctaagcctcctaaggtcaggtcttcagtgtccgggctcatcatgttaccagccactngggttgctctctgttagcactttctccccccactcaccagcaggagcttgtagatatgtt

SEQ ID NO: 9966 - DNA, 121 bp, Artificial Sequence
  Synthesized
  misc_feature (61): n=a or c
tcacagtaggatgtgtacacaggacttacatggataaaatgttcgtaatctacttctgcantgatcagatgaagacttgtagtccgtcacaggagccgtagcccaggatgccattcctcct

SEQ ID NO: 9967 - DNA, 121 bp, Artificial Sequence
  Synthesized
  misc_feature (61): n=t or c
ggcactggggctgcagatttggctttgtggcccagagacacaggcctaagctgaacacagngtcttccaaccttggtgcccattggtttctttagttgtattggtgaattaatgcaaaatt

SEQ ID NO: 9968 - DNA, 121 bp, Artificial Sequence
  Synthesized
  misc_feature (61): n=t or c
gcatgaatcatgcaccaggcgtgatggtgatagagagactgggaactagcacagccacacngtcgttgttgtgaagtagattttctacttaatgacactcactggtagtaaataggagaac

SEQ ID NO: 9969 - DNA, 121 bp, Artificial Sequence
  Synthesized
  misc_feature (61): n=a or g
gctgaatcagctagaagccgaacagcagcaaaatgtgttccttcttaccataagcttacancataacttcagaatacataacacaagcagacaggcaccactgaggcttccaaccacagaa

SEQ ID NO: 9970 - DNA, 121 bp, Artificial Sequence
  Synthesized
  misc_feature (61): n=a or g
caaggtttgccctcgttctcagtgcctgagctcagagaaacagggcaggatgtgcagagcngttctgctccaacacttcaggaactatttctgagacggtcaagtgcccaaacacgggtga

SEQ ID NO: 9971 - DNA, 121 bp, Artificial Sequence
  Synthesized
  misc_feature (61): n=a or g
gtcaatttacattcccaaaaatcagagcagaaacaggcacagcagactgattatatccagntggtaaagttgaagattttggacttgtgaagagataaggattttgccaatatttaagctt

SEQ ID NO: 9972 - DNA, 121 bp, Artificial Sequence
  Synthesized
  misc_feature (61): n=a or g
caccacctggcaccaatatgttttcaggtgctggccctccaactgtaaaggccaaatcatnacatctgttaatgcaatgcaggtctggagtaactccagagatctgaatctgcaacccaca

SEQ ID NO: 9973 - DNA, 121 bp, Artificial Sequence
  Synthesized
  misc_feature (61): n=t or c
gaaggagaaaggtatgattttaacacctatcctacattcttgtagtcttacgtttgggctntgatagtcagatagagacgaactgcagcttcattttctatcttatttctagggagattaa

SEQ ID NO: 9974 - DNA, 121 bp, Artificial Sequence
  Synthesized
  misc_feature (61): n=t or c
ctgccctcgctctctttgatacacatactgcataagtctcagctgcttacaaacacagagncagtgacctgtgaaaatgtttctgattcttcaaacatgagctctgtttccccagccccta

SEQ ID NO: 9975 - DNA, 121 bp, Artificial Sequence
  Synthesized
  misc_feature (61): n=t or c
gatcctcatgaaagttttgtattactagatctacctgatctactcccaccatttcataaanactatttgttttctcttccattttttcaaatcaatttcttcttatcattctttttcactg

SEQ ID NO: 9976 - DNA, 121 bp, Artificial Sequence
  Synthesized
  misc_feature (61): n=t or c
tatcacaggttgccactcacttagcacctttgcacctgcttgtgttaaactcttatgatanataggctgcataatcattgcagttttggagactctacaactgtaactatttcaatttcgt

SEQ ID NO: 9977 - DNA, 121 bp, Artificial Sequence
  Synthesized
  misc_feature (61): n=a or t
gtcttctatccgtaggagaagggactacatgtaatgagtttattgagatagataccagaanagccttttagttgaagcactgaacttgatcgctacatctccatcgctacagattgttgta

SEQ ID NO: 9978 - DNA, 121 bp, Artificial Sequence
  Synthesized
  misc_feature (61): n=t or c
ttaattaatgtcaaatatctttaccagtaaattctttgtccgtgaatctagaccaggaaanaggagatctgaaagaccaaaaagcaagtcaactataaaatcatagaatagtttgggctgg

SEQ ID NO: 9979 - DNA, 121 bp, Artificial Sequence
  Synthesized
  misc_feature (61): n=t or c
agaggtgagttccttgcacagctgcagctcgcagtgatcacagtagcctctcacatcctgngagggcagcacactgggtatacccagatgtaaaggagatgaaaaacaaaatctgaaacaa

SEQ ID NO: 9980 - DNA, 121 bp, Artificial Sequence
  Synthesized
  misc_feature (61): n=t or g
ttcatgaaacattgtcttatgtgaactccaaagcaaaaataacattgaactaaaatacatntaccagacaagctgccatatgcatttgcgtgtcagtaagatcatgttttggcaattaatt

SEQ ID NO: 9981 - DNA, 121 bp, Artificial Sequence
  Synthesized
  misc_feature (61): n=t or c
ctgagcactcatggttctactgcacagtcacactggtggtaaagcttttactttgtgctgnagtggattggggccattcacaacctaaggtacggctgaggtcatttcttcctgaatgcca

SEQ ID NO: 9982 - DNA, 121 bp, Artificial Sequence
  Synthesized
  misc_feature (61): n=t or c
cttggctagccagaacctgaaactggatgcttctctgtggcacacacttagtggaaaaggnatcaaaaggtgattgaaggaccgtcttcacaacataaaacaaatatttattcactctgtt

SEQ ID NO: 9983 - DNA, 121 bp, Artificial Sequence
  Synthesized
  misc_feature (61): n=c or g
gaaactgcaacctcacaggaagaggaggagcagtcaggcaagattaatctgccactggagnaagagctctagtagtaacaatgccctataagagtacactataagcctcaagtctttttac

SEQ ID NO: 9984 - DNA, 121 bp, Artificial Sequence
  Synthesized
  misc_feature (61): n=t or c
aggaaacaatatttactggctagaaagtaaggagcaaggatcagctgtactgagattgtgnctggtcagtagttggttgagaatgagtttgaacagcattattgacctaagtgggaagaaa

SEQ ID NO: 9985 - DNA, 121 bp, Artificial Sequence
  Synthesized
  misc_feature (61): n=a or g
tgaatgtccatgcacagagttttgtgcctctgatgtagacatcaccctcatgttacctggncaggacctgtgtgagggacaactgcacacctcagctctgtgattcctggatctaggacaa

SEQ ID NO: 9986 - DNA, 121 bp, Artificial Sequence
  Synthesized
  misc_feature (61): n=a or t
cgtagattcagctttctcacgccacgcatcatagcaaactcagagaataggatctagaagncaaattgggctattctccttatcaccaccagtgccacttctctgttggcccaaagcaata

SEQ ID NO: 9987 - DNA, 121 bp, Artificial Sequence
  Synthesized
  misc_feature (61): n=a or g
cagcagtacgtgttgctataaaaacaggaaagagccgcagaaccaaaaccagttctgagantgtgataaggaccaggtcttctgccacagccaagggctggtgggacatctcaaatgctcc

SEQ ID NO: 9988 - DNA, 121 bp, Artificial Sequence
  Synthesized
  misc_feature (61): n=a or g
tgcaggagggcacccacatccttcaaaacatcctttttgtaggtcaggaagataacatcanttgaatgccttacagaacaggctctgatgcgcagctaagcatcctaaatgatactagtgc

SEQ ID NO: 9989 - DNA, 121 bp, Artificial Sequence
  Synthesized
  misc_feature (61): n=c or g
tcaggtgctgttactactcaggctggaaagataactatgctaagccaaatacacacctacnagaaatgttgcaaaataatgtgttgtttttacaccaatgacacatttcttttgatataga

SEQ ID NO: 9990 - DNA, 121 bp, Artificial Sequence
  Synthesized
  misc_feature (61): n=t or c
atggtttttaacgatgcttgtagcaatcatggccaaggagctgagcccttccaagcccaanttcagccagctgtgctgcaggtactcaagtacctgagagcagcagggctgtcactacctg

SEQ ID NO: 9991 - DNA, 121 bp, Artificial Sequence
  Synthesized
  misc_feature (61): n=a or c
tataacccagaagcaatgggaggacaccagaactatcatctcatcctccgattattccgcntgtttcatttcgtcttactcatattgaaataaaccgttgtatctctgagccaccagataa

SEQ ID NO: 9992 - DNA, 121 bp, Artificial Sequence
  Synthesized
  misc_feature (61): n=t or c
ttgagaaaaatcaagaaagtaattacttggcttggtcattaattactcactactggacatnttcgagagtgtagtatgaaaagcctgaggcagctattaagggtagctctaatgctattga

SEQ ID NO: 9993 - DNA, 121 bp, Artificial Sequence
  Synthesized
  misc_feature (61): n=t or c
actgcatgtgctgaacatgttgggttttgtccaaaaaaaaccctgaataccagagttcagngagaagcagtttgcagaagtttgggaagaccttcagtgctgtactatctggaactgagtg

SEQ ID NO: 9994 - DNA, 121 bp, Artificial Sequence
  Synthesized
  misc_feature (61): n=t or g
agcaagttgtcactactcctctataaattgtttgctaaatagtgcaaaagcacttggtgcnggacagacttatagccccaaggcgatccaggatacacacaaactctaaaattcatctttc

SEQ ID NO: 9995 - DNA, 121 bp, Artificial Sequence
  Synthesized
  misc_feature (61): n=a or g
catccagctaaaacgaaagagcaaagaaccaacgatggtaagaatatttacacagctcctncttctggtgaccatgctggattgctgggtttacaaagcaacaagcatgttcacattctct

SEQ ID NO: 9996 - DNA, 121 bp, Artificial Sequence
  Synthesized
  misc_feature (61): n=a or c
attcttccatatgcttctgagacacgttgaagctctgtagatagaaggtcactggtggtgncaacagccgtgccctttcaatgtctatatagactcacacattaaactgaaagctcaaaga

SEQ ID NO: 9997 - DNA, 121 bp, Artificial Sequence
  Synthesized
  misc_feature (61): n=a or g
tgatagtgcttgtcacaggaggagcatcagacaccctgcacagcattgcagtggcagtacncaaaagcacactgaggagcaccctagctagcaggggactaaccatctgaatgatgataaa

SEQ ID NO: 9998 - DNA, 121 bp, Artificial Sequence
  Synthesized
  misc_feature (61): n=a or g
agcaagaatcaatctctaaaacattcagcaatttgttatatcaatatcttaacatggtganttccttacagcatataagaattaaatccatctctgacaagtaaatagaaggcagaatttt

SEQ ID NO: 9999 - DNA, 121 bp, Artificial Sequence
  Synthesized
  misc_feature (61): n=t or c
tttacattaacaaaaataggattagatctaatgtctaaaaggaatgagaaaatagcatttnctacacattagaaatgaattatttttatgcagctagtacttgccattgagtctttgctcc

SEQ ID NO: 10000 - DNA, 121 bp, Artificial Sequence
  Synthesized
  misc_feature (61): n=t or c
gctgttaacacattacacgtactaggtgttccttctgattataaccaaggaaatacaaagnatgtatttgtgaacacacacctgcttcaagacagcaccaacagcactgtagaagtatccc

SEQ ID NO: 10001 - DNA, 121 bp, Artificial Sequence
  Synthesized
  misc_feature (61): n=t or c
caaactgaacacatcattcttttacaaggttaccctgagatcacacgaagatcttttcacntgtgagtatttaagttggcaaagtgtcaccctcactccctgcccaactccatctgttaaa

SEQ ID NO: 10002 - DNA, 121 bp, Artificial Sequence
  Synthesized
  misc_feature (61): n=c or g
taaaatgccaataacacattacaagcagtatttcttcaagagtcaccttctttccacattntataacaaccacctcatagctggcaacaatacctgtggacagggaaagcagaactaatgt

SEQ ID NO: 10003 - DNA, 121 bp, Artificial Sequence
  Synthesized
  misc_feature (61): n=t or c
tggcccagcaacataactcccacccagtacaagctcctgagatcaagctatgatccaccancacagcgatgtgaatgcggtatcactgccactttagcctgcatatggtgcacaacaagta

SEQ ID NO: 10004 - DNA, 121 bp, Artificial Sequence
  Synthesized
  misc_feature (61): n=a or g
taaaaatcccatttgtgatacttatcaaatgcaagcacatgaatggccacataatgtcagntgtctctagccttacctggcttaaagagagaggtaggttagaatttgtttcacttcagtc

SEQ ID NO: 10005 - DNA, 121 bp, Artificial Sequence
  Synthesized
  misc_feature (61): n=t or c
cagactgaatatagaaataagcactcaaatatgtaggacaggtaggcaaagtccaatattntgacagaagcacaactattttgtgcatgacttcagccatcataatatgaaaaaaatagtt

SEQ ID NO: 10006 - DNA, 121 bp, Artificial Sequence
  Synthesized
  misc_feature (61): n=c or g
tgacagcaacagcaataaactgtgtttgggcaggagccacatatcttcaccacttaccggntgttgtgagggtgtggaggaggtggagagtagaccaggagattcctggctgcggaagggt

SEQ ID NO: 10007 - DNA, 121 bp, Artificial Sequence
  Synthesized
  misc_feature (61): n=t or c
taaatttaaaaacaacagagagtttaaggaagcacactttaaagttcagaggagaagcaangggagagaagatagaaggaggagaaacctctgtatccagcagagaggggaaaaaagtcca

SEQ ID NO: 10008 - DNA, 121 bp, Artificial Sequence
  Synthesized
  misc_feature (61): n=t or c
tgtctgtttggagcatggcctcaaaaggccacgaggtgagtcactgggactgagtctgttntggggaggtgattactaaggcaagagcaatgctggcagaaaggaggtaacatgaaaattg

SEQ ID NO: 10009 - DNA, 121 bp, Artificial Sequence
  Synthesized
  misc_feature (61): n=a or g
aagcagtggtatggcccctgcaggctgctgaaatggctcctgcctggtggcagatgggganagagcttggttttattaggccattccagaaggcatttcattttttggatgaggaggcagt

SEQ ID NO: 10010 - DNA, 121 bp, Artificial Sequence
  Synthesized
  misc_feature (61): n=a or t
ctttaatcttggaagttggtattactcagatactggataaataatggatcccaggagtaanctatcggaacttccctttgtttagtttctctgaaagagcattcctggttctcactagagg

SEQ ID NO: 10011 - DNA, 121 bp, Artificial Sequence
  Synthesized
  misc_feature (61): n=a or g
acagatgaaaagtgctgaaagcactcagaaacgtctgtctggatggattacaggtgatccntgagctgctccactgcggagaggtgcaatttttacgctgctaaagcagcggcatagaaaa

SEQ ID NO: 10012 - DNA, 121 bp, Artificial Sequence
  Synthesized
  misc_feature (61): n=a or g
ctttgcaggcttttgggtggtgagttttcagcagtgcccaaaaggtccctgaaatgtcacnttccccagcactgagttcaaaagcatcaagacttgcttggtacttgatattcagagcgtg

SEQ ID NO: 10013 - DNA, 121 bp, Artificial Sequence
  Synthesized
  misc_feature (61): n=t or c
ctataggggatgtgttgaagtgggaagagataatagccaaagtagaaataagctgattatntgcacagtgcagaatttcacataggtggatgtgtgagcttgtcttgggtcctcggtcata

SEQ ID NO: 10014 - DNA, 121 bp, Artificial Sequence
  Synthesized
  misc_feature (61): n=t or g
ctgccatagctctgtgtgcttttatgtgtgttccttaactgagcaactgtagtgaaagtcntcatgtagaaagttctgaagatcccacacaggggggaaaaaaaacagctgtcttgcattc

SEQ ID NO: 10015 - DNA, 121 bp, Artificial Sequence
  Synthesized
  misc_feature (61): n=t or c
tacagagaatgaggccatatctgggcacgaactgcttcctgtgtggatggcatggggtttnagggctttctctcataaatgaggaatgtctgctctgcccctttcctgctatactagaggc

SEQ ID NO: 10016 - DNA, 121 bp, Artificial Sequence
  Synthesized
  misc_feature (61): n=t or c
gttttaaggtcccttgttaggggcgatagttcaaaatgcaagctgtcagactctgggaagnatcctgtttattttaataaagtgcttcttttgtatgtgaaaagccaagaacgtaactgct

SEQ ID NO: 10017 - DNA, 121 bp, Artificial Sequence
  Synthesized
  misc_feature (61): n=t or c
tgaacagtttggcagattagtcattttcatgactgttcttgctgaaggactttgattctgntgtgggtgatcagtgagaatgcacaaactctcccacagaagaaacagatggggaagcatg

SEQ ID NO: 10018 - DNA, 121 bp, Artificial Sequence
  Synthesized
  misc_feature (61): n=c or g
gtgtggccctgttggactgtacctattctcctcctctgtgactgaagctggggaatagagnggcagcagcctcatggctctcacatcttttcctctgacccgtaattaaaacaatgactca

SEQ ID NO: 10019 - DNA, 121 bp, Artificial Sequence
  Synthesized
  misc_feature (61): n=a or g
ctctattcagtttatagcataagactttcacccctgattttggaaatagctttctagaacngcagtggctaattgcttttgagtgtttaaccatacactaatccaagattacatctctgga

SEQ ID NO: 10020 - DNA, 121 bp, Artificial Sequence
  Synthesized
  misc_feature (61): n=t or c
taggaaattgaggtctgttccctgtcaaaaaacctgatgtcccagtggtgtgtatagcagngggtcatgcagttacactgcactataacccagcagcccacaccagcagcgagcagcagcc

SEQ ID NO: 10021 - DNA, 121 bp, Artificial Sequence
  Synthesized
  misc_feature (61): n=a or c
tggtagaaaatcataagctcctggtggttacctctgaaaggttttctgtctgggttgttanataaaacaagttattctgaggatcaaatcaaaagagggagttgtctttgttacatataaa

SEQ ID NO: 10022 - DNA, 121 bp, Artificial Sequence
  Synthesized
  misc_feature (61): n=a or g
ttggaacaaagtttattccatgcctgtcttgtctcagccttctcgtgtgaccttggatacntcccctaactcatgacagttctcctcgctggtaatcaggatctgcaaatgtattgtgggt

SEQ ID NO: 10023 - DNA, 121 bp, Artificial Sequence
  Synthesized
  misc_feature (61): n=t or g
caagacaagataacagacgtattattgcaagttaaagctctcatacttgttgagcatgtangacaccaataacttgacacaaggttttcaaatgtgtgagagtgcagaatggaaacgtgct

SEQ ID NO: 10024 - DNA, 121 bp, Artificial Sequence
  Synthesized
  misc_feature (61): n=t or c
ttctaggaaagaagaatctatagccttcagaagctatgtatccacctccactcccatcagntttcctatcacccatcatcccccatctcccatcctctaaattaattttctatcattcagt

SEQ ID NO: 10025 - DNA, 121 bp, Artificial Sequence
  Synthesized
  misc_feature (61): n=t or c
tgctgaatacttcaccttttgcagtgtttacttctcttagtttttcgtttttctgttatantaagatgcacatggttaaaatatatattttaactgatcagatctagaatgtagtaagctc

SEQ ID NO: 10026 - DNA, 121 bp, Artificial Sequence
  Synthesized
  misc_feature (61): n=t or c
tcgtcccttcttctcaacttccttccccttctgagcccctgcgctgagaactgagggcaangctctctcctgctccctgaaggatccttgcgatggcagagggctgagagcagcatttctg

SEQ ID NO: 10027 - DNA, 121 bp, Artificial Sequence
  Synthesized
  misc_feature (61): n=t or c
aacagatagcagctggagtaacccagctttactgattgaaaagcccagtgtggtcgttagntcttacttgattccacttttgccagctattggccagtcttagcattttggaaggggagga

SEQ ID NO: 10028 - DNA, 121 bp, Artificial Sequence
  Synthesized
  misc_feature (61): n=a or g
cattgcagctgtgccccatccctggggtgcaaagtgaagttgccaggtgggctgtacaagnatgggaaggagaagggtgtgcacgatgggtttagggcacagagaaggggcctggccctgg

SEQ ID NO: 10029 - DNA, 121 bp, Artificial Sequence
  Synthesized
  misc_feature (61): n=t or g
acttatcttctcagaaggtatatctttgttcccagtatatctgtactcataaactgaaaanaggtgaacacgctttaggttgtataaattgttgcctaaaatcccatgcagcgtgcacaga

SEQ ID NO: 10030 - DNA, 121 bp, Artificial Sequence
  Synthesized
  misc_feature (61): n=a or c
tctcagctgtcctttgagaagggtacacttcagttagaaaaactactcttagggctgcatngggaagcaaactcagggagtcatgagaatatcaagaactcactcactgtgcagtgggtga

SEQ ID NO: 10031 - DNA, 121 bp, Artificial Sequence
  Synthesized
  misc_feature (61): n=t or c
tcctttgagccatcacgctcacattctgatttccagagtcacactgccttgttttaacctngtatgacttgaactggagatgctgcgcagcacagcttccactgagcgctgccagaggagc

SEQ ID NO: 10032 - DNA, 121 bp, Artificial Sequence
  Synthesized
  misc_feature (61): n=a or c
caaattgggtatcacatggttgaggaccatgtaagtattcagctaaatgtttaatgatacnaaatattgaaaactaactctcccttaggcagtaaaataggaggatgagaaagcttcctag

SEQ ID NO: 10033 - DNA, 121 bp, Artificial Sequence
  Synthesized
  misc_feature (61): n=a or g
ggatttcttttctgcagataaatggtaaattctatatgccagtgttttagtattctgtatnttctgtgtatggttctcccattggtctgctgggtagaacctctcaagtcagatacctctg

SEQ ID NO: 10034 - DNA, 121 bp, Artificial Sequence
  Synthesized
  misc_feature (61): n=c or g
tgcttctgaaagagcctttttggatagtactgtcttacctttaaatcattgagaaagctgnaagggttcctaagcagtcagggtcaaggtgtgagcagagcctgtgtacaggggttcactt

SEQ ID NO: 10035 - DNA, 121 bp, Artificial Sequence
  Synthesized
  misc_feature (61): n=a or g
actcaagacctgttaggatgacaagagatgaaaacagccggcccttcatgtggctgctgcnttagggctccaaacacacgtttcctgactgctgcacatctcagttgtatttgtcatctat

SEQ ID NO: 10036 - DNA, 121 bp, Artificial Sequence
  Synthesized
  misc_feature (61): n=a or g
tcacagaaacctaaaaattttatgtcctgtttcatcccttgcttacataagccaacacacnttatccacccttctgaaactgtttggataattacaaatccaaaactcaaaacctaaaaat

SEQ ID NO: 10037 - DNA, 121 bp, Artificial Sequence
  Synthesized
  misc_feature (61): n=t or g
ttatgataaagctatacattcagtctgaggtcaaatgcagtatgtgaatatccaaggcagntgagtaataaagaagcaactgagcaaggtttcccattttcctgctttaggatcatgtccc

SEQ ID NO: 10038 - DNA, 121 bp, Artificial Sequence
  Synthesized
  misc_feature (61): n=a or g
aaactgcagcggccacgcaccgctccgcaaacaaggaagaaaaaaagcattgccaggaacngctagccttgcctcatctttcccatatgcaaactgcacaaatgctgcgatggaggcacag

SEQ ID NO: 10039 - DNA, 121 bp, Artificial Sequence
  Synthesized
  misc_feature (61): n=a or g
agaggaaggccaacgatgtttcacttctgcttccctggcaagtggtgctctgcttctactnttctatttctaacaataaacaacgtggaatagcaatacaagtgaagctgaagcaagaggg

SEQ ID NO: 10040 - DNA, 121 bp, Artificial Sequence
  Synthesized
  misc_feature (61): n=a or g
cgcactcccccggagccccacacaccttcagaactgtgcttcacttccagatacccactcncatcactgggaagagggccactgtgaggccacaagcagcccggggaggagggctccgtca

SEQ ID NO: 10041 - DNA, 121 bp, Artificial Sequence
  Synthesized
  misc_feature (61): n=a or g
tcccagcagagctctgcagcctgagggccccaccaccaccacacagagggagcacacctcngccaaagcagcgcacctctaactctttctccagccctgcacaggacagcaggctgccaag

SEQ ID NO: 10042 - DNA, 121 bp, Artificial Sequence
  Synthesized
  misc_feature (61): n=a or g
ctaattgcagaatgacagacaatacctgatctggcagaaagcttggagagctttcagactntgaaattgtcaacccatttctttcagtgcacacttccaagagtgcttgctgtactgtatc

SEQ ID NO: 10043 - DNA, 121 bp, Artificial Sequence
  Synthesized
  misc_feature (61): n=t or g
aaaaaaaaaaaaaaaagcacttgcacacaagtcatccagaaactaaaaattatacgggganatttaaagttagaaacaagagtcccagcgtttcgagctggctgcagtcccctggcatggg

SEQ ID NO: 10044 - DNA, 121 bp, Artificial Sequence
  Synthesized
  misc_feature (61): n=a or g
cgtccattgcttgctggacagggcatgatggaatctgcctttggttttaggggtgtttgcncctttgtcctctgctcctgagtatgagtattgcaaggattaggctgacagagcggggtga

SEQ ID NO: 10045 - DNA, 121 bp, Artificial Sequence
  Synthesized
  misc_feature (61): n=c or g
ttttggtcttctatatggccagaatttcctgtgtttgactcagtgcccgctgcttcttgtnctgtcaccaggcagcgctggatttggctcccttttctttactccctgccatcaggtctat

SEQ ID NO: 10046 - DNA, 121 bp, Artificial Sequence
  Synthesized
  misc_feature (61): n=a or g
aggttcagctgaccagagagatcctcaaaaggaacatacaggtaagtaacttctggtgtcntggaggtttccttgtgttgcatttgatcccggtttgggagcctcggaggtctggtgagca

SEQ ID NO: 10047 - DNA, 121 bp, Artificial Sequence
  Synthesized
  misc_feature (61): n=t or c
gcttcccatcaactacaggcagtgacacaggcgtgctgatcgaccaataccgccgtaaggnggctgcaagttacctgaattcctccaagctgtgcaaagagcgtgacattcatctcaccga

SEQ ID NO: 10048 - DNA, 121 bp, Artificial Sequence
  Synthesized
  misc_feature (61): n=a or t
ggaaggcaaacacaataaccaaagtctgcctcccgtcgttgagaagcttagtaagataggngccagaagacagcttacacagaggatgttcgtttgaaaatgaaacgaataggcaatagga

SEQ ID NO: 10049 - DNA, 121 bp, Artificial Sequence
  Synthesized
  misc_feature (61): n=t or g
ggcttctgtctcagagatctcctgggggaaaataggcagtgaatggaatcaaggaagcccnagatgacaagctgtggttccttgtgctgttcccagctaaacacacgctgcccaacttgga

SEQ ID NO: 10050 - DNA, 121 bp, Artificial Sequence
  Synthesized
  misc_feature (61): n=t or c
ggggcagtcggtcctgcacagtctgtccaatagcacggactctgagcgtgtgctgtgctgngtaagggaagggcagccagggaggaaggactgtggtcctgatgggaactgggacagacat

SEQ ID NO: 10051 - DNA, 121 bp, Artificial Sequence
  Synthesized
  misc_feature (61): n=a or g
ctttgtactgcaaaggggaggccttgatagctgctttaagttctggtccctgcattggtcntcattctttatataccagtgctttactgactatttctccgtttcttctttcccctcagcg

SEQ ID NO: 10052 - DNA, 121 bp, Artificial Sequence
  Synthesized
  misc_feature (61): n=a or g
aaaccctctttttgtttcacagggaaaaccagacattcccaaactcattaccctatctccnggttttaacacaggttcatttttggtccccagtttgttaagcagtgtgtaggccagcttg

SEQ ID NO: 10053 - DNA, 121 bp, Artificial Sequence
  Synthesized
  misc_feature (61): n=t or c
ttgggaccgggcatggaaaagagcagcccccaaagcctgtcgtaatcctctgtgccaaaangagataagaaagcctcaaagctttattacaggtgagcttcccacgttgctgcttcctgct

SEQ ID NO: 10054 - DNA, 121 bp, Artificial Sequence
  Synthesized
  misc_feature (61): n=a or t
ttaataacagatctttttttacaattatcagacattgacttataccattttctggcccaanttgcagaggaggcaatctaaaaaatcatatagctagtcctccttttagttgccctgagat

SEQ ID NO: 10055 - DNA, 121 bp, Artificial Sequence
  Synthesized
  misc_feature (61): n=t or g
acacttcgctttgaaacacgaaaatccgccgtgcaatcctcctcaaattacagtcctccanccacacagtcgcagctttacataaaatacctatcactggaaggacttgctgtttcagtgg

SEQ ID NO: 10056 - DNA, 121 bp, Artificial Sequence
  Synthesized
  misc_feature (61): n=c or g
aacgctatcttcaagaaaattaacaaattgtgttctctgcagctgggaattgggtatgctncagccctgtccgttttcataagtggaaggggctggaaatccaaggaggctggtcctggga

SEQ ID NO: 10057 - DNA, 121 bp, Artificial Sequence
  Synthesized
  misc_feature (61): n=a or g
ctgaatgcctggattcagaaaggctgcatcagtcatacctccaggaaccgctagtaataanccataaatacaataatacaagggagctggaagaagattattacgaacaagggaaaactca

SEQ ID NO: 10058 - DNA, 121 bp, Artificial Sequence
  Synthesized
  misc_feature (61): n=t or g
atcagtgcctctaactctaatggaaaacgcagttctagacttcattgagtgttcctcagtnctgtgccctgtggggtcatgttcagccctatgaattacagctcagtctccaatgtagtgg

SEQ ID NO: 10059 - DNA, 121 bp, Artificial Sequence
  Synthesized
  misc_feature (61): n=t or c
tggaattgaagtgcaagcctgatacggaaaatattagttgaattatatgcatagggaagangtaagaattattctcctatttgccttagctggggctgccaagaatttagaggtattaatg

SEQ ID NO: 10060 - DNA, 121 bp, Artificial Sequence
  Synthesized
  misc_feature (61): n=a or t
tgctaaaggaggatgattcagatttcaattgcagatggagtttttcttttgtgcttatacngtaaatctagcccaagaaaatattttcaaaggctagaaataaacagagttcccttgcaat

SEQ ID NO: 10061 - DNA, 121 bp, Artificial Sequence
  Synthesized
  misc_feature (61): n=t or g
tatcactgggtgacacttctttcgtttaactgggagatatatcacattcaagaaagccttnctttgttttctacaagcgttttcactttgcactgttttgcaatttgacggaaggagttaa

SEQ ID NO: 10062 - DNA, 121 bp, Artificial Sequence
  Synthesized
  misc_feature (61): n=a or c
caaatgccaaagtgactgatgagctaactacagagcaggtcccagtgatacacagggaaanctttcaccattcctttgaaaaggaaaaccaaaatattcttctgccacagtccatttctct

SEQ ID NO: 10063 - DNA, 121 bp, Artificial Sequence
  Synthesized
  misc_feature (61): n=a or t
accagcacaacagcaaaaaactcctccctccttgaaagtcagacacacactatgcaacagngtagtggtagagcctgaagcgcaccaacctgtgtgtactcctatctcagctgccttttcc

SEQ ID NO: 10064 - DNA, 121 bp, Artificial Sequence
  Synthesized
  misc_feature (61): n=a or g
agaaataatgtccacactcttgagaggtcatcattgtccaggacagaagttgagggtcatntgcctacacatatgttggttggtagtaatctccatttgggcagagtaaccttgggcaggg

SEQ ID NO: 10065 - DNA, 121 bp, Artificial Sequence
  Synthesized
  misc_feature (61): n=a or t
acacattcatgaaacccaccagtagcaggatgattctcagcaacaccaccactgttaatanaactgtaagatacagatgatgtgctattaaaatctccataaaatatgacttatatactag

SEQ ID NO: 10066 - DNA, 121 bp, Artificial Sequence
  Synthesized
  misc_feature (61): n=t or c
tttatcatcaatactcagaccctggtttgtgacctctcctaacttagcagagcacagtggntccccttagacaacatataggatctttgtgttcactccagattctaaattcaggcgacga

SEQ ID NO: 10067 - DNA, 121 bp, Artificial Sequence
  Synthesized
  misc_feature (61): n=c or g
tagatgcataatatgaagtctcttgtgaagtgctatgaattgctttttctgtgtttggtcntatcatctaaaaaaatgcttgcatttttgagtaaaaactatcagaacattttctgccaac

SEQ ID NO: 10068 - DNA, 121 bp, Artificial Sequence
  Synthesized
  misc_feature (61): n=a or g
gggaatacaaccttacatttagaatccttatgaacactgttacttccaatttactccactntaactccagtgattttgaaggagttcctctgccataattctgaactcaggcagctgtgaa

SEQ ID NO: 10069 - DNA, 121 bp, Artificial Sequence
  Synthesized
  misc_feature (61): n=a or c
agcacaggcacagcctgtctgtagcagcccatgcccagagcagggacccacaagagcacantgatatctgtgtgtagataacagcctggctcatgggaacagggacctgacagcagctgcg

SEQ ID NO: 10070 - DNA, 121 bp, Artificial Sequence
  Synthesized
  misc_feature (61): n=t or c
tgcagtacattggcacacatattcattcttttccaagaactaattaacatatgctaatatncctctgggcatgtgcagatttagggtggtctcacatccacttactttatcctcacttttc

SEQ ID NO: 10071 - DNA, 121 bp, Artificial Sequence
  Synthesized
  misc_feature (61): n=a or g
gattctaattaagtctgttagaggttttacaggcaattacccccctttgttgtcacagcanctggttccttgggtgctttctggtaaggtaaatgagatataatttcttgggaatctttag

SEQ ID NO: 10072 - DNA, 121 bp, Artificial Sequence
  Synthesized
  misc_feature (61): n=t or c
tctgcaagtatcaaagaggacaagtgatgctcattcaccaacagtgaatttcaacagtcantgaaattctcaaggtgttcagctttattcctgcacagtgagtttagcagcttagagcacc

SEQ ID NO: 10073 - DNA, 121 bp, Artificial Sequence
  Synthesized
  misc_feature (61): n=t or c
tccttgcagacagggctctgtgagagaaccaagacactacagccactactacagctgtcanggtggcttaataaagtgagtttttgcctaactgttcatcccatggatggattcagcctct

SEQ ID NO: 10074 - DNA, 121 bp, Artificial Sequence
  Synthesized
  misc_feature (61): n=a or g
gcacgcagcggggtgagggaccgaagggcagggttcatcgtgttcctgcttatgggcttcncaaatgttcccggcatcaggcgagactctgcatgggaaacacagctcgtggccttccagc

SEQ ID NO: 10075 - DNA, 121 bp, Artificial Sequence
  Synthesized
  misc_feature (61): n=a or g
ctgtgcagctcaactcctcgcaagcactgtgaatacctcacatggttacctcctgggaccnccacaagtgacatcggtatgatgcaggatgtggcaaagacatgtgagtcaagcgcatggg

SEQ ID NO: 10076 - DNA, 121 bp, Artificial Sequence
  Synthesized
  misc_feature (61): n=a or g
gaacaaattaatatcacatcattttataagcaaacagactagatcaaaaggagtcgtaggnaaacccagccacacctctttcactgggagctgtcttgcttatgcaactctgaaaatctga

SEQ ID NO: 10077 - DNA, 121 bp, Artificial Sequence
  Synthesized
  misc_feature (61): n=t or c
ttaaagagtttttttaaaaggtctttttgctttaccaagaagcattacgtcctcaaatccngactttccagtgtggtcagtaaactgaaaaatcaattatttgcacggcactggtttgggg

SEQ ID NO: 10078 - DNA, 121 bp, Artificial Sequence
  Synthesized
  misc_feature (61): n=t or c
ttctctggtaaggattccagccctcttatgctttacacagcttgtgggcaggagctagccncagaaaaaaagctccagtagccaagcagggaacattttatacgaggaaaggggtcaaggg

SEQ ID NO: 10079 - DNA, 121 bp, Artificial Sequence
  Synthesized
  misc_feature (61): n=t or c
gatcaacttttgttaagaagtttgggcaaaaacaacagatacagctaagtggtttgggaancactgagactctaaaaatcatcctggcttaatgctattgaaacagatctcatgtttatgc

SEQ ID NO: 10080 - DNA, 121 bp, Artificial Sequence
  Synthesized
  misc_feature (61): n=t or c
agcaacagccgttgtgttgcttaaaaggatgctggggaaggtctccatccggtttgtttgngctaaaaagaacacaggaggagtcttcccctctcaagcattaaagcatctggaggacctg

SEQ ID NO: 10081 - DNA, 121 bp, Artificial Sequence
  Synthesized
  misc_feature (61): n=t or c
tgctcagagtgtttgcagagctgcagtgctcccggctcgcaacagccacagcaccaccctngtgctacctcagacgtttacccggactgctgctgcctctttaagaggaagaatgagcaca

SEQ ID NO: 10082 - DNA, 121 bp, Artificial Sequence
  Synthesized
  misc_feature (61): n=a or g
aaaggcaatcaaagtgcaacgctaattttcagctgcattacagtcacagaaagaagggaantaatgattccctaaagggaggagaagcacgcagcgaatcgaataacattgctgcagcaga

SEQ ID NO: 10083 - DNA, 121 bp, Artificial Sequence
  Synthesized
  misc_feature (61): n=a or g
ttccagcttggaaatagaggcaggatttgaccagagagctcgcaaccaaaggtggaggagnaatgcaacaggttgctgtagagggaggcaaaatgatgggacgaagcccctgcaaagggga

SEQ ID NO: 10084 - DNA, 121 bp, Artificial Sequence
  Synthesized
  misc_feature (61): n=t or c
gcagctcacctgggtggctttcctgcagcaactggcaccaaagtgattaaatgctcttctngttgagtgcctgcttctctttgtgtatatgtaagcaagtgaggcacagaagcaacataga

SEQ ID NO: 10085 - DNA, 121 bp, Artificial Sequence
  Synthesized
  misc_feature (61): n=a or g
actcagaccctaacactgaggaaaaaaaagtgcagtaaactacgagaagcttgacagtgcnttaagctgtgtagtatccccacatacatacttcctcctcaagcattggtgccttttttgg

SEQ ID NO: 10086 - DNA, 121 bp, Artificial Sequence
  Synthesized
  misc_feature (61): n=t or c
ccccaaagcagttgtttctcacccaagagccatcacgggcttcacagattgaaagagccgngtcgaacatctgtattaattacagagccctttcacgctgactttcggggcatgcacaggc

SEQ ID NO: 10087 - DNA, 121 bp, Artificial Sequence
  Synthesized
  misc_feature (61): n=t or c
gagctccacagtccctgcaatttgtagctgcatctctgcttcatcctcactgaattttcantgcagccccatcatatccccaatccattccctctacatccttatagaatccttattgcag

SEQ ID NO: 10088 - DNA, 121 bp, Artificial Sequence
  Synthesized
  misc_feature (61): n=a or g
cgtcacacccaccttaccatcctccatatgctgacaacagctgtattcagatgaaaatctngtcctgcgctcatagaggaagtcagcataacaattatgcatatccaaacaatgtaatcaa

SEQ ID NO: 10089 - DNA, 121 bp, Artificial Sequence
  Synthesized
  misc_feature (61): n=t or c
cggtgactacttcaatcagaagcagctgccggaccttccaagttgtggcccggttccctgnggtctcaagctgtgcacatgagccagcaccacagctgctgctcctccaccttacatttcc

SEQ ID NO: 10090 - DNA, 121 bp, Artificial Sequence
  Synthesized
  misc_feature (61): n=c or g
acttgtcacgggcaggaacaccgctggtttgtcattgtttttctctgccagctcgtcactnaccagctctagtgcctgacatgcaagtcttcaattcctgtgccagcttttgctcttctgg

SEQ ID NO: 10091 - DNA, 121 bp, Artificial Sequence
  Synthesized
  misc_feature (61): n=t or c
gcagcaacgttgccagcagttatcacagcccgataaaaatgaccttagagttcacactgcntcacagtgccaccactgagctgcggatgagggaggctttggagagccggagtaattagca

SEQ ID NO: 10092 - DNA, 121 bp, Artificial Sequence
  Synthesized
  misc_feature (61): n=a or g
ggccattctgcgatctctggttctgtgctcctatggctccgcaaaacaccatcacgtaccnctcgctttctcaggctgtgctttggccatctggctttgatctgtgagctgagctggctgt

SEQ ID NO: 10093 - DNA, 121 bp, Artificial Sequence
  Synthesized
  misc_feature (61): n=t or c
gcgaccctcgagccctaaagctgcactacaaaggtccggatggctcaatccttttccctgngccgtgtttcacacctttcacacctccctgcctacgaaagcgattcctctaacaaacaat

SEQ ID NO: 10094 - DNA, 121 bp, Artificial Sequence
  Synthesized
  misc_feature (61): n=a or t
ttctgaaatataaaacacatatttactcacatccaaatgttggttctggcaaggtatacanggtatctaagattgaattgtttgaaaaagatctttaaaattgcaaagatatttgactgta

SEQ ID NO: 10095 - DNA, 121 bp, Artificial Sequence
  Synthesized
  misc_feature (61): n=c or g
ttcttgaaagcactctgggagtttcctttctcttccatccatctgcttcttttctgacagncaagtgcaaaacaggcccaacagcagtagaagatatatttttgcctccactatttgggaa

SEQ ID NO: 10096 - DNA, 121 bp, Artificial Sequence
  Synthesized
  misc_feature (61): n=a or g
ctgtgtgaagcaagacacaaggagtaatgcaattaagtttaaacccgcctctctgatgacnttattgactctgtattaggtcatcatgtaaagatataagtagtgctatgcatacgaagtt

SEQ ID NO: 10097 - DNA, 121 bp, Artificial Sequence
  Synthesized
  misc_feature (61): n=t or c
gcctccctggtctgtaaccatctgtctgttctccttggtccttgcattcatttacgtgctntgttctgatgttggcagtgctggacgtcaatgaatacttcgaggtgcaatctttctttct

SEQ ID NO: 10098 - DNA, 121 bp, Artificial Sequence
  Synthesized
  misc_feature (61): n=a or g
tacaggaaaagcagtgctaggcctattaatacaattaattaccttgttctttttcccatcnacttcaaaaactgaaatggagcctttgcggtagatttcatcacccggtggatgtttccaa

SEQ ID NO: 10099 - DNA, 121 bp, Artificial Sequence
  Synthesized
  misc_feature (61): n=t or c
cgctcggaggcgaggctggagatgcctcaatcccgcttgcagctctgtgctcacagcagtnctcctttcctttgagactgacacatggaactgatgtgaaagagcaggtgcttaaatcaca

SEQ ID NO: 10100 - DNA, 121 bp, Artificial Sequence
  Synthesized
  misc_feature (61): n=t or c
ggagaaggagaaagtctgagaggtgcttcttctgatgtgtgtatatggaggtctatggtgntccaccttatccacttcagaggaaggtgcccttttccagctagaaagtgccctcagccgt

SEQ ID NO: 10101 - DNA, 121 bp, Artificial Sequence
  Synthesized
  misc_feature (61): n=a or g
ggtctgtctcaacgcatgcggtaatttaaaggccattattgcaccatttaataggctttcngccagtcacagcagaaatcagttcttgtgacagatttctcattaggaaataaacatactt

SEQ ID NO: 10102 - DNA, 121 bp, Artificial Sequence
  Synthesized
  misc_feature (61): n=c or g
ggtttgttcagagataccactcagctttcctgtgtacaggggggagaaggggaaacaccancatgtctcagcagcaggagtcagaaggagaaaaggccaggagaaggttgagtcatagcac

SEQ ID NO: 10103 - DNA, 121 bp, Artificial Sequence
  Synthesized
  misc_feature (61): n=a or g
gaaaaacagagatgtctttgaatcgttctatttttgcatggcgtttcaacatgtgttagcngcactgggcaacacataatgggacattgtaggcttactgagatgctgtgtcccagtggaa

SEQ ID NO: 10104 - DNA, 121 bp, Artificial Sequence
  Synthesized
  misc_feature (61): n=a or t
cctccacatctcaaagctgaataagtcaggatggtcgcatgtttccctggaggttaagccncatgaatccagagtcctctcttacttcatctgcatgagttctgctttggccagaatctaa

SEQ ID NO: 10105 - DNA, 121 bp, Artificial Sequence
  Synthesized
  misc_feature (61): n=c or g
cacccctgtagtttatttctttccctcattcacgtgctttcctaagatgtcttttgtcctncgtatttaaattacatgttgactctttgtattctctgagtggatgaattaaaccattatc

SEQ ID NO: 10106 - DNA, 121 bp, Artificial Sequence
  Synthesized
  misc_feature (61): n=a or g
tttgtcccagaatgagcaaagacaaacgttgaaacctttcagacatggatttgccacctcncacgcaggtcgacgggagattacatttcatctggcttcaggtagaggccaatctactaat

SEQ ID NO: 10107 - DNA, 121 bp, Artificial Sequence
  Synthesized
  misc_feature (61): n=a or g
aatgtatcagtgctgtgtggcgtgtgtgaaatcatactgtgacctgtgagttcaaaagacnaatctttaagaaactcacattttagcccagaatttccactattcggtgctttcagtcttg

SEQ ID NO: 10108 - DNA, 121 bp, Artificial Sequence
  Synthesized
  misc_feature (61): n=a or c
gctgggattgcaccactcatcaggcttggaaggtgcggaagctactcctaattccagcagnccccggttcttccagatccatggatgaaccacagggagtgcccacactacaggtaccccg

SEQ ID NO: 10109 - DNA, 121 bp, Artificial Sequence
  Synthesized
  misc_feature (61): n=t or c
gtgcaaagtgctttaggtgtatgaacacctctgtgtgtgcaaagtgcttggagtgtgcacnacacctctgggtgtgcaaagaatgctgtgtgtacaaagtgcactgggatacacaaagtgc

SEQ ID NO: 10110 - DNA, 121 bp, Artificial Sequence
  Synthesized
  misc_feature (61): n=t or c
ctgagagtctatggtgctctgctttgtacttactgcttaggtcgtggtgtgattatacttntgttacagtctgactaacagcaagtgtgtgtttcagtgggtacatatccaggaacatggt

SEQ ID NO: 10111 - DNA, 121 bp, Artificial Sequence
  Synthesized
  misc_feature (61): n=t or g
taccttctggtcttagtgccatgagcaatttgtggaggaggacttaaatttctcttgggtngaactggcaatctcaatctgtgggctcaggctcaaggtaacttaagacctcatgaacttt

SEQ ID NO: 10112 - DNA, 121 bp, Artificial Sequence
  Synthesized
  misc_feature (61): n=c or g
tgcagtgatcacctttcataataaatctagtaccctgattaaaatgttccatgctagcgtntgtactttcaacttcaaatgtttattttaaaacagattgtatgtaaaaggccaactttat

SEQ ID NO: 10113 - DNA, 121 bp, Artificial Sequence
  Synthesized
  misc_feature (61): n=a or g
cccagctgaaaagattaaaataaaaatcaagttctgcaagcaacagaggtgcacgtgatanagggagaggtcaaggtactccgaggaagaaataaaacacgccagagtttggaaggacatg

SEQ ID NO: 10114 - DNA, 121 bp, Artificial Sequence
  Synthesized
  misc_feature (61): n=a or g
ttgaaatccacagtaagttctgcctttccttccttctgtcctgcgaaccttcctgcagtgncagcaccaccctgggctgtgcagtgaccagccttgctggcaataccatcctcgctattcc

SEQ ID NO: 10115 - DNA, 121 bp, Artificial Sequence
  Synthesized
  misc_feature (61): n=a or g
acacagcaaaaggactctattaattttaaagaaatactccaaccatgaatttagtttccanttttgagaaagtcttgcttgtgggtaatataaaattcttacagttcttgtttaaatagta

SEQ ID NO: 10116 - DNA, 121 bp, Artificial Sequence
  Synthesized
  misc_feature (61): n=t or g
cttgggctggagctgtaaagtttcctaatatagttttggttaccgtgtcctgccttgagcnagtgggaaatgctcaagtcccagtggaagacacctgtttcttgctttgcctggggtttgg

SEQ ID NO: 10117 - DNA, 121 bp, Artificial Sequence
  Synthesized
  misc_feature (61): n=t or c
aatctccagcacagtttgagtggtgacgtctggtcgctctttgctgcagcatctctgatangcagtagctctgggtgtgagagctgccgctcgtcccctctattctcctagcacgtgccta

SEQ ID NO: 10118 - DNA, 121 bp, Artificial Sequence
  Synthesized
  misc_feature (61): n=t or c
tccataacatagctactctttgccaagttagctattcaatgctgtttcaattaataatcangaagatcctgatccagaagccctatctggatttagctgaggatgagaatacaacacagtc

SEQ ID NO: 10119 - DNA, 121 bp, Artificial Sequence
  Synthesized
  misc_feature (61): n=c or g
aggtgcctggattggtgcactgggggctgcatgtggggttctgtgactggaggtcctcagnagggtgagagtacagaattcctcctggagaagggtggatatgggcacaggtgtgcacggg

SEQ ID NO: 10120 - DNA, 121 bp, Artificial Sequence
  Synthesized
  misc_feature (61): n=t or c
gaaaagggaaaggagctgtaatgctcgcatggtttgaatgtgtgctcatgattggctcccncaaactggaagggacaagagctcaccctgataacagcagggaatctgagcaaggcctcca

SEQ ID NO: 10121 - DNA, 121 bp, Artificial Sequence
  Synthesized
  misc_feature (61): n=a or g
gtggtgttaagcataaaagtgatgctataatggatttatcttctttttaatggatgccacntcccactcgagaagcaagagaagggtgacctgatttgcaaatccccttggtttgagttag

SEQ ID NO: 10122 - DNA, 121 bp, Artificial Sequence
  Synthesized
  misc_feature (61): n=t or c
aatacttccacgcttgtattagcaaaccattttatagtaaacaatgatatgtaggcaattntgttcacagcaaatctaagctgatgatcctcgatacaaataacactcccttacaagagac

SEQ ID NO: 10123 - DNA, 121 bp, Artificial Sequence
  Synthesized
  misc_feature (61): n=t or c
gaaattgcctttcatgaatgcattctacaacagtaatcatgtcatctgtctgttttcttcnggataagtgtaacagagagaatcctgtaaatatctcatcttaatggatttctgtagcccc

SEQ ID NO: 10124 - DNA, 121 bp, Artificial Sequence
  Synthesized
  misc_feature (61): n=a or g
aatgccccaagagaatgtaagaaatcctcctgaaccatccaggaaccacccagcagagtcnaaggagcagaacattataggtaatacagcactgaaaacactgctgaggatttctacgacc

SEQ ID NO: 10125 - DNA, 121 bp, Artificial Sequence
  Synthesized
  misc_feature (61): n=t or c
tacagcctcatgaagggcccctcatgatttatgaacatggattactgcctgggcagggccncctctgtttcttgcaccaggtgtctttttaaacactgttcacagaaacacagcagacaat

SEQ ID NO: 10126 - DNA, 121 bp, Artificial Sequence
  Synthesized
  misc_feature (61): n=a or g
cgcctgcgagcctcgtccatagaagagctcacgtacatgaacacacatccgtccatacacncactacgtgcgcacatatggctgtttacattttatatttctatatttacacgggtacaca

SEQ ID NO: 10127 - DNA, 121 bp, Artificial Sequence
  Synthesized
  misc_feature (61): n=c or g
gacatttttataaatcatgatagggcatgaaataaatgctgaaggacaaaggagatcattnctatgagatctgcaaaatcctctcatatactattcccaaaatatccctagtgtgtaccac

SEQ ID NO: 10128 - DNA, 121 bp, Artificial Sequence
  Synthesized
  misc_feature (61): n=a or g
atacaggaacaaaatggcaccctacaggctagcattatataccaagaacttgagctaggtncatctccagaagaactttggaaaacattggacattttttttgctgcaattcagagcaagt

SEQ ID NO: 10129 - DNA, 121 bp, Artificial Sequence
  Synthesized
  misc_feature (61): n=a or g
gaagaatcaagaaagctcaatttcttcccatattccactgatatgttgtcagcattatctnaagccttgcaggatctagtggaaaatctgcaacacctagaatcattatatttaggacaaa

SEQ ID NO: 10130 - DNA, 121 bp, Artificial Sequence
  Synthesized
  misc_feature (61): n=a or c
ccttgaagtgagggacaacagggctcgaagccctccgggtttttgcaaactagtttcaagnacgaaaatcagtacgggagcctccccgaccctggatctcagcaaaaccagagcgggaccg

SEQ ID NO: 10131 - DNA, 121 bp, Artificial Sequence
  Synthesized
  misc_feature (61): n=c or g
ctcctccagcccagcagtggttcggtggccaaaaatgcccacttccacattttgagcctcnttttgccatcagcgccgatgccttcgcccaacagaaagggaggaaatgtgacagcactaa

SEQ ID NO: 10132 - DNA, 121 bp, Artificial Sequence
  Synthesized
  misc_feature (61): n=t or c
aaatatatgcatagcaagaatgagactcaaatttaatatccagctttcctaaaaatgctangcagtgtcagcttttttcttcttaatattgtttcagtgaaaccaaaattgtcactggacc

SEQ ID NO: 10133 - DNA, 121 bp, Artificial Sequence
  Synthesized
  misc_feature (61): n=a or g
tgtgcaggttgttgagcactgtctgtttcaggatggttgggaacagaacttattttccagnctggattttggctgcccagccttgcacccttgaggtgatacaaaccacgagtctctatgc

SEQ ID NO: 10134 - DNA, 121 bp, Artificial Sequence
  Synthesized
  misc_feature (61): n=a or g
catctactccttcccggtgcggtctggaagcagcgtggcctttgggagccgagctgatgcnctccatgctaaccaccctctcttttgatgcccccatctctttaggccactgcggaacaga

SEQ ID NO: 10135 - DNA, 121 bp, Artificial Sequence
  Synthesized
  misc_feature (61): n=t or c
gctaatgtcttcggaaaaatatttctaatgttttccgtgacatttcaacctgctgtttgcnatgagaaaattacagcaactggaaagagaagaactttttttagaacaggagatgttgggg

SEQ ID NO: 10136 - DNA, 121 bp, Artificial Sequence
  Synthesized
  misc_feature (61): n=t or c
gtcagtctcgctttagtcacgcacttttaagaaccttcacaaatgcagtattactacttanagtattcgagggagaggctgaacaccaaaacaaggagtttctgagctggcactcagcagc

SEQ ID NO: 10137 - DNA, 121 bp, Artificial Sequence
  Synthesized
  misc_feature (61): n=a or g
agtcaaacatagccaagacgaagagcgctgcactgaaataactggtatcttttctatactntggtcatggaaaatggtgcaaaactactgggttcacatggaaagatggtcatgtgtgaag

SEQ ID NO: 10138 - DNA, 121 bp, Artificial Sequence
  Synthesized
  misc_feature (61): n=t or c
ccaggcgagctgagccagaacttaagggaaaaccagacccttagggatcgccgaggagcangccgatatgtgccaagagcatggatgtactgcctgctgtacaacctctgccctgagagct

SEQ ID NO: 10139 - DNA, 121 bp, Artificial Sequence
  Synthesized
  misc_feature (61): n=a or g
cccccacattcagattgatctccttttcctacctgaagacattcccattaaactcatttgnagtctctctgtccattagaaatatacaagcagataaaccccactagcaagacacatggtc

SEQ ID NO: 10140 - DNA, 121 bp, Artificial Sequence
  Synthesized
  misc_feature (61): n=t or c
gtaacttccttgcactgggtcttgaatctcagctttttaaatgacatgtaagtttctgtgngtgctataaaagttaatcagaattaatctgttggttttgctagctgtctatgtggaatgt

SEQ ID NO: 10141 - DNA, 121 bp, Artificial Sequence
  Synthesized
  misc_feature (61): n=a or g
gagtaaattaaactggattttgagcaaagtgatttgagagtagatttaagcactccagtcntcactggctttgcctccaacaattttttttccttcgaaaacagtccatgaattcttactg

SEQ ID NO: 10142 - DNA, 121 bp, Artificial Sequence
  Synthesized
  misc_feature (61): n=t or c
atgtaaaacattaatggagtgatctgacttgtattttctcacggagaatttctgaatgaangaagtttatgtattaaattcctggaccaatgggaagcagtgtagagttgaatcacattta

SEQ ID NO: 10143 - DNA, 121 bp, Artificial Sequence
  Synthesized
  misc_feature (61): n=a or t
gttttctactttcatatcctgtatattagactcaaacagagcagacacatgcagacaatanaaacaaaacaaacgcagaaaaaaacagcaagctcttagtgcaggatattggacatgaaag

SEQ ID NO: 10144 - DNA, 121 bp, Artificial Sequence
  Synthesized
  misc_feature (61): n=a or c
ctctcaggtgacttatctgaggcaattgggctcgccttcctgtttagctttcttacagcgngctgttaaactaaatcagcagacttgtacagtcagcatcttgttaaccggggcattctca

SEQ ID NO: 10145 - DNA, 121 bp, Artificial Sequence
  Synthesized
  misc_feature (61): n=a or c
ttatcttcctcactatggttggtggaaacatgatttgtaaatcagccagcccatgaactgngacactgctcccttattggtcctgtgaaagcaggggcaacatatgtctcaacaggaattt

SEQ ID NO: 10146 - DNA, 121 bp, Artificial Sequence
  Synthesized
  misc_feature (61): n=t or g
tttaacagcagttccaattgaaaccaaagtggctttgagccaccccagcaaacctaggtgngcatttccatgggtgccacttccagccttcctccccttacctttagcccaggagatgctg

SEQ ID NO: 10147 - DNA, 121 bp, Artificial Sequence
  Synthesized
  misc_feature (61): n=a or g
gttactacccactattgacagttcaggtaggcagtggtgaaatcactcagcctgcgagctntcaaaaaaggatttcagggctttagagcaaatggttgaagggttgggtgtgcaagtgata

SEQ ID NO: 10148 - DNA, 121 bp, Artificial Sequence
  Synthesized
  misc_feature (61): n=a or g
tcataaccttgcttcatcccagaaggaaaactttagctgagagctttcaataaattcagcntgctctgaagtgcttcatttaaagacccagagcaaacctcagctttcagtgataggccat

SEQ ID NO: 10149 - DNA, 121 bp, Artificial Sequence
  Synthesized
  misc_feature (61): n=a or g
atgtgtttcttctttactcaaactattgaagttaactgcagcagtaatatagtccatcttntactatcagtgaggaacagaagttggcttatctagtcaaagcctactgtgcccagttgag

SEQ ID NO: 10150 - DNA, 121 bp, Artificial Sequence
  Synthesized
  misc_feature (61): n=a or c
aaaccatggtaaaaccaaaggcaatcattgttgtcccaggacacccactgagttaattctngttacatcaaattcatattctgtacacatgtttaaaaatcattacgttccagtgctgtac

SEQ ID NO: 10151 - DNA, 121 bp, Artificial Sequence
  Synthesized
  misc_feature (61): n=t or c
tttctctgctgactttttgaagggttggagtcattgcaatgtcacacattcatgtatttcntctggaagtttcacagtgacctccgaaggttgtgaggtggtcctggcctgtggcatccgt

SEQ ID NO: 10152 - DNA, 121 bp, Artificial Sequence
  Synthesized
  misc_feature (61): n=a or g
tccaacacacagctaaaaacatgctcaaattcatctgcagacatcctgacaaggaactcgntacaaccatgctgtcacacgtacactgggtaaattcactacctagcaacccgctccaaag

SEQ ID NO: 10153 - DNA, 121 bp, Artificial Sequence
  Synthesized
  misc_feature (61): n=t or c
tcagagcgcagcaggcccaggagagcttgcacaatccttgtgaaaaacaaagctcatcctngagcgggatggctctgtaagtaagtagggatggtgcttaatgcagtccgtcccgctgtgt

SEQ ID NO: 10154 - DNA, 121 bp, Artificial Sequence
  Synthesized
  misc_feature (61): n=a or g
cttcagtggtatttacaacagatgaaaaagctgccatcatcctctgatggggaatgatatnttaataagatgttatctttaagttatcaatcctgaatttatgttcccactggtgccttgg

SEQ ID NO: 10155 - DNA, 121 bp, Artificial Sequence
  Synthesized
  misc_feature (61): n=a or g
aaaagctactggcacatgatatgaaggtattacagcagatgatgtctggctttgctacgcntcagatttccgtgcccttctgctgagataatggcccagtatgaaggggaagaattgcatg

SEQ ID NO: 10156 - DNA, 121 bp, Artificial Sequence
  Synthesized
  misc_feature (61): n=a or g
tttccacttatctttttatggaatgagatttaacttatattatctccattaaattcaaganaatttgccaagggggtttcatctgttctgcagaaatctaaactaccatttgaaggcacaa

SEQ ID NO: 10157 - DNA, 121 bp, Artificial Sequence
  Synthesized
  misc_feature (61): n=a or g
ggcagcacacagctgttacttgctgcaagaaacgatgccctctcaatcccacagccctccntggctgtcattagctcccactcaccgtcctgctttgttatggctctagccagctctgcgc

SEQ ID NO: 10158 - DNA, 121 bp, Artificial Sequence
  Synthesized
  misc_feature (61): n=c or g
cttcctgtcgctcagccctgacacagtgtcgatgtactgctcctggatcatgaaggctgcnaggttggcggtgtagctggcgaggaagatgacggcgaagaaggcccagatgagcaccatg

SEQ ID NO: 10159 - DNA, 121 bp, Artificial Sequence
  Synthesized
  misc_feature (61): n=t or c
agacccacagacaaatacaaataaataaaaaaggtcttagtcacataaagaatccaacagncgtttgagagtcagcagctctttcagtcatttttgcctggacttgtttactcaaacttaa

SEQ ID NO: 10160 - DNA, 121 bp, Artificial Sequence
  Synthesized
  misc_feature (61): n=a or g
gaagtcagtaaacactaagggcagttcctagagctatgtaggcattgtatgtgcaacactnagaaaacttcatagcctacgctacagagcctttacttctgtaaactgttatcttgtcagt

SEQ ID NO: 10161 - DNA, 121 bp, Artificial Sequence
  Synthesized
  misc_feature (61): n=a or g
attccacagggggacatgcctcaaaattacttaaagtgctctttcataaggcctttgctcncccacatttttgttcatcagtgtgtaaagtttgtaggttttgtttctaaaaagaccttac

SEQ ID NO: 10162 - DNA, 121 bp, Artificial Sequence
  Synthesized
  misc_feature (61): n=a or g
tatcaccattatcttaagctcaaaaaaaaagttatctcacattctgagctttaaaagcagnagaagagtaactgttgcagtccctaaccaaaactgacactaaattgaagtcaatactaag

SEQ ID NO: 10163 - DNA, 121 bp, Artificial Sequence
  Synthesized
  misc_feature (61): n=c or g
agtgcctaaatgtttcctaatgcataagatctagtttgagatagatgaacttagtagtatnagccattaaagtttagggattgctgtgcttgtttgcagacattaagcaacttgccagtgt

SEQ ID NO: 10164 - DNA, 121 bp, Artificial Sequence
  Synthesized
  misc_feature (61): n=t or c
agtagtattagaggcaggtacaagagccactaccttacaaccatgctcaggtttggagttnattctttgtatgtggatatgatgaagggactctggccaaattccatgaataggtcaaatc

SEQ ID NO: 10165 - DNA, 121 bp, Artificial Sequence
  Synthesized
  misc_feature (61): n=t or c
agtgtttttgtagttgcactttgtggaattaggacagagatttgtaaacttagtaaaattntggaatcaatggaaggcttgccctcaacagcaagaggccccattctctctgctctcattc

SEQ ID NO: 10166 - DNA, 121 bp, Artificial Sequence
  Synthesized
  misc_feature (61): n=t or c
ccccagttttgttttactttgatgaaatgaaacctactatatgcccactgcacattcacanagggtctgaattaggtggaagtcatagaatcataaaatcatttgagttggaagggattag

SEQ ID NO: 10167 - DNA, 121 bp, Artificial Sequence
  Synthesized
  misc_feature (61): n=t or g
gtacttctttggactgatgattccatgctgcatagtcaagtggatagtagtttttcagttntgaagaagcttttcccttaataaaactgttttaatgcttcctgaaactgcttttttttct

SEQ ID NO: 10168 - DNA, 121 bp, Artificial Sequence
  Synthesized
  misc_feature (61): n=a or g
cctatcaatgtatcaactggtatctctttggaatacaataaaatcaaatgttgcttttctngcatattcagcaatattttattaatgcagttctgaatctaaaggcttgaacagaaatctg

SEQ ID NO: 10169 - DNA, 121 bp, Artificial Sequence
  Synthesized
  misc_feature (61): n=a or g
tactcaatttggaatgtcctttgaatatttaatacacagctgagagcatgccagttgcaangatgggcttggatgttgtgagcacagcaatagcaatgtagagcctgctagtaagcctgga

SEQ ID NO: 10170 - DNA, 121 bp, Artificial Sequence
  Synthesized
  misc_feature (61): n=a or g
aagttgaacactaaaaaagaaagcaaacagaggtgccagctgatcttaaggactaatgagngtttaaaacaatgagcaataagtgagtgagctgagtaggaagtaaacattactgtagagt

SEQ ID NO: 10171 - DNA, 121 bp, Artificial Sequence
  Synthesized
  misc_feature (61): n=t or c
gcagctccctgagcttccatcctcagtcaatgttcagatgttaaaacaattttataagcangatggcatggcacagtgatagaaaaacggataagataatgcccatgataagcactggaaa

SEQ ID NO: 10172 - DNA, 121 bp, Artificial Sequence
  Synthesized
  misc_feature (61): n=t or c
tcaaaatagtattttgtactactccaactgaattaaaatagctcaacatgtttgccgctgngcaacaattcatagaggacttgccactaacactgttggaaaggtgaacaagattttggac

SEQ ID NO: 10173 - DNA, 121 bp, Artificial Sequence
  Synthesized
  misc_feature (61): n=a or g
gtttgcagccaaagaaaggcacgtatgctgtgtcttgcagctataagcaaataaaggacancgtgataagtattactagaccttcaaaacagaagcaagcacagatcgaaaagtggaaatc

SEQ ID NO: 10174 - DNA, 121 bp, Artificial Sequence
  Synthesized
  misc_feature (61): n=a or c
ttagggttactgttctcatgcttcttatctgtgtaactggaagcaaatgatgcatatgtcnagaaatattaaccaaaacagatatcaccaaagtaattttaatcaagatattaaccaaaac

SEQ ID NO: 10175 - DNA, 121 bp, Artificial Sequence
  Synthesized
  misc_feature (61): n=t or c
aattaacagcattaatctcagttgcggttagcaagtataatcctcattttaactttgagcngtcagtggagcttcagggcattattacaaaaaagaatacttcaatttcattacaacatat

SEQ ID NO: 10176 - DNA, 121 bp, Artificial Sequence
  Synthesized
  misc_feature (61): n=a or g
aagagggactttacaactgggatctgccaccgttgctaaggtaaactgccatttggttccncacccagcaggcaggtcctgaaaccccaggtaaataattgccccctactggacatctgaa

SEQ ID NO: 10177 - DNA, 121 bp, Artificial Sequence
  Synthesized
  misc_feature (61): n=t or c
ataatgagaatcaggcagcctttcagagggttgaatactgatagtagcaccaaagttttangaactgccctgagtctaatgagcatagcccactgctgtgactgtgtccaaaacaagggct

SEQ ID NO: 10178 - DNA, 121 bp, Artificial Sequence
  Synthesized
  misc_feature (61): n=t or c
ctttcatgcatatgcgagatgcaggtgcttgtagccctgtattcacgtacgtgcttgcagnagaccaactgagaaatgcctgtagaataaaactccaatctccctgtgaaacatcacttta

SEQ ID NO: 10179 - DNA, 121 bp, Artificial Sequence
  Synthesized
  misc_feature (61): n=a or c
ataccatgccactcatggaactcagtaaattagctcttttgtctactctccatatggcctnttcacgtgttttctcttaagtactgtaaataggcagctgggactccagaattccaatgtt

SEQ ID NO: 10180 - DNA, 121 bp, Artificial Sequence
  Synthesized
  misc_feature (61): n=t or c
tgcaatgaaatatcagaccttctatctctctgacgttgctgtttcttgcatgcctataaantgtgagattttgatttcagacagtattagtgttgtgtcctgatccagcaaacccatgcta

SEQ ID NO: 10181 - DNA, 121 bp, Artificial Sequence
  Synthesized
  misc_feature (61): n=t or c
aggtctccggaatgcagtggaagaagcacacgggtgaaccccaaaatccgggtgcagtganggtgattccaccagttggaaacattctgcatgtatgatgggggagttccaccttctgact

SEQ ID NO: 10182 - DNA, 121 bp, Artificial Sequence
  Synthesized
  misc_feature (61): n=a or c
agtaggagatgaataccacagggaggaaggatgatcctgtgatactgatggcagaagttanaatcggtgatagggagcaatcacaatggatcatgtatccaaacattaataatggttcgga

SEQ ID NO: 10183 - DNA, 121 bp, Artificial Sequence
  Synthesized
  misc_feature (61): n=c or g
aacacacaacatttaaaaaatacagacacaaaaactcaaacaaacactgtgttgcactcantgtatattacaccaagcaggacaatttttcaaatgccagatactatcacatacgaagcag

SEQ ID NO: 10184 - DNA, 121 bp, Artificial Sequence
  Synthesized
  misc_feature (61): n=a or g
ccaaagataaaaaggtccattctggaccttgcagccttctacagcaatgccacatggggcngccagtacaattcaggactgccacacaccctccgtgcacaagagtgcaatgttctgcagt

SEQ ID NO: 10185 - DNA, 121 bp, Artificial Sequence
  Synthesized
  misc_feature (61): n=t or c
tcgagtgtcataggttcactgaagactaatgggcaaacgagagagaacagtgctgaagctnatctgaacatcactggcaaagcgccctccaaaagaaaagggactgctttgtcagaaaagc

SEQ ID NO: 10186 - DNA, 121 bp, Artificial Sequence
  Synthesized
  misc_feature (61): n=a or g
cttcattcttcatctttattccatagtatcattgttcaaaaagatccagacagctggttcnattttttcccaagatggaaattgtcatacagtgtcctatataatgttgctgctgttgttg

SEQ ID NO: 10187 - DNA, 121 bp, Artificial Sequence
  Synthesized
  misc_feature (61): n=a or c
gacttagaagtcatttctgataaacatgattatctaaatctggtagcatgggggtatgtcnctttacccatcttgtgttcgttccatcaaaatttatttttctatgaatcaaagctgggta

SEQ ID NO: 10188 - DNA, 121 bp, Artificial Sequence
  Synthesized
  misc_feature (61): n=t or c
cagcacagatgtatctataacctgtaatcctgcaaacacaatctccttcatctgtcatcanctcttcaggaatcttttcttgtctgactggtgaggttggtagaaagagtgctcatggagc

SEQ ID NO: 10189 - DNA, 121 bp, Artificial Sequence
  Synthesized
  misc_feature (61): n=a or g
ttgtgaacactcaatacacatacagatgcagagaaatgaacagattatctgagcaggatgngtatgtctcaacacaagaagacatgacagaagtccaatgttttggagtagaggtgctgat

SEQ ID NO: 10190 - DNA, 121 bp, Artificial Sequence
  Synthesized
  misc_feature (61): n=t or c
caaaagaacacaacacacataacataaaattgcatgaatttgtaaatagttgtgtacacanatgcacacgtatacttaccagtgtatttgtattactcctcagataaatagcattaaacat

SEQ ID NO: 10191 - DNA, 121 bp, Artificial Sequence
  Synthesized
  misc_feature (61): n=c or g
atgtgaaaaattgtatgataaaatgagaaaaaaattctctgtaagtacatctgtcaagctnttgcatgtagtctactggtctgtaatttattcttttgataatgatgacactgacagctgc

SEQ ID NO: 10192 - DNA, 121 bp, Artificial Sequence
  Synthesized
  misc_feature (61): n=c or g
cctgcagcaacaaaatcactaagcattcatattgatcttgagaacagtagtttcctaaaantgcagtgaaagagcccactgtatgaactgcactgctcaaacctcacattcaagtaaagct

SEQ ID NO: 10193 - DNA, 121 bp, Artificial Sequence
  Synthesized
  misc_feature (61): n=a or g
ttctgcctcacagagaccctgccctggtgtttaaggactgtaagtaccacgaaactgtccngcttccctcacagtgtgctccttatatctgagatagtaagagagagacgtaataattaat

SEQ ID NO: 10194 - DNA, 121 bp, Artificial Sequence
  Synthesized
  misc_feature (61): n=a or g
tttaaacaaaatgtgtttcctcattaacaaagcaatttatctcataaaatagaaatagggnaaagtaggggaatgcttcacccctttatttgttgtcaaaattcttcgaaaattcacttta

SEQ ID NO: 10195 - DNA, 121 bp, Artificial Sequence
  Synthesized
  misc_feature (61): n=a or c
cttttgatttcttgtttcagctcaagagaagagtgtttagactagacgctgtatttaatancatcactatttctgactagattacatggtaaatattttgacatttcctttgaggtataaa

SEQ ID NO: 10196 - DNA, 121 bp, Artificial Sequence
  Synthesized
  misc_feature (61): n=c or g
cgagcttacatttgccgtttatgagaagtgtcatcattcactgtgcttctgagagataaantctatattgctttggaggctttatttgtgttgatggttgaaatgggaccaatctactcta

SEQ ID NO: 10197 - DNA, 121 bp, Artificial Sequence
  Synthesized
  misc_feature (61): n=c or g
acccaccccacctcctttcccctcacccttgtacttctccaccttctaccccaatctctgntgatttcatcagcattcacaacacttttccccagagaagtatgaacaaatgaattaaagg

SEQ ID NO: 10198 - DNA, 121 bp, Artificial Sequence
  Synthesized
  misc_feature (61): n=t or c
taataggccataggcaaacaggggcaggtgttcatgaagaaaacatggtgtaagattgacngtttctgacttgtttgcatattgactgctcagaagtgtctgcctgggaaaagaaggtagc

SEQ ID NO: 10199 - DNA, 121 bp, Artificial Sequence
  Synthesized
  misc_feature (61): n=a or g
catcagaagagaagacttcctttaattttggaagtcagcatctgtgtcaactgttaaagcntttagatatcatcttgcagtaaagcatttaacatacagctgttcattggaagaaaacgga

SEQ ID NO: 10200 - DNA, 121 bp, Artificial Sequence
  Synthesized
  misc_feature (61): n=t or c
aagctttactctcttgtcttgtagtaatggaccctgctatgttagatcttctcttgtcccngcaacctcctgtagtcattgtggaggtctccatcgcaaggagctagttggcccagagctg

SEQ ID NO: 10201 - DNA, 121 bp, Artificial Sequence
  Synthesized
  misc_feature (61): n=a or t
attcacctgttgtcttttattatatgccaagatgacaaagtctttgaggcagagctgcctntttaaacagatgagtgcagaatcttgcacaacgcagcactacagaccctgcatttaacat

SEQ ID NO: 10202 - DNA, 121 bp, Artificial Sequence
  Synthesized
  misc_feature (61): n=a or t
ccaaaaataatttgataatacctttttttcctgtgcattcaagccaagtaagctatgacangaccaatattcttcaaacagctctctgtacagctgagttgcccagaacacgaattggatt

SEQ ID NO: 10203 - DNA, 121 bp, Artificial Sequence
  Synthesized
  misc_feature (61): n=t or c
ctacgtttgaagcagatttgtgcattattactttagtaccagttctgcaagggtactgatnatagtcttttactacacaacttcatactttgctttctcttaattcttgaatatatgtctt

SEQ ID NO: 10204 - DNA, 121 bp, Artificial Sequence
  Synthesized
  misc_feature (61): n=a or g
atatttacatcattaaaggacggaaattcaatgtataatactgcaaaggaaggagacttgnagatgtttttgaagaatctgaactgataataattgaatgtgaaactattacataaacata

SEQ ID NO: 10205 - DNA, 121 bp, Artificial Sequence
  Synthesized
  misc_feature (61): n=t or c
tgaaggccattttctcccaacactaccttctgtttagttaagcactgagattgctgcattngagagcctgcagctttgtttctgatattcagattggtgttgttgcccaaccacacaattc

SEQ ID NO: 10206 - DNA, 121 bp, Artificial Sequence
  Synthesized
  misc_feature (61): n=a or g
gtggattgtggagttccacctgctatcttaaatgcacatcaagcatctctaagcgggaccncgtatggaagtgaagttacttacagttgtattcatggttactttattgcaagtggcaatc

SEQ ID NO: 10207 - DNA, 121 bp, Artificial Sequence
  Synthesized
  misc_feature (61): n=a or t
cacacccatgggctccccaaatccctcctgggtgctgctgccttggttatcactgctctgncctcagcaagctgcgggcagccagctttgtgcagaaagctgggaactagcactcccccag

SEQ ID NO: 10208 - DNA, 121 bp, Artificial Sequence
  Synthesized
  misc_feature (61): n=a or g
taatctctggcaaaatagaccatatgaaagtgaagaatcatcttagagctgaataaggggnatacactctgaactgatttaccccaagcattaatgtagagcaaggcataaataactttat

SEQ ID NO: 10209 - DNA, 121 bp, Artificial Sequence
  Synthesized
  misc_feature (61): n=a or g
tttacagccaataagtggtgtatttactgagttttgtcatattgccctccaaacagagcanctgctctttccatatttgtatctgcttttgttctgtgcttaggagaggagaggaggtcag

SEQ ID NO: 10210 - DNA, 121 bp, Artificial Sequence
  Synthesized
  misc_feature (61): n=t or c
tattaccaataagccacaagtgatcctggaagaaaagcactgcctgaaaaatgaagcattngagtaccctcatagctagagcaggaaaggaaattcagtattctgagaatagagctctcct

SEQ ID NO: 10211 - DNA, 121 bp, Artificial Sequence
  Synthesized
  misc_feature (61): n=a or t
gggatcaggatcatgctggcaaatattccaatatttacaacaactatgtaccatagatagncaaggagactttcctatttcctcttctagattacatttctgtcttacactggaccttgta

SEQ ID NO: 10212 - DNA, 121 bp, Artificial Sequence
  Synthesized
  misc_feature (61): n=t or c
actcatccttcgaagggtcctcgtggcagttccctgtctatagtgaggcttctgaggagangttaagcaaggctcttgacagtgatgtgtgctgggaggacaagagaaaacagggctaatt

SEQ ID NO: 10213 - DNA, 121 bp, Artificial Sequence
  Synthesized
  misc_feature (61): n=t or g
aaatgagtaaaataaacccttttaaaataagtatgttttgttcccattctgtttcctgctntcatttaaggtgaatcacaacagcaaaatgctcaacactggtctcccaaaagcttcagta

SEQ ID NO: 10214 - DNA, 121 bp, Artificial Sequence
  Synthesized
  misc_feature (61): n=t or c
atgctgccagtggatcttctaaaccttgctgtgtttaccttgtgaaaacgcccaagcaacntctcttgacaagcaacaaacaacctggatccaatctgctcagatctacttcctagaaaca

SEQ ID NO: 10215 - DNA, 121 bp, Artificial Sequence
  Synthesized
  misc_feature (61): n=a or g
atttacctcacttgatgtagaccctatctaggagtctgggtttgtggaaccaggaaaccanacctgtggaggacattgtgtggccattctgtaaaatttcctagatgaagcaacagcaaga

SEQ ID NO: 10216 - DNA, 121 bp, Artificial Sequence
  Synthesized
  misc_feature (61): n=a or c
caactgaaaaaatgtggctcatcatttctcttcttattgaacccagagtggtgaattgtgngatcccaatcccaggccctgcccaggctttttgtgcaccagtgattctgcagtctgcttt

SEQ ID NO: 10217 - DNA, 121 bp, Artificial Sequence
  Synthesized
  misc_feature (61): n=a or g
ttccacttgcagccagcaattactagcaaacagcaggaactggattagtgcatgcgtgacnctcatctcaggggaaaaccaaactaaatagttgtttttttttttttttgtctcgaagtca

SEQ ID NO: 10218 - DNA, 121 bp, Artificial Sequence
  Synthesized
  misc_feature (61): n=a or g
agatggagaagaagaacaggagagtaactatgaagaactaggaaaacttctaatagagganttcttagagaagagtcatagaagtagaagttggcaggaaacaaacgttaaaaagatgcaa

SEQ ID NO: 10219 - DNA, 121 bp, Artificial Sequence
  Synthesized
  misc_feature (61): n=a or g
ttaggactgtaatcaaatcaggaacagattccatgtcagtcagccttatccttggaaaagngatctgagcaacatcttcctgacacgctgatattttcttggtggttttggtaaaacctca

SEQ ID NO: 10220 - DNA, 121 bp, Artificial Sequence
  Synthesized
  misc_feature (61): n=t or c
aggataccgcctgataccaacaggatacagcaaggattgctgcatgtatgctgggttgttncctttgggagccaacgcctcacagagtgtgaacaggagtggctgtagttcaagaaagaga

SEQ ID NO: 10221 - DNA, 121 bp, Artificial Sequence
  Synthesized
  misc_feature (61): n=a or g
ctggctccagggcgggctatagatctgcttatgaaaatatcagcttaagaaataacatcancaacggatgggtggggataacattccccacaagaaagaatcccagctccctaattacatg

SEQ ID NO: 10222 - DNA, 121 bp, Artificial Sequence
  Synthesized
  misc_feature (61): n=a or g
agggcagtgtcatcactgaacttggatcaggttcctcaggtactgcttggtagtctgttcnactggagcaccatgctatatagcaaagtgtcttttgatgtgctgtaaaaagcttaaactg

SEQ ID NO: 10223 - DNA, 121 bp, Artificial Sequence
  Synthesized
  misc_feature (61): n=t or c
tgtgctcaatgattcctctgggcagaatcccgtgcccacattcctcccatacttcaggttnttttattctttaggaggtatgttttgttttgttttgttttttagggagacaccagcagat

SEQ ID NO: 10224 - DNA, 121 bp, Artificial Sequence
  Synthesized
  misc_feature (61): n=a or g
tcttatttacagtcctggaaaatggactgagatcaacacacaaggtcatgaagtgtctagngagaactgtggtgcttatttcaagagacatcacagtggcatagtttcttactcgctcaca

SEQ ID NO: 10225 - DNA, 121 bp, Artificial Sequence
  Synthesized
  misc_feature (61): n=t or c
ggagcaggtcaccttctatgcctccagccaaacaacaacggctacatctcagaacatcagnagcataagaaaatgatgctccagttttctgagaggtaatttggctcagcataaagccttt

SEQ ID NO: 10226 - DNA, 121 bp, Artificial Sequence
  Synthesized
  misc_feature (61): n=t or c
ataattccaagaatgagctggactattcagactgcaacactacttgtaggacattgagaangccaaaattcagcagtaattgcggcagctgccaccctgtccgtcacactcagttgatcta

SEQ ID NO: 10227 - DNA, 121 bp, Artificial Sequence
  Synthesized
  misc_feature (61): n=a or g
tgtttttattaaggagggtggtggcattttacacagcagttaatttcatcacgtttgatantggaatctggactgtgctcacccttccaaggcctctttctgctgagtatcgtaaatgaca

SEQ ID NO: 10228 - DNA, 121 bp, Artificial Sequence
  Synthesized
  misc_feature (61): n=t or c
tttacttttgtaatgacagccaagaagtcaagttgtcagaaaagatcattcaggaaagggnagaaaggcctgctgaggccaatgtatcttagaagctgtcaatagcttgacccttgtaact

SEQ ID NO: 10229 - DNA, 121 bp, Artificial Sequence
  Synthesized
  misc_feature (61): n=a or t
aaatatagtgtggagtggctaagaggcagagacggttggagaggaccaaagactttttttnaaatgaaaataaacagcactccttctgtctgactgcaaaaacaagttatttcgtacagta

SEQ ID NO: 10230 - DNA, 121 bp, Artificial Sequence
  Synthesized
  misc_feature (61): n=a or g
cagggttcccagactcttttgctggcgctgttacatcggtttcagtccaggtttgcctgcncacaggcgttccagactgctccaaatccacagctctgtgcatccgtgacctccaacaaac

SEQ ID NO: 10231 - DNA, 121 bp, Artificial Sequence
  Synthesized
  misc_feature (61): n=a or g
cattgatttcttgccttggaaatgagcacagcttgtcatctggtcgtttctgttttcgtcntgttcactcatctcttgaacaaacattctttagatttgttaagtatgcaaacctgcaact

SEQ ID NO: 10232 - DNA, 121 bp, Artificial Sequence
  Synthesized
  misc_feature (61): n=a or g
gacaagcaattccatttcaaaaagaaatgcacgttgaatggcagcagatctggtaaaaccngcagcccccaaatggcactgaggagtcccatccctgcaggcgtccgtctgagcggagccg

SEQ ID NO: 10233 - DNA, 121 bp, Artificial Sequence
  Synthesized
  misc_feature (61): n=t or c
ggacatgcacagagtctgcagaacatttcacactgtattcatcacatttaaaggttcaggnattttccatgtacagaccagcaaccaatggtttgaggcagcggtgaagtgagatcaaaca

SEQ ID NO: 10234 - DNA, 121 bp, Artificial Sequence
  Synthesized
  misc_feature (61): n=c or g
ttaatattttgttttccaatacagtaaatcctctctacagcgacaggttagttaaatctgntttacatattgccgtcttgtgtgagaactgcggcctcgacgccgctgtgacaaaaccagg

SEQ ID NO: 10235 - DNA, 121 bp, Artificial Sequence
  Synthesized
  misc_feature (61): n=t or c
gccgaacctggcatcctcgtccttcctctgagtcttggcctatgcaaagattttggggaangctctctgggagcaggattgggtgtcctggtcagaaagctgtctgagcccatcgctgtgt

SEQ ID NO: 10236 - DNA, 121 bp, Artificial Sequence
  Synthesized
  misc_feature (61): n=t or c
aacaaaggcttttcttttgcaaatattgtttctgcactgaagtggagtagtgtagcacaangtagggccacatgttgatgtccttacctggggcctgagcccggttccacggaaatcaatg

SEQ ID NO: 10237 - DNA, 121 bp, Artificial Sequence
  Synthesized
  misc_feature (61): n=t or c
atgccttttacccttccaacacccatgtgtagggaagtaccgtgaattccaccgtctgtanggggagaagcggttctctgaagctgccaggttgcttctgatgctgatgactgctcatatt

SEQ ID NO: 10238 - DNA, 121 bp, Artificial Sequence
  Synthesized
  misc_feature (61): n=a or g
ggttgtggctagcactgcaatgccccagtggcaaagaagagaactacagagcatcctcaantcgctgcagcgaactgccaacacaaccatcaagaaactggaggtgcagcaggtactgcaa

SEQ ID NO: 10239 - DNA, 121 bp, Artificial Sequence
  Synthesized
  misc_feature (61): n=t or c
cccatcggtgctgacatggggggtttccttttcttctctctttgtggcagttgtcagcacngagctggacgagctgatgatggaagcacagctgctgcaggtttctctgcctgaaatacag

SEQ ID NO: 10240 - DNA, 121 bp, Artificial Sequence
  Synthesized
  misc_feature (61): n=t or c
caaatcttttagtacacctatgggataaaatacaatattttgtgcagatgcaatgcttttnggtcagcttttacaccagtacagccccctgttgaccaccgcctgtggaaacatttaacat

SEQ ID NO: 10241 - DNA, 121 bp, Artificial Sequence
  Synthesized
  misc_feature (61): n=a or c
tgcttaaagtgcagcgtgatatttgtgcaaaaacagcttggtgtaaactggccacgagcancttcgtgctgaaaaccagcagaaggcttttgttgagcagaggacaggggttgtgaactgg

SEQ ID NO: 10242 - DNA, 121 bp, Artificial Sequence
  Synthesized
  misc_feature (61): n=a or g
cgcttccattgctatcagctctgattgggcaagcagtgattttaaatggcaagaggacagngtggcagtgaagaaaggccagctttgaatgtgaaggaaatagctttccaaaatggaccat

SEQ ID NO: 10243 - DNA, 121 bp, Artificial Sequence
  Synthesized
  misc_feature (61): n=t or c
gccccagtcccaatattctccacacaacagccttgcagagtcaaaccatactttgtgacanggagtaacgaaactaatttctgatctgtttttttaaggagaatgtcccaagagttttacc

SEQ ID NO: 10244 - DNA, 121 bp, Artificial Sequence
  Synthesized
  misc_feature (61): n=a or g
gctgggggtatgaggtggggggggatgaccctatggttaatgaggcttgcaataatggacnaggaactttaaaaatactccctggaaaccaggaaatggagaaagagtaagacaattaaag

SEQ ID NO: 10245 - DNA, 121 bp, Artificial Sequence
  Synthesized
  misc_feature (61): n=a or g
cttgctcttaattgaaatgtcttttagataatcataaaacaaaacatataaaaaagcctcngataagtgtgtgtactgaatgagctaatggaaaaagtaatggcaatgatgctaactaaat

SEQ ID NO: 10246 - DNA, 121 bp, Artificial Sequence
  Synthesized
  misc_feature (61): n=t or c
tatatggatatatgtgagaaagacacagagcctaaacttgtatgacactgcctgtgtgctngaggaaaggacaagggggggctacatctatacagaatgccttgtgtgttaaaggagctaa

SEQ ID NO: 10247 - DNA, 121 bp, Artificial Sequence
  Synthesized
  misc_feature (61): n=c or g
acactgttgtgagattcattagaaattcattaataatgttcctctctcttaatgaacagtnaacagtcagtagtatgtaagtggagagataataactgtcttggtgagatatttgacccct

SEQ ID NO: 10248 - DNA, 121 bp, Artificial Sequence
  Synthesized
  misc_feature (61): n=a or g
aagacagatgtggtattgaggaccaaagactgactttaccaaaaagaaaggatgctgacanaaggtaaggaggagcatatttacaccaataggcatcccatcagttcagaattcttcatat

SEQ ID NO: 10249 - DNA, 121 bp, Artificial Sequence
  Synthesized
  misc_feature (61): n=t or c
gtcacactgcaatgttcttgtagtcaagtaggaacaccctttatttctgcactcctttctnagtggctcccagccataggctctttttcccaaaatatttcaatcacattgtctgcccttg

SEQ ID NO: 10250 - DNA, 121 bp, Artificial Sequence
  Synthesized
  misc_feature (61): n=a or c
ttgttgcagcaaagggatgactgtggcagttccatggccactacaggagacaaagattgtnctcagggtcccctggctgttgcattccccagtgggatcaagcagaagtgatgtttgctgc

SEQ ID NO: 10251 - DNA, 121 bp, Artificial Sequence
  Synthesized
  misc_feature (61): n=t or c
ggtctggtgctgatggcagacaggcagtgggaagacacttcccttcttagctcagtaaatnattcctctgctgtctgcctcaacttcccaatttatctagggatagcagtgataagggctt

SEQ ID NO: 10252 - DNA, 121 bp, Artificial Sequence
  Synthesized
  misc_feature (61): n=a or g
caggtatttcgtttgtttttgttgttctagtggtttttgtcatggtctaggtaattatagnaaagcaaatctttgaaaagtgctggacagtgtagctaaatgatataaaatagactttact

SEQ ID NO: 10253 - DNA, 121 bp, Artificial Sequence
  Synthesized
  misc_feature (61): n=t or c
caagctgcccagccaaggcaattaacagcatttaacatcagccatattctgtacataacangtctgttctagtgactccccctttccctttggcaaattttaagtttggttgctttaaata

SEQ ID NO: 10254 - DNA, 121 bp, Artificial Sequence
  Synthesized
  misc_feature (61): n=t or c
attctatgtatgtctcatcagggaagaaagcttttaaagattttgttgcgagataaggacntgtgtccaaatgggctttatagctgaaggaatatcagctcccggtagtctacaggtttat

SEQ ID NO: 10255 - DNA, 121 bp, Artificial Sequence
  Synthesized
  misc_feature (61): n=t or c
gattcagttttataataggtttggtgaatgcaaatttctgagattggtatcaagagtcttnttccctgtcatttacaccactgtgagcactagactgcagttctctgaccaggcacacttt

SEQ ID NO: 10256 - DNA, 121 bp, Artificial Sequence
  Synthesized
  misc_feature (61): n=t or c
ttacggatgaaatacatgctgccaggtaatgaaatctcattttctgttaaaggatcattgngggtaatcctgtgacagtgacaggacagcgttacccgctgcaaaaccagctggctgcttt

SEQ ID NO: 10257 - DNA, 121 bp, Artificial Sequence
  Synthesized
  misc_feature (61): n=t or g
catctgagccgtggatggatgcactgcaggatggtggtgatggtgaagctgtacagggtgnttcccagttaaattcctgtgagaccagcagggctggtgggggaagcaagaaatgtgctgt

SEQ ID NO: 10258 - DNA, 121 bp, Artificial Sequence
  Synthesized
  misc_feature (61): n=a or g
aaaaaaattaaaataaaaaaaaaagcaaataaaaaagaccctccaaaatgcacatggcccnttacaccagggctgtagttgagaaatagagtctataagagagaagaccaggatgactggg

SEQ ID NO: 10259 - DNA, 121 bp, Artificial Sequence
  Synthesized
  misc_feature (61): n=a or g
tagagtgtacctcctacatctagaaatgagctgtctcaggaaagatcctcagagatagttnagaatataagaataggagtgagtttataagctggaaaaaaaaaatgttcagggattcaga

SEQ ID NO: 10260 - DNA, 121 bp, Artificial Sequence
  Synthesized
  misc_feature (61): n=t or c
tggagaacaaactttcttaaaccatgtaaaagacataactttagcaataaatgatgaacanttaatttctctcccatataccactattctgtgccagaatttttgaacatcctaatagttc

SEQ ID NO: 10261 - DNA, 121 bp, Artificial Sequence
  Synthesized
  misc_feature (61): n=a or g
agtaactcaagaaggaaagctcctactatctaaactcttagcacttagacaatttaaaaanaaaaagggactgacagattttcttgtcaaagtcaagagataaagtctctactctgctatt

SEQ ID NO: 10262 - DNA, 121 bp, Artificial Sequence
  Synthesized
  misc_feature (61): n=t or c
tcctgctgaaacattttctcttctttcagggctggaaggagatatggcttgattgcaatantgattataactgcatatctatgtaccatatacagtaggtatatattttacgtacaaaata

SEQ ID NO: 10263 - DNA, 121 bp, Artificial Sequence
  Synthesized
  misc_feature (61): n=a or g
tgacataacatcagctgcattttagtagttaactttattctgaaactgcttagcttatgtngtcacagctactggaatgcagaaattggaattagcagtggacagttctgatgctgataca

SEQ ID NO: 10264 - DNA, 121 bp, Artificial Sequence
  Synthesized
  misc_feature (61): n=t or c
aagcagtggcaggtagtgctataaatatgaaatggacgggctgtctgttcctgattacttngtgaatagcttattttcttcttctttgtattttgccagtatgcaaagccaaagtctgtaa

SEQ ID NO: 10265 - DNA, 121 bp, Artificial Sequence
  Synthesized
  misc_feature (61): n=t or c
gcctcaaaaaaacaaaaaacccaaaagctggttcaaatgtgagcttatcgtatgtatgtanatatgtaaaggtagaatttttcttttccccagtgtttgttgcttcctatttgtctaccct

SEQ ID NO: 10266 - DNA, 121 bp, Artificial Sequence
  Synthesized
  misc_feature (61): n=a or c
ctcttttctgagctcccctggtaagatgcaccagcagaggattgcctaactctgatgagcngtctgcttccatttgcttaaatgtataccaaacatgatctctgctgatagttcaggagca

SEQ ID NO: 10267 - DNA, 121 bp, Artificial Sequence
  Synthesized
  misc_feature (61): n=t or c
tgttcctgaggaggtccttacaactcagagcagaacaatgagacagaaattatatcacatngttgttatttctgtcataagaaagccaggtgagttttcaattgcgtggactttgtacaca

SEQ ID NO: 10268 - DNA, 121 bp, Artificial Sequence
  Synthesized
  misc_feature (61): n=t or c
aataagaggaagtgagtaatttaaagcagcgggatccagagagttcctttattacagagangcttatataccagcaggatacaggggttgtgaatgccctggggacggtagggaaaccctt

SEQ ID NO: 10269 - DNA, 121 bp, Artificial Sequence
  Synthesized
  misc_feature (61): n=a or g
caccctccccagtcatgaatgagctggaggccccattgcaaggggatacaggtcaggaccnactaggtgaacttcaatatcatgggtggaacttcctgctccattttgcatctgatcaagt

SEQ ID NO: 10270 - DNA, 121 bp, Artificial Sequence
  Synthesized
  misc_feature (61): n=t or c
tactacactctgtcttgtctgcaagatacaattagtaaaaaaagatacttctacatacttnatacactgctttcatttcagcaggtcttgtgtcatagctaagttaactttattgtcataa

SEQ ID NO: 10271 - DNA, 121 bp, Artificial Sequence
  Synthesized
  misc_feature (61): n=a or g
aaattggggtttctgtggttcttgaaatgaaagtgtgcaaatggacataatggtacctttnaggattctgtttgtcagatgctttgctgttcagactccacttacatgcttaataaacagg

SEQ ID NO: 10272 - DNA, 121 bp, Artificial Sequence
  Synthesized
  misc_feature (61): n=a or c
ttacttcctaggccattcctagcattttaacaggctcactcaattatgcccacatagtgtntgtagcaacacattgctttaccccaaagtctcatcagtccttagcaaaagcttcaaactc

SEQ ID NO: 10273 - DNA, 121 bp, Artificial Sequence
  Synthesized
  misc_feature (61): n=t or g
aaagcttataaaggtaggaaatacctgatggaaggagaggagatacatctttgtgggcatnagattcttgctctggatctccatccccaaggatatcatgggaacttaaacacagagacac

SEQ ID NO: 10274 - DNA, 121 bp, Artificial Sequence
  Synthesized
  misc_feature (61): n=a or g
tctggtgctacaattccacccctactgcgatgtaaagtaacttgcaaattagaattctctntacaaggtaatgagcttaatctgcagaaagaaacaaacaagtgtgctactttctgatggt

SEQ ID NO: 10275 - DNA, 121 bp, Artificial Sequence
  Synthesized
  misc_feature (61): n=a or g
gatcttgcattgaggtgaaagcgttctgcccccaatttccttctcacagcattctgattangttctgatccataggacagcggcgctggaggctcccggccccaagcacaaagcagcagga

SEQ ID NO: 10276 - DNA, 121 bp, Artificial Sequence
  Synthesized
  misc_feature (61): n=a or c
agagcagcgtgaaggcctgtcctgtacacaccatgtgcctggcagtgatcttggaacttanaatgccaataaaataattgagccacgctgaaaggacaaaaaagccaaaagcaccagcctt

SEQ ID NO: 10277 - DNA, 121 bp, Artificial Sequence
  Synthesized
  misc_feature (61): n=a or g
actgctagatgcttttttcctcttgggaaaacagaatggaggacaaatgacagaatggagnctttatgagtaaataagagaactctttcctaaattgacttgtctagcagaaaaactgcag

SEQ ID NO: 10278 - DNA, 121 bp, Artificial Sequence
  Synthesized
  misc_feature (61): n=a or g
atggcacatactgaggcttcagccagcacccgggtttcaggcagggctttgattagcggcntctcctccacaacgtgggaggaggcccaaaaagcattgtctcaaggctcctgagggcccc

SEQ ID NO: 10279 - DNA, 121 bp, Artificial Sequence
  Synthesized
  misc_feature (61): n=t or c
cagagagctggagatgtcaacagattgctatgccttccagtaggggcacaaagctctaggntcagcagggaggagcaacatcaacagctggtacattccaggaactcttttccatcttcta

SEQ ID NO: 10280 - DNA, 121 bp, Artificial Sequence
  Synthesized
  misc_feature (61): n=a or g
tgtgaccccccccagagtctgacccaattcccattccacttaatttgctataaatcaggangaatatcattggcatcagttaaattgctctggtcgtaatagttcttgagatctgagggtg

SEQ ID NO: 10281 - DNA, 121 bp, Artificial Sequence
  Synthesized
  misc_feature (61): n=a or c
aacaccgaaagtgcccctcaacctcataagtctcaggttttgcgaccaacttgaccttaancatttcaaaagagcttttaaaaaagctactgcagtattaaatgattatttggctttcatt

SEQ ID NO: 10282 - DNA, 121 bp, Artificial Sequence
  Synthesized
  misc_feature (61): n=t or c
tgttggagaggcacgctgacacggccaggctaaccctgctgagcctaaaaatctcagcttntctgaggctgcttaacctaaccatagagtttgttaggtagttggagaaattatttttttt

SEQ ID NO: 10283 - DNA, 121 bp, Artificial Sequence
  Synthesized
  misc_feature (61): n=t or c
ccgtgacaactgaaaggatgagtacttcgtcttcaatggaaagttagaggatactaacagnaatccacacatctgcgtttaacatctttatatccttttgttttgtttgagatagttcttg

SEQ ID NO: 10284 - DNA, 121 bp, Artificial Sequence
  Synthesized
  misc_feature (61): n=t or g
tcattgtaattcagtttgagatttctactcagtttcacaggaacccttcctgtcaccttgntttatggtgccaagcatgtttggaggttacacacttctgagtgcaacttctgaggcctgt

SEQ ID NO: 10285 - DNA, 121 bp, Artificial Sequence
  Synthesized
  misc_feature (61): n=a or g
ttggttttggctcagaagtgaatatttgcacgtgtgtttgtagatgaagttgtgaaatacngctttgccacaccagctactgggaacaagggctttatcaggcaaacacgcttttcaagga

SEQ ID NO: 10286 - DNA, 121 bp, Artificial Sequence
  Synthesized
  misc_feature (61): n=t or c
ggtttcaaagctgtctggacaagctttgagttagccacattaaaagcaaggctctgtgtgntgtggtttcagaggaagggagatcaagagctctttgcttatcccctttcctgtcgcgcac

SEQ ID NO: 10287 - DNA, 121 bp, Artificial Sequence
  Synthesized
  misc_feature (61): n=a or c
tgcaaagcgaaaacatttttttttcagaagccgactcatcatatattgtttttaatgattnattccataagcagccgctctcaggtattacacacttatatcccctatttattccagtacc

SEQ ID NO: 10288 - DNA, 121 bp, Artificial Sequence
  Synthesized
  misc_feature (61): n=t or g
tactaaacatgggaatcattctaatgaacttatcttgggcataatgtagactatgagcacngccatcagtggctggctgattaattaaaaaaccctggctaacattttaatgttagtcata

SEQ ID NO: 10289 - DNA, 121 bp, Artificial Sequence
  Synthesized
  misc_feature (61): n=t or c
tcccccaaactcaataataagtacaaaacccccagagcccacccagccgcagcatccccangcctgaacccaaagcatctagcatagaaccacagaatcattcaggttggaaaagagctct

SEQ ID NO: 10290 - DNA, 121 bp, Artificial Sequence
  Synthesized
  misc_feature (61): n=t or c
aagtcacctggctgatcacgatctcttaagaaaagcatcaatctgttattaaacagtctangggtaccacttgggtacgaaccctgcgttgaaggcttctctccatttgggtgaaaggaca

SEQ ID NO: 10291 - DNA, 121 bp, Artificial Sequence
  Synthesized
  misc_feature (61): n=a or g
aggatctacgtcagatacaaacaaacctgttagagagtacatatcagtgaaaaatgttcantgaacaccatggtttatcatacacactccctcactgaacagaatttctcaactgcccatt

SEQ ID NO: 10292 - DNA, 121 bp, Artificial Sequence
  Synthesized
  misc_feature (61): n=t or c
gcaacagcagtgagatattgcacttttcaagagacaaactattaaagttccctttatgtgncaaacagaattaactgtcataaactatctgtactgcaagtataaagcatgtattccattt

SEQ ID NO: 10293 - DNA, 121 bp, Artificial Sequence
  Synthesized
  misc_feature (61): n=a or g
gcatttcagacacaccactccactcttccccctttaaggacaaagtgatcatctctcagcnacttatcctcccagactctggatgcagactgcctatggcactgatttcacatccattttc

SEQ ID NO: 10294 - DNA, 121 bp, Artificial Sequence
  Synthesized
  misc_feature (61): n=a or g
gtctgctggtgtctattacaaactgtgtaatatgttttctatcattatccatgaattcacnctgtgactgcacacaatgctctagccctaccaccatgataaaataactgtataaagcaat

SEQ ID NO: 10295 - DNA, 121 bp, Artificial Sequence
  Synthesized
  misc_feature (61): n=t or g
gctccaaggggcagtatggaggaggccatcttgcttacaggaactgacaaggaacttaacnctatacatgcccacgatgccaaaccatttgtcctttagggcacagggtgagctctggctc

SEQ ID NO: 10296 - DNA, 121 bp, Artificial Sequence
  Synthesized
  misc_feature (61): n=t or c
agaataaatggaagataacgtagaagagaaatacaattgctgggatgaagatcagagagtngtaaagctgacaaataaatagaaaagagacatagagaccaaaaacagaaaaaaaatgaag

SEQ ID NO: 10297 - DNA, 121 bp, Artificial Sequence
  Synthesized
  misc_feature (61): n=a or g
atttagttttgtttgtgttttctgtagaggtgatgtagaagcatgttgttttgacactaanttgtactttctgcctttaggaatgtgtaatgattttcataattgagaaataaagctaaac

SEQ ID NO: 10298 - DNA, 121 bp, Artificial Sequence
  Synthesized
  misc_feature (61): n=a or g
accccaagtgagggggtgacagagacaagcgactttcaagaaacgtgtttcaggatagatnctacactttaagcagtattccttgccccacccaggccccagaaatatcagagagggaggg

SEQ ID NO: 10299 - DNA, 121 bp, Artificial Sequence
  Synthesized
  misc_feature (61): n=t or g
aagcatgcttgacatcagcaccgactaaaacaaacagacaaattgcaaagcctctgaaaanagagaattgctccttacagtttgcttggaccacctctgaacagagggaatctgtatcaac

SEQ ID NO: 10300 - DNA, 121 bp, Artificial Sequence
  Synthesized
  misc_feature (61): n=a or c
ttacttctcttcagttaaaaatagtttagtttgtttctcctcatatttaactgctgctgcntaaagagttctctgtacatgttagtggtgcagcatggaggaaagacattcaactcccatc

SEQ ID NO: 10301 - DNA, 121 bp, Artificial Sequence
  Synthesized
  misc_feature (61): n=a or c
tggtcttccttaggaatttgttattgccctctcttggagaagggttattggaacaaagtgnctttagactgacccagatcttgtgttcctgaatccttatttgcaatgcagcacatttaca

SEQ ID NO: 10302 - DNA, 121 bp, Artificial Sequence
  Synthesized
  misc_feature (61): n=t or c
aaataaacagctacatattgagatctggactcactactgactcacggatacaaccgcctcncctccccacagttttatttgggagaaattatttggaatttcttgagattttttactgcgg

SEQ ID NO: 10303 - DNA, 121 bp, Artificial Sequence
  Synthesized
  misc_feature (61): n=a or g
agtgtacatcaacatatgttaccagcctgtatgttcagcaggataaaaataagacaatacnaaaatgtgtggtcaagatccacaaagaatataattttttggggccactgtgtttaatttt

SEQ ID NO: 10304 - DNA, 121 bp, Artificial Sequence
  Synthesized
  misc_feature (61): n=t or c
caacccaaagctttccttctgtaatattttgttttgttttaagttgatagcaatgaaatgntttggtgagtgtctatgctgtcttttatcactgattccagccaataaactatgtatgact

SEQ ID NO: 10305 - DNA, 121 bp, Artificial Sequence
  Synthesized
  misc_feature (61): n=c or g
gaccagcttctgtttggtacaaccatcgcacacctgcacataacagagatcacggaggcanaacatacccaattttccttgtattcagactgctgattgcccagtgtatggccacagacag

SEQ ID NO: 10306 - DNA, 121 bp, Artificial Sequence
  Synthesized
  misc_feature (61): n=a or g
tagcctggagaacagacaatatgatctacaaaagattagcactacagataactttgcaacntatagtcagaataagagccctatttgatcttgaatactttaacattgtatttaagttttt

SEQ ID NO: 10307 - DNA, 121 bp, Artificial Sequence
  Synthesized
  misc_feature (61): n=t or c
tggctttagataaagactttggtcacatgacatcagctttcgtcaaattcctctgtctttnggacagaataattattaactgtattccttaaatcccagcatcctggcgaaataatagatt

SEQ ID NO: 10308 - DNA, 121 bp, Artificial Sequence
  Synthesized
  misc_feature (61): n=a or g
atttttcaagagctcagcatgcagttagttacatacatgcttgtatatatgtgtgactgtnctataatcatgcagtctcagttatgagatcaaatgggctcgcttgagtaagtacgcacat

SEQ ID NO: 10309 - DNA, 121 bp, Artificial Sequence
  Synthesized
  misc_feature (61): n=t or c
tctcgtttgttttattgtaattggtttctgcaacagataattaactgtggaactcactccngtaagacacgtcagagactgagaacttgtcaaggagagagagaaagggagaagtgctgat

SEQ ID NO: 10310 - DNA, 121 bp, Artificial Sequence
  Synthesized
  misc_feature (61): n=t or c
gctggccttgcaggacacctgataatttaagagcgacttttttttttataatgaactctangtctctttgtcacacacatccatacatgtgcttttaattgtgtttattaggtaagatttt

SEQ ID NO: 10311 - DNA, 121 bp, Artificial Sequence
  Synthesized
  misc_feature (61): n=a or g
gcaaaggtactctgaaattttaactgaggatgcaaatgttatttaataagctgtgtttacntgcaggtagagcactaatactgactgaatgcacacagaagcaagcagggagggaaacaaa

SEQ ID NO: 10312 - DNA, 121 bp, Artificial Sequence
  Synthesized
  misc_feature (61): n=t or c
gcttcctccgaacagatcgccgggaataaaaaaccgataataataatcatgataaagtganggaaagaagccgagaaaaaccaatctgcgccgaattagtaggaccgcaaagtttctatcc

SEQ ID NO: 10313 - DNA, 121 bp, Artificial Sequence
  Synthesized
  misc_feature (61): n=t or g
agggtaaatatttagaaaataatgtcgtgtgttgcagtaggcgtgaactgagaattaaatnatactcattccattctaaaagatggtattaaatttaaatgcctaagagttcatgatcacg

SEQ ID NO: 10314 - DNA, 121 bp, Artificial Sequence
  Synthesized
  misc_feature (61): n=t or c
gttggagatagcctagatcctgcaatgggattcataacggcccccaaactagccagaaacntcccagatttcctgagcctgtctagagtagatgtttttctttcattagcttgtcatagtt

SEQ ID NO: 10315 - DNA, 121 bp, Artificial Sequence
  Synthesized
  misc_feature (61): n=t or c
gaagattttgacaatggagccaggtgtttctttgacaagtgattttatttctttacagaangtgtttgaaatcccagttccagaaacgtggtaagcattgagcagcttccttgcttactgc

SEQ ID NO: 10316 - DNA, 121 bp, Artificial Sequence
  Synthesized
  misc_feature (61): n=t or c
gctcgcataggcgtatagaccccattcatccgaatggaaatgataaataattggattccangtggaaaacccacaggggctaaaagactgtaggggtggaaggctccatccatgcgtgggg

SEQ ID NO: 10317 - DNA, 121 bp, Artificial Sequence
  Synthesized
  misc_feature (61): n=a or g
aatcataaaaaaatgtaactggcttgtgtgtgaccatctacattctgtaagatctgaaagngatattccataaatattccacaacatttagcacccagaacttgttcaataaaacagacaa

SEQ ID NO: 10318 - DNA, 121 bp, Artificial Sequence
  Synthesized
  misc_feature (61): n=t or g
caacaggctctatttatccctgcaagatgtttcagcaggagttacagacttactgacgcanggcgctcatctgaagaaactgctgtgggaactggaacaaattatctgggaatctagcatc

SEQ ID NO: 10319 - DNA, 121 bp, Artificial Sequence
  Synthesized
  misc_feature (61): n=t or c
aagatcaattgaaatgtttttgagtgctttctgtgtgaaatgttttgcaaagcttgaagtnccaaatatcgtatgcagcatgtggtaatttaacaagctcatgcttcatgctacatggtga

SEQ ID NO: 10320 - DNA, 121 bp, Artificial Sequence
  Synthesized
  misc_feature (61): n=a or g
tgagctggagaccactcctgatgctctgtgcaggacctgcaggtgctcttactcatcacantcgagactgaggatattccttgttcctgctgcccctccctatcctggccatcccctacca

SEQ ID NO: 10321 - DNA, 121 bp, Artificial Sequence
  Synthesized
  misc_feature (61): n=t or c
agtttcaatgtccctgaagaggaaaaaagaagattgtcctgaaaatattaaaagggaacangatgtctgctaacactgggccccacatactctttcagcactcatggtctgcacatggagg

SEQ ID NO: 10322 - DNA, 121 bp, Artificial Sequence
  Synthesized
  misc_feature (61): n=t or g
aatgttgggcctctttaatatgcaaaaaaaacaaaaaatgaagggtcattcagagaattanctgaacactgtgaatttcctaattgtctttcattgctttgtttctgttcataggtataac

SEQ ID NO: 10323 - DNA, 121 bp, Artificial Sequence
  Synthesized
  misc_feature (61): n=t or c
acaactgccattctcatgactgcttctttccttgccagacagtgaactccccttcagcatnaagtagccaaaagcaaggacatgtctggataagaatctgctttcctgcagcacagctgat

SEQ ID NO: 10324 - DNA, 121 bp, Artificial Sequence
  Synthesized
  misc_feature (61): n=a or t
tcagcaaatagtttctgaatgttctgtgttcatctgttgccctgatcactcaggaaggaancaaggacagagcattattgttgcagatagaaatgcttgttgcattgttgtgcatatattt

SEQ ID NO: 10325 - DNA, 121 bp, Artificial Sequence
  Synthesized
  misc_feature (61): n=a or t
ctgaatttacttaattttggtggttccgctgacagtcatgctgagcagtttatacattttnttttacactggtaactagtagtattcacaacctgacagttgtttaagatggtttaaaaat

SEQ ID NO: 10326 - DNA, 121 bp, Artificial Sequence
  Synthesized
  misc_feature (61): n=t or g
gggaaataagaggagtgcgtagctgccttcgttttgagagacactgtggaactggagtggngcaggtatggaatgatgaagtgtggctctctccttggtgggaatcggggagcttggctgg

SEQ ID NO: 10327 - DNA, 121 bp, Artificial Sequence
  Synthesized
  misc_feature (61): n=t or c
tgccgtttttaagcataacaaaaacatgcttcttgtaccatgttttacagaacgtcttgtntgaagctaatgaaattgctgctctactctacagcatgtgcctctgagggctattcccatg

SEQ ID NO: 10328 - DNA, 121 bp, Artificial Sequence
  Synthesized
  misc_feature (61): n=t or g
tcagtattagagagctctcatcagatcccttcgttttctgcctgtccccataacattaaanaaatgtgcttgcatacaaacagatgatgaatcaggttatgcagggcttctgtgctgaaac

SEQ ID NO: 10329 - DNA, 121 bp, Artificial Sequence
  Synthesized
  misc_feature (61): n=a or g
agcgttcaaatcagtttggtacccacctcacagataactacatgtaaaccttcttagcatngcttggaagagtggagtaatgccaaaagccctacaagtcagatgcttcttcacaggggca

SEQ ID NO: 10330 - DNA, 121 bp, Artificial Sequence
  Synthesized
  misc_feature (61): n=a or g
aggcctgataggttgtctttttaaagagtatcttgtcctcgtggtaaatagctacaggtgntgattagatcatctcaactttttcttcaatttgcttttacaaagtttttttcagtctttt

SEQ ID NO: 10331 - DNA, 121 bp, Artificial Sequence
  Synthesized
  misc_feature (61): n=a or g
catgtagcttattacaaagatccaactgggcatactggtctcaaaagaaaggtgatgcacntgtgcttcagagctgacccaaagtgatcaaaatcactaccaaaatgaatactgctttgca

SEQ ID NO: 10332 - DNA, 121 bp, Artificial Sequence
  Synthesized
  misc_feature (61): n=a or g
acagtgcaggcttagggtgccttactgaaggacaagaggcttgaaagacagtggtgcaaangagcaatctcccacaccctctaataatatgcagaagtgctttggtatagagcttgttgtg

SEQ ID NO: 10333 - DNA, 121 bp, Artificial Sequence
  Synthesized
  misc_feature (61): n=c or g
ttacgtaaccttcacagccagcattctggaagaagaaaatctgattaaatataacactgtntaaagcacgcagaaggatatacaacaaggaaaaaagatcaacagaaatgttggaaaaaga

SEQ ID NO: 10334 - DNA, 121 bp, Artificial Sequence
  Synthesized
  misc_feature (61): n=t or g
tcagattgtgtcaaagtgaacgaatggaatcacttctatcacatttcccattgacaaaaancttagccaaaccctcactacattttctactcttgtgctcagtgtatgtaacgtgatccat

SEQ ID NO: 10335 - DNA, 121 bp, Artificial Sequence
  Synthesized
  misc_feature (61): n=t or c
aaacgtctgtgccgtgcctgccagccttttgttttacattctgttacatactacaacccanaaagtggagcctcaatgctaccaacagagtctaagcagatatgctgctgaatgttaccat

SEQ ID NO: 10336 - DNA, 121 bp, Artificial Sequence
  Synthesized
  misc_feature (61): n=a or g
atcacatgctgtcatcagctcattcagaaggagtttaatttgtatgtccagctcaagcacncgttactggggaaaatcatctatcccctacactttgaggagggcattcatagtataataa

SEQ ID NO: 10337 - DNA, 121 bp, Artificial Sequence
  Synthesized
  misc_feature (61): n=a or g
ggtcttcttccttgtcttcttagaaagatcataatgactgaagtagaccagagaagcgcantttcaaaaccaacttgctctctcctttttatctagccatacatttgttgcctataaaagc

SEQ ID NO: 10338 - DNA, 121 bp, Artificial Sequence
  Synthesized
  misc_feature (61): n=t or c
ccgcattcctcttttaaaatagcctatctaggattccaggtgttcttatcatcatggtatngagcctgattttgctattagtgctgcttaggacagcaaaggaaagactgtccttgggtga

SEQ ID NO: 10339 - DNA, 121 bp, Artificial Sequence
  Synthesized
  misc_feature (61): n=c or g
tgctgtgaccccaacttaacatgtaaacatggcaagggatatgagtacgattcctctggcnatcactgaacttgaggggaatctttctttgacttctatgggcttcaggatgagtctccaa

SEQ ID NO: 10340 - DNA, 121 bp, Artificial Sequence
  Synthesized
  misc_feature (61): n=t or g
acgagcagagttctggttttgggttctgaagtgagtccttactgaggtgaatagatctctnctaaagaggctccttaactttcattctgctacaggtcacgtcattacaaagtatttgtca

SEQ ID NO: 10341 - DNA, 121 bp, Artificial Sequence
  Synthesized
  misc_feature (61): n=a or g
ctggagtttgctaccacatgtgcaaaatgtgagctcagcactcacagtgcccagtctttancacatctcaccgttgctttgggctcccaggcttacatagttcttcacatctcttaaatgt

SEQ ID NO: 10342 - DNA, 121 bp, Artificial Sequence
  Synthesized
  misc_feature (61): n=a or g
ttatgcatgttttgggggcagataggttgttcccttaaaaactgtgctcttggggaatacnggcttgagaagagtgggaaactggaaaagcaagatgagttggagttttctgttaatattt

SEQ ID NO: 10343 - DNA, 121 bp, Artificial Sequence
  Synthesized
  misc_feature (61): n=t or c
gctgcctctccataagcattgctttccatttatctacattagacgagtgttttttgcacanactaagatgagatattcaacaaaaatgcttaaagaacatcattgcactgtactgcatttt

SEQ ID NO: 10344 - DNA, 121 bp, Artificial Sequence
  Synthesized
  misc_feature (61): n=t or g
gtcacaaataagtattcaaacaagactatgctggtggacagtcatttatgggctaagattncattcaagtgaaagactacatcttccatggtagaagataacttttctaacagaatggatc

SEQ ID NO: 10345 - DNA, 121 bp, Artificial Sequence
  Synthesized
  misc_feature (61): n=t or c
agttggaagagtttggtatctgggaataaaccagcaattaccttctcgtcattagcagagngtcacttcagcttcactaaaactgcatctgtattctcacataagacaacttctgccttcc

SEQ ID NO: 10346 - DNA, 121 bp, Artificial Sequence
  Synthesized
  misc_feature (61): n=a or g
ccatcttggctttctttcagcagtcaggtaggcaacttgaagattttggaccagctggtanaaatcttctcattacagccacccctcaggcttctcaggccacaggcatttatctaataac

SEQ ID NO: 10347 - DNA, 121 bp, Artificial Sequence
  Synthesized
  misc_feature (61): n=a or g
aacaattataatgaaacactgcaacatatgacatggcataacatgatataaatttatgctnagtacttgaacattcagtgaaaaattaaagacactacttatctgttctaccgtgacatct

SEQ ID NO: 10348 - DNA, 121 bp, Artificial Sequence
  Synthesized
  misc_feature (61): n=a or c
gctcctgtttgtttgtttctctttttacctccataactttacagctttataaaagaacatnctagagtggatgaggttatactgggtgttaatgtttaacagaacgtaaatgactttgtac

SEQ ID NO: 10349 - DNA, 121 bp, Artificial Sequence
  Synthesized
  misc_feature (61): n=t or c
gaacagaaacttccagcttccttaacaatagctgtgggcagactccaaagggagctgcatncagtcaggggtagccaaaatgaaagaactgagataggaaagtccatcaagaaggaaaaaa

SEQ ID NO: 10350 - DNA, 121 bp, Artificial Sequence
  Synthesized
  misc_feature (61): n=t or c
atatttagaagctaactctctgattttcctctgaaataggaactggctttggatttagaanggtgatttctgacattttgcttcaagatcattccagtatcagtttttccagatctatttc

SEQ ID NO: 10351 - DNA, 121 bp, Artificial Sequence
  Synthesized
  misc_feature (61): n=t or c
aaaagaacctgaaataaacttccagcaaaccatattgaatattaacgtcgtgttaagcccngaaaagctgcgttagtaaactctggaatttagattatatgcaacttcaacataacatcgg

SEQ ID NO: 10352 - DNA, 121 bp, Artificial Sequence
  Synthesized
  misc_feature (61): n=t or c
gggtatagattagtagactaaaacagctgatgctgaagcccagaattcattttgcaaaggnaattaaagtattctgcaaataaaaccattgcaaaggaaaattcacttgaaaaccacaact

SEQ ID NO: 10353 - DNA, 121 bp, Artificial Sequence
  Synthesized
  misc_feature (61): n=a or g
tgaaaaattagttagactaagttagttaactaagaaagttagaagatgattacagtgaagnaacaactataaagatcagctcctggaagtgagcaagatgtcctaacacagccttgaaccc

SEQ ID NO: 10354 - DNA, 121 bp, Artificial Sequence
  Synthesized
  misc_feature (61): n=t or c
gtgctgttcaggaggtggttcattgtgccctcttcatgagggataagtctaggggagaagngctcttgaagatgatatcaaaatgcaaacgtacaaagggtgctaattaatgctgagtaca

SEQ ID NO: 10355 - DNA, 121 bp, Artificial Sequence
  Synthesized
  misc_feature (61): n=t or c
ggatagtctgagctgtgtgctaaggcctcctttgcagatgttggcaactgtaggaaaatgntgtctgaataaattaaagcagtgcattccctttaggtctgttagccagcctgtactatat

SEQ ID NO: 10356 - DNA, 121 bp, Artificial Sequence
  Synthesized
  misc_feature (61): n=a or g
tttttcagtttgtaagttcatttctgcacagaatgctacagtttttcaagatctggggccnatattagcaagctcaagggaagaattgaaaataggagtagtagtttaataaaacagaaaa

SEQ ID NO: 10357 - DNA, 121 bp, Artificial Sequence
  Synthesized
  misc_feature (61): n=a or g
ccttttattcagtcctcggccagaaaggggagctgtggaattacagagcaaagcttacacnagcagtgtgctccgtcaggtttgcagaataacagctgggaaagggagagatgtgagagca

SEQ ID NO: 10358 - DNA, 121 bp, Artificial Sequence
  Synthesized
  misc_feature (61): n=t or c
caccctctcttgctgaggtcaggtgcttgaggagtggcactacaggcctgcacaagcaaanatcgcacaaagccagctcctgctggaaacataaagagtcccagacgctagaacagtattt

SEQ ID NO: 10359 - DNA, 121 bp, Artificial Sequence
  Synthesized
  misc_feature (61): n=a or c
aaactgaatgggtgtagagcaagagcacctctgtctcccagaacagttttatgaaagtagnggaatgcatactcacaagaaaggggaatgtgcttgtaagcaacatgccatgtggggagtg

SEQ ID NO: 10360 - DNA, 121 bp, Artificial Sequence
  Synthesized
  misc_feature (61): n=c or g
gggacacggcagcatggtggcactgttccaggggaatctcagctggctgagccagctgctntctggtcctgctgaatatttgatgtgaggtagaacgcagtacacaaaagaaaatctgcgt

SEQ ID NO: 10361 - DNA, 121 bp, Artificial Sequence
  Synthesized
  misc_feature (61): n=t or g
ctggctcttgccaatagtcactctgccaacagactacagagatcaactgcaggtaataagnatacataaatagaaagttaaagggtactaattctaagacctcatttaaccactagacaca

SEQ ID NO: 10362 - DNA, 121 bp, Artificial Sequence
  Synthesized
  misc_feature (61): n=c or g
gtagttcaggctgattaggaaacgattgtaggagcttcatctccatgggatagggaagggngaggtggcaggtggcagtacgtttgctccaggactattgattgtgcttttcaggccaata

SEQ ID NO: 10363 - DNA, 121 bp, Artificial Sequence
  Synthesized
  misc_feature (61): n=a or g
tatggaaacctcttgcttctttgtattgttttgataatgcaaaacagtcatgcagctaaanagcacaaccccttcagcaaaagggacctgggaaatggcaagtcactatgacactgatggg

SEQ ID NO: 10364 - DNA, 121 bp, Artificial Sequence
  Synthesized
  misc_feature (61): n=a or g
aggacacaacatcatttgagacctaaaaacctaccagaaatttcattattctaagctttcnttaagtggtgctgtaaggcctgtcatctcacaaagctcactagtgacaaaatttaaaatt

SEQ ID NO: 10365 - DNA, 121 bp, Artificial Sequence
  Synthesized
  misc_feature (61): n=a or c
caagcactgctggaccccaggtattctctgtcctcatctcctccatggaagacaagctgcngccaggtggttacaaccaccccagccaagatgctggcaacaaaaccagccaaacacaaag

SEQ ID NO: 10366 - DNA, 121 bp, Artificial Sequence
  Synthesized
  misc_feature (61): n=a or g
gaatgtctgctgatggtccaaacacctacctcattctcctacttgcttctttttaattcanttaagagacaagaaactaaaaaatgcatcaacagtacatgtaaagctgcacatggggaag

SEQ ID NO: 10367 - DNA, 121 bp, Artificial Sequence
  Synthesized
  misc_feature (61): n=t or c
gaaacttaggacttggcagtcactctgtgcatggcatcctgtgtctgtgcatcccatgtcngagcacttcgctgctctgtcctagagaatgtgggcaccatggtatccattgagagagctg

SEQ ID NO: 10368 - DNA, 121 bp, Artificial Sequence
  Synthesized
  misc_feature (61): n=a or g
ttctgtgattagggatgcttactttgaaagagtagtgatacaaagttcctctgactcagcngaatctattagccttcactctaacgcccttgtaggacagtgcctattctttgaccacaga

SEQ ID NO: 10369 - DNA, 121 bp, Artificial Sequence
  Synthesized
  misc_feature (61): n=c or g
aagaaattctaatatcatgtcaataggatttattttaaacagttctcaaaagaataccatnaacacaagtaacatttccttaaattcccctatgttgaaataccaaagagcagatattcta

SEQ ID NO: 10370 - DNA, 121 bp, Artificial Sequence
  Synthesized
  misc_feature (61): n=a or g
cagaagtgaggaagtagtagaggtggagtggctgtgcaaatccagatggagacgtctgtgncctgcatttctgggcaaaggacacagctagccttcagccacaacttctcagtgttcccca

SEQ ID NO: 10371 - DNA, 121 bp, Artificial Sequence
  Synthesized
  misc_feature (61): n=c or g
agcacacaaagatcagcttcactgagcaccatacatcaagtactgataaagatcttctcanatgattctttttcaagatactagaattttttattttttatttttaatcacaatcatgcta

SEQ ID NO: 10372 - DNA, 121 bp, Artificial Sequence
  Synthesized
  misc_feature (61): n=t or c
ttaagggcatgacttgactgtgtaaatacaggcttttgacagtgcttcgtggctgtcctgnttcaaattatggccaggcagcaattggtggtgacagcgcatgcagggagcacagctgagc

SEQ ID NO: 10373 - DNA, 121 bp, Artificial Sequence
  Synthesized
  misc_feature (61): n=a or t
aaacaatgaaaagatgggacaaaagcatttatgatgatcttctggtcacggagtgactcanattttcagccatggaatgaggttaatggcacagttgccatttgtgcttgtcaggtttgtc

SEQ ID NO: 10374 - DNA, 121 bp, Artificial Sequence
  Synthesized
  misc_feature (61): n=t or c
tgtccttttcctaggtgttttaagaatttgtgggttgcataccctttctgaagctaaagangggttatcaaaatcagagccaccacttaaagcatcattaaactctggcagtgctttaacc

SEQ ID NO: 10375 - DNA, 121 bp, Artificial Sequence
  Synthesized
  misc_feature (61): n=a or c
tcaattacactcatgtatggtattgggtttgtgatagactgtcatacacaggattatatgnttgtaaagggtgaaaggcatttgttaatcttctgttccatcaatgctgtcttgcttggac

SEQ ID NO: 10376 - DNA, 121 bp, Artificial Sequence
  Synthesized
  misc_feature (61): n=t or c
aaactccattaattatgaaagagttagcaataaataaataaactctcatagttgaagatcngctttgttcagatttaaccatcaacaattgctccttcaatacgtgaaggaataaatgaac

SEQ ID NO: 10377 - DNA, 121 bp, Artificial Sequence
  Synthesized
  misc_feature (61): n=t or c
taccaagccatctctgacatcctagcgcatctggctattctttctccatccaatttgacanccctcacatgacctctttaacatgatctcttactcatgaagagcaagagatggagatctt

SEQ ID NO: 10378 - DNA, 121 bp, Artificial Sequence
  Synthesized
  misc_feature (61): n=c or g
agtccatgcatcagcatcttgtctataaggatcttaagtgggataatgatagaggccttanagaaggccttcttttaaatcccaggtactctaggaatggcagggaaggtactttatgtag

SEQ ID NO: 10379 - DNA, 121 bp, Artificial Sequence
  Synthesized
  misc_feature (61): n=a or g
gcacactttaacaaaatgtaagagtttttcaacataacaaaatgcttccatggaagctatntatatattttacctagagtgataaaaccatggaagttttatcctagttatggtaatttga

SEQ ID NO: 10380 - DNA, 121 bp, Artificial Sequence
  Synthesized
  misc_feature (61): n=t or c
aaaactgtgcatcttctgtacatacacatgcttacatacaatattttgtacaaacacaacntataattttagctattaaaagagagtaccgatgctcagcaatatcacttgaaggcatagc

SEQ ID NO: 10381 - DNA, 121 bp, Artificial Sequence
  Synthesized
  misc_feature (61): n=a or g
gaaagttcttgggccacatgtaaggtatataataaactttgtgtatataaggaacaaaacntctttcatcattttaatgttttttaattacgacacacacaaaaaagcaacaaaaacagaa

SEQ ID NO: 10382 - DNA, 121 bp, Artificial Sequence
  Synthesized
  misc_feature (61): n=t or c
atgcaaatgctacactgtaaagaataagtggtttgttacggattatatacccgttgccatnttacacaaataaaaaaacatcaataaccaagatctttccacatcactaatagcccaagac

SEQ ID NO: 10383 - DNA, 121 bp, Artificial Sequence
  Synthesized
  misc_feature (61): n=t or c
tcagacttttcctgctaaaattctcatcagtactcagactgataagtactcatacccaganatttttgttttactttctagaaacatttctcttgctttttcccacagacttttctgttag

SEQ ID NO: 10384 - DNA, 121 bp, Artificial Sequence
  Synthesized
  misc_feature (61): n=t or c
gtaccatttataatggatgaaaagggaacaggcaagcaaaggatgtaagttcatagaaaantaattgaaaagtagatttaattagtgtactgaatatcaaagagtttaaaatgtcaaatgg

SEQ ID NO: 10385 - DNA, 121 bp, Artificial Sequence
  Synthesized
  misc_feature (61): n=t or c
aaagatctgagtatttgtgatgattctctctggcttttctccagacctttcttgaggtgcntaaactggaagaactcctccccaggaggactgaccagtgctggtggttgggcaggaagga

SEQ ID NO: 10386 - DNA, 121 bp, Artificial Sequence
  Synthesized
  misc_feature (61): n=a or g
gcaattgttaaatgaaagtaatgggctgaatggttaatagagaaaatgagtgttcagtacnccagggtatgagggcctatcaagggaataggaagacactgttttttatccaaatcttaac

SEQ ID NO: 10387 - DNA, 121 bp, Artificial Sequence
  Synthesized
  misc_feature (61): n=t or c
cctgttacttctctagactacagaaaatatgagcttgcttgattgcatttttgtttgttcngtctcccccttgctttatgagaatgctgtttggcaagctgtattaacaagacttaagtat

SEQ ID NO: 10388 - DNA, 121 bp, Artificial Sequence
  Synthesized
  misc_feature (61): n=a or g
tcatcttaattgctttcttttccctgtgtttatttgggttcccaagtccccgagtgatacnttttttgtggctctggggagtttctacatccttcattatttattttagtatttctttctc

SEQ ID NO: 10389 - DNA, 121 bp, Artificial Sequence
  Synthesized
  misc_feature (61): n=a or t
ctgcagaaacagactttagctgcaacaggaagtactgagacattgaaatcttgatcccagngcatcagcaaggtcacacaaagagtgttaccacccatcaggccagatctcctctttctgc

SEQ ID NO: 10390 - DNA, 121 bp, Artificial Sequence
  Synthesized
  misc_feature (61): n=a or g
atgctcatatattacttaaatgtgaaatgctgaagctcttgaattaagaaaaaataagctnagttggtggcttaggtagtataaggaaagtaagcttctataacttgaattgcaacatcta

SEQ ID NO: 10391 - DNA, 121 bp, Artificial Sequence
  Synthesized
  misc_feature (61): n=t or c
aatacaccaatttacatattactacttactcataattatacagcagaaagccttcaacaancaaaatataaacatcttctgtcatcttcagactgttacatgtgtccattggttcttcagt

SEQ ID NO: 10392 - DNA, 121 bp, Artificial Sequence
  Synthesized
  misc_feature (61): n=a or g
ttgtcacttcacttctccaatctattgaggtctttctggaaagcagcttggtcctttgggntttcagccactccccctgtgaacttgctgagggtgcactctagcccatcattaatgaaga

SEQ ID NO: 10393 - DNA, 121 bp, Artificial Sequence
  Synthesized
  misc_feature (61): n=t or c
aataaaataacaaaaacaaacaacagtttggccctacttttcaccagtacaaaaaactaangtgcccagctgagctaatacaagtggaaaataatgtttgtttttaattaggagtacactg

SEQ ID NO: 10394 - DNA, 121 bp, Artificial Sequence
  Synthesized
  misc_feature (61): n=a or g
aaacagatgagtgcatacaaggtgctgtcctccttcaaagttcacagtattatccagtctntcagtctgctgtgtcagagactaactgctcttgtgatgggtagactccacaatcactctg

SEQ ID NO: 10395 - DNA, 121 bp, Artificial Sequence
  Synthesized
  misc_feature (61): n=t or c
aggcaaattcttggattgcaaatttgtgaataggccctaaaagcgataaacataaccatcnctcatacaagaagtatgctgggaaagtataagggaatagaacacatgaagtgactaggtt

SEQ ID NO: 10396 - DNA, 121 bp, Artificial Sequence
  Synthesized
  misc_feature (61): n=a or g
caggggttgagagcaggctgggcatttctctgctgtgagatggacacatgctgctccccangcagtttggaaagtactcttttctttttttccaggtggggtggaactcccagccaactcg

SEQ ID NO: 10397 - DNA, 121 bp, Artificial Sequence
  Synthesized
  misc_feature (61): n=a or g
ttgggtcaaggtcatgacttggaaacatgctagagaggaatagactcttattttacttgantttattcagctaatccttgtctcaaacaaaacagtaagagacacactaggaaagtctacc

SEQ ID NO: 10398 - DNA, 121 bp, Artificial Sequence
  Synthesized
  misc_feature (61): n=a or g
gggtgtggggagggacaagcactgagtgcgactcatatgttcccagaaagatgggcagcanctcagcctccctgctttggaggcagcttcctccccgtggaaactccccacccactcaagt

SEQ ID NO: 10399 - DNA, 121 bp, Artificial Sequence
  Synthesized
  misc_feature (61): n=t or c
gggaaattgatcttccctgggttatatagcaacagaagtcccatgtttccagccactgacnataggcaggtagaggctgttgtgtgggcaggatcttctttgtctctcagagtcttagaag

SEQ ID NO: 10400 - DNA, 121 bp, Artificial Sequence
  Synthesized
  misc_feature (61): n=t or c
ctgataactgactcatggctcctttgctctcctgttgattgtgtgccacatctaaatcatngtcacattgcagaggtgtatgtagggaatttcctgattaggtacaggactggctcttcaa

SEQ ID NO: 10401 - DNA, 121 bp, Artificial Sequence
  Synthesized
  misc_feature (61): n=a or g
acctgtgagtaatggaagtatataggacatgaagataaacatttctttttggactgaaacnaactctacagcacgtacctcgtggttaacgaagcgtatgtctcgggagaatatggcagcc

SEQ ID NO: 10402 - DNA, 121 bp, Artificial Sequence
  Synthesized
  misc_feature (61): n=a or c
agctaactatagctgattattatggagagctattaacatgctgttcagtttgctcttgaangctcattctgtataagctgaatccatcattcagtgatctgttttcagaaatactttagca

SEQ ID NO: 10403 - DNA, 121 bp, Artificial Sequence
  Synthesized
  misc_feature (61): n=a or t
gtatttccccccctaccctgcctcctttcagactttgttcgacatgtgaatagctccattngggaaatgtgaaagcactggactacgtattgacttgctgttctgacattccagagggaaa

SEQ ID NO: 10404 - DNA, 121 bp, Artificial Sequence
  Synthesized
  misc_feature (61): n=c or g
aagataggtacaaatgcatgtagttgtaagcagtcattagcagcagagcatcttcacaatnactgttgcaatccactgcaggaaaattcacatctgttttttggattttagaaagcatttt

SEQ ID NO: 10405 - DNA, 121 bp, Artificial Sequence
  Synthesized
  misc_feature (61): n=t or g
aatactagcaaggagatcatgccatagtgatgtcaatggcaaacctgctgctgtcctcagnggactcagggcctcacacaggatttcataacttgctcattctacttatgatgtatttttt

SEQ ID NO: 10406 - DNA, 121 bp, Artificial Sequence
  Synthesized
  misc_feature (61): n=c or g
taaggaattttgcatttcttagtttttcacgtataaaatatatttttgtatgcaacctggntgaatttacaagaatgacagtatctagtaataggactagggagaatggactcaagttgtg

SEQ ID NO: 10407 - DNA, 121 bp, Artificial Sequence
  Synthesized
  misc_feature (61): n=c or g
tcactagtgctggctgtgccacaagttgctgtgggaagtgctgggaaaagttttcaattancagtacttgcatcttggattcattttaccagccactgtatcatcactgtgcgaacagaga

SEQ ID NO: 10408 - DNA, 121 bp, Artificial Sequence
  Synthesized
  misc_feature (61): n=a or g
gtttttgagtagatcctgatcgttttatcctcttgagaagaggaatcctggaaaaacagcncttctgctactgtggccgtgattatttctcctgtctgtagtcaacagagctgtgagatct

SEQ ID NO: 10409 - DNA, 121 bp, Artificial Sequence
  Synthesized
  misc_feature (61): n=t or g
ttattttttccactgagcagattcttcaatgagtgttataggaagccattctctacttgtnttcatacacttatgtttggccataatgtaaatgagaaaggtgttttagcagtaagtaaaa

SEQ ID NO: 10410 - DNA, 121 bp, Artificial Sequence
  Synthesized
  misc_feature (61): n=t or c
agtttccattcgatggcaaagtgaaagatgaattatgctattattatgagcagcaaaatanagtaatagtagctcttttgaatgaacttttaaactacttaagatgatcacataatgaact

SEQ ID NO: 10411 - DNA, 121 bp, Artificial Sequence
  Synthesized
  misc_feature (61): n=a or g
gcccctccccaaaggtgggggtgtgggggggtcctcggctgggccacagctccgtgtcagnggcgttttcgcaggaatttgtcaccacctaccaaaatggctttttagttttcttttcccc

SEQ ID NO: 10412 - DNA, 121 bp, Artificial Sequence
  Synthesized
  misc_feature (61): n=a or g
gctgcagtcttattgatggtcataaaaagtaagaagctgtttgccattattaaaatagtantgcttgggtactgcctggtgattgctgtcagcacggttggttttttaatttgtattccag

SEQ ID NO: 10413 - DNA, 121 bp, Artificial Sequence
  Synthesized
  misc_feature (61): n=a or g
cagtgacagtggttccatacctgagacacaaatgccttgctcaatctagatctggcagccngagattctctgtgctcccaccagtatagatgtctctgctgtgtcttaccttttgggtggt

SEQ ID NO: 10414 - DNA, 121 bp, Artificial Sequence
  Synthesized
  misc_feature (61): n=t or c
ggagaacactgggaaaagtatctgatgtgtttctctgttcttccactctccttcagacatncactttcagctgatgttggaaagaggacaggttttttgactaacttagtgcagctactct

SEQ ID NO: 10415 - DNA, 121 bp, Artificial Sequence
  Synthesized
  misc_feature (61): n=a or g
tccatgaagaaggaaaaaaaaaaaagagggggcggggggggggaaataaagttataagaanttaaagagacaaagggaaagctgaaggatgataaaatatttgcatgtgatcggatcaagt

SEQ ID NO: 10416 - DNA, 121 bp, Artificial Sequence
  Synthesized
  misc_feature (61): n=a or g
aaaccttacagttcaacttcacattaaaggaactgtcatctgctttgagactgcttcacanaacaaggaaaaccacagtaagctgcaacaaccaaggtgagatgcactcctgatctgaacc

SEQ ID NO: 10417 - DNA, 121 bp, Artificial Sequence
  Synthesized
  misc_feature (61): n=a or g
tatcatttgcttagcttagattaagaaaccttgacagtattgtagggaaggttatgacatnaattattaattggtgtaaggtattaggagaaaactttaaaatcatatattaccagtttta

SEQ ID NO: 10418 - DNA, 121 bp, Artificial Sequence
  Synthesized
  misc_feature (61): n=t or c
aaaaaaaaaaaaaaaaaaaaaaaaagtatttccagttaagaaaatagtagaaatttgcatncttttatcttcttactgttagagttgctgagaagtcaacaatatatgcctggaagttatc

SEQ ID NO: 10419 - DNA, 121 bp, Artificial Sequence
  Synthesized
  misc_feature (61): n=a or g
catgtgcttttccctggtcagtgcacggggtgcctgtgtccatcccatgtcagcttcttcntgtgacacccacagcatttccataaagagatgctcctgtgcctataaatagctggagaca

SEQ ID NO: 10420 - DNA, 121 bp, Artificial Sequence
  Synthesized
  misc_feature (61): n=a or g
tatactgtttttcttgagaccaaaatcaggttgactgaatgttgccatttcatttaagtgngcatcaaggaagtgggaagcctttcagaaggcttccctctgtgggtctcaaaacagcctg

SEQ ID NO: 10421 - DNA, 121 bp, Artificial Sequence
  Synthesized
  misc_feature (61): n=t or c
acaattgttgctacttccttctccatccccaaacacacaaactattcctgagttattacangtttcctgccaacacctgccaaccccacacacacctgctcagagagcttccgaaatcaaa

SEQ ID NO: 10422 - DNA, 121 bp, Artificial Sequence
  Synthesized
  misc_feature (61): n=t or c
aacattcccaccagtaagaaatcaactgggtgttcataggtgacctggctgtcagactccnaggccaaattaattgaaggaggaagaagtatcgagtaaatgattttgcacgcctaacctt

SEQ ID NO: 10423 - DNA, 121 bp, Artificial Sequence
  Synthesized
  misc_feature (61): n=t or c
tatgacttagagattcctcaataaatgtttttacacctatcatccatcgttttggatggcngcatcgctctaatttctgccaccagaaataagtgctctccagtaccagctagaattccaa

SEQ ID NO: 10424 - DNA, 121 bp, Artificial Sequence
  Synthesized
  misc_feature (61): n=t or c
ttattcctccccagatgcaagtctctacttttactcttttttaacccccataaattttctncctgcccagccctccagtctgtccatgccttgttcactggtagtacagccttctggtgtg

SEQ ID NO: 10425 - DNA, 121 bp, Artificial Sequence
  Synthesized
  misc_feature (61): n=a or g
cagtaactgtcctataatgtagtaattaaactcacatagaagaagtgcttaatttaaagcnttcgcaaattgtttctggtctccagggcctaaatcagtgccgcaggaggaggtgagatgg

SEQ ID NO: 10426 - DNA, 121 bp, Artificial Sequence
  Synthesized
  misc_feature (61): n=a or g
tccccgcagtcagattcccggtgtattcctgtgacaggcagagttaaggtgacaacaggcngatccaagcataggggtttgtctgcctgggtgctgcagccctgctgctttgctgcgggtc

SEQ ID NO: 10427 - DNA, 121 bp, Artificial Sequence
  Synthesized
  misc_feature (61): n=a or t
tgaagggtaatagagagaggagcagtgaagactggttaacctttcctttgtggcaactagnttatccactcattggcattttgtagttaatgggcactggccattgtcatagccacttggc

SEQ ID NO: 10428 - DNA, 121 bp, Artificial Sequence
  Synthesized
  misc_feature (61): n=t or c
attaacccggggcctgtggctctcagggtaaggagaatgagctcttctggagggaagaggngcaaaagaagcgttcatttctctctgcagagcgatggaagaaagggagggtttggagtgg

SEQ ID NO: 10429 - DNA, 121 bp, Artificial Sequence
  Synthesized
  misc_feature (61): n=a or g
atacagtaaatattagaagctaccgttcctgcctttgctttagtttcttgggggaattgcntgaaagtaaattcaaatcagcggggatttgtttgtcaaattttgcaaatcattttccaga

SEQ ID NO: 10430 - DNA, 121 bp, Artificial Sequence
  Synthesized
  misc_feature (61): n=t or c
tattcgaggccagatggaacttggtgttttcaattaagcttcagctgggttttgtaattcnagttttttgttcaaacagagagctagagcaaaacatggcagaaggaatggaaagcagcaa

SEQ ID NO: 10431 - DNA, 121 bp, Artificial Sequence
  Synthesized
  misc_feature (61): n=t or c
ccccaattttgtgtcatcagaaaatttcattggagagtgactattctttgtgcccaggcanggaatgaagaatacgaaagacgatcaaattgtcagaaatgccgttactgtctgtctgcag

SEQ ID NO: 10432 - DNA, 121 bp, Artificial Sequence
  Synthesized
  misc_feature (61): n=a or g
tagacttcactactctcaacctggatgtgtacagattttccaatgttcagaggttcttatncagttttataattgaacagcattcacagatcattgtgtgggacttaagtaaaaaaatacg

SEQ ID NO: 10433 - DNA, 121 bp, Artificial Sequence
  Synthesized
  misc_feature (61): n=a or g
ttgaacgggactgggaagttttgcaaggagaagcaaaaaatctgcaaagctcaaatttgcnaaaagttctgttttgcagcgatgcactttgttctcattatgggttattaattatttgctg

SEQ ID NO: 10434 - DNA, 121 bp, Artificial Sequence
  Synthesized
  misc_feature (61): n=a or t
taagaagcaagtgggcaacactgaagaagatgggatggtcaggaagaagaactcggaggancgagggatggtgcattgtcttattgaagacatggatgaatgagtagctgttctgtactga

SEQ ID NO: 10435 - DNA, 121 bp, Artificial Sequence
  Synthesized
  misc_feature (61): n=a or g
ggacaatatagtctaaagagttttcattgatacataacctgtgtggaaaggttgcacagtntttctctatgcattccctctatgttttaatgttttatctggtcttgctgcaactacaggt

SEQ ID NO: 10436 - DNA, 121 bp, Artificial Sequence
  Synthesized
  misc_feature (61): n=a or g
tgagtaaggtttatactgctcattgttccataagatctaaactggcacaggcattgaaacnctctactatgacaggagcaaggcaacagaaaaactcttcctcagccctgttctccacttt

SEQ ID NO: 10437 - DNA, 121 bp, Artificial Sequence
  Synthesized
  misc_feature (61): n=a or g
gtcaaataaagtttaattcctctttgtttgtgaacaagatgtgtgcattatagatgcattnaaggaattagtacaggactgcttttttaaaagcctctcttacaaggagcaagattaaaaa

SEQ ID NO: 10438 - DNA, 121 bp, Artificial Sequence
  Synthesized
  misc_feature (61): n=a or g
cagactgatgcaattttttgagttaagaaaaggatttaaataagtcccacataattgcacnatgcttctgccacaaatactcatgtttgcaaaaatgcttacagcatttttattttttctt

SEQ ID NO: 10439 - DNA, 121 bp, Artificial Sequence
  Synthesized
  misc_feature (61): n=t or c
atgaagggtggaaccccaacttctccatgttataacaacacaaaacagaaaacagaggcangtacaaaatatcaacaccaacacccactccaccattagtcattttcagtagatttcaaaa

SEQ ID NO: 10440 - DNA, 121 bp, Artificial Sequence
  Synthesized
  misc_feature (61): n=t or c
acacgtgtgtatatttccttggccaaacttgaatcagggaccttaggagaccctaatttcnctgaagtgaagggctcagatctaacatgtctggttttcaggtccaaaattaatgtaggtt

SEQ ID NO: 10441 - DNA, 121 bp, Artificial Sequence
  Synthesized
  misc_feature (61): n=a or t
ttccatgagcttcactacataaaattgggcatttatctattgaactaaaagtgtccagggngcgctaccatacagctagcaaactactacctcatttttatgttgctcttgctaaacaaga

SEQ ID NO: 10442 - DNA, 121 bp, Artificial Sequence
  Synthesized
  misc_feature (61): n=a or g
atttagttactgtgttgtctgctgtgcaataaagatttcatgagaatgaacgcagaaaatncactccctgagagaaactactgcttcaacaaagtacagattatatcacccagacactcgt

SEQ ID NO: 10443 - DNA, 121 bp, Artificial Sequence
  Synthesized
  misc_feature (61): n=t or c
gcactgtgctgtcttccgggctggcagcgtattgccggctgccaaacattggtattgcagngtaaggaccaaaacttcactgtgaatgccatagagctgtgtcactgacagaaggtgcgtg

SEQ ID NO: 10444 - DNA, 121 bp, Artificial Sequence
  Synthesized
  misc_feature (61): n=t or c
acattctgtaatttcccctttatctcttcatccaacgtgcaagcaaagcttgatttaacgngaggaattaacacatttcaccacaaaagcatgcgtaactcatacagaacatcttcacttt

SEQ ID NO: 10445 - DNA, 121 bp, Artificial Sequence
  Synthesized
  misc_feature (61): n=a or t
acatcatttttcactctttgttatcttaaagagtgaagaacgcgttatgatatgaactgantttattctgagatgtagacttctttgtaacttttcccgttcagcaaacgtcagtaagatt

SEQ ID NO: 10446 - DNA, 121 bp, Artificial Sequence
  Synthesized
  misc_feature (61): n=a or g
gaatggagaagagaaatgaaaaaatgctaagcagagttatgaacaattttgtggatattcnttaaaatatggaccaacgcttattgcatatggatgcattgtcagtggggctgcttttgtt

SEQ ID NO: 10447 - DNA, 121 bp, Artificial Sequence
  Synthesized
  misc_feature (61): n=a or g
ctaaaaataaaacaaaacaaaagtcacagccatttagctcttccccttctgctcattttcnttgcgcagaagtgcaatgtgattcacacctccgattcagctgatttgattagttgttgct

SEQ ID NO: 10448 - DNA, 121 bp, Artificial Sequence
  Synthesized
  misc_feature (61): n=a or g
tagaggaggaacagaaatatgatcttacctgagctagtccagatttgtgatactttaatgnaggatgcagctgaaatgcagagaagagtacagaaaatgcaatattcatttctaatgttaa

SEQ ID NO: 10449 - DNA, 121 bp, Artificial Sequence
  Synthesized
  misc_feature (61): n=t or c
ttactgttttgaaagaccttgggtttttgcattgcttccaacagactgcatgctgtcagcncttctggtttctcagtagatatgggagaatatgaagctagagaagtgatgcctcactagt

SEQ ID NO: 10450 - DNA, 121 bp, Artificial Sequence
  Synthesized
  misc_feature (61): n=a or g
taacactgagccacatccaatctaatgatcagccaccaaacaaacataccaaatacttatngtattatgtgccatacacaagctcatcattgacttatgaaatgtaaatatttataagtgg

SEQ ID NO: 10451 - DNA, 121 bp, Artificial Sequence
  Synthesized
  misc_feature (61): n=a or g
tatacttaagcaggaaattaatacagtaacctataagaaatccagtttggccttaaaaccnagggaccactgagatctgtccagccattatggtgaataatcagatctatttctatggcca

SEQ ID NO: 10452 - DNA, 121 bp, Artificial Sequence
  Synthesized
  misc_feature (61): n=c or g
agcacggcccggcaggaggcaggaacgagcgcttctctccttcactgtaatccaaaccttngtctgcttctacaggcacattcttgcactgactaatgatcaaaccaggctgcgctctccc

SEQ ID NO: 10453 - DNA, 121 bp, Artificial Sequence
  Synthesized
  misc_feature (61): n=c or g
ccaccctgcttttgtgaaggaaactacattatggttctcaggtagcacagtggcttccatnacctcctgtttgcttcccaagctgtgtgtgttggtgtagaggcacttcagctgggcagct

SEQ ID NO: 10454 - DNA, 121 bp, Artificial Sequence
  Synthesized
  misc_feature (61): n=t or g
tgaaagctgacacctgaggggtagcaaaatgtaggatatggcaaagccaccttgttatgtnctagcgcagttgacttatttgaagatgctgctgaatttacaaccaattctcaaacattct

SEQ ID NO: 10455 - DNA, 121 bp, Artificial Sequence
  Synthesized
  misc_feature (61): n=a or c
tttatttatcggaagacaatattcatgcaaatgccacagaacccaacaagaaagggatagnaggattcagccaaaagcgtgctcttgaccactttttatctgactgttttagcattaaggc

SEQ ID NO: 10456 - DNA, 121 bp, Artificial Sequence
  Synthesized
  misc_feature (61): n=t or c
tttttttttttaatctctttctccattgtgggagaaaaggtctgtaagattttcctatttntcattcttctgctatatttaagaataattaaagccattctggctaagggtgatataatgc

SEQ ID NO: 10457 - DNA, 121 bp, Artificial Sequence
  Synthesized
  misc_feature (61): n=t or g
taggatttgctcagttagttcgtgtaagtctgaataactaatcactttcaagagaaaaatngtttgcatgtatcttgatactccaagtcctaatgtgaaatacagtccagaaggctgcttc

SEQ ID NO: 10458 - DNA, 121 bp, Artificial Sequence
  Synthesized
  misc_feature (61): n=t or c
tatctactgatttgattgggtatggggcagaagagagctttcactaataagtaaggagagnttccactaattcgcctcgcacaatcgttgatttggacacagaggataaagatggtcagaa

SEQ ID NO: 10459 - DNA, 121 bp, Artificial Sequence
  Synthesized
  misc_feature (61): n=t or c
attccattaaactttgaaatgaaaaaaaaaatacaattatgacctacattcatttcatgtnccatctaagcataactttgaaaaatcctaatgcaaatgttagttaagtcacattcttttc

SEQ ID NO: 10460 - DNA, 121 bp, Artificial Sequence
  Synthesized
  misc_feature (61): n=t or c
ctgatggtcagccaccaaaggtgtagctccactgcacttacggggctcttgtgtgagccantgccgccttaagcactttctcactgattaatttatccaggactgttgggtgcatataaga

SEQ ID NO: 10461 - DNA, 121 bp, Artificial Sequence
  Synthesized
  misc_feature (61): n=a or g
gttcttagtgtttaatattcacctgaaataaaatataaagtccctgaatatgtcaaggctntatgcaagttcatcagcaatgtgctgcatcctcgcatggcactgtgcagttctttgagca

SEQ ID NO: 10462 - DNA, 121 bp, Artificial Sequence
  Synthesized
  misc_feature (61): n=a or g
tgcaaatcaaagaactaatttcttttcctgagagcaatatccttggtgttagggcagcgcnttttctcttagtccttgtgcatttaacaaggcattcccttgcatatgggtgaaagcttcc

SEQ ID NO: 10463 - DNA, 121 bp, Artificial Sequence
  Synthesized
  misc_feature (61): n=a or g
aaattgttagaaaattgcctgattttgcctcaaagtagttggatagtcattagaaagctcnataaattgtcttggattgttcctttgggccactgtctgactccatagctccaaggactcc

SEQ ID NO: 10464 - DNA, 121 bp, Artificial Sequence
  Synthesized
  misc_feature (61): n=t or c
ataaagaaaaaagccatctacttgttttttgaggtatgtttaggtcaccttctagcagcangctattacagcttatgtgtaatgaactgcattgtaggactgctgtttaaaggaagcctga

SEQ ID NO: 10465 - DNA, 121 bp, Artificial Sequence
  Synthesized
  misc_feature (61): n=a or g
cttggctcctaaggctgacacataattgagcagttgccccacatctcaaggactgcctcanaacctatggaggaagccatctggtggactttggtatgtgatcacatgttctctgttttcc

SEQ ID NO: 10466 - DNA, 121 bp, Artificial Sequence
  Synthesized
  misc_feature (61): n=a or t
tgaatatgtcacataagtgtacaatctagcattagaagattgcctactctgtcatttttanacatatttaagtcccagttcctttctgatgtacagcagaaaacaagtagttgaaaccagt

SEQ ID NO: 10467 - DNA, 121 bp, Artificial Sequence
  Synthesized
  misc_feature (61): n=a or g
ttacatactgacatgggtcagtggcaagagagctaaattcccccactagaaggtctgatcnccagtgtgatatacgtaggcatgtaaaaaaattgagaaggtgacaaagaaactaacagca

SEQ ID NO: 10468 - DNA, 121 bp, Artificial Sequence
  Synthesized
  misc_feature (61): n=t or c
ttgaaaggttccaagtaaaaaattaatagtagttacaaagaaaccggtaagtgaagacagnctctgcttccaatcatcataacttctcttaagacatcctccagggagtattttcttcaca

SEQ ID NO: 10469 - DNA, 121 bp, Artificial Sequence
  Synthesized
  misc_feature (61): n=a or g
agacattgttagggtgtttttaaatacattcatctgctgtcaggtttaaagtcaggtgagnctgacccaaagggaaacgtccattcacaagaggtggtattgttacatgggcgttgtaacc

SEQ ID NO: 10470 - DNA, 121 bp, Artificial Sequence
  Synthesized
  misc_feature (61): n=t or c
gcttcataatgaaaaattcttccaaggctgtgctgtagaatacaaccaggaggttagtccngtgtatttcctcatcctcacatatatactgttgtagtaggcaagaaagcaacaatataca

SEQ ID NO: 10471 - DNA, 121 bp, Artificial Sequence
  Synthesized
  misc_feature (61): n=t or c
aatgtaatttataaatgtttaagaaaaacccaacatggtctccctcctagccctggagtcngctttgtctagctacggatttcctgtctcttctgaatttttgaaagtgtaatgcatttgt

SEQ ID NO: 10472 - DNA, 121 bp, Artificial Sequence
  Synthesized
  misc_feature (61): n=t or c
aaataccagaaaacataaaggaaccactggaagaatcgtgaaggcaaagccacggaaacangagtattagctaagtactgcagtatcacttgcaactggggggtatttcaggctgcttcta

SEQ ID NO: 10473 - DNA, 121 bp, Artificial Sequence
  Synthesized
  misc_feature (61): n=a or g
ctgaaagactcaccacactaatctctacacttgctcactgtgaagttttccttcaggcacntgtttcttgctagtgttgtgagtcacctgagagtatatgctggtgtaatactgagaaagg

SEQ ID NO: 10474 - DNA, 121 bp, Artificial Sequence
  Synthesized
  misc_feature (61): n=t or c
ttttctgagcatcacatctctctttgatgaggaaccctgcttttgtatgtgcatacaaacnttgaattgctgcaaatacagctcacttccagttaccttttaaaagcacgtaagcactgca

SEQ ID NO: 10475 - DNA, 121 bp, Artificial Sequence
  Synthesized
  misc_feature (61): n=a or g
actcagtgcatgccataatccgaatcattagattttcaggatatctatgtctttcaagacncatttcccatttttgctgtgatttaaccatacctcccacatctgttggatccctgtttac

SEQ ID NO: 10476 - DNA, 121 bp, Artificial Sequence
  Synthesized
  misc_feature (61): n=t or c
gattacatgtagtggtttatcttcattaagtcccttcttattagcgtttactggaacagcnttgtgagggtgcagacaccataatttgtatatcaatttccaatcaatttccagctttagg

SEQ ID NO: 10477 - DNA, 121 bp, Artificial Sequence
  Synthesized
  misc_feature (61): n=c or g
gaaccagataagaaaatagccatgtttatgaactcttgggtcatttgcagccccaggagtntttccctgtgcacatatataatgcatgcattcacagtaaattcttaaaaaccaccccctg

SEQ ID NO: 10478 - DNA, 121 bp, Artificial Sequence
  Synthesized
  misc_feature (61): n=t or c
tgtaaatgttgtagtgtttgattatgcctgcacattcatgatgtaacaagtaagactgcanaggcaactgtcagtcaggaagactttgtgatcttataacatctgggtgatctttcctgat

SEQ ID NO: 10479 - DNA, 121 bp, Artificial Sequence
  Synthesized
  misc_feature (61): n=a or g
gacagtgttttaggaaccgcacaggacatgagtcctccgtcagcagggaaggagagatccnggatgggcacacagagggccctgccctgcaggactgaggtttggggtgggaattcccatg

SEQ ID NO: 10480 - DNA, 121 bp, Artificial Sequence
  Synthesized
  misc_feature (61): n=t or c
gattaaggagacaggtagcaaagtggaagttgttctaggtgtctactatctactgcccacncaggacagtagtacagatgagctactctatacgcaattagggggatattttgggattgat

SEQ ID NO: 10481 - DNA, 121 bp, Artificial Sequence
  Synthesized
  misc_feature (61): n=a or g
ggaataaaaccaccagcaagtttatctgaatactagaacaaggacaatactgttgtgttgnaatatttttatgattatttagtgcatcagagaagcattattagtcaagtagtccctgaga

SEQ ID NO: 10482 - DNA, 121 bp, Artificial Sequence
  Synthesized
  misc_feature (61): n=t or c
gctgatattgcctctggctccttgtgtgcaattgggaggctcagatgcagtcattgccttntgaagccctcactgactcagacctcctacttgcgtctggtgggattaagccatcttggct

SEQ ID NO: 10483 - DNA, 121 bp, Artificial Sequence
  Synthesized
  misc_feature (61): n=a or g
gagtgaatatcaacaccctccttcgcaggtttaacagggatactgcctcttcacgtgcaancaagttggtcattcaaggagatgatgctcagctgtgtgtgtgaagctgtgctatcagaat

SEQ ID NO: 10484 - DNA, 121 bp, Artificial Sequence
  Synthesized
  misc_feature (61): n=a or c
ttagatgcgacccattgatgcagcctatccacatctctatgcaaagtcttcctactctcangcagatcaacattcccacttaatgtggtatcatccacgaatggtacttcaaatactttgt

SEQ ID NO: 10485 - DNA, 121 bp, Artificial Sequence
  Synthesized
  misc_feature (61): n=t or c
aatacacataatgcttgcagatgaacacacaataacatctctgctgcagaatttctgatangtatccagggtctttcatatgagctttagctctgatgtgttgtaaaatacttctctgatt

SEQ ID NO: 10486 - DNA, 121 bp, Artificial Sequence
  Synthesized
  misc_feature (61): n=a or t
ttggctttgttttgttttactttatttatttatttttgtgggaacaaactaaaatgccgcngttgtcttgttttctctgggattttaacctagacaggggaaatctgagatttgagcaatc

SEQ ID NO: 10487 - DNA, 121 bp, Artificial Sequence
  Synthesized
  misc_feature (61): n=t or c
gatttaaaaatatatttttgttgtctttttcctgagtctctgacaaacacctttcgacttnttatgcattttgatttaaagtaaggtgggttttttgttgttgttgttgtttctttaatat

SEQ ID NO: 10488 - DNA, 121 bp, Artificial Sequence
  Synthesized
  misc_feature (61): n=a or g
cacacaacagctgtttaaccaaggcagacagctcaggctgtttgaacaccagcaaagcacngcaggcagcgagctgtgcctgaaagctcagcctcaggtccctcacatttgtatttccagt

SEQ ID NO: 10489 - DNA, 121 bp, Artificial Sequence
  Synthesized
  misc_feature (61): n=a or g
gttagatacagatgagagatgttttccaacctaactgtgtctttgcatgctagtagtgtcntgtgatgacatcagggagtgctgactgaacctcctgtattcactggggaagcatcttcct

SEQ ID NO: 10490 - DNA, 121 bp, Artificial Sequence
  Synthesized
  misc_feature (61): n=a or t
atgagaaacagctgacgctgcttcagtgggggctcagaggtttggctaattgtgttctacngagtgacagaaatccttctttttgtattaaaagcagaagctgtgttgtgtgtgtgcaaag

SEQ ID NO: 10491 - DNA, 121 bp, Artificial Sequence
  Synthesized
  misc_feature (61): n=t or c
tggcttctctttcagttacaactaaattttccagacaggccactatggtttgagttcttgngttcaacagagcataaacaccaccagaaggccaattctcagtacttcttccatgttagaa

SEQ ID NO: 10492 - DNA, 121 bp, Artificial Sequence
  Synthesized
  misc_feature (61): n=a or g
ataagataagatctgaacacttaaacttcagtagtgtacaatgtgatctctatcttacctnagcctcaaagcattcagtagtggtaaagtcaaaattattatgggtaaatgttttctcact

SEQ ID NO: 10493 - DNA, 121 bp, Artificial Sequence
  Synthesized
  misc_feature (61): n=a or g
ttagacacaatctttagccaatggtaggcacttgcatagtaactaaacagaaacattaccnatttgcttttataaatgtttaaatacgagatacagtgcaattaaaatgggcacaactaca

SEQ ID NO: 10494 - DNA, 121 bp, Artificial Sequence
  Synthesized
  misc_feature (61): n=t or c
tagcaatgcattagtgcaagtacaccaatcacatgttacaagaaagggaagaacagtcatngaggaaagaaaatttgtggctattagaaaaaaccctggggatctcagggagtctactccc

SEQ ID NO: 10495 - DNA, 121 bp, Artificial Sequence
  Synthesized
  misc_feature (61): n=a or c
atttgcacactttgtttctgcagagaagataaatcaagaaaccattccagtaccagatacnacaacaaagacaaaatagataaaaactgacaagaatactacaattcctaagccccaccag

SEQ ID NO: 10496 - DNA, 121 bp, Artificial Sequence
  Synthesized
  misc_feature (61): n=a or g
caatctcatgcattctgggctataagacctcagcagcccatgccaggtcctctgttccacnttacctcccacttattacccatccctgtcgagaagctgcttcttcctgaggttttccact

SEQ ID NO: 10497 - DNA, 121 bp, Artificial Sequence
  Synthesized
  misc_feature (61): n=a or g
gttcagcttgttgaagttgaatgtgtattttaggagatgtctatgtcgacatctatgaganaagactgtcacattcctgcagtctcttgctatataggtagttaaatagtatatataaatg

SEQ ID NO: 10498 - DNA, 121 bp, Artificial Sequence
  Synthesized
  misc_feature (61): n=a or t
gatgttgtgtgggaggaggataagaatcatttccaagctaaaaggtatttgtaggaaaatnaggcaatagtttaagtttacagaggaaaatcaggaaaatctttcagggtgctactgagat

SEQ ID NO: 10499 - DNA, 121 bp, Artificial Sequence
  Synthesized
  misc_feature (61): n=t or c
gaataacagtggtttacactgtaagaaacgctcacaatacctcagttgcaattaagctcangccttctccccctctcatgcatcatattgtgacagcaatgaatggttttcattactgtgg

SEQ ID NO: 10500 - DNA, 121 bp, Artificial Sequence
  Synthesized
  misc_feature (61): n=a or c
aatgaaaaaacaagcaaaaacaggaaaggagacaaacatccttccttgctttccttctacnttcttaatcagatgtagtatcagaccaggtgaattttctgttattgctataaaatacgtt

SEQ ID NO: 10501 - DNA, 121 bp, Artificial Sequence
  Synthesized
  misc_feature (61): n=t or c
tgaaagaactatactgccttgaacattgcgtcctatggctttcataaaaggttgccataanctgttgtttaaaattagattccaaattgtgaaacactctctaaacacagaaactgtattt

SEQ ID NO: 10502 - DNA, 121 bp, Artificial Sequence
  Synthesized
  misc_feature (61): n=c or g
aagcacattgcacatgtgggcacctacagcactttctaagcactccattgcagacatactnatggcacacagcacatgggattcttgtgtattcttttgtcactacttcaagtgcagggaa

SEQ ID NO: 10503 - DNA, 121 bp, Artificial Sequence
  Synthesized
  misc_feature (61): n=a or g
aagagacagcagaatagagtgaagtaatgaaaaagctatttattcatttgaaccagctccnctctgtgtagtcttctacaaatggatctgatctgcatgacacacaactaggcattaaatc

SEQ ID NO: 10504 - DNA, 121 bp, Artificial Sequence
  Synthesized
  misc_feature (61): n=a or c
ccgggtaccacctagacttaattttccagcaaaaactgctctgatttttctaccttaagcntgttatttgtcacctgtgctactctgtagctgttcttaagtgttgtgccatcagcttttt

SEQ ID NO: 10505 - DNA, 121 bp, Artificial Sequence
  Synthesized
  misc_feature (61): n=a or t
acctctcatgttattacgggccactgaggggtttatacttctccagagttttgattaactntttgttaagtggctgtgctttagtccttggtgggtactgacaaaaaacaaaccctaagga

SEQ ID NO: 10506 - DNA, 121 bp, Artificial Sequence
  Synthesized
  misc_feature (61): n=t or c
gatgttcatggtacctcaaggaagttgtggggagcacagctccccagagtgaaacagaagngaaaacccaattcaggcacgaggttgggttcaaattgctcattgcactgagtgctgtaga

SEQ ID NO: 10507 - DNA, 121 bp, Artificial Sequence
  Synthesized
  misc_feature (61): n=t or c
tgggacagttctagctgaagctgaattaaatgaggcccactttctagctagtctttaacanaaatagccatttttgacaatgctgcagaataacacataactccaagtaaccttctgccta

SEQ ID NO: 10508 - DNA, 121 bp, Artificial Sequence
  Synthesized
  misc_feature (61): n=t or c
tgatttgaaaagttcatttgaatgccttgcgaaggagataagtgctccagctctcattganggtgtgcagtgactctcgcccatcactcctgctctgtgccaggcgttgggttcggcaggt

SEQ ID NO: 10509 - DNA, 121 bp, Artificial Sequence
  Synthesized
  misc_feature (61): n=t or c
ctgaagttatcccttgtacttgcggaggtaggaaagactgagtatagatgtgcccaaagtnaaaacacaacagatgtgaactttgctaagcagtcatgctacagaattacacataattatt

SEQ ID NO: 10510 - DNA, 121 bp, Artificial Sequence
  Synthesized
  misc_feature (61): n=t or c
ctggttgtaaattagaattcccctttataaagaaggtatattgctctaaagtttggccatnagattatgggtgcagatggtctgttacggtagggatttggaggtgtaaagggatacatga

SEQ ID NO: 10511 - DNA, 121 bp, Artificial Sequence
  Synthesized
  misc_feature (61): n=t or c
cattggtctttgcaagcaatggcttggtcaagatcacttgtcccaagacagatcacctaangtgtcagcgcacattaaaccagggcataaacaagaggcatcttgggagctcagctcaggc

SEQ ID NO: 10512 - DNA, 121 bp, Artificial Sequence
  Synthesized
  misc_feature (61): n=t or g
acacagcaaaatgcatcctgtggtgcacccagtttgctcagctttttataccaaactctgngtgagactgtgaatccccacaatctgtggtaatgcagtgacttctttgtgaagttgggaa

SEQ ID NO: 10513 - DNA, 121 bp, Artificial Sequence
  Synthesized
  misc_feature (61): n=c or g
gacagagacagctcaattactggcatctccataaaagcattgctgtgcacttctgagaaangtaagaaaggccagttccacagagggttcaaccctgacagatatcaagtgaggtgttaat

SEQ ID NO: 10514 - DNA, 121 bp, Artificial Sequence
  Synthesized
  misc_feature (61): n=t or c
gtagttctgaggaaaaaaaatcagcttcattcaccaattatagcacagcgccaatatatcntctgaggatgggctgattctgaggtcatgaatgaaaggaagttctgcctaaaaggctgat

SEQ ID NO: 10515 - DNA, 121 bp, Artificial Sequence
  Synthesized
  misc_feature (61): n=c or g
atctttccattcaacagaaaaatgctttagagctctcaccatgacggggtactgcataganaacccagccttttgtccaaaccaaagctctcctagctccactactagtgtcagtagtgcc

SEQ ID NO: 10516 - DNA, 121 bp, Artificial Sequence
  Synthesized
  misc_feature (61): n=t or c
gggaggcaggaaatccccagaagcaggctgcgaattggatggcatagaaatggacagtaangttctattcttcagagctgctgttatgcactgcacctcctgagatgaagagcccacccct

SEQ ID NO: 10517 - DNA, 121 bp, Artificial Sequence
  Synthesized
  misc_feature (61): n=a or g
tgaggtgctgagcagaaataacatcagcacgtcctcagcctgcatgggggagggctttccnaagtggaggaggcaagggctggatgtgatgggttgggaagctggggaaccagggagccct

SEQ ID NO: 10518 - DNA, 121 bp, Artificial Sequence
  Synthesized
  misc_feature (61): n=t or c
gggccatgagttggatgcaaatctgcgcttcctcactggaaagcaggagttatgacctcanggctccattaaatgtggttggcagtggaaagctctcctggcacacaggctgtgatctgct

SEQ ID NO: 10519 - DNA, 121 bp, Artificial Sequence
  Synthesized
  misc_feature (61): n=a or t
ttaagagaaaacactgagagcaaacagagcaggtgaataatttctagttttaaaaacaagntgctttaaaattggccaggcaccttggaaagcccacagaagctctgccttaagacgctgg

SEQ ID NO: 10520 - DNA, 121 bp, Artificial Sequence
  Synthesized
  misc_feature (61): n=a or g
atcctcctgcaagacctcctgtggctttaaatgggagttgtagacagttttacagaaactnaaattgaagaccataacttaagtgcataactgcatttcagtacttaaacgtagtcctctg

SEQ ID NO: 10521 - DNA, 121 bp, Artificial Sequence
  Synthesized
  misc_feature (61): n=t or c
agacacttcgtactcctccatccaactcagaataaagtctttgatttgttcaagaacttcnttcatttttttaattggtaatgaacgctttaatttttctaatagttgtttaacatcagtt

SEQ ID NO: 10522 - DNA, 121 bp, Artificial Sequence
  Synthesized
  misc_feature (61): n=t or c
tcaaggtttatcgctgcttgaacagtggctgttagtcataaagtcagcaaacatatccatntcagaagtccaaccacttaaatggatctatgtagggtttataagcaacagaagtaatttt

SEQ ID NO: 10523 - DNA, 121 bp, Artificial Sequence
  Synthesized
  misc_feature (61): n=a or g
tgatcaagggagagaggggctctatcctgctctgctctcagaaaatgctcacccacagacngtgaacactgccacacacatttgtgttttgcctacaaagttttgctcccaggaacggtgc

SEQ ID NO: 10524 - DNA, 121 bp, Artificial Sequence
  Synthesized
  misc_feature (61): n=a or g
aagagaaaaacttgtatttccagtcttttgcttatgatagagctccttactgtcggctgtnccataagccaagctgcattttcagtagcattatgacagaataatctgtatttctgtaaat

SEQ ID NO: 10525 - DNA, 121 bp, Artificial Sequence
  Synthesized
  misc_feature (61): n=t or c
ttgttttctccccataagttttcaacattcccaaccgtccattctggaccacctttccagnagattactcttttacctaacaacaaagccgatttcttcttgatatttcagtaatcagaaa

SEQ ID NO: 10526 - DNA, 121 bp, Artificial Sequence
  Synthesized
  misc_feature (61): n=a or c
tctctgcctcattcattttccataattgaaatggaaatgaaacccttcatcattaaaattntgactcatatactgagttaactgtcatcctataagaccgaaaagaaaatattttagcatc

SEQ ID NO: 10527 - DNA, 121 bp, Artificial Sequence
  Synthesized
  misc_feature (61): n=t or c
gagctttgttgtgcttctctttgtattttatctagcaaggagaaaatatatcattttaagnaatgttttgtgatgacttcaaaagagactgctgttgttctcactgctttttagtgtaaaa

SEQ ID NO: 10528 - DNA, 121 bp, Artificial Sequence
  Synthesized
  misc_feature (61): n=t or c
tagccacactcacattatatgcacgtgcaaggctgcagacattgacagagatctaatgcangagaacaacctgccacagagctctaaatccatctctatagccacttcccagaaatttcca

SEQ ID NO: 10529 - DNA, 121 bp, Artificial Sequence
  Synthesized
  misc_feature (61): n=t or g
ttcttggccatcagtcaaacttaaaagtgcaaaagcaaagatgtagggaagctaacagaancacagcttaaagcgagagacaagaaaaatttagaaagcatatgccctaggcaactgcaag

SEQ ID NO: 10530 - DNA, 121 bp, Artificial Sequence
  Synthesized
  misc_feature (61): n=a or g
ttgccattcagatcatgcttgaattcactggcagagcaaaatctgaaaaacaaatcaaacngagtatactttatggtgctgttttatttgtagcctgtttgtttttctgagggaagacata

SEQ ID NO: 10531 - DNA, 121 bp, Artificial Sequence
  Synthesized
  misc_feature (61): n=t or c
aatgaagaacagtgatggctcttgggattcatttaagttacaaggattgttacatgcatcngtgatactgatcacgttgtcagtgttagaaattagaggaaacattttgagaagaatgaat

SEQ ID NO: 10532 - DNA, 121 bp, Artificial Sequence
  Synthesized
  misc_feature (61): n=a or g
gataccttgtgtgctgcatgggtgtgacctgggagaggcagttgttcccaaactctgcagncatcagtgtcagtgtgtgtttgtgcctgataaccaagcgagtattccttcctccgttcat

SEQ ID NO: 10533 - DNA, 121 bp, Artificial Sequence
  Synthesized
  misc_feature (61): n=t or c
tgatgttttccatacttgatttttttttgaaagttccagttaatatggctcatctgtctcntggtgcaaaggagaaggctggaaaagacactgttttgctcgtgtgcttctttctgaacta

SEQ ID NO: 10534 - DNA, 121 bp, Artificial Sequence
  Synthesized
  misc_feature (61): n=t or c
ttttttttttcctctctctttttttgtgtgtgtgctgttgggctgggtttaccaggagcanagtgggtgggagatgggttgcagtgctgatctcagagaaatgctgtggtgccgacacagc

SEQ ID NO: 10535 - DNA, 121 bp, Artificial Sequence
  Synthesized
  misc_feature (61): n=t or c
tgtttccagagacttccaataaaacatttgcacagttacagttcagaagtttggatcaagntaactaagtcatagtcaagggtgcttagcagggtgtgcagcgtgggcaagttatattctg

SEQ ID NO: 10536 - DNA, 121 bp, Artificial Sequence
  Synthesized
  misc_feature (61): n=t or c
gtaaagccagatgctgggtatctgtatggaatactgcagtggcatgcaaagatgcttgccngctaggatgcttgccagtaggaggtagccaaatgagaatatcattcaacttgcattattt

SEQ ID NO: 10537 - DNA, 121 bp, Artificial Sequence
  Synthesized
  misc_feature (61): n=a or g
tgtatgtgctactagttgttactgcagtagaaactgctcacacagtctgagcatagaggtncctctgacaaaaatactgcgcttccctctagccatgaggctgtaggctattcattggcct

SEQ ID NO: 10538 - DNA, 121 bp, Artificial Sequence
  Synthesized
  misc_feature (61): n=t or c
tccctggttcaccagcacaatgtcctcttggcctgggaactgaggatatgagcactctgcnggtgaatatttctgttacaggaaggaaatcatgcattttcaattgcaaaatatttgtctg

SEQ ID NO: 10539 - DNA, 121 bp, Artificial Sequence
  Synthesized
  misc_feature (61): n=a or g
ctcagttaagctttgaataaataatgtagatattgatacgtgcctatatctcttttctgantaattgaaatgtgagttttctgttaacacctgatttctctctccttggaacttcagaatt

SEQ ID NO: 10540 - DNA, 121 bp, Artificial Sequence
  Synthesized
  misc_feature (61): n=a or g
tgggagacagggagagatgttctcacctggggacttctgctggccactctgtagcacctcngccagcaggtagcagtggtgccatctagagatgctgagggacaccccaagcccatgcagt

SEQ ID NO: 10541 - DNA, 121 bp, Artificial Sequence
  Synthesized
  misc_feature (61): n=a or g
tgcttgctgggcaaagccctcccctctacttaaacaaaagactaccacaaataaataagtnaagggtgatagcctcttctcatgcacttactacttgaagatgacaaaataaattgtactt

SEQ ID NO: 10542 - DNA, 121 bp, Artificial Sequence
  Synthesized
  misc_feature (61): n=a or g
aggcaaaaaaacattttggaaaaatagtagataatgaaaccgagttagaacttgtgaatgnagcacaactcagagtcagccctgtcaggagaaaacagacagaagacacaggactgccatg

SEQ ID NO: 10543 - DNA, 121 bp, Artificial Sequence
  Synthesized
  misc_feature (61): n=a or g
ctgtccctgctccagtgtggggtttctcccataagatgctgttcttcctgaatagatcctnaataggatttccacaggctgcagcactccaagcactgctccaagatggctccgtaccaca

SEQ ID NO: 10544 - DNA, 121 bp, Artificial Sequence
  Synthesized
  misc_feature (61): n=c or g
ctcggcgtgagtgtccccaacgtcccccgcgtgtccacaccgcgtcgccctgctgtgtccntcacgcatctctatgggttgacctgatggctctttacgcccatagagttgcatgggttga

SEQ ID NO: 10545 - DNA, 121 bp, Artificial Sequence
  Synthesized
  misc_feature (61): n=a or g
caaactctggaagatacaaaagcaaaagcctggacaatctgctggcttcacacaacaatgnctgtgtttttctttctgtttaatctgaatctgagtgattatacctctgttgtgtacctta

SEQ ID NO: 10546 - DNA, 121 bp, Artificial Sequence
  Synthesized
  misc_feature (61): n=a or g
atagctgtgacttaaaattagtcttcttttctcctgtgtaaggttgcctgaaacaccttcntgtctcctgctaccatggcaaggaaggacacaacacagttcatgattttttggcctatac

SEQ ID NO: 10547 - DNA, 121 bp, Artificial Sequence
  Synthesized
  misc_feature (61): n=a or g
gctgaagttgtgtggtccccctcctgaaaatcagaatgaggatcagagcaaaggagagtcnaggggagaaaattagttcccattttgaattttatttccatttgcagtttgatttcataaa

SEQ ID NO: 10548 - DNA, 121 bp, Artificial Sequence
  Synthesized
  misc_feature (61): n=a or g
tgggtagagttagtattgatctcctccatcatcgtttgctgctgccatgtgtgggcagccnggtttgattagtgggacagttgcaacacaggtccagcacaaaccaagggagctccctgca

SEQ ID NO: 10549 - DNA, 121 bp, Artificial Sequence
  Synthesized
  misc_feature (61): n=a or g
tcctgctctacagtgccactcatttccaaacccatgacctgcagggtgagaccgagctacngggacagcggtggcaaagcccttcctcagcaaaacctcttgcttcagccctaagccaacg

SEQ ID NO: 10550 - DNA, 121 bp, Artificial Sequence
  Synthesized
  misc_feature (61): n=a or t
gagatgtcacagatgcataggaggaggtaggcatagaaaacacaagtctttttacattccntttttcctgaggatgcccacagttgtgcagaacccaagtagcattttgggaaacaaccag

SEQ ID NO: 10551 - DNA, 121 bp, Artificial Sequence
  Synthesized
  misc_feature (61): n=a or g
gaaagtttttgaaaaacatcttcacaagagcctattggaaaaatagttgtgcttctgaganctagacagccttctgagggacacaggacaaaactactctttggtgtaggaaaacactgca

SEQ ID NO: 10552 - DNA, 121 bp, Artificial Sequence
  Synthesized
  misc_feature (61): n=a or g
gtagtaattggcagaagagtgtgaggagctgcagacagggtctattcttattagtagctgnggtgaatgaccactgaaggcagcaatcctccagaaacactgatgagacattcctattccc

SEQ ID NO: 10553 - DNA, 121 bp, Artificial Sequence
  Synthesized
  misc_feature (61): n=t or c
gcacatctttcaagcaaagcgcatgaaaattcgtctcgacaagattaggaaaacagccccnagacctatcttcactgagcaactgcaaagcaaggaagctgtagtgaggagaaatgcgctg

SEQ ID NO: 10554 - DNA, 121 bp, Artificial Sequence
  Synthesized
  misc_feature (61): n=a or g
caaataaattttccccctctgaagtatatcaagggttgcagtcttttgcagaaccataacncagagctaaaatattcctctgcaacaaagcaagaggagaaacacgggcccacactgaaga

SEQ ID NO: 10555 - DNA, 121 bp, Artificial Sequence
  Synthesized
  misc_feature (61): n=a or t
tatgttaagattaagaacatgaactaccagtaacagggctacctaaacaacaaatacgacngattattaattttattgagggaagataatctataagtattatacctggaatcatgggaag

SEQ ID NO: 10556 - DNA, 121 bp, Artificial Sequence
  Synthesized
  misc_feature (61): n=t or c
ttccccacccgttatatcttgattaatagtgacccttcataacaattctgaagttcagagnaggatggtgaatgcgagggcccagtccttaccacttctacttcagcatgtagcgcttact

SEQ ID NO: 10557 - DNA, 121 bp, Artificial Sequence
  Synthesized
  misc_feature (61): n=a or g
ggctgctttgtgatcctaccacttcacagaagcgtttcctggtacttgaatgtctcacatntttgtgattcatgatgacttcactggcatttgtgaatattaagaaattcagaaatgggag

SEQ ID NO: 10558 - DNA, 121 bp, Artificial Sequence
  Synthesized
  misc_feature (61): n=t or c
ccataagaagacagggaacgcaggtccatgccaaatttttcttccagtcgggtgatgtgcnggggaaggctctcatggcagcctatagttgtcgtagtacttgcctggtttcttgatctgc

SEQ ID NO: 10559 - DNA, 121 bp, Artificial Sequence
  Synthesized
  misc_feature (61): n=t or c
agggacggtactcttcctgtcacccagactttctgaagcaatagatcttaatgaaaaccanagatatgcaaaggtatttagtgttaaaggaagggtcgtggttgagtctggactgtgctgt

SEQ ID NO: 10560 - DNA, 121 bp, Artificial Sequence
  Synthesized
  misc_feature (61): n=a or g
cacaactatgctgcatgagaatttgagttctcattttcagtttgtgctcagcctaaccacngctaatgtgctgaaatgccatggtctgtttgtgagatcttgccaatggaagaatcaaaac

SEQ ID NO: 10561 - DNA, 121 bp, Artificial Sequence
  Synthesized
  misc_feature (61): n=a or g
agtgggagatatcaacatgcgcattaagacactctgaatgtagtagtcttcatgagatttntgacacatttcctaccaaaataaaaacagggctgctaaattacagtacactgaagtgtct

SEQ ID NO: 10562 - DNA, 121 bp, Artificial Sequence
  Synthesized
  misc_feature (61): n=t or c
gaggtttgtggactagatgaagttaacagctgtgtttgcttggaaagtcacccatgggaantgagcaccagtctgctatcctaactattagagtatcctcctagacgaaccttcccatttc

SEQ ID NO: 10563 - DNA, 121 bp, Artificial Sequence
  Synthesized
  misc_feature (61): n=a or g
aatattttaaagggaacgttgagctgtttcaaattgaaataaaatgctccagtaagagtanatggcttaaatcagcagccgacattatcgaagcgctcagcgctcaccgaagatatccttc

SEQ ID NO: 10564 - DNA, 121 bp, Artificial Sequence
  Synthesized
  misc_feature (61): n=a or g
ggagtgcccaaactgcacccggctggctgctccttcccatcattcctttgaccttgagccncatcaatccggcgagactggatggcacagaaaaaggctggaaaggatgtacagtgtcgat

SEQ ID NO: 10565 - DNA, 121 bp, Artificial Sequence
  Synthesized
  misc_feature (61): n=t or c
aatatgtgtttcttttacaaggtgaatgccatacttggaagcccctggtaaagtagccttnttcccgggactcatcactaggaatgttgtctcactttccctgtgaatgcacagctggaac

SEQ ID NO: 10566 - DNA, 121 bp, Artificial Sequence
  Synthesized
  misc_feature (61): n=t or c
atttgtcagctaaatgtgcagccatgtgtaggcgtaaccatgttcatgctgctcatcgatncacctctctgccagggctgactttgcagatactccatcatatgttccttttgagttctgt

SEQ ID NO: 10567 - DNA, 121 bp, Artificial Sequence
  Synthesized
  misc_feature (61): n=t or g
ttttttgtcctgctggctaacgaaagtgctttgagctggatgtgtcttctggaggaatgtnaccttgagtgcaattaaatgataaagtaaggataacatcaatcttacttttccatttgac

SEQ ID NO: 10568 - DNA, 121 bp, Artificial Sequence
  Synthesized
  misc_feature (61): n=a or g
tggtgtttggggagttatctgggtacaaattggtgtaagccctttatcatcagcacaggcnttttctcatctgagattggacttggctgcaggaggatgcagcttccttcccccacacatg

SEQ ID NO: 10569 - DNA, 121 bp, Artificial Sequence
  Synthesized
  misc_feature (61): n=a or g
caagtaaaatatggagacaactcaacctaccagagtaacttaattcaatttgaaggtgagnaaaatcataaacaacagaagtaaagtgatactctttaaaacagtgaatgaaaaaaagtgg

SEQ ID NO: 10570 - DNA, 121 bp, Artificial Sequence
  Synthesized
  misc_feature (61): n=a or g
tctgcctgcctgatgtaacagggcagtcacacagtacatgaccttatttgaatgtaaagcnttattttgctttgcagattcgtattactgactcgagggtggcaccaactcacctgcagta

SEQ ID NO: 10571 - DNA, 121 bp, Artificial Sequence
  Synthesized
  misc_feature (61): n=a or t
cagacagatttcatatttatatttttcaaaacaaacataattaaaagttttctctgggtcntacttcctggttttgagtttgctgagcaagcaatctgcgtaatgcattactgtcacatcc

SEQ ID NO: 10572 - DNA, 121 bp, Artificial Sequence
  Synthesized
  misc_feature (61): n=a or g
catagtgcatagttcatctgatcctgaggtcagtgagtgaagtgggtagagaagaatgctngattgtgcctaatatactttttcctcaacttttgtgactcttgtgtttctagggatcatg

SEQ ID NO: 10573 - DNA, 121 bp, Artificial Sequence
  Synthesized
  misc_feature (61): n=t or c
tctctcatggaagtttcctttttccctttatctaccctaaattaaaatgaatccacacagngtgctctgacgttttataaacagacgtttcacaagagaatttgttattttcccagattta

SEQ ID NO: 10574 - DNA, 121 bp, Artificial Sequence
  Synthesized
  misc_feature (61): n=a or t
gcttaaatgctgcctcagcaccattgccacgcacctttgtgaagctcttctccatgggatnaaagggaaggaatgtgatgctgaacaccggagttggctgcgctcattattatttttttgc

SEQ ID NO: 10575 - DNA, 121 bp, Artificial Sequence
  Synthesized
  misc_feature (61): n=a or g
tttcctgctgaagtactgcgcaggtcaattgcgtttgttggttctagctgaggattgctgnagcccctggcttgctggggtagtacttgtttgaggtacccttgctggatctgcagtgagt

SEQ ID NO: 10576 - DNA, 121 bp, Artificial Sequence
  Synthesized
  misc_feature (61): n=a or t
gaattcttgtctgaataatcatatctattacatactggaaaattgaccatagtagatttcnaaagttttgggctattctgtttccagaaagtgaacaagagcacgacatgaaaaaaaagaa

SEQ ID NO: 10577 - DNA, 121 bp, Artificial Sequence
  Synthesized
  misc_feature (61): n=t or c
tgtgcgatccgttcccccagtgccgtccagctgccgctcctctgcacttcgtttgctgctngggttcaccgtgtgcaatacacaggggtattttttcccaatttcttatcctgtgagttgt

SEQ ID NO: 10578 - DNA, 121 bp, Artificial Sequence
  Synthesized
  misc_feature (61): n=t or c
aagaaaaaaaaacccaaaaagctgtaggttccatgttttaattgttggcgttcttcccttngtggcgcttcatctcacgctggcagccctgaggccgatggtagccaggtgggttggtgcc

SEQ ID NO: 10579 - DNA, 121 bp, Artificial Sequence
  Synthesized
  misc_feature (61): n=t or c
catcaggatagcaagtgagtaatttaactacagtattctaccaggtgaaaaccctgagtanggttttgaatcttactatattattgtttattctaccactgtgttaggttcacttgatgac

SEQ ID NO: 10580 - DNA, 121 bp, Artificial Sequence
  Synthesized
  misc_feature (61): n=a or g
tgggagcggtttggtcgatgcccttcaggatgctgtgatggatgtttctggagggcagacntctatgcagcagcttctatcggatcgcctcactgctagagcaggtggatgccaggacacc

SEQ ID NO: 10581 - DNA, 121 bp, Artificial Sequence
  Synthesized
  misc_feature (61): n=c or g
gaggtttcttaagagttttgctttaccaggagatttagaagtgatctctaaaacgttaaantaaccctagaaactgggggtttgaaacattaacattggcttaagtcactgcaccatccaa

SEQ ID NO: 10582 - DNA, 121 bp, Artificial Sequence
  Synthesized
  misc_feature (61): n=a or g
tgcagctgtcatctcctcatcctctggcatggtgcaagcactgtgctgggtgactaaaganggtaaaaggaagaaattattcctccttaatttcattcaaaaatacatgcctggttgcaac

SEQ ID NO: 10583 - DNA, 121 bp, Artificial Sequence
  Synthesized
  misc_feature (61): n=t or g
cacatgaagctgagctctacttctggatcactttgttgcagcacacgcctctgagccagancagagtcatagagactgttaaatgaaactgcccttccttgtgcctagctctgtgttcctt

SEQ ID NO: 10584 - DNA, 121 bp, Artificial Sequence
  Synthesized
  misc_feature (61): n=a or c
agaacggtgcagaaggtctaagcccgcgcctccgggtgggttttgtaagtcctgagccttntccccgcggtagcggagcgccggagcgtgccgcaactttccgctccgggagcgcaccggc

SEQ ID NO: 10585 - DNA, 121 bp, Artificial Sequence
  Synthesized
  misc_feature (61): n=t or c
gcacctccccctgtgccagcagtgaccctctgctctcctgtgccagctgtgacctcccacngcaacaccgggacacctctgtaccttcagagatgtgtttaaaccattggccatccacact

SEQ ID NO: 10586 - DNA, 121 bp, Artificial Sequence
  Synthesized
  misc_feature (61): n=a or g
tacctgtagccctacaattgttgtagagtcaacacaccccaatggaagcgtaggggggtantgctgccattctgacttatggaatgatggaatatctacaggcacctctaactgtgggtgg

SEQ ID NO: 10587 - DNA, 121 bp, Artificial Sequence
  Synthesized
  misc_feature (61): n=a or t
tcttccattactgaatgcaaaaacatgtttagccattgtaacttacgcagtgcatgttatngtagcacaccatctggctttctgtgccaaaaagtaagaaacatcttgcatggttgtgtgt

SEQ ID NO: 10588 - DNA, 121 bp, Artificial Sequence
  Synthesized
  misc_feature (61): n=a or c
cctcaggttgtgggtgcgtctcgctgtgcttttctctcggtaacggagcagaaaaccttanttctggttttcctgcgttctcccccatgtcggggctcaggaaggcgacctttgagggagg

SEQ ID NO: 10589 - DNA, 121 bp, Artificial Sequence
  Synthesized
  misc_feature (61): n=a or g
tctcttctcacattttcctagcagagccaaagccaggttaaaaccgccagaggaaaaaggncacgtatgggtgtacctgtcagtgctgctcaagtcagcgaggaaattaaaagccccaggg

SEQ ID NO: 10590 - DNA, 121 bp, Artificial Sequence
  Synthesized
  misc_feature (61): n=a or t
atatcagttgctaaattagttgaatagcgttaacactttaggtaaagccatttctggaatnaactcgtggagaaatctgctggtttttcaggaacagaaacagagtgcctctcattgccag

SEQ ID NO: 10591 - DNA, 121 bp, Artificial Sequence
  Synthesized
  misc_feature (61): n=a or c
tgcatgactttgcagcgtaacaaggcaatatttagaaaacataactcttaggctgaaatantttgtagcatctccagaaagctatttccctcagcagcaccctcctccagcctagtgctta

SEQ ID NO: 10592 - DNA, 121 bp, Artificial Sequence
  Synthesized
  misc_feature (61): n=t or c
aaaactgtcctaaggcagcctgcatgccttactgtacttagattactgcctataggataantgatgtaagcatgagggtctttagatggaataccccaattttgtgccagcatggcctttc

SEQ ID NO: 10593 - DNA, 121 bp, Artificial Sequence
  Synthesized
  misc_feature (61): n=t or c
ttcttaagaaagcagagggaaagtagatgtcttcaatattctccgctctcctatttttagntcttaaaaatgtttccttgtgaggttatggttgggaagatatgggtacaactccagtagc

SEQ ID NO: 10594 - DNA, 121 bp, Artificial Sequence
  Synthesized
  misc_feature (61): n=t or c
caaagagagcagagtggagataaaagtcaatcattctgcttcagaatatttgacacatacnttcccatgtcttaatgttgatgcacaagaataatgaggtagacaaccagaactgaataat

SEQ ID NO: 10595 - DNA, 121 bp, Artificial Sequence
  Synthesized
  misc_feature (61): n=a or g
gccatgtaatactgactgaagtggtacaaaataaaaggaagaaactaaaaaaatccaagangttatgttgtctagttccgcaactgattttgaaatagaagtagaaatatgctttatgttg

SEQ ID NO: 10596 - DNA, 121 bp, Artificial Sequence
  Synthesized
  misc_feature (61): n=t or c
tgtctaaagctttagatgtagggaaatattaattaaaagcagttgccctgcttatcaaatntagaatttgtttccttactgtgttgtgagattattgtagccctcactggtggtgtaagtg

SEQ ID NO: 10597 - DNA, 121 bp, Artificial Sequence
  Synthesized
  misc_feature (61): n=t or c
ctaataaaacccagcatgtgctaggtcttctttgtactaagggcacaaaactaactcaagntgaatccttgtgtctttttcttcaaagttatgctttagacagtcctgcacggttgcactg

SEQ ID NO: 10598 - DNA, 121 bp, Artificial Sequence
  Synthesized
  misc_feature (61): n=a or g
ttattcaatatacatattcatgtaaaccgtgtgagaatggaacctattctaatggtaagancagctggtgccaaagctggactgagtaagtattgatatttttgttccatggtaatatgca

SEQ ID NO: 10599 - DNA, 121 bp, Artificial Sequence
  Synthesized
  misc_feature (61): n=a or g
tgtggaaacatgctgtgagattgagtcaggcataaatatgtggtatctacatacatatatntatttcatttggtacttgttcctaatagatgtcatgcagcaactgtattgtcagcaggta

SEQ ID NO: 10600 - DNA, 121 bp, Artificial Sequence
  Synthesized
  misc_feature (61): n=c or g
caggagaccctgataataaatgtacttatcccaaatccaacaacagagcatcaaacagggngtggctttaccttgcttatacctgtgcctgtggtaatcctgaacgttttcaatacgactt

SEQ ID NO: 10601 - DNA, 121 bp, Artificial Sequence
  Synthesized
  misc_feature (61): n=a or g
tcattgtcacataggtaacttgtcatgtatctccttccagcaggacttttctttagtagcntagcattcatgtgagtaaattagtcatgtactgtaaggctttttacctgcaccttctgcc

SEQ ID NO: 10602 - DNA, 121 bp, Artificial Sequence
  Synthesized
  misc_feature (61): n=t or c
tagggtgtgcattggctcatcattcctttctgatgtttgccttcctgtgtgcatctttatntggggctctcgataagatgaggagcaccagaaatctcccagggataacaaatgattttgt

SEQ ID NO: 10603 - DNA, 121 bp, Artificial Sequence
  Synthesized
  misc_feature (61): n=t or c
atgtgggaaagaaacttgaattagatccaaggatatgcaatcattatgatttaagataatntgttagtataatacgactatttgtgttttggtgtgttcaggaatatctttaattcttatt

SEQ ID NO: 10604 - DNA, 121 bp, Artificial Sequence
  Synthesized
  misc_feature (61): n=c or g
cctggggccaacaggttggataagatacttttttaaagggcttttacgtctgtggtagtgntagatactactggaagttccctttgtggtagaagtgatttggggctccacagtggattga

SEQ ID NO: 10605 - DNA, 121 bp, Artificial Sequence
  Synthesized
  misc_feature (61): n=a or c
tcttcagattgctgtcagtcctatggataatgtttgccttggggctcatttttgctgttgnactgtgaagttttaggatggctcttgtacaattgccttcaggatgtgccctctccaaagc

SEQ ID NO: 10606 - DNA, 121 bp, Artificial Sequence
  Synthesized
  misc_feature (61): n=t or c
agaagcactctacagtgtcccatatgccgtgactctgctggatgaacagtgtggtcacagngacttttggagcgatggtcaccgctggaagtaaaggaaattttggttcccaaaaccagaa

SEQ ID NO: 10607 - DNA, 121 bp, Artificial Sequence
  Synthesized
  misc_feature (61): n=a or g
gagaataaatactgctcctccagcaaaagctgaatagtattgtttgaactgagaaaacacnggatgtcattctaaaagtgtaggtgcaactaaaataactatttacttcactgtcaatgag

SEQ ID NO: 10608 - DNA, 121 bp, Artificial Sequence
  Synthesized
  misc_feature (61): n=a or g
gctgccctccactttaggccggcgtcccctcaaatagaaccattctggctacagcagtggnctcaggctccaactctcttgcctctgcaagaagacccttctcaggttcatcagtaccaca

SEQ ID NO: 10609 - DNA, 121 bp, Artificial Sequence
  Synthesized
  misc_feature (61): n=a or g
tcagggctccatttctgcctctaaagcagtgtgactttggtactgtgagtgatcagccccnctgccctctaaatactcataccaagttgctgtttgcagtggtggaggtggagatggagat

SEQ ID NO: 10610 - DNA, 121 bp, Artificial Sequence
  Synthesized
  misc_feature (61): n=t or c
attaggttaattttgtgtgtatgttatccaaactagaccagcagcacagccatctcaaacnaaccactaccaaattcagcaactggaagtttatgaaaaataggtgggctgattttcagtc

SEQ ID NO: 10611 - DNA, 121 bp, Artificial Sequence
  Synthesized
  misc_feature (61): n=a or g
cttaggcatacatttctccttgatcccttgttatctacagtttctccccaaactccacaancagatatgtgtacagatacatacaagaaagagaagtatcctgatctgcaatatagatact

SEQ ID NO: 10612 - DNA, 121 bp, Artificial Sequence
  Synthesized
  misc_feature (61): n=t or c
taacaatatttcacaccttgccacagatctcttgagtgatcatcaccttgtgaatattaangcccatgttccttgtctgggcccaggctccttgtgacacagacaggccaagggaatgcgg

SEQ ID NO: 10613 - DNA, 121 bp, Artificial Sequence
  Synthesized
  misc_feature (61): n=a or g
ttgaggaagtgcactctcttcaattttcaaatcgaaagaacacagcgtgttggtttctgtngatactttcaagttatacagatttttttttgtttctcttgctgcagctaaatacaatgga

SEQ ID NO: 10614 - DNA, 121 bp, Artificial Sequence
  Synthesized
  misc_feature (61): n=t or c
ctgaagtgaaccaaaagtcagcctagagcaggatcctgtctcaaaccatagcaagagcagncgtgcaggcaaaagcataaatgtaggtcatgcatacaacaatgtccacttacacaccacg

SEQ ID NO: 10615 - DNA, 121 bp, Artificial Sequence
  Synthesized
  misc_feature (61): n=t or c
aaggtgatcaaatagtcctagaaggtcacagccctgaatactctcccagttacgagcaaangtcctgcagctttcatgtctaaagcactgcccgtgtactttactggctgcttaatgctaa

SEQ ID NO: 10616 - DNA, 121 bp, Artificial Sequence
  Synthesized
  misc_feature (61): n=a or g
atcgaacttgagaacattattcaatattcttctgtagaatcatttttggggatcattagcncttaaaaacagaacgagatgaatcctgcaaacccataggtgacacagatcagtttaccta

SEQ ID NO: 10617 - DNA, 121 bp, Artificial Sequence
  Synthesized
  misc_feature (61): n=a or g
ccattgcttatagtctctgaaaacaagcctgtactatgaacctgtaggcacaaagaagccnaaggtaccagaggattaggcattcaagttcttaaatggtgaggccagaaggtggccatta

SEQ ID NO: 10618 - DNA, 121 bp, Artificial Sequence
  Synthesized
  misc_feature (61): n=a or c
ttctttctcctttcactcactagtgccagcactggattacacctcacactgtaactcaacnagttcagcatttcttgaaaaagggagaggtggaagtctaaaaagtgcctttttgctcctg

SEQ ID NO: 10619 - DNA, 121 bp, Artificial Sequence
  Synthesized
  misc_feature (61): n=a or c
ttacacgtggaaatgtatggcatggtgctgattgtggcaaaaataccagcatgtgcttcantgttaaacattggtgatttctcttctcttctcttctcttctcttctcttctcttctcttc

SEQ ID NO: 10620 - DNA, 121 bp, Artificial Sequence
  Synthesized
  misc_feature (61): n=a or g
taccaggaaagacatcggagaacccagtcttggagatgttcaacaccagatcagtcatctnctgatctattagtgataggatagcaattaatctattaaaaaataattccattataaggca

SEQ ID NO: 10621 - DNA, 121 bp, Artificial Sequence
  Synthesized
  misc_feature (61): n=a or c
ttcctctcccacgttagaatatcacttgctgcagggagttttgagatctcatatgccctcntagggtttgcagtagtcaggcacagaaaggtttctccaggactagctgcaaagtaactcc

SEQ ID NO: 10622 - DNA, 121 bp, Artificial Sequence
  Synthesized
  misc_feature (61): n=t or c
atatacctgtagtcaaacctgtcacgctcggtgttcaagataggtgtgtgtggcagtaccnataagccttctccttcccctcatatcaactgatctgtctcctcccttcaataaatcttca

SEQ ID NO: 10623 - DNA, 121 bp, Artificial Sequence
  Synthesized
  misc_feature (61): n=a or g
ggggaaagagagagacatggatatgttgtaatggttccagtaaatgattacaaagattgcncttggagcagcagttgtatgaagagagaaggagagctgggataattcaggttgaagagga

SEQ ID NO: 10624 - DNA, 121 bp, Artificial Sequence
  Synthesized
  misc_feature (61): n=a or g
ttttgtttttgaatgcatatgtcttatgtatcagtgtagtccaggtccactcctgaggagnttttttcctccttggaggacatgtggtcagtcgaagggcacagtgtacaaacctagcaga

SEQ ID NO: 10625 - DNA, 121 bp, Artificial Sequence
  Synthesized
  misc_feature (61): n=a or g
cagccatgcagctgctcaggaatagagctttaattgtgtgggctgtaatatagaaagcagngtgtgtgcattatcatggaagaggctggaggcagttccaaagattttatcaaacactgtg

SEQ ID NO: 10626 - DNA, 121 bp, Artificial Sequence
  Synthesized
  misc_feature (61): n=t or c
ctgtgtggctattaaaacattagatgaatttgggccctgtgaaaagaatagccctctcagngcataccctattgaaaaatgtggcaaatttgattaagtaattagtaagtatttatattat

SEQ ID NO: 10627 - DNA, 121 bp, Artificial Sequence
  Synthesized
  misc_feature (61): n=a or g
aaattccaattagataattttttttttcatcacaacggtggtcaaacaattggaaaagttncccattgagtttgtggaatctctatagctagagatcttaacatttggctttacaagattc

SEQ ID NO: 10628 - DNA, 121 bp, Artificial Sequence
  Synthesized
  misc_feature (61): n=a or g
actgagctgccaaaatggcacgtcccaaacttgccttgaatatacacacgacggggaacancactgacgctcatttaattcttccctaaaaggatcggaaaccgaggagaaggtacggagg

SEQ ID NO: 10629 - DNA, 121 bp, Artificial Sequence
  Synthesized
  misc_feature (61): n=t or c
ccttcactttaaaatatgggtgtcagtctccctctgccaacatcacaacacgggggggcangcagccgccggcagcaccagtgccaatgggattcccaaacatgccgtgctgcaaggtgtg

SEQ ID NO: 10630 - DNA, 121 bp, Artificial Sequence
  Synthesized
  misc_feature (61): n=t or c
ctgcaactttttcttccagatccttcaagaacacttatttaaggctgaaataaaacagccntgttttgcaaatatgtaatgtctagatctcagagtgcaaatgcatgagaacttatccaca

SEQ ID NO: 10631 - DNA, 121 bp, Artificial Sequence
  Synthesized
  misc_feature (61): n=t or c
tttgaactaaggttttgcagtggatgaacttagcatagcaaactcagtaaaagctcttcanttttcttcatgttattttccttcaatcttcctgagtgtattcagagtgttttgacctgtg

SEQ ID NO: 10632 - DNA, 121 bp, Artificial Sequence
  Synthesized
  misc_feature (61): n=t or g
gtgggagctatcaactctttcctgctctgatttattctaagctcactatgtctagaattanctgtaaacatgtctgtgacagctacaaagacaaaggttgctgctgaggttcaaatcagat

SEQ ID NO: 10633 - DNA, 121 bp, Artificial Sequence
  Synthesized
  misc_feature (61): n=t or c
atccccactccctgtctcagctccttgggtcctacccaaacgcccaccttcacggctatgngtgtttcagctctggaagtggggatgccttttgcagacaggggtgagatgctgctacctt

SEQ ID NO: 10634 - DNA, 121 bp, Artificial Sequence
  Synthesized
  misc_feature (61): n=t or c
gtattccatggttgttttctttccagggaagaacaacattaaaaacactgcacctcttacngatgaaaacctgctatttctttttagaaagcacaacaactttgtggtatcatctatcaca

SEQ ID NO: 10635 - DNA, 121 bp, Artificial Sequence
  Synthesized
  misc_feature (61): n=a or g
ttgaaaacttgtgtactgtgtgaccagagaacgaaatgtttgtttcccatgagctaatgcngagcaaggagtgtatgcttcggtctgttctcatgtcacatgagagctacctccacctctg

SEQ ID NO: 10636 - DNA, 121 bp, Artificial Sequence
  Synthesized
  misc_feature (61): n=a or g
agcatggatccagtaacaaggcagaaggataaaaaggaggcaagaaggacaagctaggccnaagttttttcttactcacttctgacatgtttctgagactgctttttatgccatgcaaaca

SEQ ID NO: 10637 - DNA, 121 bp, Artificial Sequence
  Synthesized
  misc_feature (61): n=t or c
ctgctccagctgcactgatgcacatctgggtggtttagcactaactcagttccatctacancagctgaggtcctcccaaggactgcagcacagcccactgctggatggatgccatggggtg

SEQ ID NO: 10638 - DNA, 121 bp, Artificial Sequence
  Synthesized
  misc_feature (61): n=a or c
ggaaaggagaagtgagaagtaaggagctttttaattttctttttgtatgtatttcaacacnctatcactggctgaaaagtacttccgccaacaaagccataggagactaaacttttaagca

SEQ ID NO: 10639 - DNA, 121 bp, Artificial Sequence
  Synthesized
  misc_feature (61): n=t or c
agatataaatcagatgtgggggtatcagaactaaaacacagaaaatctggggagctgaganatacctcctcaggagcgcactgctaaaaggagcaaagctcatttcacatacaagttcagc

SEQ ID NO: 10640 - DNA, 121 bp, Artificial Sequence
  Synthesized
  misc_feature (61): n=a or t
cttattattatctgttagcaaaagattaaaaatttaaaagtgagtattacccaagattcangtcacaaaaataccactgcaagctggatctgggttaatctgcttgtctaccgctccatag

SEQ ID NO: 10641 - DNA, 121 bp, Artificial Sequence
  Synthesized
  misc_feature (61): n=a or g
aactagatatcaagatgcgcaaatgcactttgtgtggtctttccagccattgatccactcncttggcttttattgtgtgaaaatcactgataagagtgctataattatggatgaactctgt

SEQ ID NO: 10642 - DNA, 121 bp, Artificial Sequence
  Synthesized
  misc_feature (61): n=c or g
aaaagatgtggccgatgctttggtgaagtagaaatccccagggagccaatctggcaagcanggttgtggagatttgctatcggaccttttgtaagaagtgtgaaaggggtctgaatccctc

SEQ ID NO: 10643 - DNA, 121 bp, Artificial Sequence
  Synthesized
  misc_feature (61): n=t or c
ccttgtcctaactcaagactgagcttaagtttaatgttctgtttttcagagaactgtgtcnctacacattttttaacctttttaaaaataattattattattaaccttttaagaactcttt

SEQ ID NO: 10644 - DNA, 121 bp, Artificial Sequence
  Synthesized
  misc_feature (61): n=a or c
aacattgtgccaaaaggcagtgcttgcaggatctgataggttcccagaggcagagctgggnggccctgtgcaaaccttcagtagatcctgcttgctttctgcctgcaaatgaagttctagg

SEQ ID NO: 10645 - DNA, 121 bp, Artificial Sequence
  Synthesized
  misc_feature (61): n=t or c
atgttccttgccctcccaatgcagcattgcaccattttaagttggagctcttgttttaagngaacaaactgtttgagttcccttcatgttgaggctggctgcctggttgtgcaactggagt

SEQ ID NO: 10646 - DNA, 121 bp, Artificial Sequence
  Synthesized
  misc_feature (61): n=a or g
ccttgtgtagaatttaatcaaattattttgaagattatggctcaacgcctcttggtaaggnataaaggcagcagttccgggaatgcatactcaacatttgtcttgcagagatgttttacac

SEQ ID NO: 10647 - DNA, 121 bp, Artificial Sequence
  Synthesized
  misc_feature (61): n=t or c
tggtagtgtcagagctgggagcctgaggagcggtgccttaggtggccttgtcagggtctgnagtgctgacagggtcaggcagaccaccctaaagcgttcctgctatgtggccgtgttagag

SEQ ID NO: 10648 - DNA, 121 bp, Artificial Sequence
  Synthesized
  misc_feature (61): n=t or c
ccagaaatgtctcccagcagcagctgtcaggagtgggaggacaagccctgttcatctcctngcaaagatatgatattcccctattgtaggtgctaattattattttctttctatgactgag

SEQ ID NO: 10649 - DNA, 121 bp, Artificial Sequence
  Synthesized
  misc_feature (61): n=a or g
cacagacgaatgttgcagtatctgagtgattaggcctaagctacagtataaggaaaagtanaagcactcctgacaggaatagactacttgaggcaaaacattctcaggtacattcttatgt

SEQ ID NO: 10650 - DNA, 121 bp, Artificial Sequence
  Synthesized
  misc_feature (61): n=a or g
atttatgtttttctaagctgaaaaatctttgggactggactctggtgattacttgtgagangattactggtgccaattcttccagaaagttcatttttccttttttttttttttttttccc

SEQ ID NO: 10651 - DNA, 121 bp, Artificial Sequence
  Synthesized
  misc_feature (61): n=t or c
tgctcaagtacagtagacacaagcgttgcatgtgatgagttgtactgaatctttagacagnggagtgaaagtgaatacttcaagcacaggtctgtgctctgttgtggctgaaaagagaagg

SEQ ID NO: 10652 - DNA, 121 bp, Artificial Sequence
  Synthesized
  misc_feature (61): n=t or g
taagactaatttcaccatcaacagtagacaacatctgctcatggaggaagtctttctattnaagaaactgtcaacacaggtgactgtccatagtagatatacatgtatttatatcaagttc

SEQ ID NO: 10653 - DNA, 121 bp, Artificial Sequence
  Synthesized
  misc_feature (61): n=a or g
tcagtgttgctttggaaaaacttaacagtaatacgcataagcatataataaacattgtttngttttcatctctgcatatgaaaggccagtataatttttatataggtaggtatatgtaatt

SEQ ID NO: 10654 - DNA, 121 bp, Artificial Sequence
  Synthesized
  misc_feature (61): n=a or g
cttaaagcacctttcaaaggcagcgccccaaggcttcaatgcagttacttttccatccaanacttgttctagtttctgcatctcgacttacctctgctgttacaggtgggagaggaaagcc

SEQ ID NO: 10655 - DNA, 121 bp, Artificial Sequence
  Synthesized
  misc_feature (61): n=a or g
ggtagctgtatctgagagaaaaaatacaggagttttaataacaggttgggcaaacagaganaatcagtgtgtgttttaacttcctggcttcagtaggtttaagtaacagtttaggatgagt

SEQ ID NO: 10656 - DNA, 121 bp, Artificial Sequence
  Synthesized
  misc_feature (61): n=a or g
ctttttcttaaggaaggtaacatttagaacaatggcttctacatgagcttttgtttaattncgagagcactgcagaatatgtttttcacttaaaatccaagcgtgtgaataaaactgcatt

SEQ ID NO: 10657 - DNA, 121 bp, Artificial Sequence
  Synthesized
  misc_feature (61): n=a or g
ctcgttctcattaagactcacctgcaccccactgctctcccccagcccagagaaggaagcntttaagaagcggccaaagctgcagcaggacaacggggaggagacggacgagaatgaagca

SEQ ID NO: 10658 - DNA, 121 bp, Artificial Sequence
  Synthesized
  misc_feature (61): n=a or g
tttgcaaaatacacttggagggccagaaaagcacgtagttacacagcatagatactgatancagtacgaacatatttcttaacttccctcctcttttttttttttttccccatccagaaat

SEQ ID NO: 10659 - DNA, 121 bp, Artificial Sequence
  Synthesized
  misc_feature (61): n=t or c
gcaaacccttgggtgtgtgcaggggaagggggagcaggaggaacaaggggagggaacaggngggaaaaggcatcactagaggcacctgatcacagactatcccactgtcctgtattttctc

SEQ ID NO: 10660 - DNA, 121 bp, Artificial Sequence
  Synthesized
  misc_feature (61): n=a or g
cattacatgatgagaaagggaggagagccacaggcattgtcttcttagcatgagttcttcnagcatgaaccatccatggctgcactggaggacatcctttttctatcacagatctcagtgc

SEQ ID NO: 10661 - DNA, 121 bp, Artificial Sequence
  Synthesized
  misc_feature (61): n=a or g
ccacaacagtctggtttggaaagataggcaacgtgagaaacagtggtcatttgccaaatcntggggaagataaaataggcagtctgtaatgtatctgcccgtggctctgtcctctacttcc

SEQ ID NO: 10662 - DNA, 121 bp, Artificial Sequence
  Synthesized
  misc_feature (61): n=a or t
aatgctacaggccatcagcatcactgtcacaggcactgcccacaccttttctgacacatcngaggactgtggacaatgcagaagcaatgccaccagtttctctgccccttgtgccaaacac

SEQ ID NO: 10663 - DNA, 121 bp, Artificial Sequence
  Synthesized
  misc_feature (61): n=t or c
tttagcagaggttacaggaaaactcatggcctgtgtattctgtttgatctgactgataatntgcgtgtcttctttcaatccattttgatgtaaaatttcaaaaaaatgaactgttcataag

SEQ ID NO: 10664 - DNA, 121 bp, Artificial Sequence
  Synthesized
  misc_feature (61): n=a or g
cataagaaggtaaaggatttaaggtattctgtaaatctgaactctttttataactccatcntttctaattcttgccttttctgtgagacatgtatgagaagggttttttttgttttttttt

SEQ ID NO: 10665 - DNA, 121 bp, Artificial Sequence
  Synthesized
  misc_feature (61): n=t or c
gtcagagccacaaatgcaaaattgagattaactgctttctaactgagtgtttcagttccantgaagtcctctatcaaatgtaggctgttgtctttgctccagaggtcctacagccctggtg

SEQ ID NO: 10666 - DNA, 121 bp, Artificial Sequence
  Synthesized
  misc_feature (61): n=t or c
tttggcccatcctcctctgacagcctcttatctctgctaagataccgttttcagacaaagnagatattttctcttctatcttctttgttatctgacctttatcatctgcaatatcattatc

SEQ ID NO: 10667 - DNA, 121 bp, Artificial Sequence
  Synthesized
  misc_feature (61): n=a or c
agcggctccttcaccagcaggaacagccagctcccaggtagggagatggaacatgttctcntggaacatctcagcactacagctgggtttggctgcaaaagtgtggttttctggttaagat

SEQ ID NO: 10668 - DNA, 121 bp, Artificial Sequence
  Synthesized
  misc_feature (61): n=a or g
tgccttaaaggaaagttcaggtaacaaaggagaaataactataaagttaaacttaagggtntatccaaaattccagaaaaacaagttattttttctacttgtaacaatacataaaattaaa

SEQ ID NO: 10669 - DNA, 121 bp, Artificial Sequence
  Synthesized
  misc_feature (61): n=t or c
tcggctgtgccagccaggtgatgagttcaggaaacggctttgtgcgctacgggtcgtgtgngttgccagcagagggaatgaatgcacacagctgccacgttcagctctccacctccaaagg

SEQ ID NO: 10670 - DNA, 121 bp, Artificial Sequence
  Synthesized
  misc_feature (61): n=a or t
ctaaggtttatgcttattgttaagggcataaagtatgtgaaacaagtagggaattacaaanaataaggatcaatgccttttctacatgcagtgactgtcatgattgagaaatgaatatgag

SEQ ID NO: 10671 - DNA, 121 bp, Artificial Sequence
  Synthesized
  misc_feature (61): n=t or c
attgctgggaccccccccaaaaaatggagcagcagaagggaattactgtctcccaacttgntgtagccaccagagaaggaaaatggccgtgctgcagcccccccgggacatgtgtttgaca

SEQ ID NO: 10672 - DNA, 121 bp, Artificial Sequence
  Synthesized
  misc_feature (61): n=a or t
ggccctacagcaggacaaggggaggcaggaatcaggtgcactggagctgacttgctgaatnccaggacttacagcaactcatctgcagaactctcccttgtcagtgtcagctccctactgt

SEQ ID NO: 10673 - DNA, 121 bp, Artificial Sequence
  Synthesized
  misc_feature (61): n=t or c
ctctgggttgcagcattcatcgtattcctgcactagggttatttttttcgtttctcttggngatgcacttgcaaaaaatcaggaagcaaacttggtgtctgtctagtttctgtctagttct

SEQ ID NO: 10674 - DNA, 121 bp, Artificial Sequence
  Synthesized
  misc_feature (61): n=a or c
tcacaagatttgaaatggccaagtatgcttgattatttactgcatagagggtagggttaancacattcatccaggagattctcctgttgcatgatgacgctgagtggaccccttgcttcca

SEQ ID NO: 10675 - DNA, 121 bp, Artificial Sequence
  Synthesized
  misc_feature (61): n=t or c
ctgtaggacagctcatttttttcattgctttcaagatttagacattatggatcaatattanggagacttctcaatcatttcagagatcaatttcaatcaagctaattaatttgcaactact

SEQ ID NO: 10676 - DNA, 121 bp, Artificial Sequence
  Synthesized
  misc_feature (61): n=t or c
ggccacgggtgaaggtggtgacaccacaaacacttgtaccatctccctttcatagctcttncaaggaggactccatccagtgaagacccctctggacaaggttctgagcagcctggtttgt

SEQ ID NO: 10677 - DNA, 121 bp, Artificial Sequence
  Synthesized
  misc_feature (61): n=a or g
tctctttcaacctacagcaggatggtatgtagaaaggataaagtatacatattctcaatantggttattaaacacaaggaattaaacatacatttttattcagaagatatgtgaactaatg

SEQ ID NO: 10678 - DNA, 121 bp, Artificial Sequence
  Synthesized
  misc_feature (61): n=t or c
caatgcatcgacttgtagacatgtgctagacagcttgaggaagagagtgccatgaatcaancatataaaagggtttgttttctaaatggaagcagactgctccagactcagatttgagcct

SEQ ID NO: 10679 - DNA, 121 bp, Artificial Sequence
  Synthesized
  misc_feature (61): n=t or c
aaggttttctgggttaatggtcctctgagaggattactgaaagacactccgtgccttccantcctacaccttgcctcttaggtctggctgaaacatgaggatctttgtccatcctaaagaa

SEQ ID NO: 10680 - DNA, 121 bp, Artificial Sequence
  Synthesized
  misc_feature (61): n=a or g
tcttgcctcatcagtgctcctgtgtgatggtttcactggtgtaagataacggcaggacctngggataaggtaagggaatagggacagcaagtgctttgccagcctgtcagccaccatgaac

SEQ ID NO: 10681 - DNA, 121 bp, Artificial Sequence
  Synthesized
  misc_feature (61): n=c or g
tagggggcaaagtatacttcatttccacagttaagaagtaacctgcaatttataggacacngaacctccacagaaaggggattctaaaaatgacctattttccacaaaatggtgcaaaccc

SEQ ID NO: 10682 - DNA, 121 bp, Artificial Sequence
  Synthesized
  misc_feature (61): n=t or g
gtcaaatgaaaagaacataagatacaattaaagctaattactattaagagcatcattcttntttaccactctgatcatgcaatatatttaaatgcgaacagttttcagttatactgacaca

SEQ ID NO: 10683 - DNA, 121 bp, Artificial Sequence
  Synthesized
  misc_feature (61): n=t or c
tttacaagcttttagttatacttgggcatggaatagcgaagtaagagttgaaaagctaagnaagcatatttaactgaggtcacaaaagcttatgttaaaaagaaatctacattcagcatgc

SEQ ID NO: 10684 - DNA, 121 bp, Artificial Sequence
  Synthesized
  misc_feature (61): n=a or g
cgctgttcaaagagtattgtttttcataggaaggtaactcaattgcatgtgttctgcatcncagttcctttctttcttgtgggcactgatttgtactgtatctgcaaattcctgctgaaag

SEQ ID NO: 10685 - DNA, 121 bp, Artificial Sequence
  Synthesized
  misc_feature (61): n=a or g
aaatggtctgactattaattttcctcttttaatctccagtctactgttctccctgccattngatttaataaactatttaagtctctcttttgaaactgtcatccatagaacactttcaaag

SEQ ID NO: 10686 - DNA, 121 bp, Artificial Sequence
  Synthesized
  misc_feature (61): n=t or c
cacagtgacaagtaaggtcctgctggtaccatccggatcattttatttttgagaatagccnttcccttcaaacagaaagagatgaacaagcctttcaggtctaagcaaaaaagatttcaat

SEQ ID NO: 10687 - DNA, 121 bp, Artificial Sequence
  Synthesized
  misc_feature (61): n=t or c
ttctgaggacacacaagatccgggttcttgaaggctaaggctgagtgctgcccttggaagngcaggctgcccaacagcgacctactgactacagtctactgactgcaaattcctcctctgg

SEQ ID NO: 10688 - DNA, 121 bp, Artificial Sequence
  Synthesized
  misc_feature (61): n=a or g
atttcatttttcctttccctattctgagtgaaagttggtaatcaagacatagtactagacntacacactctctcttctatcccaatattaaatgcactctttgccttcatataaaaaagaa

SEQ ID NO: 10689 - DNA, 121 bp, Artificial Sequence
  Synthesized
  misc_feature (61): n=t or c
atggattcttggtgccactaacaaatggattatggaatacaaatggagttcagatcctggntgtatctagaagtatatcatgatccataacatcatatgtatgtgatccataatgctgagc

SEQ ID NO: 10690 - DNA, 121 bp, Artificial Sequence
  Synthesized
  misc_feature (61): n=t or c
gagaagcacagttcccattaaagcactaacctgcagtctagctcaattcctacctgcttanttcagctttaggcacctgcccttgcagagatgtgtttttcacctttggaatagtcctaat

SEQ ID NO: 10691 - DNA, 121 bp, Artificial Sequence
  Synthesized
  misc_feature (61): n=a or g
taaaaccagctacaaaaggaactgcttccctagtgggaatttctgcgtgttgcaaacccancataactcttctgtgtaaggcaggaagggctggactctgcattggtaccatctgaaaatc

SEQ ID NO: 10692 - DNA, 121 bp, Artificial Sequence
  Synthesized
  misc_feature (61): n=a or g
tcttgattatcaaatgaaaatagatattgtaatatttcataaactttggaatctagtgccngtataaatggatgggtcacctgaaacatcttgtgtaggtggcagatatggctctggaaga

SEQ ID NO: 10693 - DNA, 121 bp, Artificial Sequence
  Synthesized
  misc_feature (61): n=a or g
aagtccaaattgaattgtagcatgctgctaccagaaggcaggggatgcagcatttgatttntgcctttctgcttttgtacttgtactctgggcgtgagcctggaggaactccattcttttc

SEQ ID NO: 10694 - DNA, 121 bp, Artificial Sequence
  Synthesized
  misc_feature (61): n=a or t
aaaataatggtatctctcccttgggggcatctggtgacttcagacccattcgtatttgggncctgtttccttttttggtaggcacacatcccatgtgatcctcctgttccaaatgtttgtt

SEQ ID NO: 10695 - DNA, 121 bp, Artificial Sequence
  Synthesized
  misc_feature (61): n=t or c
gacagccaggagctgctcagcagatggatgggcgcctcttcttctcctctttagctttttnttccctgctgtatccccactgtaatactccttaattcaattaattctctctttctttttt

SEQ ID NO: 10696 - DNA, 121 bp, Artificial Sequence
  Synthesized
  misc_feature (61): n=a or g
attttcatactttgtagacatgcttgaattaaaaatgaaagaatctagtgttcaaggtacntggatgaatagctgctacttcagatgtacgactttgctgacaacctgtcttgtccattta

SEQ ID NO: 10697 - DNA, 121 bp, Artificial Sequence
  Synthesized
  misc_feature (61): n=t or c
ttgacccaccaccccttcccagccctcctgtgctcccatgtcacaagggatgccagcattnccatgctggagggaatgatagtagccccacttgcagccattccagcacaccgctgtgtcc

SEQ ID NO: 10698 - DNA, 121 bp, Artificial Sequence
  Synthesized
  misc_feature (61): n=t or c
gagaggctgtgttaagtctctgtttcagggtctgcaaggtcaatggatgttgttccggcgngctcaataaactacaggatacaccagggtttgtggggagcgttcttcaattgaatcatga

SEQ ID NO: 10699 - DNA, 121 bp, Artificial Sequence
  Synthesized
  misc_feature (61): n=t or c
ctgttagctgctgagtggtgctgcatccggatacaaactgcttgcttcacaatgcttacancatacttatatccatacactaaaaagactggagagatgcaaggaaaggaaagcaacatgg

SEQ ID NO: 10700 - DNA, 121 bp, Artificial Sequence
  Synthesized
  misc_feature (61): n=c or g
agtggttccacctgaaccaaatgagtatcagcaaggccaagatgttgtaccttgattctgntggatgaaaagcttgccatgagacagtaacatgctcttgtagtctggaaggtcaggtgtg

SEQ ID NO: 10701 - DNA, 121 bp, Artificial Sequence
  Synthesized
  misc_feature (61): n=a or g
tggcacttcactgctctgcaatggggaagcaaccaaaacccatggagaaaaaatatttacnaggcaaattactagaacaagatttttcttgaaaacaggaagaaactgcagtgtccttgat

SEQ ID NO: 10702 - DNA, 121 bp, Artificial Sequence
  Synthesized
  misc_feature (61): n=a or g
tctgatctaggaagtgttccaatcatgttattaatgtgtaattagaactgttccggatgtnactatgagcagttctggagagagatcattgcttgtactcctgtccagtggcaggttttgt

SEQ ID NO: 10703 - DNA, 121 bp, Artificial Sequence
  Synthesized
  misc_feature (61): n=t or c
aaagagttagaatactgcaaaggtctgaaacatctctgtaccaatcaaaacatgtatttanttccaacgctacaagtttaaggtgtgcaagttaatgtctgaatgcactgacaactcagat

SEQ ID NO: 10704 - DNA, 121 bp, Artificial Sequence
  Synthesized
  misc_feature (61): n=a or g
tttatgccattcgtttcagcttttacccaaaattccatattgctttcacttttcagatatntacacagagctctgaatatacagtaatggatttaaaataaccactatttgtcttttgaat

SEQ ID NO: 10705 - DNA, 121 bp, Artificial Sequence
  Synthesized
  misc_feature (61): n=a or g
atggatgaagatctgtgctgctggcaggtgcttagaataaggtttccttgcatttcgtaantgtgaaatgattgattttgactttcagaagtgcatagaaagctctctgtctcatttgtta

SEQ ID NO: 10706 - DNA, 121 bp, Artificial Sequence
  Synthesized
  misc_feature (61): n=a or t
tgcagtattactagcatctttaaacaactgtgtgatctgtattaactaccttttggtattntaagcggagctaatatgtatttgcttctttatcttaaaaagaaaaaaaaaaaaacaaaaa

SEQ ID NO: 10707 - DNA, 121 bp, Artificial Sequence
  Synthesized
  misc_feature (61): n=c or g
ctcaaattaggagctgaagccaggtcagtgcacagtttagaattgccttataatgtctcanttaacaatttttgtatctgagctcttgaatttcagtgcccctgaaagtctgcatctgtga

SEQ ID NO: 10708 - DNA, 121 bp, Artificial Sequence
  Synthesized
  misc_feature (61): n=a or g
acaggagacttatgtgtggagaaatgccgtcgataaaatacttccctaagatgctatgganacagtgtattttagagagcaatatactacattttcttcgaggaacttggaagaatgtggg

SEQ ID NO: 10709 - DNA, 121 bp, Artificial Sequence
  Synthesized
  misc_feature (61): n=c or g
attgttcagcacatttaccaaacatcggctattttagccataatttccactctgaatttcnacctaaacctgaatcccataacaaacccttcgtcagaattttctgttatctctaaggtca

SEQ ID NO: 10710 - DNA, 121 bp, Artificial Sequence
  Synthesized
  misc_feature (61): n=t or c
actaatatttgaggcataatatcagataagctgggacattcacttcgtacaccagcctagncctaggcagcaggagagctaagtttatatctatacatattaattaagtgggccaacacct

SEQ ID NO: 10711 - DNA, 121 bp, Artificial Sequence
  Synthesized
  misc_feature (61): n=a or g
tgcagcttgaaaggctaacagcatcctgagcaacatcaaaagggagatagtcagcagggcnaggaaggtgattgttcccccctactctgcccttgtaagaccccatctagagtactgcccc

SEQ ID NO: 10712 - DNA, 121 bp, Artificial Sequence
  Synthesized
  misc_feature (61): n=a or c
cagatgtgttgcttttctatacacgctgtgaatacttctgtacctctgagaaaacgcagtnagagatgctcccttgactgattacaccttacagtaattaaccttcttgctatttccagtc

SEQ ID NO: 10713 - DNA, 121 bp, Artificial Sequence
  Synthesized
  misc_feature (61): n=a or c
aggaacagataatgaaagagatgatttgtttgggtatgtctcaagctttggccaaggaagncaagagcaaacccagaacttgaacaatgggggctatggagaaggagatacactaacaagt

SEQ ID NO: 10714 - DNA, 121 bp, Artificial Sequence
  Synthesized
  misc_feature (61): n=a or g
tgatcagaatatgttccagatgaatcctgttggagatctactacagaatttatgctacgcncacaacttttaaaaagttcagattatgacccctctgatgttattttaatgctattttata

SEQ ID NO: 10715 - DNA, 121 bp, Artificial Sequence
  Synthesized
  misc_feature (61): n=t or c
tggctgcacagttcccataaaggaaaaagacatacgcgacattgaactaaacatatcttgntttcctttgcaggtgcaaatgctaaagggcgtactcagacaaaatattttgcataatgtc

SEQ ID NO: 10716 - DNA, 121 bp, Artificial Sequence
  Synthesized
  misc_feature (61): n=a or t
tgcaccccaggtttgctgttctttggaggctgattacttctctctgaagctaggaactatntattgttcttttaaatgttcctctgattttttgacagttgctacacttcccaagaactgc

SEQ ID NO: 10717 - DNA, 121 bp, Artificial Sequence
  Synthesized
  misc_feature (61): n=t or c
tatgtcatatattactcaagtaggaaatatttaggattacaaggaaaaactagtgatattngaaagtaaagctttaagcaaccattgctatttaaagtaaccttttcccttctttttatgt

SEQ ID NO: 10718 - DNA, 121 bp, Artificial Sequence
  Synthesized
  misc_feature (61): n=t or c
ctgctcctactttgtagtgcgctctctctcctgcacttcagtagtttgatgagcacaaggnagccctgccatatgcaatggctagagctgcttcaggccttcgaggtcctcgtgctgggca

SEQ ID NO: 10719 - DNA, 121 bp, Artificial Sequence
  Synthesized
  misc_feature (61): n=t or c
ccttctgatacagatgttaggaatgtgtccttcatgtcaggacacaggagggaaagaaaanctcctctgcagtgataattattgttatgtgttagaggctacctggctggaaaggcagaat

SEQ ID NO: 10720 - DNA, 121 bp, Artificial Sequence
  Synthesized
  misc_feature (61): n=a or g
atacttaaagtctccaaaccattctgtgttctataactgttctgttatttctagcagtaantgtaaagaactgctttgctaagattagtgattacctttcaggcacctcagatgaggttct

SEQ ID NO: 10721 - DNA, 121 bp, Artificial Sequence
  Synthesized
  misc_feature (61): n=t or g
gtgtggtcacaacaggtgggtgaggaaatggacagacactgtagcttacctttgacagctntgtttcctcaatatttttccttattttccttagagtagctctgatgtagttacagaccag

SEQ ID NO: 10722 - DNA, 121 bp, Artificial Sequence
  Synthesized
  misc_feature (61): n=t or c
gtgatcagctcattaggatctaatgaggcatcttgagtaagtttcagccatttagcattantgaccgattgtctacaagtacaatatttctagaaaacagtgccaacctatcacagaagtt

SEQ ID NO: 10723 - DNA, 121 bp, Artificial Sequence
  Synthesized
  misc_feature (61): n=c or g
tctgactgcctcaggtggaaattcttgtgtagatggaatttattattttctgctcacccanagtaaatgttttgattctgtcttacaggatgaaaaatactttggtcatttgacatattct

SEQ ID NO: 10724 - DNA, 121 bp, Artificial Sequence
  Synthesized
  misc_feature (61): n=t or c
ttttcatcattttcaacgtgaagttttttcaagtcttcgagtactatctcacgtgactgtntcagtttcttaatttcagtattttgtgtctccatttgacattccaattcatgtagtttct

SEQ ID NO: 10725 - DNA, 121 bp, Artificial Sequence
  Synthesized
  misc_feature (61): n=t or c
acttctcatctcagaaaattggtgtaaagcagaagttccttttagtgcctctgtcagttangggtttcaacaaggttagtgattaaaatacagctaataaatatgaagaaagtaaaggact

SEQ ID NO: 10726 - DNA, 121 bp, Artificial Sequence
  Synthesized
  misc_feature (61): n=t or c
agagcaggattaatagggtgattaaatgctggaggcagcaggtcgtgatgtacccataatncaagttttcacaatagttactgtcttttattaaataatcaaatgaaatgtgtatgtcatt

SEQ ID NO: 10727 - DNA, 121 bp, Artificial Sequence
  Synthesized
  misc_feature (61): n=a or g
ttagcagatgtcattctctccagctgcaggactctctggataaaaagttgaagttgcactnttactcagcttctccttccaaagacaaaaacaactccgcagaagacaaattatactacct

SEQ ID NO: 10728 - DNA, 121 bp, Artificial Sequence
  Synthesized
  misc_feature (61): n=a or g
attaagttaataaagttgtactttactaggtgtgaggggctcgattattccattagcagtnccatacatggatacccaagctcagaactgtggattggaacaatcaggttatgaggatgga

SEQ ID NO: 10729 - DNA, 121 bp, Artificial Sequence
  Synthesized
  misc_feature (61): n=a or g
atttaaacttgttgtaaactacgtgatttgaccttcatggttagattagccaatgtcccancagaagatgaactgaaatagcatgtcactgaattgaaatactgtgtcactaattcctagc

SEQ ID NO: 10730 - DNA, 121 bp, Artificial Sequence
  Synthesized
  misc_feature (61): n=t or c
ttatgataataaaaaaacataactatctcaatcatatactttcagtgtggtcaactgcaanaagtatgttctctttcttctctgtcgaatcccaaattcaactctgcccctggtggatata

SEQ ID NO: 10731 - DNA, 121 bp, Artificial Sequence
  Synthesized
  misc_feature (61): n=c or g
atcactaagtgcagagtgctgatagaggttaggtgatgacttaaggcagtgtcaccttccnaggcagagtcactaaacaggggagacagcacacatttatcttcctctgtttgcacagtgt

SEQ ID NO: 10732 - DNA, 121 bp, Artificial Sequence
  Synthesized
  misc_feature (61): n=a or g
ataccatttatgatatgcaaaacctcagtgtggtgtggaccagaacccagagaagaacagnaaattcacttggaaagaacaatgctggaccaatcaaattacatggaacttgttagtcagt

SEQ ID NO: 10733 - DNA, 121 bp, Artificial Sequence
  Synthesized
  misc_feature (61): n=a or g
ctctgtttgggaaaaatcagttcagaagaattacacagagtatgtggggaagcagcacccntgtgtacttcagtctgtgcagcagtgggacagcccgagggcatggtgagtatcaccacag

SEQ ID NO: 10734 - DNA, 121 bp, Artificial Sequence
  Synthesized
  misc_feature (61): n=t or g
cctggtggtctcatgcccttcagtaacataaaccatgaattccctgcagcgaggtttgctnccggccacttcactgcaaccccatgctgagcagttcctgggtcccctaaaaccaatgcct

SEQ ID NO: 10735 - DNA, 121 bp, Artificial Sequence
  Synthesized
  misc_feature (61): n=a or g
tggtgagtgaaagccacgatgcacctcctcacactgaggattttgttgttgctgtaccacnagccatggggacacgtcaatccagcaaggcacagggcagagccaccccctatacagccac

SEQ ID NO: 10736 - DNA, 121 bp, Artificial Sequence
  Synthesized
  misc_feature (61): n=t or c
gatcttctcatgatttgaaactgctttgtctggtaagttttatgaagagaattacaggcanctaagcaaaaatttttacatgccctaagattgagactctggtggaaaatattgaacattc

SEQ ID NO: 10737 - DNA, 121 bp, Artificial Sequence
  Synthesized
  misc_feature (61): n=a or g
tgcagatgaaagatgagggcactaagggagttgcttcagttcagataatcaaggaattccntgcagcccctttgtgttgtttctctggttgaaggacttctctcttaagagctttctgtgc

SEQ ID NO: 10738 - DNA, 121 bp, Artificial Sequence
  Synthesized
  misc_feature (61): n=t or g
tctaggactttgtaacttcataaattctggacaagtcccaaagactgaagacccctgttgnctggactaatgctgaaacctagaccagtgacctctttctctgtttgtctcccccttctcc

SEQ ID NO: 10739 - DNA, 121 bp, Artificial Sequence
  Synthesized
  misc_feature (61): n=a or c
aacagagaataatagtagttgtaattaagctattattattaaaaataagagaagtactgantcatagcaagttaatggctaatattgcatgtacatcacttgtggatttactgtgttcact

SEQ ID NO: 10740 - DNA, 121 bp, Artificial Sequence
  Synthesized
  misc_feature (61): n=t or g
agaacttgtatagctgcactcagccatcacagaagaacacagacaacaatatagcaatttncaatatcaagaataaagagcacaagagactgcagatgagcaggacatcttgctgaatgca

SEQ ID NO: 10741 - DNA, 121 bp, Artificial Sequence
  Synthesized
  misc_feature (61): n=t or g
aaatatagtgaaggtggactgtatataacacctcttcatcctgatacccatgtggtttttncatcatagtcagtttacccctgtacccctgttcccctgaaatgctgccagaacaccatac

SEQ ID NO: 10742 - DNA, 121 bp, Artificial Sequence
  Synthesized
  misc_feature (61): n=a or c
tttttaccaaaactggatctgattctgtacccagatgtagcagagatcaacgcatacaggnaccacgaacacaattatgacatggctcatgtgatcctaaggtgaaaatacctagattttt

SEQ ID NO: 10743 - DNA, 121 bp, Artificial Sequence
  Synthesized
  misc_feature (61): n=t or c
gctacttttagctcttcagaaagcacaattgagtctgagttcctctgtgctattgtagttntacctggcataccacagagctgctcagagggatgtgagaattatttggggcctatttctc

SEQ ID NO: 10744 - DNA, 121 bp, Artificial Sequence
  Synthesized
  misc_feature (61): n=t or c
gtattcatgcagtgcctgaaggggagcctgggaggacagttgcccatcatgtgggaaacgntcatgtagaatgatgggaccttgggtgaggacccttgtagggcatcctacacatgctctg

SEQ ID NO: 10745 - DNA, 121 bp, Artificial Sequence
  Synthesized
  misc_feature (61): n=a or g
actgggttaatggatcctgaggacagtcctcccagcaatagcatgtattgagggatctgcncaggtttcacagctgcacagtgcagagttgctctgcaaggcatgagctaatgtacagttg

SEQ ID NO: 10746 - DNA, 121 bp, Artificial Sequence
  Synthesized
  misc_feature (61): n=a or c
caaacaaacaaacaaacaaatgaaccaacaataagtttgacctctctcccattcattttgngaagaattttctcagcaagtggcctataagcaggtacggacataatgtacatctttagcc

SEQ ID NO: 10747 - DNA, 121 bp, Artificial Sequence
  Synthesized
  misc_feature (61): n=t or g
catcttaattttcacagatgtttggagaaagactgcaatttgcatgagtgcctgagtctgngggaactgttgaatactacagaagaataggctggtctaacaccaaactcagtatgtattc

SEQ ID NO: 10748 - DNA, 121 bp, Artificial Sequence
  Synthesized
  misc_feature (61): n=c or g
cctgctcattttttcccctcatcctacacggtcccatctttcagcacaagaattcacttgntctttcagaggaagaggccaggaacctgacctaggttaaaactaacaccacaaaggacag

SEQ ID NO: 10749 - DNA, 121 bp, Artificial Sequence
  Synthesized
  misc_feature (61): n=t or g
ttcaggaggaactgacagttaatattctcagaatcaaacagtagaatacccatggtagganatccgcatatccattggtcaaaaaaatttccttaaaaaaagaaaaaaagatgctgtcact

SEQ ID NO: 10750 - DNA, 121 bp, Artificial Sequence
  Synthesized
  misc_feature (61): n=a or g
ggaaaactagaaaaacaaaaggaggggacaggggcagggagcacagacatatctgatgtangatggtagaactccactgtcgtaagtcaaacactgatttttattttttatttttaaacgt

SEQ ID NO: 10751 - DNA, 121 bp, Artificial Sequence
  Synthesized
  misc_feature (61): n=a or g
tctccccaagagcataatgaaaaccttcacttcaacagggaagtcttcttgtaggaacaancaaaccagtttcagatactggaattatcaatggttctaggaaacaattctgtgcaagtat

SEQ ID NO: 10752 - DNA, 121 bp, Artificial Sequence
  Synthesized
  misc_feature (61): n=t or c
ctcagaagtggtaacttttggtgcttcctttttcaaaggtcctgagctcggtggctgaganggagggagctgtactggctgggctgtctgtttgccagtctttctggcaccagatgcaggg

SEQ ID NO: 10753 - DNA, 121 bp, Artificial Sequence
  Synthesized
  misc_feature (61): n=a or g
aacatgctgcctttcattttccaaaggtaagcagccataccatgcacagaaagctttttgnccaacaaagccattttccacgtaaacatcagacagtaacttgtgagtgcatgcaccttgt

SEQ ID NO: 10754 - DNA, 121 bp, Artificial Sequence
  Synthesized
  misc_feature (61): n=t or c
tcaaaacattttacctccataagatacttgcaggtgtatgtagtatcacaagtagtatccncctaaaaatatcatatcaataatatgtcttcatttcttaggatgcaggcagtggtagcaa

SEQ ID NO: 10755 - DNA, 121 bp, Artificial Sequence
  Synthesized
  misc_feature (61): n=a or g
cctctgatatggtgatcatctgattggtacagtctcattggagccttaatgcattctgggnacagacctaccccataggaagtcatgcatgcccccatcacattactctattcctgaaaaa

SEQ ID NO: 10756 - DNA, 121 bp, Artificial Sequence
  Synthesized
  misc_feature (61): n=t or c
atgggaaggcatctgtccagtaactgccaccactaacccaaatccaaacctctaggctctngtagcctccttggactctgtggaggaaaccttgattgctggtgataaattctctaactta

SEQ ID NO: 10757 - DNA, 121 bp, Artificial Sequence
  Synthesized
  misc_feature (61): n=c or g
aaagcaaaatttcacaagttaatggtctgcccttttctgacagcacaccaagctttcacantattaagtaacactttgcttcattcaaccactgaactgttgacaagagcacttcagcaag

SEQ ID NO: 10758 - DNA, 121 bp, Artificial Sequence
  Synthesized
  misc_feature (61): n=a or g
attttgatgtgatattcaggattagtgctgttctttgcaggaaatactttagagcaaagcntttcaacttccagtgaagcagacactcttataacaacgagcacttcagagaagtggaagt

SEQ ID NO: 10759 - DNA, 121 bp, Artificial Sequence
  Synthesized
  misc_feature (61): n=t or c
tggggatggaagttgcaggaaaatctcagtgtttagtattggcagatactgctcaacattnaactaacagaagaaagtataaaggatgtgtaggtaacactgaaaagtgattcatggctcc

SEQ ID NO: 10760 - DNA, 121 bp, Artificial Sequence
  Synthesized
  misc_feature (61): n=t or c
caaagtccattccctctttagacaatgatagtaattggatcactggcctacaacacccacngtggcctacaaggataaagccctcttggtcatgcagaggaatgctaaaaagaggatatgt

SEQ ID NO: 10761 - DNA, 121 bp, Artificial Sequence
  Synthesized
  misc_feature (61): n=t or c
ttctttaaaagcagttacttattcacagtgcatgatttccgagtcaaaagagtttggacanactcttacacagtggtgacagaaaaccttcttaaacttcatagtaccttgcatcttgaac

SEQ ID NO: 10762 - DNA, 121 bp, Artificial Sequence
  Synthesized
  misc_feature (61): n=a or g
ctccactgctctgtggagataaccaaaatagtctgtcgcccccatttttaagaaatactanacactgcatcagaggcagaatcttcacatcattccttcagcagagccagagacttcccat

SEQ ID NO: 10763 - DNA, 121 bp, Artificial Sequence
  Synthesized
  misc_feature (61): n=a or g
tatttcctagtaaagtatgcctacaatgggtggtataaactgttctctccattacctaaangagataactatatctagtccagatgtagatatctaattattagaaatccacatttactgg

SEQ ID NO: 10764 - DNA, 121 bp, Artificial Sequence
  Synthesized
  misc_feature (61): n=a or g
ttgtaaagtacagaacttgtgaaaaaaacttacagagcaaagagaagattgtcagtgtacntacatgggtggaacagatagatggatagcatctgcaggcaaaaaatattttccacctata

SEQ ID NO: 10765 - DNA, 121 bp, Artificial Sequence
  Synthesized
  misc_feature (61): n=a or g
cagttcatgcctgacccaattcaagctcacaattgtttgtgaggaagaatacatacagaanaaagaagataatatacagcatattaccatcaaatgctgttccctatggaatgcaatagca

SEQ ID NO: 10766 - DNA, 121 bp, Artificial Sequence
  Synthesized
  misc_feature (61): n=a or g
caaagtgatagagctggaaaaaatgcgacctgaattgggcactagtaatagagccatagcngtaatataagacatgccatttggtttattttaaataagtaccctgagctaatgagttgca

SEQ ID NO: 10767 - DNA, 121 bp, Artificial Sequence
  Synthesized
  misc_feature (61): n=a or g
gggaactgcatgttccgaatgacacgctcgtgggttctgacagttaattcagcacaggccntgctgaatgctttttaatctctcggtacagtttctaactaactcaatgctctctgctttc

SEQ ID NO: 10768 - DNA, 121 bp, Artificial Sequence
  Synthesized
  misc_feature (61): n=a or c
aggaggatcccaggcagatggaagcatcatcgctaggatgcttataggtgtttgcaacccntagttctcactaaaaaaccttgctctgtgatatttctttgagggattatgctggacctgc

SEQ ID NO: 10769 - DNA, 121 bp, Artificial Sequence
  Synthesized
  misc_feature (61): n=a or g
ctagccaagaaatgtacgtttaacagtaaataaatgctttacagtacacaaatgactatangttgaagcttgctcaagtttttctttggtagcaatacagaggtcctccagggactgctct

SEQ ID NO: 10770 - DNA, 121 bp, Artificial Sequence
  Synthesized
  misc_feature (61): n=a or t
ccacgactttcatctttaacacacatccttcattcattcaaaagatgtcattcttccatcngtttcaaacacaagacatttagcgtcctcccaggagcagcacatcctgccatttgtaagt

SEQ ID NO: 10771 - DNA, 121 bp, Artificial Sequence
  Synthesized
  misc_feature (61): n=a or g
gattgcaggtggatttcccatgcacagcatagactggattttaaatgtatgcaaataagcntttgtgtgcctgacaccatgacacagaaacatcaggatttactcactgacagtttttttc

SEQ ID NO: 10772 - DNA, 121 bp, Artificial Sequence
  Synthesized
  misc_feature (61): n=t or g
gagtcagcacactgagcaggagctgtgggatcaggtctacatgctgaacagttttttcctncagacttacaaacaccttccccagtagacatgtttcagcccatttccacgctaagctttc

SEQ ID NO: 10773 - DNA, 121 bp, Artificial Sequence
  Synthesized
  misc_feature (61): n=a or g
attaaaaaaacacaactcatgctcagttttaaacagagcaacgttactatgcacaacactngatggttcagtggttgaaggggacaaagaggacataccttgcaatcagttaaattctcac

SEQ ID NO: 10774 - DNA, 121 bp, Artificial Sequence
  Synthesized
  misc_feature (61): n=t or c
cagcaacactgttccttgggcacagagcaatgggaaggcagaccgagtttcccaagggaangtaccttcatgtttgcaacaggtaatgaggtcctgcagggaaaagggagtagccgcgtgc

SEQ ID NO: 10775 - DNA, 121 bp, Artificial Sequence
  Synthesized
  misc_feature (61): n=a or g
atgtcagatagcactgaacaagtgtgagtaactagatcaaaacccagtcctcagttgaccnggatacaggagcccagacagcacacgtttagacacctgtacttaggtggtttagtcttga

SEQ ID NO: 10776 - DNA, 121 bp, Artificial Sequence
  Synthesized
  misc_feature (61): n=a or g
taggaagtggagaagctgcatatttaatgcttctagaaactaagtaatgaaacaggagctnatatacaatgggttcttcacgaaatctagtacttaatggccagataaagataaatataca

SEQ ID NO: 10777 - DNA, 121 bp, Artificial Sequence
  Synthesized
  misc_feature (61): n=a or g
gattgttgagatcaaagtgaatatgattcttacagactgtttattttagatatattcatangtatgtttagagtaaaccttgggctatgtttaaagggaatagacatttttaaatcttcag

SEQ ID NO: 10778 - DNA, 121 bp, Artificial Sequence
  Synthesized
  misc_feature (61): n=t or g
gcacagagcgatcagcccagcccagaactggaaactgagctccagcccagggaagttttgnatttccccgtgctgcttaagtgatccctctaaaaactgcaggctccacattgctttgcta

SEQ ID NO: 10779 - DNA, 121 bp, Artificial Sequence
  Synthesized
  misc_feature (61): n=c or g
atttctccaatgaaagcaggggaactctctgaagatgtctctatatatttactgttccatnctggctttacctacaaggaaggggctgcgaaaaggcagactgggctgttgattactcaca

SEQ ID NO: 10780 - DNA, 121 bp, Artificial Sequence
  Synthesized
  misc_feature (61): n=t or c
acttctagtaagtcagaaatgagagtaggaatcttagagaaacatctcaaaagatgggccngtggttgccctgctcttcagccacatcgatgaagggacctccctcaactgctgaatggca

SEQ ID NO: 10781 - DNA, 121 bp, Artificial Sequence
  Synthesized
  misc_feature (61): n=t or c
aatggctcttttcttctagtatgaaaaccaaaggatgtgaaattaaactaaggggtactantttcaaaacaaaccagaagaggtacttcattgattacacagtgcatagttgggttgtagc

SEQ ID NO: 10782 - DNA, 121 bp, Artificial Sequence
  Synthesized
  misc_feature (61): n=a or c
tcattctgaagcagcttctcattagacaccgaaaggctggcaagaccaagggcaaaatctnagtgaaatgttttaactgtatttaaacaaaaactacttacaatgatattttaaaatactt

SEQ ID NO: 10783 - DNA, 121 bp, Artificial Sequence
  Synthesized
  misc_feature (61): n=t or c
gctgactcgatacatagaaccatgtcaactaacagaagattttggaggaactctcacctangatcacatggattggttgaataagaggctggttagttttctgtttgtttcaaatgtctca

SEQ ID NO: 10784 - DNA, 121 bp, Artificial Sequence
  Synthesized
  misc_feature (61): n=a or g
gttgtctcggtttctcggccccagactttctgttttgcagcccagtttgggaaaggaaatnctttaaaatctcaacacttctcgcaggacaggaaagccacggcttcctccgcagccccac

SEQ ID NO: 10785 - DNA, 121 bp, Artificial Sequence
  Synthesized
  misc_feature (61): n=a or t
tgtaactaagataaaggttttgttttgtttttgcatttgaatttgctaaattgaaacactntgattgctttgtccagctcaactgaaattcaagaaattaccgaatatgtgaaatcaagaa

SEQ ID NO: 10786 - DNA, 121 bp, Artificial Sequence
  Synthesized
  misc_feature (61): n=a or g
atttcccatttcatcatctgtgttctcacattttcaattctgagctgcttttttaataggntagtcatatattttcacagtattgatgtatgcaggttgtaatggagagtttttcatgctg

SEQ ID NO: 10787 - DNA, 121 bp, Artificial Sequence
  Synthesized
  misc_feature (61): n=t or c
agtaaatgacatcagatgagctcctccagcagttatctcgatcacggagaccttttggaancagtgagagttaactccccactatactgccttctgctggaaaacacacaaacaccactgc

SEQ ID NO: 10788 - DNA, 121 bp, Artificial Sequence
  Synthesized
  misc_feature (61): n=a or g
tctgttccccttgctagtgtagctcaagtttgtgtagtgacctagagctaagcaattaccntgcataggcttgctagagtaaagtactggtgagtgtgccatgactatgaaatcggttagg

SEQ ID NO: 10789 - DNA, 121 bp, Artificial Sequence
  Synthesized
  misc_feature (61): n=a or g
aggtctagtattgttaagagctaattttcccttacttctccttaagttgtttccaagcacngtttgttacatttaattctcttaaaagcactcagcctgtttatttctgtgtttgtttttt

SEQ ID NO: 10790 - DNA, 121 bp, Artificial Sequence
  Synthesized
  misc_feature (61): n=a or g
tgtggtatttttttgttttgttttgttttgggtttttttttgcacagtgtcattaacactntgtgtgcaagaatttccctctaatctcatttttgtgacaaattccttctgcagtttctgg

SEQ ID NO: 10791 - DNA, 121 bp, Artificial Sequence
  Synthesized
  misc_feature (61): n=a or g
gaaagcacaggtttagaatgataaagctcatgaataactgaaaacaggatcatgggactanctgttctgctgctgaaaggacattgaattctatgaagcccttagaatttaggaaaaaagc

SEQ ID NO: 10792 - DNA, 121 bp, Artificial Sequence
  Synthesized
  misc_feature (61): n=t or c
attcagaccaagatcaagacattggtaagagaatcatattacagattattttatcatatgntcaggttggaacaagaggcttacatttgtctttgtaatagctagcttatgtttccgtttg

SEQ ID NO: 10793 - DNA, 121 bp, Artificial Sequence
  Synthesized
  misc_feature (61): n=a or g
ggcacaggatttgttcctagcactttagagaaggttaatacatgatattaagcagcatttntgaacatggatgaatgtgtttctgggttcagacaactggaaggagttggctgggtgacgt

SEQ ID NO: 10794 - DNA, 121 bp, Artificial Sequence
  Synthesized
  misc_feature (61): n=a or g
ggcagctcgcatacagcaaaggagcatcttccaggaaggcatcgatctcatcttaatgcanaggcttccagggctggcaaacctgtgggagtctgtggcaactcactgggctgcctgctgc

SEQ ID NO: 10795 - DNA, 121 bp, Artificial Sequence
  Synthesized
  misc_feature (61): n=a or t
tctctggtatggaatggttttgaaaatcaatttggcatgcatttgaattaagacaaaattnactcagttcaaaattgctatgagtgttttccttccttggatggatgcatttacactggaa

SEQ ID NO: 10796 - DNA, 121 bp, Artificial Sequence
  Synthesized
  misc_feature (61): n=a or g
ttgatccctaggaatcatatcaaaatgcaaagtagtatccccaagaaactttaaaaggacncacaacactggaatatataaagtttggagaatcctaagatgactgagaaacaacttatgt

SEQ ID NO: 10797 - DNA, 121 bp, Artificial Sequence
  Synthesized
  misc_feature (61): n=t or c
gctggcttctttttctccttgccagcatcaggatgggagccggatagggagcctttccctnccgtggatgtctcttgcctggatttggtttgcttggtgctgtgtttgggctgatggcgac

SEQ ID NO: 10798 - DNA, 121 bp, Artificial Sequence
  Synthesized
  misc_feature (61): n=t or c
aaggcagtgttcatttcagtataagctatctatgacttcatacacagagtattattatctnatttcctctgagctttatgccatcattctctttttgtgtcttttttctttttttttctgc

SEQ ID NO: 10799 - DNA, 121 bp, Artificial Sequence
  Synthesized
  misc_feature (61): n=t or g
aacattaaaaagtggtctgagaaagagcaataatccaattggttccagtacctgtatgcanctcattcaggacccacactgggactttcctattccactgagaaaggtcctgatagacatg

SEQ ID NO: 10800 - DNA, 121 bp, Artificial Sequence
  Synthesized
  misc_feature (61): n=a or c
aaacaactggcagtgccaaactagcacagtgagtacagctcatctgcggcgggttaagagnacttgttttcagaatgaagcataacagcaagcccagaatgaatgttgaaatgatatcctt

SEQ ID NO: 10801 - DNA, 121 bp, Artificial Sequence
  Synthesized
  misc_feature (61): n=t or g
atattggtgtgagagtgaggaaaagttacctgaagcaaaccattagtacggaaaatttcangctgagaatgatcttaaccaagaactacttgatagctttgataacagctgatatcactag

SEQ ID NO: 10802 - DNA, 121 bp, Artificial Sequence
  Synthesized
  misc_feature (61): n=t or g
gcacaggtgtcacctcctggtttgtctgtacaaaggaatttacatggtcaaaattacctgntactgcttgagaagactgataaagtatctcaaataaccactgtttccactgctacagtca

SEQ ID NO: 10803 - DNA, 121 bp, Artificial Sequence
  Synthesized
  misc_feature (61): n=a or c
gaggaaatcttttttaactatctaggttttacagttgtttctgtgtgtctgcaaataggancatctatataaacattagtacagtacaggaggagaagcattgtcactgtctgaagttccc

SEQ ID NO: 10804 - DNA, 121 bp, Artificial Sequence
  Synthesized
  misc_feature (61): n=a or t
gtcttaattaattgaacaatcactgtttgcagttccttcagtcattccaaaagtaactgangcaacactgaccaacaggagactgtagggtctgaacagaacacaatggtctcaacaagta

SEQ ID NO: 10805 - DNA, 121 bp, Artificial Sequence
  Synthesized
  misc_feature (61): n=a or g
ctgaatttattccaacttacttaactttaaacacgacactaacaattattttacaagatcntcttgaattcttcttgataccctgaccagtggtgggatccatccttttttttttgtgtgt

SEQ ID NO: 10806 - DNA, 121 bp, Artificial Sequence
  Synthesized
  misc_feature (61): n=t or g
tgctatggagcaacatatggtgccgtgaagtagctatggagatgctgtaggatgttctcgngttgccatatggtgccaagaagcaccctgggctgtggggatgccatacgggatgatgaga

SEQ ID NO: 10807 - DNA, 121 bp, Artificial Sequence
  Synthesized
  misc_feature (61): n=a or g
cttaaagaaaatatctttatagaaccctgctgtcttaatcttcctgagcagttcaactgcntgtcctgtgcaacaaattcttcatactccatgggcagggatattcctgggcttactgaag

SEQ ID NO: 10808 - DNA, 121 bp, Artificial Sequence
  Synthesized
  misc_feature (61): n=a or g
gcagcactgcccgtatgctgcaggtttagcgttggcagaaccccgtccgtttcaaaacaanaggaaggaagatggcagttctcggaacatggaaaagttcaggctcaggttctgtttttca

SEQ ID NO: 10809 - DNA, 121 bp, Artificial Sequence
  Synthesized
  misc_feature (61): n=a or g
ttaaatgatttgctcatgtgaaaaactgccaatgcaacagtctgctaatccttgtaatatnactaatgtacacagaaatggtatcttctctattctttatgtaagaaagagtaactgtgtt

SEQ ID NO: 10810 - DNA, 121 bp, Artificial Sequence
  Synthesized
  misc_feature (61): n=a or g
atgtgaaggatgccagggctgggggctgggaaaggacacctggccactggtggggtgtgangggttccctccctgatggttcccctccctgatagaagcagagcatcacaagtgtttcctg

SEQ ID NO: 10811 - DNA, 121 bp, Artificial Sequence
  Synthesized
  misc_feature (61): n=t or c
tctccctcttcacttaccagaaatacctgagatttcacgtgcatgggtgttggatgacagngtgtttgtgttgctgatgagaaacattgctatttgtggtgtttagtggcagtacggttgg

SEQ ID NO: 10812 - DNA, 121 bp, Artificial Sequence
  Synthesized
  misc_feature (61): n=t or g
ctgcactggatttaccagcaaatccctctgtagcatccatcgggtgaaaccctctgtgctnctggaagacagtggaatctctatctcccgagctaacaccttcagtactattacagtatct

SEQ ID NO: 10813 - DNA, 121 bp, Artificial Sequence
  Synthesized
  misc_feature (61): n=a or t
ttgttctgcacagtcttgcagtaaaaaatgtttcaagaataaaagtcctgaggagaaaggncttactctgaaatcccttacgacgtgcaaaatccttttaacagcttgctaatggctgcag

SEQ ID NO: 10814 - DNA, 121 bp, Artificial Sequence
  Synthesized
  misc_feature (61): n=a or g
gaaaattgcatgaattaattgtaaaaagaatacagcactttccattcaattttgtcttacngactcctcttgcagaccaaattactacaggcacaggacttcttgggcgctgctgtggaac

SEQ ID NO: 10815 - DNA, 121 bp, Artificial Sequence
  Synthesized
  misc_feature (61): n=t or c
tcattaaaacgtacaatgtaactcacctacaatgtgtttctggaataagcatcttactggntcttgcacagttaaaatgactacaaccaaatacttgcattttctccacaaaaattcttgg

SEQ ID NO: 10816 - DNA, 121 bp, Artificial Sequence
  Synthesized
  misc_feature (61): n=a or g
ccagcccctgctccaacattaccactgcttgcagagaaagctgagctcaccaggagctgtnaagcttcccaagactggcatggaaacaatcttccatcccaagggagtctgcagtggctga

SEQ ID NO: 10817 - DNA, 121 bp, Artificial Sequence
  Synthesized
  misc_feature (61): n=a or g
cacaactgagaataactgggtcttattttttaggcaccgaagagaaatagtagaatagacngtcattctgtagcagaagttctagactgttattggctcccaagctgaatatatttagaga

SEQ ID NO: 10818 - DNA, 121 bp, Artificial Sequence
  Synthesized
  misc_feature (61): n=a or g
aggatgactgaattaagacaacaggcacttgggctactttcgcttattaatgaaagctctntttttcactgccgtacttgtcagtctgcactgtaacccccttcgctatgacgggaggaat

SEQ ID NO: 10819 - DNA, 121 bp, Artificial Sequence
  Synthesized
  misc_feature (61): n=a or g
tggcattttggaatgcttacttccactccacgtttccacatttgtatggcacagatgtccngtttccccatgtcccgtgaaggctttttgcctgtccatactggtggcagctcagtctggg

SEQ ID NO: 10820 - DNA, 121 bp, Artificial Sequence
  Synthesized
  misc_feature (61): n=a or g
ggtgttgagtgtgattgtggttaagcaccagcgggcttgaggttgactttgaggttaaccnaggtatcagcttggacaaagcctagatatcactggtcacaaatacagggtgagattttag

SEQ ID NO: 10821 - DNA, 121 bp, Artificial Sequence
  Synthesized
  misc_feature (61): n=a or g
atgtcagagtgcacctccactgcagctggggtgggcagctcagagcttctatagccttcantaggcaatgctaactgatgtaaagctgcctgggcacgcacaatgatgtgaacagttcatt

SEQ ID NO: 10822 - DNA, 121 bp, Artificial Sequence
  Synthesized
  misc_feature (61): n=a or g
gacctttattattacatccacggaactacaatcatggccagggaatttttctcaagtgccntagtttaagtctgatgaaattatccgggaggaccatttcagtcagtaatcgtaacataat

SEQ ID NO: 10823 - DNA, 121 bp, Artificial Sequence
  Synthesized
  misc_feature (61): n=a or g
tgctcagaaagagaatagatttgggtacagggaggggtaaaggacaaaatcgaaggtgagngaacgtgtcctttcagatttagaacattcgcctttgtaatatgagaaaattagctcaccg

SEQ ID NO: 10824 - DNA, 121 bp, Artificial Sequence
  Synthesized
  misc_feature (61): n=a or g
ccgcactcccttgcctgccgatgtgtcagggtaacctcggggtgttcagcagcagtttcantgtagaggtctcctgggaagtggataaacctcatggaggagtgcagctggggaggagcgt

SEQ ID NO: 10825 - DNA, 121 bp, Artificial Sequence
  Synthesized
  misc_feature (61): n=t or c
caaatgcagaattaataagaaaaactgacaacacatattagttgtgcaggtgatcaaacangcttggaagtcaatgataaacagacatacttctttcaaaacgtaaagctagcctagatag

SEQ ID NO: 10826 - DNA, 121 bp, Artificial Sequence
  Synthesized
  misc_feature (61): n=t or c
agctgaaagcctctatttcatagtgctaaaaacgaaacctgagcatgttctgattatggcntacaaatggccagcatcagctagctagctcggttctcactgcctgtctcaatgtttctta

SEQ ID NO: 10827 - DNA, 121 bp, Artificial Sequence
  Synthesized
  misc_feature (61): n=a or c
cccttagtctttacagcagtatgctgtaggaacaatatgatagaaataaagcactcatggngctttttatggaagggagggcaaaggatcaggacaaaacacatttgctattaattgcatt

SEQ ID NO: 10828 - DNA, 121 bp, Artificial Sequence
  Synthesized
  misc_feature (61): n=a or g
aatacaaggggcagctctccagtttggggggaggggggtggagaaattcttggctcctgcntcctacaggaacctgggaatgaagctgaaggcaggaggaacaggtgggaaacccctacaa

SEQ ID NO: 10829 - DNA, 121 bp, Artificial Sequence
  Synthesized
  misc_feature (61): n=t or c
gccatcgtccgtccttaggcacgttcagcaagtcctcttcttgcagattctctgggactcngccaaaagagtcaagtgacacctgcttgcgggactgcttcgctatctgggcaccaggcat

SEQ ID NO: 10830 - DNA, 121 bp, Artificial Sequence
  Synthesized
  misc_feature (61): n=t or c
ggccttttaaagctcctttgcattatttacacaaacgaggttccagcaagcgagcacattntgttatagtttaacagtattgcataactcaggaaacaaaatatgctctcgtttaagttta

SEQ ID NO: 10831 - DNA, 121 bp, Artificial Sequence
  Synthesized
  misc_feature (61): n=t or c
cattacttgctctctttcatgaaagcagataagaaagatgaaacgaagatgctatttactntaatattacttccttaaattgatgaataaagtctaaatttagaagtccaaatgtggttgc

SEQ ID NO: 10832 - DNA, 121 bp, Artificial Sequence
  Synthesized
  misc_feature (61): n=t or c
aaaaatcaattttcttttaaaaccttcctaatttgtctgaacgcgtttcggttttactctngtctgtaatcctccttcagaggtttttaatcccactaaaaaaaagtctctacttaaaaag

SEQ ID NO: 10833 - DNA, 121 bp, Artificial Sequence
  Synthesized
  misc_feature (61): n=a or g
gaagaccaaatatgatgcctgctttagctctgcgtgcagtcaagcatgtgctctactgcancagtccatgcagtcttattagagccttgactgaactttatttgttaaggactggatttca

SEQ ID NO: 10834 - DNA, 121 bp, Artificial Sequence
  Synthesized
  misc_feature (61): n=t or c
ggaccaggctggcatgtttggggttctgtcagcgcccatctccctctagttgtggcctttngagttttccgtaccaaacacgagtcccacgtgccacctacagatgccacaaggttcatcc

SEQ ID NO: 10835 - DNA, 121 bp, Artificial Sequence
  Synthesized
  misc_feature (61): n=t or c
ccctccgggtgagcactaagcagacagtgaatggtaagcatgttgaatttagaaagaaaanagcagagagcctaattagacccaattgattagccaccgaaaaagcaaatctccgagttca

SEQ ID NO: 10836 - DNA, 121 bp, Artificial Sequence
  Synthesized
  misc_feature (61): n=a or g
tatgcagcagagtgctgagcagcctaagacctagggtagttcaagtctcttgcacatctgngtttgcttaaccagcagctgtagacagctttagacaaattcttatgcaggtaggagaccc

SEQ ID NO: 10837 - DNA, 121 bp, Artificial Sequence
  Synthesized
  misc_feature (61): n=a or g
aaattaaagaaatatgcaactggttgctcaagcagaatttgtgtgtgtgctctgctgggangaaagcaatatcaaccagatgatctgtatttgcttattttcatattttcttaaattttct

SEQ ID NO: 10838 - DNA, 121 bp, Artificial Sequence
  Synthesized
  misc_feature (61): n=c or g
aatctattcatccatagctgttgcataaatgtctactgtctatcatctccaatttaaaagnatccttctattctcatagataaacttaagtcaccaaatcatatctgtgatgccaatactc

SEQ ID NO: 10839 - DNA, 121 bp, Artificial Sequence
  Synthesized
  misc_feature (61): n=c or g
tcagcactggtgaaaaacatctggggtgctgtgtccagatttgggctccccaaaacaaganggtctttgatatactgaagggagttccctcaaaggtcacgattaagggattgaggcagct

SEQ ID NO: 10840 - DNA, 121 bp, Artificial Sequence
  Synthesized
  misc_feature (61): n=t or g
accagatgctaatttcattctgtgctactgaacagaacccgatttgcttgttatgatatcnactgtttggtttcatttcacactccactaagtcaacataatgcagaaaaggtagtcaggc

SEQ ID NO: 10841 - DNA, 121 bp, Artificial Sequence
  Synthesized
  misc_feature (61): n=a or c
gcaggcactgataaatccaggcgtccgatctcagcaggttggattatctattgagctgccntggcctttccctgctgcagaacaggtcttctactggtgcagaaagagctggagctgcgct

SEQ ID NO: 10842 - DNA, 121 bp, Artificial Sequence
  Synthesized
  misc_feature (61): n=a or c
ccataaaattgaaggcaaatttatcaaccagagttgtctattgctgctgtagcatattaantaattcaagcaacaagaaaatgatttgaaaattcgagtaagtgaacatattcctttatgg

SEQ ID NO: 10843 - DNA, 121 bp, Artificial Sequence
  Synthesized
  misc_feature (61): n=a or g
gagaataccattatgaaaatcttaatcacaggaaggttttctaccaagcctcctctcttanacgtaagataactgcccattagaaatgagcttcagaagtgttgttactgacacatctgct

SEQ ID NO: 10844 - DNA, 121 bp, Artificial Sequence
  Synthesized
  misc_feature (61): n=a or g
aggggaacaacaaagccatgacaatttattgtctcctctacaaggttaacaagttgcagcnctgatcagctgaatccctactgtgtgcatggaagaaaggagggaagaagaatgttagttc

SEQ ID NO: 10845 - DNA, 121 bp, Artificial Sequence
  Synthesized
  misc_feature (61): n=a or g
cactgcatttaccaagagtagatctatgagtttcaatagtccacagtaaagaagaaagatntgatatccaaatatagcccacaggtatttcttaatgctgcacagcctagagctgggagca

SEQ ID NO: 10846 - DNA, 121 bp, Artificial Sequence
  Synthesized
  misc_feature (61): n=a or g
tctaatgcctatgtagaagacctgagtagtggagaaagcattactcccaagactgctgctntgttctgagtgctcctgaagactcgttaaaaacaaagccaggccttttggagcctgcctc

SEQ ID NO: 10847 - DNA, 121 bp, Artificial Sequence
  Synthesized
  misc_feature (61): n=a or g
tccaggtttaccttcctggaagtggcacctgtagtttgatagctcatcaactcagtgaccngaaggtcattttttcttgtcactatctctacacttgctttgtctgctctgtgtcttggta

SEQ ID NO: 10848 - DNA, 121 bp, Artificial Sequence
  Synthesized
  misc_feature (61): n=a or g
aatcaagtgtgatcttagaaagaacaattggtaagcacctcctataacaaaggatgtacangaagtgtatttacttctttcgccatcgtgaataatcagttatgtctttgtcagcatcaat

SEQ ID NO: 10849 - DNA, 121 bp, Artificial Sequence
  Synthesized
  misc_feature (61): n=a or g
gtttccagttgctctctatcccagttctctactcagctctgctgttttgaagtgagaagcntgagcttgttctctccagcaggagctgtctgtcccttctggtatcaggagcaaattgtct

SEQ ID NO: 10850 - DNA, 121 bp, Artificial Sequence
  Synthesized
  misc_feature (61): n=t or c
tacagcatgagtgggtgtaaatcatcacaaattctggtttagtgcacagtcttggaaaatntacagctttgtaaaaggaacctgtgagttgttgacagccaactctttctggcacttgatg

SEQ ID NO: 10851 - DNA, 121 bp, Artificial Sequence
  Synthesized
  misc_feature (61): n=t or g
aagcatgtggattgctggataactcccacgtgattttatctctaggtgtacttcttccaanactgaacaaggcttttcacacagatgccaaatccaggagtttcaatatattcacatgcaa

SEQ ID NO: 10852 - DNA, 121 bp, Artificial Sequence
  Synthesized
  misc_feature (61): n=t or c
ctatgaatattgtcctgggaggaacaatagtattcccaagtgcaccttctacaaaggtcanatgcctggaacatacatttttagaactacttaaaattcaccaacaatcagtgtaaaacct

SEQ ID NO: 10853 - DNA, 121 bp, Artificial Sequence
  Synthesized
  misc_feature (61): n=t or g
cttgtgtgtcaggttttgtccatatcctgatgtctttgcttacatagaggttggtttgggntgtctctacatgtatctagtcaaaacagcaagaaatgttacactgtgtgcagcatcctgt

SEQ ID NO: 10854 - DNA, 121 bp, Artificial Sequence
  Synthesized
  misc_feature (61): n=a or g
cggtgcatagggaaatgtattgcagggtttccagcaccactgtgtgcatacaccaaaaacnctattttccttcttgccggtcaagtcttggttgcagcaaagcaggctttgatcacctttg

SEQ ID NO: 10855 - DNA, 121 bp, Artificial Sequence
  Synthesized
  misc_feature (61): n=t or c
acagagtagcctcttgttacataaaacaaaaagctttgtgaatataacaggaaaagacaanggaaagactaaagacctcgagttctttttttctgtcatttctccagaaatccaaaattca

SEQ ID NO: 10856 - DNA, 121 bp, Artificial Sequence
  Synthesized
  misc_feature (61): n=a or g
acagatctgaggctgctgccagtttcccccgatgctggatcagctctgtggggcgatcacngaatccataaagagctcggggatatctctgttagaggtaagagcaatcatttcaacagct

SEQ ID NO: 10857 - DNA, 121 bp, Artificial Sequence
  Synthesized
  misc_feature (61): n=a or g
atgggaaaggcagttctgcagccccatacacagtctggctggcagagaggcttcagcctgncagtggcctcccaggtagacactgcaggtacgtttagggtttaaagaagaacccaaaaat

SEQ ID NO: 10858 - DNA, 121 bp, Artificial Sequence
  Synthesized
  misc_feature (61): n=t or c
ggaggcaaggtggaatttagggatttgaatcttcagtcagttttctttttgtgccgtagangcagctttttgccttttgtatgattgtttaaagccctttgttccaagtcctggcttgatt

SEQ ID NO: 10859 - DNA, 121 bp, Artificial Sequence
  Synthesized
  misc_feature (61): n=a or g
agaagtacaataacagcttctgcagcagaacagttgataatagccctaggaaacatagccnggatcaatttgcatagaatttaggaagaaaatacgtattttattgaggaatataattata

SEQ ID NO: 10860 - DNA, 121 bp, Artificial Sequence
  Synthesized
  misc_feature (61): n=a or t
agaagttcaatttaaatgtctaaatgtagtcattttatgtgcctgagaaattctgggacanccgtacaggatttacaatactcaatagagtcccttgtaggatactcaaaggtttctagag

SEQ ID NO: 10861 - DNA, 121 bp, Artificial Sequence
  Synthesized
  misc_feature (61): n=a or g
agacagggctccacctggtgaggagcttctcaaatcaaaccacttgcaggcacatttgagngaaaagcaaaggctcacaaaacaggcacgttgatgtctaataaattattcaggagtagaa

SEQ ID NO: 10862 - DNA, 121 bp, Artificial Sequence
  Synthesized
  misc_feature (61): n=a or g
tgcagtttcagtgtgtgttcatatatctttattaatccagagattcctaatcagtattacnaaattgttcccaaagaaaaggtagttaagaaaaattgtctgagattcacaaccacattta

SEQ ID NO: 10863 - DNA, 121 bp, Artificial Sequence
  Synthesized
  misc_feature (61): n=a or g
gtaatgcacacagatgttagagaaactgtttgtgctcagtaaagcaagaggcccaagtttngctgtattgaaatggagctcgctgtgaaactacttgagggtgtaatggacacagccatga

SEQ ID NO: 10864 - DNA, 121 bp, Artificial Sequence
  Synthesized
  misc_feature (61): n=a or g
cgaccttctggctgatggcattgcctggcccctcactgacctctttgctgtggcatacccnctgctgggaaaaacaaagccaccttctgaaacaggactgcttaaggaccatgtgtgggaa

SEQ ID NO: 10865 - DNA, 121 bp, Artificial Sequence
  Synthesized
  misc_feature (61): n=a or g
ttgcagaatgtatacagtaaagagactgaagtttgaacaaatttcgagcaaatttgctaanctaatagcttttatggaagagctccaaaactcccctgctaaagaaagaaatcgacttggg

SEQ ID NO: 10866 - DNA, 121 bp, Artificial Sequence
  Synthesized
  misc_feature (61): n=a or c
ggaaccctgcaacctaggactccttctacgagtgctccaagagcaatgggagaggcatccncttgctgctggctcttggagtgagctcagggactctgcaagtgctgcttctgcctccctg

SEQ ID NO: 10867 - DNA, 121 bp, Artificial Sequence
  Synthesized
  misc_feature (61): n=t or g
tagtatataatttcagtagatctgtgaacactaagaaaatgttgctgtggtattattagantgaagctgtaaatctgtgatggcttttttattatttatatttatttcaacttaaacctac

SEQ ID NO: 10868 - DNA, 121 bp, Artificial Sequence
  Synthesized
  misc_feature (61): n=a or g
tgcttagagagtgaagttttttttttaaaaaaaaccctccttccttttaacacgtttgcancctcctgaaatgcagttttgctgtggtaatgcagtatagctttagttgtgcgggctccct

SEQ ID NO: 10869 - DNA, 121 bp, Artificial Sequence
  Synthesized
  misc_feature (61): n=a or g
aatactattacataattgacatccttacctctttggaaatgctcacatccttttggcatgnctaaaagtggttaagaattatctggtcaatagtgtagtcagtcagtagtttccccagtta

SEQ ID NO: 10870 - DNA, 121 bp, Artificial Sequence
  Synthesized
  misc_feature (61): n=t or c
ggtatggacctattcacttctgttcactgttctctgaaacaaaaaccctccttccttctcnttttccattctgcgcagccattctatgctcaacaattctttctcactacctaatatagtc

SEQ ID NO: 10871 - DNA, 121 bp, Artificial Sequence
  Synthesized
  misc_feature (61): n=t or c
gtatcaaagaaccttttcaagagtgcttaggagagatccgaaaggtaagtagcgagataangttgaaacttgcacagagaacgtggattctcccgatccgggcagaaccccggaccggact

SEQ ID NO: 10872 - DNA, 121 bp, Artificial Sequence
  Synthesized
  misc_feature (61): n=a or g
ggcaaaccagtagaagtaaattgaagatacagctaaatctgtctgagatttaaaatgtatnacctccatattttctaagctctcatctcattgatatttgaattactgagagataggtttt

SEQ ID NO: 10873 - DNA, 121 bp, Artificial Sequence
  Synthesized
  misc_feature (61): n=t or c
cactcattgaaagtgaaactgtgggcctctttcaattccaaataaagacatacacattctnccttgaatttaactgcttttggaaatcgtttgagcacagctgggctccaatttttaatat

SEQ ID NO: 10874 - DNA, 121 bp, Artificial Sequence
  Synthesized
  misc_feature (61): n=t or c
cagttggctttggtactgactttggggttagcgttgggcatgctgctcaatttcttttctncttctcagtttctacaacgactgaagatattaatgttaaggctcaaagttacctgaatgc

SEQ ID NO: 10875 - DNA, 121 bp, Artificial Sequence
  Synthesized
  misc_feature (61): n=a or c
tagcatggaagaattttaaaatgcacctttcaaggtaaagcttaagtggcaacttctgaanttttatgttactgaacttagataaacttttaacaatcaattctctttatttacaaaggga

SEQ ID NO: 10876 - DNA, 121 bp, Artificial Sequence
  Synthesized
  misc_feature (61): n=t or c
acctgtaaaaaagatgttaaattatctgatatctgccactagagtgaaaatctctttccangttgactttcagtaagaaaaacatctctgtttctaaaaccaaggaagaatgcatcaacgt

SEQ ID NO: 10877 - DNA, 121 bp, Artificial Sequence
  Synthesized
  misc_feature (61): n=a or c
ttgttaataattagaaactcagtcttcatttatgaattgatgatgaacgaacaagaaaggngtactttcattggtgatggttttgaaaatagtaacacagatttgtaatagggagggggaa

SEQ ID NO: 10878 - DNA, 121 bp, Artificial Sequence
  Synthesized
  misc_feature (61): n=a or g
ttaaaaaaaaaaaacctttaacattacttttatatataatattcataccaaaattaagttnttttctttgcacacgaggccacgtaggtcacacagtgatatgcagaagccactgtggcaa

SEQ ID NO: 10879 - DNA, 121 bp, Artificial Sequence
  Synthesized
  misc_feature (61): n=t or g
cccagtggtaacacactacttcagactccgctagctaaataagcatcagaggccttgcatntaaataacagcaggaaggaacccaaagttaggactggccaatattagcagagcacctcca

SEQ ID NO: 10880 - DNA, 121 bp, Artificial Sequence
  Synthesized
  misc_feature (61): n=a or g
actctcagtattatggaacgggatgcaatcaaccctcgctgcatcttacccaccttagctncttaagcaatacagtatgcaaggcaactaatcactggtgccagttcttgtgggttttttc

SEQ ID NO: 10881 - DNA, 121 bp, Artificial Sequence
  Synthesized
  misc_feature (61): n=t or c
ttcatttgtgtaatactgggtgattctctcctgttggatgttgtgagctgttctagatctnactgattttatttgcatggggaatatatgaatggcaaactgtcccagacaaaggttttag

SEQ ID NO: 10882 - DNA, 121 bp, Artificial Sequence
  Synthesized
  misc_feature (61): n=a or g
cctccagaagtactttttcaactcagcaattctgtaaatagtctatgctgccctgaccagncatttcaaatcgtacatacatttatattttataaacaaacttctgtaagcgtgctgttta

SEQ ID NO: 10883 - DNA, 121 bp, Artificial Sequence
  Synthesized
  misc_feature (61): n=a or g
taaatgtggtatagtgtcaggggatagagatacggcaaatcctgacctctttgagatgggnttgtatttcctcagttaattataacccacatgttcactgtctctgatctccacagactta

SEQ ID NO: 10884 - DNA, 121 bp, Artificial Sequence
  Synthesized
  misc_feature (61): n=c or g
agggcatgtgtagagccattggaatggaaatgatcacaccactcctcactgggtcacctgngtaccctttcacctcattcctgcagagcttttgtgacgctgtggatggtttccaataccc

SEQ ID NO: 10885 - DNA, 121 bp, Artificial Sequence
  Synthesized
  misc_feature (61): n=t or c
taggattctgatggcctctgagactgtacctgctctagaaaactaagatgtgtccaggaangttcctggactgtgataaactgtactagtaaactgctagaaaggcctgtggcatgaattt

SEQ ID NO: 10886 - DNA, 121 bp, Artificial Sequence
  Synthesized
  misc_feature (61): n=a or g
taaagagggctatacaggctgaacacacacagctttgcactgttgcaggaaaagaactggnacaaaacgcagctccaaaaggggcacacggcttccttatttgtatcagtgtaaggaggga

SEQ ID NO: 10887 - DNA, 121 bp, Artificial Sequence
  Synthesized
  misc_feature (61): n=a or g
tttgagagagaacttaaaaatttctaaaggaaaggataaattcaacttgtattcccactgnaaatgcacttgttataggttgtgtgggaacaagattaaaagaggaatatatttgcattgt

SEQ ID NO: 10888 - DNA, 121 bp, Artificial Sequence
  Synthesized
  misc_feature (61): n=t or c
gggcaccttgtcatgtgattctgtggctggagaacctgatcttgtgaacactgatttcagngcacatatctgagtggagtattaggcagcagctcactgctaagggagttcaccttgtgat

SEQ ID NO: 10889 - DNA, 121 bp, Artificial Sequence
  Synthesized
  misc_feature (61): n=a or g
tgctgaaaccccgttatcccagtactgcttaggctcctggagcaggagcctgcaattactntgtaacgatgaacataaaagggaactttttctgtctatattactccattaactttctcta

SEQ ID NO: 10890 - DNA, 121 bp, Artificial Sequence
  Synthesized
  misc_feature (61): n=t or c
gggacagttttgagtgtgtgatattatcagccactgtgaaccaaatggagtcaactgtaancaatactcaggtgaagagtcatgaaagaaaactcaaatgttgcagaagatatttctaatg

SEQ ID NO: 10891 - DNA, 121 bp, Artificial Sequence
  Synthesized
  misc_feature (61): n=a or g
ctaattcatattactgaaaagtacagccagaggactggtttgtatctcatttaatccatcnttttctaattgtttttgaaggatcattctagcttgcgtaagtggtgaagaaaatacttct

SEQ ID NO: 10892 - DNA, 121 bp, Artificial Sequence
  Synthesized
  misc_feature (61): n=t or c
ggcatgtttactggaacactgctgcacaggttctgggccaggaatagtttgcatccaatgnagaagggtatgcttgggtcagcatactaatgtgagcatccatgtctgtaggtaggatctt

SEQ ID NO: 10893 - DNA, 121 bp, Artificial Sequence
  Synthesized
  misc_feature (61): n=t or c
gcagtgtgtgcatggaagtcttcaggcccccatttttcccagggcgagttgctcatctganggagagctgcaacgcacctccctgtagcgctgggcagaggcatccaccagggacagagct

SEQ ID NO: 10894 - DNA, 121 bp, Artificial Sequence
  Synthesized
  misc_feature (61): n=a or g
tagcttctgggaacctgtttgcaagatttgatggagctgatcaagtgggtcctctgagagncagctggagaggaaggtaagaaagttttgctaaggagctcttgcttgaggctgaattata

SEQ ID NO: 10895 - DNA, 121 bp, Artificial Sequence
  Synthesized
  misc_feature (61): n=t or c
acctctgcggctatgccaggacagccacaggcagcaaactatctcaggacaaggttgaggntgaagaattaatctacttacaaaggtgcaagtagatggatgaataaatggggtaatagat

SEQ ID NO: 10896 - DNA, 121 bp, Artificial Sequence
  Synthesized
  misc_feature (61): n=t or c
tggcaaggtggcctgcaatgcacatctggttctgtgatgcttttctgagatggagaaacantgtgcacatctaatgttggctatacaatactgcctgtagataattcctacatactgatga

SEQ ID NO: 10897 - DNA, 121 bp, Artificial Sequence
  Synthesized
  misc_feature (61): n=a or g
agttttgttttgaaagaattgtcctggtgttagaaattgatgggaagctctgcagacaacncaaatgataagcagtgtttctgtgtcacacatgcaaactccatgtagttggatagagtta

SEQ ID NO: 10898 - DNA, 121 bp, Artificial Sequence
  Synthesized
  misc_feature (61): n=a or g
cgtcaaggctccttacctttccaacagcagaattcattaggaaagtgaagtgaagcaaaanccactgcccctgatcaaagcttaaatctttcaagtgctcacaacctccaaatgtccattc

SEQ ID NO: 10899 - DNA, 121 bp, Artificial Sequence
  Synthesized
  misc_feature (61): n=t or c
tttcacttatacatgtttcacccaaagtattgagcatcaggtattttcatatttttacatntttacaagtagggcttttatttgaaaaccctgccaaactgaagatgctttttgtggtcaa

SEQ ID NO: 10900 - DNA, 121 bp, Artificial Sequence
  Synthesized
  misc_feature (61): n=c or g
gcagagtataaatgtatactatcggtggtaagactgtagttttaacagatcaattttccantcttaatactgatcaggaaaaacaggaattgaatgcgtggttcctctctttctgaggtat

SEQ ID NO: 10901 - DNA, 121 bp, Artificial Sequence
  Synthesized
  misc_feature (61): n=a or c
gcggtgcagcagttgctgctggtttgaaaagcacttaaatcctttgtgtcagctgtttccntctggccttcggtgtgagagggcagctgggtatggcttacacatgtgactgtacgtgcag

SEQ ID NO: 10902 - DNA, 121 bp, Artificial Sequence
  Synthesized
  misc_feature (61): n=a or g
ggcagccagggctggggcttggggcaggcctgtggtctggtggatgcacacattgtcagcnctcagagcactttctcaaatacttgtccctttttcataggacacctttggagatgaaagc

SEQ ID NO: 10903 - DNA, 121 bp, Artificial Sequence
  Synthesized
  misc_feature (61): n=a or g
actctgccaagcagctgctgatccaggctccacagagttcagtttgcagttaagctgctcnttaggaagagatcctaccattatgggttggaaaaaaaataaggtgaaagaattagctcag

SEQ ID NO: 10904 - DNA, 121 bp, Artificial Sequence
  Synthesized
  misc_feature (61): n=a or c
ttcatgcataaatgtgtttaactattggcttacctgagctatagtagctgactaaagctgntcagtacatcagttttttcatttgcagagtcatacattgccgaggtaattctagcgcaaa

SEQ ID NO: 10905 - DNA, 121 bp, Artificial Sequence
  Synthesized
  misc_feature (61): n=t or c
tccccaaggtctgggcagaggaaaggtaagtgttagcaagaaagacttactgcaatcacanaacacctcaaaatgaagcctgtaagaattgtacgtaggacaacttctgggtgccaagctc

SEQ ID NO: 10906 - DNA, 121 bp, Artificial Sequence
  Synthesized
  misc_feature (61): n=a or g
aaccccagcagaaaccattttaggagtcattttcttctccatgccaggcccatgatctcantgtgcttgttacatgaggagacatcaaaatggtgaggaatatgatgcatatttccatgaa

SEQ ID NO: 10907 - DNA, 121 bp, Artificial Sequence
  Synthesized
  misc_feature (61): n=a or g
tattagggatgctgctgctgaagtatttcttagctaaaattcttaagagaacagctctgcnagctttggccaaggaggccactacctccacttcctactggggatcaatgaagtcctggga

SEQ ID NO: 10908 - DNA, 121 bp, Artificial Sequence
  Synthesized
  misc_feature (61): n=a or g
agtaaaaaaaaaaaaaaaaaaagaatgttgttgcctagtattaacccaactgaggcacaanaacttattagacatccacaaattcttcaacaaatctaacctgatagagagccaggtccgt

SEQ ID NO: 10909 - DNA, 121 bp, Artificial Sequence
  Synthesized
  misc_feature (61): n=t or g
gtaatggttttcttaagaagtaataatcagaaatatgtaatctagttttactataaaaatnccaaataataactgcttcctctgcatcccagtcctagcagtgttggtagtgagggccact

SEQ ID NO: 10910 - DNA, 121 bp, Artificial Sequence
  Synthesized
  misc_feature (61): n=a or t
cataacccttaagttcaaacaatttggataggaagctaagaactgtattccagctgaagtncagaaaagtcagaataccttgttttgttcaaatgaatatataaatatacaatcttacgta

SEQ ID NO: 10911 - DNA, 121 bp, Artificial Sequence
  Synthesized
  misc_feature (61): n=t or g
agaaatcttagaattaggaaaggtaataaacatctgtcttggttgtccatcttattctatnaggctcaaactaacatcaatcaccaggtaggacagtacagaatacagtctgaagtcactt

SEQ ID NO: 10912 - DNA, 121 bp, Artificial Sequence
  Synthesized
  misc_feature (61): n=a or g
cacaagccaacagtgagctcttgcagccctgaagggaaaccgtatccagggctgcaccaanagagggagaaaatctgtttctcatatgacacaatcttcaatggtgtgcccgccttagcca

SEQ ID NO: 10913 - DNA, 121 bp, Artificial Sequence
  Synthesized
  misc_feature (61): n=t or c
cttcctcagaacttccttatgcatgatgtaacattttgtcccttagttttggcctgatggnctcctgaaggggtaaaaataacacctgtcatgatgtttgtggactagagtgtaaggatct

SEQ ID NO: 10914 - DNA, 121 bp, Artificial Sequence
  Synthesized
  misc_feature (61): n=a or g
gccagttaccctcacgcgtgtgcacctttttttgcaagactaggtagtctggttaaatgcnttgctcattagtgttctccagcctcaagtcgtaggctgttttgtgctgtgtgagcacctt

SEQ ID NO: 10915 - DNA, 121 bp, Artificial Sequence
  Synthesized
  misc_feature (61): n=a or g
ggcacagtacacaccatgtggagatggtcatggccattgcatagcacttccttttggcagnggtaaactatcaagataaaatttctgtgtctaattacactgatgactcaaactgatagca

SEQ ID NO: 10916 - DNA, 121 bp, Artificial Sequence
  Synthesized
  misc_feature (61): n=a or c
tcttgtttcattttatattctatcttgctagatttcagtataatgaaggctaaacaaccancacgccccattccaatttaactggcttatcactttggagtctcagggagataagagcagt

SEQ ID NO: 10917 - DNA, 121 bp, Artificial Sequence
  Synthesized
  misc_feature (61): n=c or g
gaaaaatcaggatttgaagtaccatatttaatttacatttgcaaagaggatagaatagctnagggagtggagctctacaacatgcttcgtaatatataagtcaataagaattatttcattc

SEQ ID NO: 10918 - DNA, 121 bp, Artificial Sequence
  Synthesized
  misc_feature (61): n=a or g
ttgcatagctctgaggatgagtgacaatgcaggcagtgctcaataaaagcataatttttanggaaaagagagatcctttcagggaagggagaaccctttgcccatcacttccctttccttg

SEQ ID NO: 10919 - DNA, 121 bp, Artificial Sequence
  Synthesized
  misc_feature (61): n=a or g
atacaggtctgctataatggttttattattcagtagagcactgtgattgctaaccaaagancagaagtattgcatagtcttttaggaccataccttcagtctggttcagcttctggaatat

SEQ ID NO: 10920 - DNA, 121 bp, Artificial Sequence
  Synthesized
  misc_feature (61): n=a or g
tgcctgtcagttgtcctcctccagacatttctgcatctattggttaatttcaactacttcngaaagaacatccgagaactggaaggtgtggaggccttataaggtctgtgggtggctgggc

SEQ ID NO: 10921 - DNA, 121 bp, Artificial Sequence
  Synthesized
  misc_feature (61): n=a or t
attgcacatcatagacatgctgtgtataggtagacacattctttatccaaaaagatagagnaatttaagatttaatatctaagtcatttgtcactatccgtcagctgaaatatgataatca

SEQ ID NO: 10922 - DNA, 121 bp, Artificial Sequence
  Synthesized
  misc_feature (61): n=a or g
gaaaatcagcccttgattttttgtcagcctctcggttctctggggtcaaattgagtctaancgcttccaaagtctggaatataatgaaagtttaatttatttttcttcctcctttatcact

SEQ ID NO: 10923 - DNA, 121 bp, Artificial Sequence
  Synthesized
  misc_feature (61): n=a or g
tctgctctcaccccatgccaccttctttaaagtttgggaacagccccattccatgtaaacntgcagcttccttcttgcatctgctctccttgcagcggcgaatggttattccatcaggaaa

SEQ ID NO: 10924 - DNA, 121 bp, Artificial Sequence
  Synthesized
  misc_feature (61): n=t or c
aaaccactagaaaaaatccctaactactgagtaggccattatagttcatctctgtttcctntccagccatctgtctgtcttgttttcaagactcttcaagctcttgaaggagaagttattt

SEQ ID NO: 10925 - DNA, 121 bp, Artificial Sequence
  Synthesized
  misc_feature (61): n=t or g
tgaaaaccaaatgtcacagttgggtttggacattatgtggttgtgcaggctatttcacacnttccttccatatccaaatacatttaaaaaagcaaaggaaaaaagggtgattattgtttct

SEQ ID NO: 10926 - DNA, 121 bp, Artificial Sequence
  Synthesized
  misc_feature (61): n=a or g
tgcagctatcctagcaccaaacagatcaaaaaggtgtaacaagttttccaaagaatccacntttttcacagatttaaaaattactgtcttgcttttcttgctgtatttaagtagggtttag

SEQ ID NO: 10927 - DNA, 121 bp, Artificial Sequence
  Synthesized
  misc_feature (61): n=t or c
tcttctgtaaaactttcacacctgaagtcctgacctttattcttgttttccttgtatgaangtctgtggtctgagatgattttggaagccgaagtgctcagaggaactcacaacgctgacc

SEQ ID NO: 10928 - DNA, 121 bp, Artificial Sequence
  Synthesized
  misc_feature (61): n=a or c
ctgaatttaaggcaggatgcttgcagtctttagagaaacatgacttacacagaactgctangataactcttaacacaaataactctaataataaaaacgtagtgtgtaattttcttcgtga

SEQ ID NO: 10929 - DNA, 121 bp, Artificial Sequence
  Synthesized
  misc_feature (61): n=t or c
aacatctaaacctcacacggttcatgatccagatcaagccacttactggaggcactcagcntttagcatagccttgcattttacaacttccgtacctttccatgcagaattgcaatatgca

SEQ ID NO: 10930 - DNA, 121 bp, Artificial Sequence
  Synthesized
  misc_feature (61): n=c or g
aaagatttaggctgattcacataaagcaaatcaatagatatgtgaatacaaagacaaggantactacagcacggtaaagttaaggcagcgagagcgctccatctggagcgaagcacagtgc

SEQ ID NO: 10931 - DNA, 121 bp, Artificial Sequence
  Synthesized
  misc_feature (61): n=a or g
aacataacattgaattcaaatccctctgtgacaaaagttaaaagatgcgttattataaagngccatgaaaacctgaagcactaacctgcaagtagcctttctcgatcaaatgcctcttagc

SEQ ID NO: 10932 - DNA, 121 bp, Artificial Sequence
  Synthesized
  misc_feature (61): n=t or c
cagtttgaggactgtggagcacattgccagtcttggctggattgtcccatcacaccatatngaccagattttatacctttcggttcccatcttttgggccaatggaagatggactgaatgg

SEQ ID NO: 10933 - DNA, 121 bp, Artificial Sequence
  Synthesized
  misc_feature (61): n=c or g
cagatttttcacttgtattttattatttgcaaaggatatctggtttccaaggggaaaaaancacacattactgcactcctgaaaccactgatgtcatatgttgtctaccttacaccaaact

SEQ ID NO: 10934 - DNA, 121 bp, Artificial Sequence
  Synthesized
  misc_feature (61): n=a or g
ttatttgtagtatttacatttgtaatgctggcagtgtactgagtgctttgtagagacactngaagacaaagtccctgcccaaagagcttaatattcatattttattcaaaatgaaaagtat

SEQ ID NO: 10935 - DNA, 121 bp, Artificial Sequence
  Synthesized
  misc_feature (61): n=t or c
atgtgtgcagaaatgcagttgggtaaaagtatgtgtgtacccttcagttctgatttacatngatgcgattcttatgccagctcatatttaagcccatattatcatacaggtttcagtcaat

SEQ ID NO: 10936 - DNA, 121 bp, Artificial Sequence
  Synthesized
  misc_feature (61): n=t or c
cattacagcttcactgcctattgagttgtgcagtgcacactcatgtagaagagtgctaganagttgcacatgatgctgggaggactcctgccctccacatgaaaactgatgcaaatagatt

SEQ ID NO: 10937 - DNA, 121 bp, Artificial Sequence
  Synthesized
  misc_feature (61): n=t or c
gcaccaagacatccccctgccacaggtgaggagggaggctccggcttctttaacaaccaangggaaagcagagtccctcagtattgctaggacctcagtgatgcaagagctcacggagctg

SEQ ID NO: 10938 - DNA, 121 bp, Artificial Sequence
  Synthesized
  misc_feature (61): n=t or c
agctctgctgaccctggggaattaccccatggaaactcccatctactgagcagcaagaggnaaactaagcagggctgggaatttggaacaagttcagccctcggaatatatggaggtttgg

SEQ ID NO: 10939 - DNA, 121 bp, Artificial Sequence
  Synthesized
  misc_feature (61): n=a or g
ccaaggagtctctttgtaattgcttaagaaaaagctcgtggcaccagggtctgagaactcntttgatgaatatggaaaatacagtgtttcacacctaagtgactaaccttgcaagcacagc

SEQ ID NO: 10940 - DNA, 121 bp, Artificial Sequence
  Synthesized
  misc_feature (61): n=a or c
tttaaaaaaacaaaaacaaaaactgaccatgtttttccaactcaaaatttcataagctgantttagtcagcctgaaaatcagcagtgcaagtgcaaacaagcagcaggaaagagatgtgac

SEQ ID NO: 10941 - DNA, 121 bp, Artificial Sequence
  Synthesized
  misc_feature (61): n=a or g
accttatgagagcaccagcatgaaaccagctcctgcccaaagcctgttttctttctccctnctagcaatctgcacttagcaggcaaaatgttcctgattgccaccccacagtcttctcgca

SEQ ID NO: 10942 - DNA, 121 bp, Artificial Sequence
  Synthesized
  misc_feature (61): n=t or c
aaaaaatactattggtaatgagattggagttttgcagcattagctcaaagagcaattcagnattgctgttaaaatcagacaaatttctcaacatacaaaattaaagacaaccttggtttca

SEQ ID NO: 10943 - DNA, 121 bp, Artificial Sequence
  Synthesized
  misc_feature (61): n=t or c
aggtactggggagttggccaggtatcctgcttccaaataaagccttttcaactgcactaantggctccaaaatatggttaactaaccatctaaatcacaactccgccatgcaggcagctgt

SEQ ID NO: 10944 - DNA, 121 bp, Artificial Sequence
  Synthesized
  misc_feature (61): n=a or c
tattttccaagtacagctgattttgaagatgtgtcttctgaaggttcctgaccctcctccncaccccatttaaacacctgaggtaagcctcactgataggtgttcagcaccctttgaaaat

SEQ ID NO: 10945 - DNA, 121 bp, Artificial Sequence
  Synthesized
  misc_feature (61): n=a or g
tttctggactttcctttcctttcctggacttctaaaaataaccagtagagaaactgagatncttcgagaacttcaagttgaaaaaaaaaagatctacattggtattcagagtcacctcaca

SEQ ID NO: 10946 - DNA, 121 bp, Artificial Sequence
  Synthesized
  misc_feature (61): n=a or g
gattgatttgataataggtgggtttcattttaatatcagtgacaatggaggtagaagggantaagagagtgtggtacagtatatcaggtatttaacaaagacagcctgaaaatcaataata

SEQ ID NO: 10947 - DNA, 121 bp, Artificial Sequence
  Synthesized
  misc_feature (61): n=t or c
ttccatagtcacccttcaagaacctagcaatttctattgctctaagtggtaaggttaaacncctctggaaagattcataaatggtaactgagatcctctgaaatcgtaacactcttggtat

SEQ ID NO: 10948 - DNA, 121 bp, Artificial Sequence
  Synthesized
  misc_feature (61): n=a or g
tgccttaagggagctctacacccattcccttgcaagtgtttaatgcctttaaaaacttggntgcacatgcgatgtccactgccaagtgaaggtctcttgcacctccttgtccactatgcaa

SEQ ID NO: 10949 - DNA, 121 bp, Artificial Sequence
  Synthesized
  misc_feature (61): n=t or c
tgagctttccagttatatcagcaccactggcatcttttttccttgaatctcaatatgaaantcctttaatgattgaatctgcttttgtagtggcgaagaaaattttatttctgtggtattt

SEQ ID NO: 10950 - DNA, 121 bp, Artificial Sequence
  Synthesized
  misc_feature (61): n=t or g
atttctgaagtaggtcttgttccctttttccagacagagagatacttccatgacaggaganaattcatttcttaatgtcttttccctctgtttgttgccattttctagttttctcagcaaa

SEQ ID NO: 10951 - DNA, 121 bp, Artificial Sequence
  Synthesized
  misc_feature (61): n=t or c
acaatggtataaccttgagagaaagcaaatgcagagactctgagaattgccttttcccttntttaaccagcttttaacgaaaaatgctcagaagtagggggttattataaaatcctgccag

SEQ ID NO: 10952 - DNA, 121 bp, Artificial Sequence
  Synthesized
  misc_feature (61): n=t or c
ggtgcagcaggatgacaccattctgatctcaacaattttttccatttgtagtattttgcanattaattcccaattaattttggatgataaagagtaaagcaaagttaaaaacaaagttgaa

SEQ ID NO: 10953 - DNA, 121 bp, Artificial Sequence
  Synthesized
  misc_feature (61): n=a or g
tcacctgtggcaggcctgacatttaccctagcagaagttccttttgacaattccattaatnagcgtacttagatcacaaaagaaaaccttaatcctaagatcatgcagctctttacttctg

SEQ ID NO: 10954 - DNA, 121 bp, Artificial Sequence
  Synthesized
  misc_feature (61): n=c or g
agaacgcatgggctgatccagcagtgagttctgcattgggaaccaccagggttcgctgagncacagctgtgggaatcgtttcttcttgctgttaaaccacaggcactcggggttgaaataa

SEQ ID NO: 10955 - DNA, 121 bp, Artificial Sequence
  Synthesized
  misc_feature (61): n=a or t
aaagaagtgtgagaccaatagagttacatagctgttaacttgctgaaatactattcgtttnactttgctagcctttttgtttgagcattataaaagattcagcatgtgtgtgcaaacaaga

SEQ ID NO: 10956 - DNA, 121 bp, Artificial Sequence
  Synthesized
  misc_feature (61): n=t or c
gtgcaaaaaaaaaaaaaaaaaaaaaaaggagagaaatgccagctaaaagcctttgtagtgnacaaaattatgtaaagctttaattttacaagttctcccattccctctttctttagcaaca

SEQ ID NO: 10957 - DNA, 121 bp, Artificial Sequence
  Synthesized
  misc_feature (61): n=t or c
aagaattaaatgtgtgtttaaactcaaactcatgctcaagtgctttgttgaatcaggcttngtaatatctatccaaccccttctaaatagcatttctttagtcctatgttcctgactagat

SEQ ID NO: 10958 - DNA, 121 bp, Artificial Sequence
  Synthesized
  misc_feature (61): n=t or c
ccgtgcgttaccccatggagctcaccccaaagcagtgggaatcagtgttttcctccaccangttcacacatcctcctctgtctgatgcctctctcagagccaccccacccacacgttggcc

SEQ ID NO: 10959 - DNA, 121 bp, Artificial Sequence
  Synthesized
  misc_feature (61): n=t or c
gctatatttcatgcacacttactacccatgcttactaacgtggtcacaagactcagacttnggaagtctcgcagtgcggatgagtgtctgccctagactatcatcattaagggatactttt

SEQ ID NO: 10960 - DNA, 121 bp, Artificial Sequence
  Synthesized
  misc_feature (61): n=t or c
tatctcccatttcggtatgaaacagtaatatgccccagaagcagaatagaacatggagcangtattcaggagtcggtatagatttaggagatctgatgaaccatctcagacatttctccag

SEQ ID NO: 10961 - DNA, 121 bp, Artificial Sequence
  Synthesized
  misc_feature (61): n=t or c
ttcttctcctgtgctctagaaagacgtctcttgtgctttgctctgtgtgtatgccgtcttncaccttggctgccattcgtttgttcctgtaaacgtgttccatgttgatgattggtatagc

SEQ ID NO: 10962 - DNA, 121 bp, Artificial Sequence
  Synthesized
  misc_feature (61): n=t or c
tggacttctgagccatgagttggcattttcagattactcacaccgactctaaatatctcgncttaaaataacagtgacttcagggccctatggattgtaaacgtaagctcatttttccctt

SEQ ID NO: 10963 - DNA, 121 bp, Artificial Sequence
  Synthesized
  misc_feature (61): n=a or c
caagaaggaattgcaagcagtgatagggagtgggggctttgtttcatatctaccttagccncctcaaagtgtctgtgtccagtttaaatcacagaaaagtggatgatcatcaggttacagt

SEQ ID NO: 10964 - DNA, 121 bp, Artificial Sequence
  Synthesized
  misc_feature (61): n=a or c
gagtgcagctcaggcactctccagttcttgtccctcccgctgcttgcccatgtctaaattnaacacaaaatgccaaagtgggtttgtgcatatggtgggtcctctggtgctccccgtaaag

SEQ ID NO: 10965 - DNA, 121 bp, Artificial Sequence
  Synthesized
  misc_feature (61): n=c or g
aaatgtaggtgtatgaatgtattttaatgtggtggatctcagagttgtgtaaatcaaaacntctcaaataagtagcaccccccggtacgtcgtggcaacggtttgtgtattaacctgatca

SEQ ID NO: 10966 - DNA, 121 bp, Artificial Sequence
  Synthesized
  misc_feature (61): n=a or g
ttttatcagctgtacttctgcactttatactcctgttgttaaggaaccagcgttttcccantgacgcaccaatgctggcaggaagcacatcctaagtgtattttgtgactcatttcaatct

SEQ ID NO: 10967 - DNA, 121 bp, Artificial Sequence
  Synthesized
  misc_feature (61): n=t or c
ttgctcaaaacaatttggagcatggtgtttcactggaagcttaagcagatctgaacacttntcagccatgttttctggcttatacgtctgtgtatgagttttcgaggtgtttcgaggaaca

SEQ ID NO: 10968 - DNA, 121 bp, Artificial Sequence
  Synthesized
  misc_feature (61): n=t or g
tcttctcatcttggagttggatcatttttctttccttttcctcaaaaggaggagcaagggnctcccttctgctgttgcacttgaaactgtgacgtatatacacagaaaattctgcagtctc

SEQ ID NO: 10969 - DNA, 121 bp, Artificial Sequence
  Synthesized
  misc_feature (61): n=t or c
taggagattctgatgagtttttatgtatggcaaatgggtattgcacaagaagttaaacaangaaatgtaacttgtacaacttgcagaatataagctgaaagtggaacggatggtacagaga

SEQ ID NO: 10970 - DNA, 121 bp, Artificial Sequence
  Synthesized
  misc_feature (61): n=a or g
attgctcctaacattttgtgattgttcctttaagaaaagctgagggagaggtccagatttntcactggcatagctgatttataccttggtgatgtacagatatacctacctttttgatgtg

SEQ ID NO: 10971 - DNA, 121 bp, Artificial Sequence
  Synthesized
  misc_feature (61): n=c or g
tttctccctgcctcagagaaggacttgaatattgtctttgacagctcaaaggaattactgnatgttttaagaagattggagttctccttcccttctgctattgcagtctttcttttgtcac

SEQ ID NO: 10972 - DNA, 121 bp, Artificial Sequence
  Synthesized
  misc_feature (61): n=t or c
tagaacacaaaggaaaccaaggccaggacttgatcctcaggatgggtaatggaaggacttncatttatcaagaatttcagtactgtctcagtttgagaactttttctaagacttagttatt

SEQ ID NO: 10973 - DNA, 121 bp, Artificial Sequence
  Synthesized
  misc_feature (61): n=c or g
caagtcctaaaacatcaagctcagagtctcacctcggactgcaaaacattccagcaacaanaagaatttctgcagtaaatggcggtttcgttttccatcttgaaagcaagtttagcttcct

SEQ ID NO: 10974 - DNA, 121 bp, Artificial Sequence
  Synthesized
  misc_feature (61): n=a or g
tcccatgaaatctaatttttaatatcgttgtagcacttttaacaaagattgttttacatgntcagacagtgttgcaaaagctgttgctgtgttcttaatgaattggaatttatttgatgct

SEQ ID NO: 10975 - DNA, 121 bp, Artificial Sequence
  Synthesized
  misc_feature (61): n=t or c
ctcaggcaattggtctactgaggaaggggaataacactgagggagagaaactaatgccagntgcacccaacttaggaaaacagatggatcagaaattttaatgttagatcacacttgccag

SEQ ID NO: 10976 - DNA, 121 bp, Artificial Sequence
  Synthesized
  misc_feature (61): n=a or g
aaggtagtgtgcacgcacatgctggagatcctgtttggatgataagactgacgtagcacgntatggagacgtgctctgccgagctgttattcatgcccctctgctgcgctcccacacatcc

SEQ ID NO: 10977 - DNA, 121 bp, Artificial Sequence
  Synthesized
  misc_feature (61): n=t or g
ccacgtgatcccgatcgtgtgctaaaacctgcggacaaataacctcactgaaagaccaacntaagatctgcctctcccagtctcgagtgttccagtcaggattgtgcagcgcatcccaccg

SEQ ID NO: 10978 - DNA, 121 bp, Artificial Sequence
  Synthesized
  misc_feature (61): n=t or g
tgtctgtcaactcttgggtagtcatcaactcttgggtgtcctttaggtcttgggtgcctgnagttccttgttcccctggatttcagagtccccatggagccctagatgccctttgggtctt

SEQ ID NO: 10979 - DNA, 121 bp, Artificial Sequence
  Synthesized
  misc_feature (61): n=t or c
ctcttcagagagacagactcttattctaagctttgagacaacccagtgtatttaagcaaantggaaatcccatatcatccatgcttctttaccaggattacacttttctatgagacaaaag

SEQ ID NO: 10980 - DNA, 121 bp, Artificial Sequence
  Synthesized
  misc_feature (61): n=a or g
acactaaaacaaatctggctgctttagagtgcagtatataagcatttaaggagtaaagtcntgtagattcttccttttagctgataagtctgggagccaacaggtagatgtttaacactta

SEQ ID NO: 10981 - DNA, 121 bp, Artificial Sequence
  Synthesized
  misc_feature (61): n=t or c
gagttggctgtcacggagagggaaactgactgctgagggcagtgtatcttcataaagcccnagagagcaaacccaacacctaatagagaactaaggcaagaaaggacactagctatctttc

SEQ ID NO: 10982 - DNA, 121 bp, Artificial Sequence
  Synthesized
  misc_feature (61): n=a or g
gaaccacaagggaaaccgatctgacagagcaggtcgcccaataaaaaggtggtcctggttntcttgataaggcaaagccaagcaggccgatcagtggtgtttttagacccacaagtgtagt

SEQ ID NO: 10983 - DNA, 121 bp, Artificial Sequence
  Synthesized
  misc_feature (61): n=t or c
gctttgtatctgtcatagtttccatggaaataattagaagacagtgctttcagagcaaccngtggtgatataagtgtaggctataaatataaacttaagtattgcttcacttcttacatta

SEQ ID NO: 10984 - DNA, 121 bp, Artificial Sequence
  Synthesized
  misc_feature (61): n=a or g
tgcaaactctatagcttaatttatctctgatgtagaaaactcatctttaataatgacagtngtactttcgaagcaagttctcatagatggatttacactactaaattgcccctttctgttt

SEQ ID NO: 10985 - DNA, 121 bp, Artificial Sequence
  Synthesized
  misc_feature (61): n=c or g
acagactgccaatctaagactgacatccaatattgattccaatggactgtcagcctccagnaaggcacattccacacctccacctcctgtttggaaacaagtccttcccttgtgagcctta

SEQ ID NO: 10986 - DNA, 121 bp, Artificial Sequence
  Synthesized
  misc_feature (61): n=t or g
gacatctatttcattatcttttaagtggaggcatgtcttgcacagcaaaattttgcagatnatttctgcacagcacccagtaggaaacttccttcttctctgtaaatcagtaattcttcct

SEQ ID NO: 10987 - DNA, 121 bp, Artificial Sequence
  Synthesized
  misc_feature (61): n=t or c
tttgtttttttaatgtatgaacatctgatgaaacagagacagatgtacaatgtaagcaganggttattttctgaatagtttctccattctttggaatgctgaataagtccatcttatacta

SEQ ID NO: 10988 - DNA, 121 bp, Artificial Sequence
  Synthesized
  misc_feature (61): n=a or c
ctgccttacttaacctacggatttttagctagaatagatttatagctaatatggatgcagngctataccatcccttttgggtgatttttatattcatactagagttctgcaaagctttaat

SEQ ID NO: 10989 - DNA, 121 bp, Artificial Sequence
  Synthesized
  misc_feature (61): n=t or c
tcacctgagctgtgaggagcagggaacctgctatttgcatgttaacccaccaaagcaaacncagctgcatgctcttcctcctaacgcttcctcaacagacttgtttactcgctctgtaacc

SEQ ID NO: 10990 - DNA, 121 bp, Artificial Sequence
  Synthesized
  misc_feature (61): n=a or c
cctaatgatcaataatgtagcctaaatcctttgtactatccaataatatttctcatcatgnacattttaaaacatatcttggaacttcagttcgaaattgcagcacagttcaagttataag

SEQ ID NO: 10991 - DNA, 121 bp, Artificial Sequence
  Synthesized
  misc_feature (61): n=a or c
ggtgagagatgctagctttcttagcagcaagtgttaaaatatatctgtagattcccacagntttatggtatgtgccattttgcatttttttaattgtacgtggatgcattggttttctctc

SEQ ID NO: 10992 - DNA, 121 bp, Artificial Sequence
  Synthesized
  misc_feature (61): n=t or c
ggagtaattttcacaaaaagtctatttagcatagtgaaatatggagagcctcaaagaaatntgatctcaatccagacagtacatctcattgacaaatctgcaagaacttgacccagaaaga

SEQ ID NO: 10993 - DNA, 121 bp, Artificial Sequence
  Synthesized
  misc_feature (61): n=c or g
cagaaactgtgacaatatatttcataattaaaaagttgtgtgtttctgatcaatatactgntaaagaagtttggcgaggtgattaattaattaacttctgtcaagctaaagttgcttcttg

SEQ ID NO: 10994 - DNA, 121 bp, Artificial Sequence
  Synthesized
  misc_feature (61): n=t or c
agaaaggtcctcctgcaagtggagttgatgaacctggcttgagattgtcaatgcagcaggnctttccctgaagccgtgtctctggaggacctgggaacaatgtggcaggggttctgccctc

SEQ ID NO: 10995 - DNA, 121 bp, Artificial Sequence
  Synthesized
  misc_feature (61): n=a or g
acagataaaaagaacaacttctctcaccataggcacaagttgaatgagcagcaggaatacngcatcagagaaaaggctacaaaggttccagcaataaattatttcttgtttctaatattct

SEQ ID NO: 10996 - DNA, 121 bp, Artificial Sequence
  Synthesized
  misc_feature (61): n=t or g
ataaatctctcatttgattggtttgtggttttcatttctgccttcatattgaagtgttatntagacgtttttattcaaaaagctagtgactttgaaatctttctagcttttatcactttta

SEQ ID NO: 10997 - DNA, 121 bp, Artificial Sequence
  Synthesized
  misc_feature (61): n=a or g
tgctgaggtttgtcactgagatcctgcagcacagcacaaaagcatgcaaacataaatctcnttcattttcctttgcgagtcaagttcaggtttgcacctgctctgcttccaaggaccttca

SEQ ID NO: 10998 - DNA, 121 bp, Artificial Sequence
  Synthesized
  misc_feature (61): n=a or t
tgtctttcctattctgttcaaagtttgttaatccaacgtcaacttctagatccagtacagngaagggtttccttcagctctagcgaaaatcttgaagagttgtatagttgggtagtctttt

SEQ ID NO: 10999 - DNA, 121 bp, Artificial Sequence
  Synthesized
  misc_feature (61): n=c or g
aagcatagaccacttcaaagagggacgtgtctacactgatcactacaacgtgcattgctgnagaagggaaaagccagcacttcaaacagcatttgaataaaatatggattttaaaaaaaaa

SEQ ID NO: 11000 - DNA, 121 bp, Artificial Sequence
  Synthesized
  misc_feature (61): n=t or c
caaaggtcttagtttccagtggatgacttgcttaggagtttatctactgagtggcctgctncttttgctgagtgaattttagtccttccaggcatgagtgggcatttccagagctgtgtaa

SEQ ID NO: 11001 - DNA, 121 bp, Artificial Sequence
  Synthesized
  misc_feature (61): n=t or c
cgatgggagctgtacaaagatctgagaactgccagcatggagttcattgtgttaattgganggtgatgcagtgttagtgagaagatgtattttgggttcagcgtcttctgtgttttgctca

SEQ ID NO: 11002 - DNA, 121 bp, Artificial Sequence
  Synthesized
  misc_feature (61): n=t or c
gagatagacagtcctttcttaattatatttgtgtgaaagaagtctctgaggtctgattaanctaaggtgtctttgtatatttgatactgggagaaaatgatcaatttccaggaggtcaaga

SEQ ID NO: 11003 - DNA, 121 bp, Artificial Sequence
  Synthesized
  misc_feature (61): n=a or g
tatcacagcaaaacacaaggctcagtgatttttcctttaaagttattgtaagctctctagntctgcattctgatgtgtgggtagataaagtggttagatcaggatccttagaaaggcatga

SEQ ID NO: 11004 - DNA, 121 bp, Artificial Sequence
  Synthesized
  misc_feature (61): n=a or c
tagaactgagtagaagttgaaaaaacaccaagtatccaatctttttttctgatcttactgnaagtaatgaaacattaactgtaatacataaccattggtgatcatatttcatttgataatc

SEQ ID NO: 11005 - DNA, 121 bp, Artificial Sequence
  Synthesized
  misc_feature (61): n=t or c
gtacaatgttcacctcaaagatttaatgtggcttatagcacctagagaccagtttgagggntttgcaatactataacatttaaattagccttccaatatggttatccaacaaataaacaca

SEQ ID NO: 11006 - DNA, 121 bp, Artificial Sequence
  Synthesized
  misc_feature (61): n=a or g
ctcaggagaaacttccagtatagcctttgcagtcttgctggagttaacatggaagtctgcnattaaaaactctcctttggtcacctcacagtttaaaacagtggcgttgaggagcagaaca

SEQ ID NO: 11007 - DNA, 121 bp, Artificial Sequence
  Synthesized
  misc_feature (61): n=t or c
ttccgctgcccagacaggctatccttatttagttggagaaaggagagatttctgcctaacnagttctcagcatgacgctgtttgagtgcatcctcactgatctatagactgccagctgtac

SEQ ID NO: 11008 - DNA, 121 bp, Artificial Sequence
  Synthesized
  misc_feature (61): n=c or g
tgtctaataacagaagacctctgagagagcgggacaaatatgtcagcagcacccctttcantgctctcccttagactccagtaaactaatacagccacaatgacaccttttgttcaaatat

SEQ ID NO: 11009 - DNA, 121 bp, Artificial Sequence
  Synthesized
  misc_feature (61): n=a or g
aatccttctcttattcatttgctattagattgtcccaagaatcatttgctatgatccaagntactgaaaagctgtcataatttttttagatctgagtaactgccttttctttcgtcctgtc

SEQ ID NO: 11010 - DNA, 121 bp, Artificial Sequence
  Synthesized
  misc_feature (61): n=a or g
ggggagggaaaaggccattatgtttggagtgaatgaaatcactcctggcaggagcgttaancagaggaaaaagagggtgggtaggaagcaaacgagatgggatttcagctgtctgcctggg

SEQ ID NO: 11011 - DNA, 121 bp, Artificial Sequence
  Synthesized
  misc_feature (61): n=t or c
acgttgctattgctgagatactaaggttcttggaggagaaaatggcacacaggttatattnagaaaaatagagagttgtaaaaagaagagaacttgtctggaagccgtacagtgctctttc

SEQ ID NO: 11012 - DNA, 121 bp, Artificial Sequence
  Synthesized
  misc_feature (61): n=a or g
ttgagtcattcagtttcatatattcaaatctaaattcagtagataataggtaaaagttgtngaccagagtttcatttctaagtaactatgataactacagatggtgtcatcatcaagtgca

SEQ ID NO: 11013 - DNA, 121 bp, Artificial Sequence
  Synthesized
  misc_feature (61): n=t or c
cacagtgtcatccttcagacttgaacagaatagctataaatgctccctctgaatcttgtantgagcgacaaactaatacaggtcagcagagaaggagtaatcagaatgtttctgaattaac

SEQ ID NO: 11014 - DNA, 121 bp, Artificial Sequence
  Synthesized
  misc_feature (61): n=t or g
attcacttggcctatagcagttttgctgtcagcaatggtcttcttgatgattttattacantttgggtcctcatccagattacatgtattcacaaaaataactgtacccagcaaaactgtc

SEQ ID NO: 11015 - DNA, 121 bp, Artificial Sequence
  Synthesized
  misc_feature (61): n=c or g
tgctcccttcttctttgtgagtttattcacaggtatgcaataaggtgtgcccactgggagnaagttctgcctaatctcaatggcagcacttcatgtcatcctaaattttatgtggtgctgt

SEQ ID NO: 11016 - DNA, 121 bp, Artificial Sequence
  Synthesized
  misc_feature (61): n=a or c
gttacactacacagacctgtacacagccttctgctgtgggaacacagccagggaaggctgnctggaccccaatgatgcgacactggcaagcaaatgtgggagatgctcaaggagggtttaa

SEQ ID NO: 11017 - DNA, 121 bp, Artificial Sequence
  Synthesized
  misc_feature (61): n=t or c
taaagtcactgactgagacagaaacccctctgtggttggaagggtactgagcgagctagtntttgtctcttgttgaaacaaagcaaataaacttggtgtggaaggtggaaaggagatatgg

SEQ ID NO: 11018 - DNA, 121 bp, Artificial Sequence
  Synthesized
  misc_feature (61): n=a or g
cagaattgcatgttttgtgacttgtacccattgtccctgtcctcttgctgtgcctttcccngaggagtctggctctgtctttcctatgtccaatcaggtagtttaggattatagcaatgat

SEQ ID NO: 11019 - DNA, 121 bp, Artificial Sequence
  Synthesized
  misc_feature (61): n=t or c
ggataaatttatcattttcattccttttcccaaactgtgtccacataagatgttttcatangagaacaaaatagtccttttgtctatgccctttcaaggttaaagtagccagctttccaga

SEQ ID NO: 11020 - DNA, 121 bp, Artificial Sequence
  Synthesized
  misc_feature (61): n=a or g
tactaccaccacgttctatttcagtttccaaaacctgtagttttaccttctttttgttgcncatatggcagctgcatactttgcagaacttcattccagaatcttcatttgacttttaagg

SEQ ID NO: 11021 - DNA, 121 bp, Artificial Sequence
  Synthesized
  misc_feature (61): n=t or c
agaagctggattgattcaaagtttgtaaactggcgctgaattaacagaacaaaatagatgnacttatttcaacttgttctttttatacaagtcctgtggtttctcccatggtgcttgtgct

SEQ ID NO: 11022 - DNA, 121 bp, Artificial Sequence
  Synthesized
  misc_feature (61): n=t or g
ttaagagttatctagagatgcagccaagcaccaaaacggaacaaagtatgacgcagagatntctgtcatgatgtgttttcacagaaatcactgtgtgtgatgacttctccaccctgtaatt

SEQ ID NO: 11023 - DNA, 121 bp, Artificial Sequence
  Synthesized
  misc_feature (61): n=t or c
cccttgtataactcaaaagtgcataccttcccgtatatcacaaagatagaagttgctcttngatttgctatctgttcttaagcctttttttttactgcaaacaacatttgattccagtgac

SEQ ID NO: 11024 - DNA, 121 bp, Artificial Sequence
  Synthesized
  misc_feature (61): n=t or c
tttcataattcaccataggaatgctttacaaaaattttgttttcattgtctaagaatatanatcattcctatctcaatgggaaatcggtaaagagcatttttttcagatttctccatttgc

SEQ ID NO: 11025 - DNA, 121 bp, Artificial Sequence
  Synthesized
  misc_feature (61): n=a or g
tttctaccctgtatggtctccttattgctccctttggagtctgctggcagcagatcaagcntagtttgtccttcttggtttgcagcagcctgctgtctacaaagatttgtgagaataatgg

SEQ ID NO: 11026 - DNA, 121 bp, Artificial Sequence
  Synthesized
  misc_feature (61): n=t or g
gatgagttttcatttactggggaatttctgattcctctgcatacgacgtaatctaatgtangtagaaaatactcagtcaaatttcagttttaaggagtattttagctgttaactaaaatat

SEQ ID NO: 11027 - DNA, 121 bp, Artificial Sequence
  Synthesized
  misc_feature (61): n=a or t
cttcatctggagagctctgggaaggaacagctcagactcagctgtagcttatttatccccnggttctctactcctttaaaggaaggggacacaaaatagacagaaaagaggaaacattttc

SEQ ID NO: 11028 - DNA, 121 bp, Artificial Sequence
  Synthesized
  misc_feature (61): n=a or c
aatatgaagctgcaaagctagcagaagtagctagttcattacaactggttctccttggtcncaaatggtatacgtccatttgtgtcttaacttagcaaaattcagctgacagagctaaaaa

SEQ ID NO: 11029 - DNA, 121 bp, Artificial Sequence
  Synthesized
  misc_feature (61): n=a or c
cttcctgtgctgcaccgagttcagtggaaaccaacatcacagtgagctgcagagtgcctcnccaagagcagcaccgggctcttcaaataaaacccacttcatgaagttttggcagaagctc

SEQ ID NO: 11030 - DNA, 121 bp, Artificial Sequence
  Synthesized
  misc_feature (61): n=t or c
gaacatgaagatgaaaaatggcttactgacttagcatttagtgtttttggtgaattttacnggtcatttaattgatctgaatatgcatcttcacagtgaaagttacctgtgctatatttca

SEQ ID NO: 11031 - DNA, 121 bp, Artificial Sequence
  Synthesized
  misc_feature (61): n=a or g
ctctagaaaatgtggcttaaatttccaaattaactatgccattgcaagaaaaataaatcantctgaaatctggatgtgatgctgatattgttttaacaggtacaatttcaattacacttct

SEQ ID NO: 11032 - DNA, 121 bp, Artificial Sequence
  Synthesized
  misc_feature (61): n=a or g
atgattactgagctcacttcggggagggagcagagagaaggagaatctagtgtttattttngttagtattattggaaaggggcggctggcagttgcacctgaagtcctgcgcccatgttat

SEQ ID NO: 11033 - DNA, 121 bp, Artificial Sequence
  Synthesized
  misc_feature (61): n=a or g
gtgagagcagatcaaatctggcatagcgtgtcatgtaggtttacaacaggcaaattgtctnttcagtgtaatggctgcagatccagggcaaattctgagtattttcaggtgtataaaacat

SEQ ID NO: 11034 - DNA, 121 bp, Artificial Sequence
  Synthesized
  misc_feature (61): n=a or g
tgttttccctttgccgtctgtgtattctccgtagtgctctcctttatttgcagttttgttntggagccattggaactacaaacaattctcccggtgtggatatattgcggatgctatatgt

SEQ ID NO: 11035 - DNA, 121 bp, Artificial Sequence
  Synthesized
  misc_feature (61): n=a or g
accacagccttgctggactgaatataaaggtataaaaacatccctctgtctctcagtagcncctccacctggataatttttatatattgtttgctgagtttgcatattgtaaatagggaac

SEQ ID NO: 11036 - DNA, 121 bp, Artificial Sequence
  Synthesized
  misc_feature (61): n=a or g
actgctgggatgcgtgtcccaccagggcagctctgtctgtggagcccagaggtgagtcagnagttcagtgtcacaccgctgtctcccatcgttgcccatttctcacagtgtgtgttccctt

SEQ ID NO: 11037 - DNA, 121 bp, Artificial Sequence
  Synthesized
  misc_feature (61): n=a or g
actgactcctgccaaggatagaacttatctcattattagaatcataaagtaaaccaagtantgacagcttaaagagattttagttgcagtttgtggacctattctccccttaggtagggtt

SEQ ID NO: 11038 - DNA, 121 bp, Artificial Sequence
  Synthesized
  misc_feature (61): n=t or c
attgaacatctgatctttcttctgcattcctgcctgctcaggcgtggttgtggatatgagnagtcttaatacagtgcaggaactctttaatcattgtctaaccctattggatttattaaaa

SEQ ID NO: 11039 - DNA, 121 bp, Artificial Sequence
  Synthesized
  misc_feature (61): n=t or c
aacttatagacaacactctttacacagtttacttaaaagctagcatgtttagaagtaaganacctgaaggatatttaactcaggaggactaagcctgaggttaagggaaatactcttcctg

SEQ ID NO: 11040 - DNA, 121 bp, Artificial Sequence
  Synthesized
  misc_feature (61): n=t or c
gtcttgatccacagtctgaggttgagattaaaaaataataacttgtgaagttcacaaaaanctagtatttgtgttctttcaagcacttcttcagcatagtttaaagcctggacttctacgg

SEQ ID NO: 11041 - DNA, 121 bp, Artificial Sequence
  Synthesized
  misc_feature (61): n=a or g
tattataagtgacaataggaccaaagttgtaaagcagcagcagatcttcaacccaaatatntgctgtgtgttttttcactttgtctgaatctgctgttggatgattttcttcaacaaatta

SEQ ID NO: 11042 - DNA, 121 bp, Artificial Sequence
  Synthesized
  misc_feature (61): n=a or g
acacatccatggggggaaaaaaaaatcttttttagaaactgatgcaacatgggaatgcctnaagacatgtgcaatgttattattcttaaccattcacacccagtttttactggttgcaaaa

SEQ ID NO: 11043 - DNA, 121 bp, Artificial Sequence
  Synthesized
  misc_feature (61): n=a or c
ggtacacttggataaacatatggatttagtataatatgggagattaacctgaggttgaatnaagtggtaagtttctacagttatttaacttaaaatgtgttctgcctgtcaccgagtttct

SEQ ID NO: 11044 - DNA, 121 bp, Artificial Sequence
  Synthesized
  misc_feature (61): n=t or c
cagacagggacagagagatctgcctggggtttcttgatcatattttagcattgcttgagcnctgcaggcatagctggcgtaacaaattaattgtgcatctgtgtgatttatgtacctgtgt

SEQ ID NO: 11045 - DNA, 121 bp, Artificial Sequence
  Synthesized
  misc_feature (61): n=a or g
cctacatagataaacagaaaaggggagttagttttattgtcccttggacacaagtggtagncactgagggacacagacaattttctgtaaggcccagttctctgatatttggttgcaggta

SEQ ID NO: 11046 - DNA, 121 bp, Artificial Sequence
  Synthesized
  misc_feature (61): n=t or c
ctcaaacaaaatgccctcttaacaaacaaaaactgaaaactgccctcttacagacatccangccctcgcagtacgacctgcaggagctcactgaagcccattttattcttttttccacacc

SEQ ID NO: 11047 - DNA, 121 bp, Artificial Sequence
  Synthesized
  misc_feature (61): n=t or c
atttatattcctaacatacacatggctctcattttgttcccattcatggcccaccagatgntaacacatgacctatttcagcccctacaaaacctgaagaatggaaactttaaaatgagtt

SEQ ID NO: 11048 - DNA, 121 bp, Artificial Sequence
  Synthesized
  misc_feature (61): n=a or g
taatatagagctcaacaaaatatctagacgtcagccctctgttgcagccaagatcaagctntcttggtgttatgctatatacatgaatcatgtcaccttattgggaataagataatcatag

SEQ ID NO: 11049 - DNA, 121 bp, Artificial Sequence
  Synthesized
  misc_feature (61): n=a or g
aatgtagcagaaataaggctctacaattctattatgcagccaacggttaaatgagtgaccnagataaatagtggcaagactaaaccatgcaattaacaggaattgcatgtatacagtgcca

SEQ ID NO: 11050 - DNA, 121 bp, Artificial Sequence
  Synthesized
  misc_feature (61): n=a or g
aggacaattaataagctgtagttagtgtaaccacactaaatttccaatgccttaacatganactaaaactgtaaactcagtattacaattgtactgatgtcttgaaaatggaaaaagccat

SEQ ID NO: 11051 - DNA, 121 bp, Artificial Sequence
  Synthesized
  misc_feature (61): n=a or c
gagtaattagggccaactctgttaacatgtctttgttcattacagggaaactgcagcactntcctgatcccgaatatattctcaactaattcatcatactacaaatctgctttcactgaaa

SEQ ID NO: 11052 - DNA, 121 bp, Artificial Sequence
  Synthesized
  misc_feature (61): n=a or g
tgacaaacttcctaatttctactgatgttcacttgtgtgtgataattaacctataacactnttcaagtctaaatgtgcaggtgtttattagtgacagaaacagtattcatacatctgaaaa

SEQ ID NO: 11053 - DNA, 121 bp, Artificial Sequence
  Synthesized
  misc_feature (61): n=a or g
cgtacccttctaggaagagctcttgtagtcctgcagtcttgggagacttcataaacctgcnacctaaaacaagctcatccatgcaaaccacccatattcatttactggtgtcaatggtgtc

SEQ ID NO: 11054 - DNA, 121 bp, Artificial Sequence
  Synthesized
  misc_feature (61): n=t or c
catgctggtcccatggcaccgagctgacggggcgctgggtctgtccacaggatacgagggngtctactgtgaaatcaacacagatgagtgtgccagcagcccctgcctgcacaatggcaac

SEQ ID NO: 11055 - DNA, 121 bp, Artificial Sequence
  Synthesized
  misc_feature (61): n=a or g
atatataaggtatatattgcattgtctaagtagtgaatctgtctgggaatcctgcagtcanactgatagagaaagtcttttatgtaagaggtgatgatctcagtactcaaaacaaatgttg

SEQ ID NO: 11056 - DNA, 121 bp, Artificial Sequence
  Synthesized
  misc_feature (61): n=t or c
catcttggtgcagttgctaccctgcatagcaaactccaaaaagcataaattctcacaaatntctcctggtcctatttcctaaactcagctcaacaaccaagttagcaacaagctttcttgg

SEQ ID NO: 11057 - DNA, 121 bp, Artificial Sequence
  Synthesized
  misc_feature (61): n=a or c
tttgccatcaccatcttctgaagtcaagggaaggcaatgcctagccttaaccgcttgttgntttgagtcaggctcctgaaagagttcctgatttgtattaaattcaaaatctcaaaccaaa

SEQ ID NO: 11058 - DNA, 121 bp, Artificial Sequence
  Synthesized
  misc_feature (61): n=t or c
tcagtcaattcaaacctttcctgctttgaaacccttccgtaaaagtcactgaagtacctcngctcacaaaaagtttattccattactcatcctacagctaagtacattatctcctacataa

SEQ ID NO: 11059 - DNA, 121 bp, Artificial Sequence
  Synthesized
  misc_feature (61): n=t or c
tcagaaaaatcacaattaaatagtatgtgtaaggaaagtaattgaatgttattttaaagtnagagaggaaaattagtatctgatctgtatgcagaaacaaaagcctgtcttcaattgtatg

SEQ ID NO: 11060 - DNA, 121 bp, Artificial Sequence
  Synthesized
  misc_feature (61): n=a or g
ttcctctgccatttttggctttacaacttcaccttcatacatattattttggtgccgttcntcacaaaggcttctgaattccttttctattgggttaaatgttgtctggggagctgaagga

SEQ ID NO: 11061 - DNA, 121 bp, Artificial Sequence
  Synthesized
  misc_feature (61): n=a or g
tctgcagatttacctcaagtctgtttcattggcaagtttagtaccctttttatcctaactntatccttgacacttacttaaaaacattggtgtgggacagtctatgggttggtctttgttg

SEQ ID NO: 11062 - DNA, 121 bp, Artificial Sequence
  Synthesized
  misc_feature (61): n=a or g
ggcctcatcttaagttctttcttaactgagataggtgtaaggagttgaagaaaaatgactngtgtcatcaaagtgtaataaagagtttacaaataccaaacaatgtaacacagaaaaaaag

SEQ ID NO: 11063 - DNA, 121 bp, Artificial Sequence
  Synthesized
  misc_feature (61): n=a or g
ctcgtctgcagaaacagtgggttttggcacctcctgtgcccaagagtgtgaagcatgcccnagagaattctagatttgtagccacaaggagtgtgatctttctgttttctgtcagctttgc

SEQ ID NO: 11064 - DNA, 121 bp, Artificial Sequence
  Synthesized
  misc_feature (61): n=a or t
tattagttttctaactgttcccttctctctttatacatgtggcttgcaagaacaataggcnacgagttatctcactcctccagcccaattagacagtggaaaaacgtatgaaaaatatgta

SEQ ID NO: 11065 - DNA, 121 bp, Artificial Sequence
  Synthesized
  misc_feature (61): n=t or c
tgtagggatctaattttaatgacatcaactgattgctttacagctttgagttgtcattcantgacgtatgcttttgattcattccatctcagttccttcattaccagttccctcctattct

SEQ ID NO: 11066 - DNA, 121 bp, Artificial Sequence
  Synthesized
  misc_feature (61): n=a or g
caatcatgaaaacaaaacaacaatgaactccaaatgccacataagagtatctttagaactntaatttaaacacattaacaagaccaaaaaaataggtctttaaatagttgcttctagaagc

SEQ ID NO: 11067 - DNA, 121 bp, Artificial Sequence
  Synthesized
  misc_feature (61): n=a or g
aaggttatcagaagtagtcaacatggattcgtcaaggggacataatgcttgaccaactcantagccttttatgatgttgttactggctctacccagtggcacccagatgtggggagagcag

SEQ ID NO: 11068 - DNA, 121 bp, Artificial Sequence
  Synthesized
  misc_feature (61): n=t or c
agatgcaagcatgggcttgcctatacccaatcaagatatcaactggttatttcaaacttantcatgttcacaattgttgccaattcaaaaatcaaaagtaaaacacaacaattttgtttaa

SEQ ID NO: 11069 - DNA, 121 bp, Artificial Sequence
  Synthesized
  misc_feature (61): n=a or g
atcatttgattgttttgcaagccttacaccatatgttgctaattgacatacaaaggatgtntgctctgttgtcctcattaatttgtagcaactaaatattttgtcttccacttaaacttgc

SEQ ID NO: 11070 - DNA, 121 bp, Artificial Sequence
  Synthesized
  misc_feature (61): n=a or g
taggaaaaaactactggttttatccctatgttgatatccaattcataaaccatatttggtngaacagctgctattataaaaaggactcataaaaattaacaccgtgtatctaaaataactg

SEQ ID NO: 11071 - DNA, 121 bp, Artificial Sequence
  Synthesized
  misc_feature (61): n=a or g
cacactcccagaaagaatatttaatcttggctcactgggcctgctgctctgaagcatgccntgccacaatactatcactgctctgtgaacaaagagaccaagctaaattgccactggagac

SEQ ID NO: 11072 - DNA, 121 bp, Artificial Sequence
  Synthesized
  misc_feature (61): n=t or c
cattaatctgccccgttccttaagcttcttcatgctgacatttccatgttagcatgttttnttaaacaatacatgttttcacaaaagaatgacttctaaagctttcccaagaatattctac

SEQ ID NO: 11073 - DNA, 121 bp, Artificial Sequence
  Synthesized
  misc_feature (61): n=a or g
aaatgtgctgtgggaaagtcagtggacgaaactgtgatgataatgatagactactaagaangaataacgtctgattaaataataaccattcaaaacaggtttaaatgtttctaaaacagag

SEQ ID NO: 11074 - DNA, 121 bp, Artificial Sequence
  Synthesized
  misc_feature (61): n=a or c
ttgttgaaatagctaagactagagaagtaaggctgcttgggttctttttcttgttcatctncacctagggaagaagggtgtgtttggttgcatttccatggtacgcatgtgaaggaggaag

SEQ ID NO: 11075 - DNA, 121 bp, Artificial Sequence
  Synthesized
  misc_feature (61): n=a or c
ctggctccctgctggagctctgcctggcccagcctgtggagcccaaggtatgggaaatccntttgcctttgggaactcccattccctgtgcttctccagctgtactgcaactgcacagcaa

SEQ ID NO: 11076 - DNA, 121 bp, Artificial Sequence
  Synthesized
  misc_feature (61): n=a or g
agtactgaagtatctatctgtgagcatatatatataatgtcattatgttcaatgtcttctnttttctctctacaagaaatcatcctgcagagagatgtggtaatacactcactgaaggtta

SEQ ID NO: 11077 - DNA, 121 bp, Artificial Sequence
  Synthesized
  misc_feature (61): n=t or c
ctccgcgctgaacctcagcgagagagtaaaaatacacagctataagtggtcttgtcctttnaaaatgttactgtcagggcacacaatcacttacaaggtttttttcctagagtataagcaa

SEQ ID NO: 11078 - DNA, 121 bp, Artificial Sequence
  Synthesized
  misc_feature (61): n=a or g
tcctatctatatgaggcaggctgccttactaatgacacaagaaacgagcgtccaatggcanaaccttgagatgtcctgacatgatgacatgaacacatcttgtaaggagtaaatttcagtg

SEQ ID NO: 11079 - DNA, 121 bp, Artificial Sequence
  Synthesized
  misc_feature (61): n=a or c
agctgcgagttttcttgcttttctgcattaggctgctcttccaaagagggcagccaacacnaggaaacagttaacatctcatggccagcttgtcaagtagtatgtagaagtattctcttca

SEQ ID NO: 11080 - DNA, 121 bp, Artificial Sequence
  Synthesized
  misc_feature (61): n=t or c
agggctgaaaaaactacatactgaaagaaagatgtaaaaagatgctataatcttgaatttngccattcttgttagagttgaagctgcaaattgtgaattattgtgcacctgagcaatgtga

SEQ ID NO: 11081 - DNA, 121 bp, Artificial Sequence
  Synthesized
  misc_feature (61): n=t or c
gtttcatgcagtgcttgatctgtggaaaaccaccgagtgcccagcagtgtgtaatcctcanataagtcggcagtgtctctcctgagtatgcgatgatggcacactggacaacatacctgct

SEQ ID NO: 11082 - DNA, 121 bp, Artificial Sequence
  Synthesized
  misc_feature (61): n=t or c
ataaaataatttaaacaaaaaggtagagaacacatactttgcatatttagacagtagcctnaagagttaactgcttgaagtgttcaggaatgttgacaagtatcagctttttttctcactc

SEQ ID NO: 11083 - DNA, 121 bp, Artificial Sequence
  Synthesized
  misc_feature (61): n=a or t
catgctgttgtttcattttgtgccttaatttaaattattctgttgaaaacctctgagaacnatagtaagatctggctgtagatgaagctactgtgtagctttaacttttttcctccagcat

SEQ ID NO: 11084 - DNA, 121 bp, Artificial Sequence
  Synthesized
  misc_feature (61): n=t or c
aggactcacactagtcatctaacagccttgtcacatagttccatccataaacttagcaagntctgcattaaaggagttttacctctatgttgttagatgtcaagagtttccctagttctct

SEQ ID NO: 11085 - DNA, 121 bp, Artificial Sequence
  Synthesized
  misc_feature (61): n=t or c
gggagaaaatgtactgtaagtacctcagttagaaaaattattccggcatgaactaaacacnggagaatacttgcatagggacagttacaactgtgcctgtagaaggatgtaagagacgggg

SEQ ID NO: 11086 - DNA, 121 bp, Artificial Sequence
  Synthesized
  misc_feature (61): n=t or g
agacctcttacagtaaatacttttgtctttgtgtaagacacctacataaagactgctgtanacatgttcttatgtacatgtattagtgcacagacagttacatttgatgcacccaccttgc

SEQ ID NO: 11087 - DNA, 121 bp, Artificial Sequence
  Synthesized
  misc_feature (61): n=t or c
tcagtgggcatggccagagctcgtgcagccagggaggtttctctgctttcccttccatgcngaaccccgctgtgtttatttacttgtacccgcagctgttggagttggagagaattgctgc

SEQ ID NO: 11088 - DNA, 121 bp, Artificial Sequence
  Synthesized
  misc_feature (61): n=a or c
tataaaagaaaacatctgagtactaagctaacaatgtatattcccttaactggcttcaacnctcaggtcaggtcagagtttgcatcttgttatatggcaatcttttcaatgtttttccaga

SEQ ID NO: 11089 - DNA, 121 bp, Artificial Sequence
  Synthesized
  misc_feature (61): n=t or c
ttaggtaagtagaggatattttcacatcattgtttgagaaaggcttcaaagcaaaaactgngagaatcatgacagccacaaatgggatggcaagcctggatatattctatgttgatttcaa

SEQ ID NO: 11090 - DNA, 121 bp, Artificial Sequence
  Synthesized
  misc_feature (61): n=t or c
caagggtgagatgtggtaatagggtgagcaaaaggctgaatctctcagtctgcaaagaaanttccctggagctgccttgcaaagaggttaaaccatagggcagcagtcctccaaaaaaaga

SEQ ID NO: 11091 - DNA, 121 bp, Artificial Sequence
  Synthesized
  misc_feature (61): n=t or g
taacttgccagtgaaatttttatgtttgtaattatccatgttgtttaaatgaataccaagnttctgaaccttagaacttaaagaactttattgccttaacagtctgctgtatcacagattc

SEQ ID NO: 11092 - DNA, 121 bp, Artificial Sequence
  Synthesized
  misc_feature (61): n=a or g
tgccatctgctgcataccatagttggcttggctccccattactgggtcatgcataagcccntttgcatacggagactgaggcaggaagaaaggaagttgcgttccattgctttgatgtgct

SEQ ID NO: 11093 - DNA, 121 bp, Artificial Sequence
  Synthesized
  misc_feature (61): n=t or c
ctcacaaatctctacctattcttgctaactagtccaagttctcagctgctttctgtcatgntctttctatcacctaaattccagagacagagcaggaatttctgtcttccctctgtgtcct

SEQ ID NO: 11094 - DNA, 121 bp, Artificial Sequence
  Synthesized
  misc_feature (61): n=t or c
atcaatagatttgaactgtagttgaactgatgcagggcactcaagcacagagcagctgttnctggaagaaacttgcctgccttgggaagaaatcaacatgcattacaggtggggtacaacc

SEQ ID NO: 11095 - DNA, 121 bp, Artificial Sequence
  Synthesized
  misc_feature (61): n=t or g
tgctctgatttgcagcaccaccgtgaacttccttttaactatcgatggtgactggagctgngtaaaaaactgagggtaaagcaattctcttattactgagacggtggttgacataaggtgg

SEQ ID NO: 11096 - DNA, 121 bp, Artificial Sequence
  Synthesized
  misc_feature (61): n=t or g
aaatatctctgtacagtatctgcttcactgaagtgcaatcttggagattgtataggattanatcatcaatcctttcatataccacagaaatttaataacacattctgcaaggaagaagaag

SEQ ID NO: 11097 - DNA, 121 bp, Artificial Sequence
  Synthesized
  misc_feature (61): n=a or g
tggaatagttttaacaagggagcaatgtagattaggttacttctcacatgtactagtcacnttgcttgaatgttaagagttaacattattacactgctacattttcaattctccttccatt

SEQ ID NO: 11098 - DNA, 121 bp, Artificial Sequence
  Synthesized
  misc_feature (61): n=a or g
tgtaaactttattttctgtattgcatctttggagtgatgggaggagtacagatgtcaggtncagtggaggcacgagcagactgttttgtgagattttgagcatattttgtgttttattata

SEQ ID NO: 11099 - DNA, 121 bp, Artificial Sequence
  Synthesized
  misc_feature (61): n=t or c
ccagctcaaacgccttgaatctgttagtcgttctcctgtgtattctcacttcaatgagacncttctgggagtcagtgtaattcgagcctttgaggagcagaaacgttttataaagcagaat

SEQ ID NO: 11100 - DNA, 121 bp, Artificial Sequence
  Synthesized
  misc_feature (61): n=t or c
tgtcccttgctgcagcgctgtccccatgtgaaagcgcttccaagctgtgcagtgcaggatnttgctgtgggtgtggcattaggagcgtggaggaactttagggctgctggagtcccgctgg

SEQ ID NO: 11101 - DNA, 121 bp, Artificial Sequence
  Synthesized
  misc_feature (61): n=c or g
ataaccataatcataaccataatcatcatagtcataaacattatttgtgatgttgcaactntttcttagtctctgatggataactacatggactagttactctaacaatgattttctgttt

SEQ ID NO: 11102 - DNA, 121 bp, Artificial Sequence
  Synthesized
  misc_feature (61): n=t or c
ccattctacctatacatcttaatttattaaatagatccaccagtgaaagccactgaataanttgacaatatctctgtacacatatgtttgatcaccacccattggtgtaacaaaaatttat

SEQ ID NO: 11103 - DNA, 121 bp, Artificial Sequence
  Synthesized
  misc_feature (61): n=t or g
aggcagggggctgtgatccagacattcacgtagaaggagcagtcagatcaatatcaatctncagcctgctgctgttacaaaggatcatgagtgcatcttgttccgctgtatttgtgtttgc

SEQ ID NO: 11104 - DNA, 121 bp, Artificial Sequence
  Synthesized
  misc_feature (61): n=a or g
atgtcttcatctattttagatcagaataacagaactataactgcgaactcctttttatttntagttgtttagtgaagacttcagactgtgaatctgacaatagaacagcaaaaatggcaat

SEQ ID NO: 11105 - DNA, 121 bp, Artificial Sequence
  Synthesized
  misc_feature (61): n=a or g
tcagcctgcctgcctcttgttggaaaaatgctgaaaggatgacaacagatgaaggaggagngatgcataggcttctcctgcagtccaggaaacctccagctgcagtaaagcacagtgtatc

SEQ ID NO: 11106 - DNA, 121 bp, Artificial Sequence
  Synthesized
  misc_feature (61): n=t or g
atccaagggcggagcaaccttgctagggggagtttagaactttaaacaatacctcaaagtntaggcttttagcttgttttgcattttactttgagatctttctcttttggctgagaaacat

SEQ ID NO: 11107 - DNA, 121 bp, Artificial Sequence
  Synthesized
  misc_feature (61): n=a or t
tcagacagaaaggactatatccgtgatgctgatttcacttccatccttcttaaatacatantttgcacattcctcattctgaaaaacagcatatgattttcagcttgactggattccccag

SEQ ID NO: 11108 - DNA, 121 bp, Artificial Sequence
  Synthesized
  misc_feature (61): n=a or g
atagcagggctcagccagcaagtgggtgacaacagccagcatcgccactgcttgggtaaangagcaatacaactctaatcagtaatttgtgaaagccttctcgcacagagatttcctgcta

SEQ ID NO: 11109 - DNA, 121 bp, Artificial Sequence
  Synthesized
  misc_feature (61): n=t or g
ctataagagcagctagtgggtccccacacctgtgtgacaacttggttagacatctgcaatnctgtgcctcctgggtccacctgataaagcactgcactcgtttcagcaggctcaaaaatca

SEQ ID NO: 11110 - DNA, 121 bp, Artificial Sequence
  Synthesized
  misc_feature (61): n=t or c
aaaagtggtagagtctaaatttaaattgtgaggcttttagaaatggtgaaccaattaattnctgagaatgacttccctttacaagtaacaccactaaaatttcttactacttttgaaaata

SEQ ID NO: 11111 - DNA, 121 bp, Artificial Sequence
  Synthesized
  misc_feature (61): n=a or g
attgcctatttctctgtagccttttttgtttgtttgttttgaaggagctgaaagcgattgnctcagtggagttcgccttttgtgttgctaaacctagctaagaggtctgatggtgtcagta

SEQ ID NO: 11112 - DNA, 121 bp, Artificial Sequence
  Synthesized
  misc_feature (61): n=a or g
ccatccacacagtcaaggcactagtgcaacatgtgatcttattaatattattcacacaacncttccttcccttctttggaaagaaagattaaagtacacatacatctttttgcaggaaaaa

SEQ ID NO: 11113 - DNA, 121 bp, Artificial Sequence
  Synthesized
  misc_feature (61): n=t or c
ttcagaatttcccattataaagcttgaataattggtgtgcagcaagagagaaagtaacaanaaaatatatagatatgtgttttttaatattttttctgtggcatatttaaatctaaaagtg

SEQ ID NO: 11114 - DNA, 121 bp, Artificial Sequence
  Synthesized
  misc_feature (61): n=a or g
aaaaactttggctttgtgcaaagatcttatttgtctctatgtgtttgtgtatcctatcctncatgttgcacagtagtgagtttacacattctgcaagtaggaaggaatgagtttactcagt

SEQ ID NO: 11115 - DNA, 121 bp, Artificial Sequence
  Synthesized
  misc_feature (61): n=t or c
gtgatttaatatatctctctgcaacctaacagccataaaaacatgtttacctacacttagntttacattttaagctgttttaatccagacttaatgtaactttttaaaagtgcagtgcttg

SEQ ID NO: 11116 - DNA, 121 bp, Artificial Sequence
  Synthesized
  misc_feature (61): n=a or g
aaggttactactttctgaaatttgatagaggttacagtgacaccattctagctacactaancaggcagtttgttacagtaagtcaacataacattaaacaggatatagcatgctgcctttg

SEQ ID NO: 11117 - DNA, 121 bp, Artificial Sequence
  Synthesized
  misc_feature (61): n=a or t
ccatcagatgaatacctaaccaagtggtcttccagactccattctcccactcaatagactnggatcagcatcagactattttgttctccctgcatataaaaagtaatgtaagttaagctct

SEQ ID NO: 11118 - DNA, 121 bp, Artificial Sequence
  Synthesized
  misc_feature (61): n=a or g
aagctcattctgagttgttacatgtcacctgagactgaatggctggagcatgacaggatcntgcagctgcacatcgggctagaaccggttatttaagctcttgcttctcctccttgggcac

SEQ ID NO: 11119 - DNA, 121 bp, Artificial Sequence
  Synthesized
  misc_feature (61): n=t or c
cacagccatgtgaaggaggaacagcagtgagggaaatacaccttaagaaaaaacacaacangaagaaacctggcttgcttaggtaagtctctaagtgctactattaggatgagctcatctt

SEQ ID NO: 11120 - DNA, 121 bp, Artificial Sequence
  Synthesized
  misc_feature (61): n=a or t
aggctttgaaaacaaaccagcacaccagcagcttgacaggatccctaactgggacagaaangagcaataatgtaccattctttcactgaaaaatacaaaaaacaacaacaacaacaaaaaa

SEQ ID NO: 11121 - DNA, 121 bp, Artificial Sequence
  Synthesized
  misc_feature (61): n=a or g
tgggcagtaacttgatttttaatattataacctgatagttgtaatcttggtggatcttctntgacagaaatggcagcaatgcaagatcaggtccattgtattctctcattgtgctggtttc

SEQ ID NO: 11122 - DNA, 121 bp, Artificial Sequence
  Synthesized
  misc_feature (61): n=t or c
aaaggacagaaaagctgaatttggaggcagtactacatggttttctcacacaagaatcaanggcagtcaccttttgtttctacagatttttcttacacactccttttttcacattctgatc

SEQ ID NO: 11123 - DNA, 121 bp, Artificial Sequence
  Synthesized
  misc_feature (61): n=a or c
agtctcctccctcattcttgtttcccactagtcttgcagctctttcagattgtgatcaaantgcaagtttcagcttgctgcaggtcctgtcacctgcagtgcagacagtctctgaatggtt

SEQ ID NO: 11124 - DNA, 121 bp, Artificial Sequence
  Synthesized
  misc_feature (61): n=a or g
cagcatatcatattttatagcacgtcatgccaccaaaaccaagtcccttgttctatactgnaaagcagtagacagggaagagaactgtaagaaagaatcatagaatcgctaaggttggaaa

SEQ ID NO: 11125 - DNA, 121 bp, Artificial Sequence
  Synthesized
  misc_feature (61): n=t or c
agttagcaacaagaaaaactcatgttttcctcacacctgtgactttggattattccagttntccacactctacttagaattctatctttcatctgttcttccagtttcctttacaacttct

SEQ ID NO: 11126 - DNA, 121 bp, Artificial Sequence
  Synthesized
  misc_feature (61): n=a or g
tgaatgcagagagacaggaaaaccctgaagtatatatagctttcatatctgccccctaagnagcttacaggcataattttaatcatattttgccagataatatccaggatttgcttgcagc

SEQ ID NO: 11127 - DNA, 121 bp, Artificial Sequence
  Synthesized
  misc_feature (61): n=t or c
gttgttttttttttcttcccaaatttattcgctcccatctccatcccagccaagcagccangagatggcaagcaggagactgctctacagaaagaacaccaaccttgcaggcgagagaaaa

SEQ ID NO: 11128 - DNA, 121 bp, Artificial Sequence
  Synthesized
  misc_feature (61): n=c or g
ctggtatgaatttcaggacatgcaaagctgcgctaattcaaatgcactttttacagatatnccctctgttaagctgattagtcattacttgttgaccaagcaatttttagaggatgtgggt

SEQ ID NO: 11129 - DNA, 121 bp, Artificial Sequence
  Synthesized
  misc_feature (61): n=a or c
gagctccaaccctctgtggatgtgtgtggttgtaaggacaggaaacagttgatacagttanctttaaccagtttcagaccacccaagaaggatagcagtcacaattcaacaataaagaagg

SEQ ID NO: 11130 - DNA, 121 bp, Artificial Sequence
  Synthesized
  misc_feature (61): n=c or g
tcatcttgatactggccagttggatgaaagcattatttaatgtaattatgaaatatagctnagaactcaagtattccaagctctgcagcaggattccatttgtaactccaaggagcgtaaa

SEQ ID NO: 11131 - DNA, 121 bp, Artificial Sequence
  Synthesized
  misc_feature (61): n=t or c
acagacttactttgacaactgatctaatccacttgatcttggacacctttaatttgggtangcttctttactgccataactcttttcctagattctctcctgatggacgattaatagcatc

SEQ ID NO: 11132 - DNA, 121 bp, Artificial Sequence
  Synthesized
  misc_feature (61): n=a or g
gttttaagacccgctttgtggtaagtgtccgcacttctcctcttgtgcctggcaagaaagntcagaggttttccagaatcacatgcaatcagcctttcctgcaggccaacgccatgctggc

SEQ ID NO: 11133 - DNA, 121 bp, Artificial Sequence
  Synthesized
  misc_feature (61): n=a or g
ctatcaggagccatacctttctgacagtgtttcaggtgtaggaaaaatgagtctgtagatnacagagcataatgtatgccaggaaaaattttgagtgctgtgatcatatctagccaccgag

SEQ ID NO: 11134 - DNA, 121 bp, Artificial Sequence
  Synthesized
  misc_feature (61): n=t or g
ctaattcatctctagtaactctttgtatgcattttggacgtaagctcatcaagagtagaantaattacccaagacatacccactaaccaatatagcgtctaacaaaagtattaagtatttc

SEQ ID NO: 11135 - DNA, 121 bp, Artificial Sequence
  Synthesized
  misc_feature (61): n=t or c
tcgtttctctatgtttcaagggccaaataaaggtactgtataggagaatttgcttacttgnctctgttttggaactactggtttctcagatgttaagaagactgtatggctgaatcactgg

SEQ ID NO: 11136 - DNA, 121 bp, Artificial Sequence
  Synthesized
  misc_feature (61): n=a or g
agtctctatattatttgtaaagccttctgggttatattctggtttaagatttcttcacagnactcttgctgacatcagtaagaggtacgctttcatgtctggagtgcatagtcatttgttt

SEQ ID NO: 11137 - DNA, 121 bp, Artificial Sequence
  Synthesized
  misc_feature (61): n=a or g
aggtcttaaaactcactgggcattaggttctataagagcacttgtattgcaaattatttancatactacgaattgaaatgcactcaatattcaagtctattcaagaaattcctaatctaat

SEQ ID NO: 11138 - DNA, 121 bp, Artificial Sequence
  Synthesized
  misc_feature (61): n=a or g
gaaatgttggtttagcttaactgacattgattgtggattttgctgtcgttgttactatttntttgtttatataaaaactgatgcaatttctgctaattaggtctcatatatcagctctggt

SEQ ID NO: 11139 - DNA, 121 bp, Artificial Sequence
  Synthesized
  misc_feature (61): n=t or c
ggacactagagaaaatcaggcctcagatgttattccaggtcatgttccttatgagctctcngagggagctgagtcacgtgcctcctggcagtcatgacaccaccttaatcagatccgctct

SEQ ID NO: 11140 - DNA, 121 bp, Artificial Sequence
  Synthesized
  misc_feature (61): n=a or g
tctcgaaggtcctttcctaccttaacgatcccaggattgcatggttctgtggtggttgtgnagcagcagagcagaggatggcatgaagataccttcagactattcgcctgcatctccctgt

SEQ ID NO: 11141 - DNA, 121 bp, Artificial Sequence
  Synthesized
  misc_feature (61): n=t or c
tatagaagtgatatcaggaaataaggaccctttccatcccacttatttcttcttcaaatanaaacattgcgtatctgcagaacatccatataatgacctcatgatgtgcttacctgaagta

SEQ ID NO: 11142 - DNA, 121 bp, Artificial Sequence
  Synthesized
  misc_feature (61): n=a or g
gacagcaggaaaggagtgtgcaattcaaactggaaagcactgttgttgttcacccttacanctttatcaattttttccccttttactactctggttttcctcggagcatcagctccctgtt

SEQ ID NO: 11143 - DNA, 121 bp, Artificial Sequence
  Synthesized
  misc_feature (61): n=t or c
ggacctgttatggtcccaggtgttagtaaaagcaaatggttaatcatgggctggtggagangtccagttaccagttaatgagtgagatagagaattaccttttacagggtatattttcttc

SEQ ID NO: 11144 - DNA, 121 bp, Artificial Sequence
  Synthesized
  misc_feature (61): n=t or g
aaagcgaagacactatactgtcacagtacagtcagcacttttctacttgcttttgattatntcatgctaattccaaacagatttaagtatcgttttctttaaataaaggacttaaagacaa

SEQ ID NO: 11145 - DNA, 121 bp, Artificial Sequence
  Synthesized
  misc_feature (61): n=a or g
agttttgcagtgcttgagacaactttaatgacctccatgaggagcatgtggtcctagactnttagatgaaggctgaatgcttggttcatgttcgtacttctaatgcttctgaagcataaag

SEQ ID NO: 11146 - DNA, 121 bp, Artificial Sequence
  Synthesized
  misc_feature (61): n=t or c
tgctctatgtgtcaggactaatagtctggattagtccttaaaatggatctgttggcacagnggtaacaattacaaaatagtgtgtaggaggtgagaaacttctttatttcttccaagtatt

SEQ ID NO: 11147 - DNA, 121 bp, Artificial Sequence
  Synthesized
  misc_feature (61): n=a or c
ttagcacagctaggtgcacatcaggatgcagagacctatatatatttgttctattatttcngagattttcatcctaaattttcctcccttcaccacagcaatatatttttccaagagatga

SEQ ID NO: 11148 - DNA, 121 bp, Artificial Sequence
  Synthesized
  misc_feature (61): n=a or g
caggggagacttttactaagaaaatttacacctggaggtttaatggctctgctctcacagnctcagtcttaaccaggaaaaacataagccccattgcatctagaaaaacatttttaagtag

SEQ ID NO: 11149 - DNA, 121 bp, Artificial Sequence
  Synthesized
  misc_feature (61): n=a or g
agccataacggcaatgcacctttgaagctttttgtcaactatgcatttcttgaatgccagntggtttgaattatttgactgagttattaagaagcccactcagatcataaaatggagcatg

SEQ ID NO: 11150 - DNA, 121 bp, Artificial Sequence
  Synthesized
  misc_feature (61): n=t or c
tactaaaaaaacaaagcattcaggctaagtaaccactccgcagccttgtacatacatacangagaatgagcaaacaaacgactgcagcttaaaggcacctcctggatggctcaacaaacaa

SEQ ID NO: 11151 - DNA, 121 bp, Artificial Sequence
  Synthesized
  misc_feature (61): n=a or g
gcagctgagagctctgcactgctgcacattggccctgctgcctagtgctagcaaagcctcnggagactaaaaataaacaggcatttatgttggaggaagcaaaccatgattgacaaccctc

SEQ ID NO: 11152 - DNA, 121 bp, Artificial Sequence
  Synthesized
  misc_feature (61): n=t or g
attacggccaccatggactggggaagtcacacagggcacagagatgtgagcactgagcatntcagagcaatcttcatcctctcttcattgatagacccactccagctcaaggacacaccac

SEQ ID NO: 11153 - DNA, 121 bp, Artificial Sequence
  Synthesized
  misc_feature (61): n=t or c
tctcttgctaaatggaaatggagccacctaagccagacatgcaataaataattcagctttngacataaaaatctcatgtattacacttgtatttttaaaataacttaccataggcctaaca

SEQ ID NO: 11154 - DNA, 121 bp, Artificial Sequence
  Synthesized
  misc_feature (61): n=t or g
ccatgggtcctggcagcagaggacaccaacagtgttcagggctgtattaatgagagtcagncagtcaattgtggtagtaattatccccttctactaagcacttattggacctaatctcgaa

SEQ ID NO: 11155 - DNA, 121 bp, Artificial Sequence
  Synthesized
  misc_feature (61): n=t or c
taaagccttctgtgctttgtccatgctagttctgatgtctccgttaccagtctgtcctgcngtgccttcctagctgtatgacataggggctaatgacaaactgacaggagggggctttctg

SEQ ID NO: 11156 - DNA, 121 bp, Artificial Sequence
  Synthesized
  misc_feature (61): n=a or g
tctggctggctgagggtaacacatggaataaatgaataaataaattcgaggaagagtcggngagagaacagatgagtgaatgggtgatagggaaggagagtgagactaaacagagagaggg

SEQ ID NO: 11157 - DNA, 121 bp, Artificial Sequence
  Synthesized
  misc_feature (61): n=t or g
ctgacgtcctggtaggggatgccctgggtctgtgctgctttggtagcctgcagtttgcccngcagaaagactggggataagccaaggtgcgagagaaacaaatagcaataatttccaagat

SEQ ID NO: 11158 - DNA, 121 bp, Artificial Sequence
  Synthesized
  misc_feature (61): n=t or g
tatggccctcagatatacaactatctgattataaataaagagttgcttgatataaaaaacntctattctggtagtgggtctcctcattttgtcacgcctaacaaaggatgttcaaatgctg

SEQ ID NO: 11159 - DNA, 121 bp, Artificial Sequence
  Synthesized
  misc_feature (61): n=a or g
tcagaagagatattgcatcagtacctttttccaggaggacaacacatcatgtagaaagacnacaaaaagagaagtcatacatacttggggagaattacagtctagctgaaatctaccaact

SEQ ID NO: 11160 - DNA, 121 bp, Artificial Sequence
  Synthesized
  misc_feature (61): n=a or g
tacttttagtcaggaaattagaagttaactgtgcatcagagcactgttttacacctgtaanaacctcatttacggtacatggaacaaacaactcatccaacctaaacgcctatgatgatct

SEQ ID NO: 11161 - DNA, 121 bp, Artificial Sequence
  Synthesized
  misc_feature (61): n=a or c
cttctacgagattacaggtaacagcttgcctgaaaataagaaattccattcaggtataaangtctccattaataatgtattccttggtccatccactcgtgtgcgtacatccctatacatt

SEQ ID NO: 11162 - DNA, 121 bp, Artificial Sequence
  Synthesized
  misc_feature (61): n=t or c
aggcagcaagggagtttgcacaatgagacttctgaggagacaaaaaaactagaagtacaangtgagctgatgtatgagggtgaccaacttgcaccttcagtcctcctgcactgtaaatctt

SEQ ID NO: 11163 - DNA, 121 bp, Artificial Sequence
  Synthesized
  misc_feature (61): n=a or g
gaaaagaaagcgaggtataagctcatcctagtaattgacagtagggaattctgaggaaaanagatttgaaatgttgtaaacacttcagatgagctgctcacttgtcttcatgaggagaagt

SEQ ID NO: 11164 - DNA, 121 bp, Artificial Sequence
  Synthesized
  misc_feature (61): n=a or g
ccacaattttaattggctggcattgttcttttgccatgaaaaccaagagcttcctgatcanggtggcatctttcatgacagcctgcaggttcacagtctgaccatttgtaaacatccggtc

SEQ ID NO: 11165 - DNA, 121 bp, Artificial Sequence
  Synthesized
  misc_feature (61): n=a or c
tttcacagagcacatggtttctcagcacagctcagcagtgtaagacagctctctgtttctnctcagctaaaaacacaaagttagagaccatcttttctctcttctttaatactgcgtcaag

SEQ ID NO: 11166 - DNA, 121 bp, Artificial Sequence
  Synthesized
  misc_feature (61): n=t or c
agaggaaatcatcttcttttcagaaatggtcaggtggtggtgcatggcgggttacagttgngcatcttttggcaggggtctgaggtatgcagcttcatgagaaggtgttgcactttgaaat

SEQ ID NO: 11167 - DNA, 121 bp, Artificial Sequence
  Synthesized
  misc_feature (61): n=c or g
atcaaacattagctgaataccaagagtaatcataggagaaaataggtagagaacaaagtanactgcagtaatagaattttttgaattctttctgtaagaataggctgtatttgccaaaaag

SEQ ID NO: 11168 - DNA, 121 bp, Artificial Sequence
  Synthesized
  misc_feature (61): n=c or g
aagctatgttttcctttgttattttgctggtaagtatacttaaatacagcttctgacttanccagcatcacaaaatggcctaatgttactctgcaagaggaggatattttggcagtgtttt

SEQ ID NO: 11169 - DNA, 121 bp, Artificial Sequence
  Synthesized
  misc_feature (61): n=a or c
ttagtcttaagcactttcatcccacctgtttccacatgcagagcttttcaaataaagaacnactaaaattcatcatcacaggtggaaaatgctctttctagcaagacaagatggaacagct

SEQ ID NO: 11170 - DNA, 121 bp, Artificial Sequence
  Synthesized
  misc_feature (61): n=a or g
atgctgctgagtaccaagggcttcttctcatctgaagctttacacttccagatactataangagaatttacttttctgatggagagtgcttggtctgaagcgttgtcagagctttctgaaa

SEQ ID NO: 11171 - DNA, 121 bp, Artificial Sequence
  Synthesized
  misc_feature (61): n=a or g
gaaattttaaaagaaaacacaccagaagtgttgtaagttttgccctaatagcagcattcangtagctaaagaatgacttgataaaacacaaagtgactttcattttatcagtaaacagaat

SEQ ID NO: 11172 - DNA, 121 bp, Artificial Sequence
  Synthesized
  misc_feature (61): n=t or c
agccttttcacagaatagttcttactcatctgtgcagaaattggatatctcttaatttgcnacctaaggaactataggactgcctgtcttcatcttctttaactcttctctgacagaaatt

SEQ ID NO: 11173 - DNA, 121 bp, Artificial Sequence
  Synthesized
  misc_feature (61): n=t or c
acagaaaataccacagtaaggggaataaccatttgatccacccttaattcactactacttntattttgtacttttgcatcttgcattcactgcagttttttacacacattcatattttgat

SEQ ID NO: 11174 - DNA, 121 bp, Artificial Sequence
  Synthesized
  misc_feature (61): n=t or c
agacagaaagatgctgagtttagttatctcacactgagaacatttcctgctcctcccaaanacacttcagttatctattggcaggagtcatgttttcaagagcatttaatagcaatttcta

SEQ ID NO: 11175 - DNA, 121 bp, Artificial Sequence
  Synthesized
  misc_feature (61): n=a or g
aataaaaaaaataatatgatttcagaggcagatccagctgtgaaccaatgtttagaaaccntgatttaatgtggtaattaagcctgtgacgcaagtaaaactgctacgtaataagctggca

SEQ ID NO: 11176 - DNA, 121 bp, Artificial Sequence
  Synthesized
  misc_feature (61): n=a or g
tcctacgaaggtaacttgacatgttaccttctcacaatggctagtgagaagattcagttgnccttggcatctaagatactgccacatctcaactaatgccccttaagaaaaaaaaaaccaa

SEQ ID NO: 11177 - DNA, 121 bp, Artificial Sequence
  Synthesized
  misc_feature (61): n=t or c
gtattatcacagacagaatggcagacaagatcattgttgttagtagttgttagttatcccnccttgagccaacaggaagtgtttaagcttttgcttaaacagcacatctatatgtctcaca

SEQ ID NO: 11178 - DNA, 121 bp, Artificial Sequence
  Synthesized
  misc_feature (61): n=a or g
gctctattagagcatgcacacaagcccaagcattaaaagcattataaaggaaaggaatcanaagttcaacatattccctcgtgcgcacatgctgagataaggactttaaagcttttgtgta

SEQ ID NO: 11179 - DNA, 121 bp, Artificial Sequence
  Synthesized
  misc_feature (61): n=a or g
tccacctctgccacagatcagtgctctttctcagcttgctgtctgctgccacaactcccanggcatctttaaaaaagctgcttcccaacctggcaattctcagaccatgttgttgacagac

SEQ ID NO: 11180 - DNA, 121 bp, Artificial Sequence
  Synthesized
  misc_feature (61): n=t or c
acagcagggagcccatcaatattttctgtgatgaaagattttcagggctgacgctgttctnctttccactggtgtaaatcaacagtagctccattgttatgagtagatttatataccggaa

SEQ ID NO: 11181 - DNA, 121 bp, Artificial Sequence
  Synthesized
  misc_feature (61): n=a or g
taaatggtcatatgaaatccagctgtggtcagcatgaaggctagagaaggagagtaggaanattaccacaatagcaatacctgtttttgtaagaggatgtgttaccaactgtcgtatcaga

SEQ ID NO: 11182 - DNA, 121 bp, Artificial Sequence
  Synthesized
  misc_feature (61): n=a or g
aatttttacaggaagataatcaagcttacaaatgtatctctgtaaagaattaaaacgcctnttcagaacatcctgatctgaaatgctgcccagagaggctgtgtagtctaaggagatattc

SEQ ID NO: 11183 - DNA, 121 bp, Artificial Sequence
  Synthesized
  misc_feature (61): n=a or g
gggaagttccccccatgcagcccagactcaccaaagaagaatggaaaccaaattcttcccncgggaaggggggctgcttagctctatttaaaacaggtatattgttttcatactcccttct

SEQ ID NO: 11184 - DNA, 121 bp, Artificial Sequence
  Synthesized
  misc_feature (61): n=t or c
aagaaaaatagcacagcttagccacaggcacagctgagaactgatgtaaacacaaaatcanagaaatttccacacatccacttctgacttttcgatactagcagagcttctgcagtgatca

SEQ ID NO: 11185 - DNA, 121 bp, Artificial Sequence
  Synthesized
  misc_feature (61): n=t or c
taaaagctaaggaattttaaagagctaagtacaactgtgtggcttgctcttcgctgccttnccattgcttctgcaacactggcttgtcttgtttctttttaaattttgcttactttacttt

SEQ ID NO: 11186 - DNA, 121 bp, Artificial Sequence
  Synthesized
  misc_feature (61): n=t or c
ttccctgaatttaacaatttttccttctcacatgaactgtctttcagctcattcttcaccntctgtttcatgtagaaattttattatactaaattattgtgggaagtccaaactaagggat

SEQ ID NO: 11187 - DNA, 121 bp, Artificial Sequence
  Synthesized
  misc_feature (61): n=a or g
gccaggggagggctttgctgcactgagagcctttggatgctgtcactggtgcaggggctgngcaatggagctggccacctgcttgctcaggaagtcacagttaatgcactctcacagcttt

SEQ ID NO: 11188 - DNA, 121 bp, Artificial Sequence
  Synthesized
  misc_feature (61): n=t or c
caatgtttattttatataaaatattttcagaaaacaattacttttatttaattcttaaatnattggttacttggttactttgaaggtgtttcaactttgagtccttatcctatatcaagca

SEQ ID NO: 11189 - DNA, 121 bp, Artificial Sequence
  Synthesized
  misc_feature (61): n=t or c
tataggttgtgtaaactgatgaaaggaacccagctttaataaccatttcctaggcaaagtngtgctcactgactcattgtgctcatagtgtaagcaaatgacccttctgtcttagaaagag

SEQ ID NO: 11190 - DNA, 121 bp, Artificial Sequence
  Synthesized
  misc_feature (61): n=t or c
cgttattaccacccctgtgactgttaaatttctcaagtttccagttttctgaacaaggctnaatttcctctttcatatatctaaatattttaaggaatacatatctctattacttaatgtt

SEQ ID NO: 11191 - DNA, 121 bp, Artificial Sequence
  Synthesized
  misc_feature (61): n=t or c
gtgggctgttccgacacgttattcagctaaatatggaggagttcttctcatgcggtcttangtttttactttttcacactgctgtggactgttaagtagctctttcacctgttaaaatacc

SEQ ID NO: 11192 - DNA, 121 bp, Artificial Sequence
  Synthesized
  misc_feature (61): n=a or t
aagcgtgccaaggaagccagagaaaacgccactgctagagcactgtcatacccagggatanttgaggtcacttatactgggcacacaggggccagacttggcagtcacaggaaaaataaaa

SEQ ID NO: 11193 - DNA, 121 bp, Artificial Sequence
  Synthesized
  misc_feature (61): n=a or g
tcaatgtactactgttgcagtctgtagcacagtggcatgttaccctaccaaaacaaacccnaatcaatattatcagcagggttctagaaaagttcaaattcaagagctgtttcttcagctt

SEQ ID NO: 11194 - DNA, 121 bp, Artificial Sequence
  Synthesized
  misc_feature (61): n=t or g
cttaaaataattttttacaactagtcagtctcctacctacatatgaatgataaatcaaagngctaagttattaagtggtgtgattaacaaaagttgtcaaatctaaagccctgtttccaat

SEQ ID NO: 11195 - DNA, 121 bp, Artificial Sequence
  Synthesized
  misc_feature (61): n=t or c
cagactatacacaagtgaagcaggagttctgtggaaactgcttggtgacaatgcttagaangtatttcactacatatagcagtcggtctgcaagactaagtaaagacatggggaatgttat

SEQ ID NO: 11196 - DNA, 121 bp, Artificial Sequence
  Synthesized
  misc_feature (61): n=t or c
gtttctgttcatttaaggtcgtaagggcaaatgatcattggaagcattgtgtgagtaaacngatgtcagaatcatgcagttgaagcagaagtaaaatgaaaaaggcaaaaaaggtcaacta

SEQ ID NO: 11197 - DNA, 121 bp, Artificial Sequence
  Synthesized
  misc_feature (61): n=a or g
agttttgttacttcatctacaaattttgctttttgtttgcagtataagttgcttatggccntgtcctttccagtagaaatgactttggtatagtaatgtttcaccacaaattcgcgtgccc

SEQ ID NO: 11198 - DNA, 121 bp, Artificial Sequence
  Synthesized
  misc_feature (61): n=a or g
tcccattgtgaactctgagtaacaaaaactcatttttaacattgatctcaaaagtataagngacttggatccatcatcagtgtttttattaacagattaggaaacctcaaattaaacacaa

SEQ ID NO: 11199 - DNA, 121 bp, Artificial Sequence
  Synthesized
  misc_feature (61): n=a or g
aaaatgcacgtagcagtcagtgaaaatcagagagaacccatggtgcaaccaaacttgaaantctgtgaagaagggaagtgcagctaagcgtccaattcacatttaactattaaaaattagt

SEQ ID NO: 11200 - DNA, 121 bp, Artificial Sequence
  Synthesized
  misc_feature (61): n=a or g
tgttctgtttaatcccaggaaattctgcaggatgtcatttgtgtggctggtgtgataaggnataatgtactgtgcagggctgaaccaagttacattggattgcattacactgaagtacagt

SEQ ID NO: 11201 - DNA, 121 bp, Artificial Sequence
  Synthesized
  misc_feature (61): n=t or c
agatcacagtctgccaatctgagaacaaaagcactcgtactcctgtcttctattcctgaanttcagtacctttgtatcagttatgcacgcacaatttctaactttccatcatccaaaagcc

SEQ ID NO: 11202 - DNA, 121 bp, Artificial Sequence
  Synthesized
  misc_feature (61): n=t or c
gacaaacattaataatgtgttataaaatcctcttgtagtttttcatcaggctgaacaaagnctacgtgtctattatttctggtctttattacagagtcagatttttatcctgtcttcagcg

SEQ ID NO: 11203 - DNA, 121 bp, Artificial Sequence
  Synthesized
  misc_feature (61): n=t or c
tgtaccatgtcttgacaataaggctaatgtgcgtggctttcttcaatggagagcgcccagncttgttagctcaagcatccttcagcaggattttgaaagaggtgaactacactctataaaa

SEQ ID NO: 11204 - DNA, 121 bp, Artificial Sequence
  Synthesized
  misc_feature (61): n=a or g
tccaagcttcacactcaacagagtcatgaaacaataagtttcatacaagagagcttcatancatcccacagattattctgtgccaaagcagagtacatttacttgtgttttgtctggacta

SEQ ID NO: 11205 - DNA, 121 bp, Artificial Sequence
  Synthesized
  misc_feature (61): n=a or g
ttttcatttaatgtattgtatgatatagtatcttttctaccccttccaaagattatttccncaactgttgcatacttaacagtggcagtcccacagacgccctcccttttagtaagctttc

SEQ ID NO: 11206 - DNA, 121 bp, Artificial Sequence
  Synthesized
  misc_feature (61): n=t or c
tctcaacctcttcagcatgctttcttaatgcagtgctctggcctctcagttttggctgtcnccttccagattgtccctatgtccttctgcaaatgtatagtccagaactacaggcagtact

SEQ ID NO: 11207 - DNA, 121 bp, Artificial Sequence
  Synthesized
  misc_feature (61): n=t or c
atggaaaagttggtaatgaagtagatgtctgttggcttacacaattatcgtgtgataaaangcctcgagatggagtttggtaggaattacctcctgctctcacagcttgcactgctctgaa

SEQ ID NO: 11208 - DNA, 121 bp, Artificial Sequence
  Synthesized
  misc_feature (61): n=c or g
gtgggcactctggtccctgtttgaggggcctttgttcccagtgctgctggcctatctgtcnctcttcctcaatcaagatgatcatcgagcccaccagtgccaagctgctgccagaccctct

SEQ ID NO: 11209 - DNA, 121 bp, Artificial Sequence
  Synthesized
  misc_feature (61): n=t or c
tgctgtggaaaggaagtagtcagggcaaagataaagaaatgtggagatgaaaggtaaacantgaaaaagtttgtacagatatctgatttctgtactcttgtggggcagtggtatttagaag

SEQ ID NO: 11210 - DNA, 121 bp, Artificial Sequence
  Synthesized
  misc_feature (61): n=a or g
ctgcaagatcatcagggaaagcagttgaaggagggagtcttgcagtaacagaatggccccnttttggctgaaggttgcagggataagcagataaacagtttcaacacggtcttgaagggaa

SEQ ID NO: 11211 - DNA, 121 bp, Artificial Sequence
  Synthesized
  misc_feature (61): n=a or c
aggtttaatggtgagaatgaatccagttgcagaaacagcataaacttacgtgattaggtanaatttaaactaatgagaagttcaaagaaaatgaggtatatgagggaaattctgattccta

SEQ ID NO: 11212 - DNA, 121 bp, Artificial Sequence
  Synthesized
  misc_feature (61): n=c or g
ttgcacacacgtccttccctccctcccatcactcagctcttcgctctgctgctgcagcgtnttctcgtgagtgggtatctgaagcagcgcgcgtttcagctgccctcatctgacacagctg

SEQ ID NO: 11213 - DNA, 121 bp, Artificial Sequence
  Synthesized
  misc_feature (61): n=a or g
aaggcatcatgggagcattccagtgctgacaacagaccgtgaggtggatcttgtatttctngagatgattttgcaatgagtttgaaaaaccatctccccttcaccagccaacatagaaaag

SEQ ID NO: 11214 - DNA, 121 bp, Artificial Sequence
  Synthesized
  misc_feature (61): n=a or g
ctgtggctggttgtgtcccattcctatttcaaccacagcatagccagatagtggctggttntgttaggtgatgagagggccatactcaacaaagactggggaagaagggaaaaagtgaaaa

SEQ ID NO: 11215 - DNA, 121 bp, Artificial Sequence
  Synthesized
  misc_feature (61): n=a or g
agctacctgcagaagggtatgtgctatgttcttgttttggtgtgagagatgtctgacagcnccaggtttgttcctgggaacatacaatcatagaatcatagagtggcctgggttgaaaagg

SEQ ID NO: 11216 - DNA, 121 bp, Artificial Sequence
  Synthesized
  misc_feature (61): n=t or g
caacctgctattgcgatgtgttttcttagttttatagaagaatttttgtggcagtacgccngagtcttagatctgtcctgtttctttgaggaatcaaagagttgatgaactaagttatata

SEQ ID NO: 11217 - DNA, 121 bp, Artificial Sequence
  Synthesized
  misc_feature (61): n=t or c
tgcccacggacctttgcccatggcaggacagatctctcaagctgaagttcagcaaattagncctcctctcccccatcgtaggatgctatccgtctaaagatttcctttaatttagagctgt

SEQ ID NO: 11218 - DNA, 121 bp, Artificial Sequence
  Synthesized
  misc_feature (61): n=a or g
tatttgtaaggtccttgcaccgtaacacaaaagtacgtcccataacacaaggctgcagatntaaaaaaactatgtacaaacacagtgcagttagactaatcagagctaagtttaactcatt

SEQ ID NO: 11219 - DNA, 121 bp, Artificial Sequence
  Synthesized
  misc_feature (61): n=t or g
ttgtaaaaccctctgcagaaatgcagccttagtgctcacgcacaatacccagacctgctgntgtaaaccaaggttgcaatgtgcaaacaagtgccagcaaactccatctctgatgatggat

SEQ ID NO: 11220 - DNA, 121 bp, Artificial Sequence
  Synthesized
  misc_feature (61): n=t or c
tttgaagcgttccataggctgttgagcctgcaactgggcaccttggggaggcctgttattngttcaagaaaggaattgctacgcaggcatcacaagtgaaagccgtgcagtcccgctgctt

SEQ ID NO: 11221 - DNA, 121 bp, Artificial Sequence
  Synthesized
  misc_feature (61): n=t or c
aggaagcagaattcctggaagtcccagcagagaacactgaatcaggccaacttcaaagatnagctttcacaacctcaaaagaatgatcttcacagtttacactccattgtgaagtatgacc

SEQ ID NO: 11222 - DNA, 121 bp, Artificial Sequence
  Synthesized
  misc_feature (61): n=t or c
gtggaatttattatatttatcactatatgttcatctttgcaatgtaaccagtttgttttangttgtgtatgtgcaagtattcttcttcccaccaatgtgagtcatcccattatgattctac

SEQ ID NO: 11223 - DNA, 121 bp, Artificial Sequence
  Synthesized
  misc_feature (61): n=a or c
ggttcaaaggtgagttacactaacaagaatgctctaaaatctccgcaccattgaaaatatntcttgaaataaagtctccaaaacttgcctgcagagatcagaagagatgcataatctctgc

SEQ ID NO: 11224 - DNA, 121 bp, Artificial Sequence
  Synthesized
  misc_feature (61): n=c or g
tgctgcttagaccagtgcaggatgctgagcagctttgccaggagttgatggtcatgctttntgaaagcctaagacactcatacctttatcccaacttttttttttttaatcttcatcagtg

SEQ ID NO: 11225 - DNA, 121 bp, Artificial Sequence
  Synthesized
  misc_feature (61): n=t or c
gctaattaaaacgagcttggggagaggagcctgctaacaggatcacagcctctcttgcatngagcaatagacgtgtagtaggcatccatgtttccccgtacgcttattttccaagctgagt

SEQ ID NO: 11226 - DNA, 121 bp, Artificial Sequence
  Synthesized
  misc_feature (61): n=t or c
ggtgcagctacacttcctcgggtggtatatttcatccctgtgtctcctggtgtcctgtggnctcccctgttcctttacctgtttgtttctgggctgctaattattgccaaagtgtcttgag

SEQ ID NO: 11227 - DNA, 121 bp, Artificial Sequence
  Synthesized
  misc_feature (61): n=a or g
gggaagtagggattcttcttaaaggacaatgatttctagatgtcttgaaaacattagaatngtaagaaaaaggtatctgagagttgaaaaaactgaagaggagagctggagataatttata

SEQ ID NO: 11228 - DNA, 121 bp, Artificial Sequence
  Synthesized
  misc_feature (61): n=t or c
agagcttacaacataagcctttaaagatacatacagtagagcattacagcatacaagcagngttatcagtgctgccctgccacccttgaagctgggccccaaacttgcacctacactctca

SEQ ID NO: 11229 - DNA, 121 bp, Artificial Sequence
  Synthesized
  misc_feature (61): n=t or c
tattatttcttctgctcttcctagtgttcatatggaaagacattagagcacttaacacttngcaaaaataaaccctttttaacttcgtggtggtaacacaaggctaggcactatgaaaatt

SEQ ID NO: 11230 - DNA, 121 bp, Artificial Sequence
  Synthesized
  misc_feature (61): n=a or g
atatcgtatgttgggcagttaataaaacacttagctacaacttccctttaattcaagtagntgcgggggaaggaattactacattaatttgaagcattaaattgaagaagtttggcacaaa

SEQ ID NO: 11231 - DNA, 121 bp, Artificial Sequence
  Synthesized
  misc_feature (61): n=a or g
agaaatgaccgcagaactaccagaaagcagatgtccttgccctgagaacagagccctccgnacaaacaagcagaaatgatgctctgtgattgcccagacaagcacgacgcagcggggcagc

SEQ ID NO: 11232 - DNA, 121 bp, Artificial Sequence
  Synthesized
  misc_feature (61): n=a or g
taccaggagccctgcaaaacaccctgatcccaaacctaacctattcctgcaacatcagagntgagtttgcactcagacgtttccttcccaaataatgctgtgcagcactttctctcctgct

SEQ ID NO: 11233 - DNA, 121 bp, Artificial Sequence
  Synthesized
  misc_feature (61): n=t or c
gggctcttgtgaaggcaagcagccaggactgagaaagatcagtgattccagaagtggcagnagagaacagccaaggctttccttgatagaaataaataggtatatgctgcatcatatatca

SEQ ID NO: 11234 - DNA, 121 bp, Artificial Sequence
  Synthesized
  misc_feature (61): n=t or c
gggactgacatttgcctggtacaaatgtcccaagccctggcaacaagggcagagtttgtgnggcgtcagctccaatctgaagtcaagcaggtccaaattcatccctgaagtaacaccttga

SEQ ID NO: 11235 - DNA, 121 bp, Artificial Sequence
  Synthesized
  misc_feature (61): n=t or c
gctctgctgggccagtataatgatgaagaggccagatgtgtgctttgctatttcatgcatnctcaataaaattagggcttcttgtctgggacttgcattgctcctggttatatattaagca

SEQ ID NO: 11236 - DNA, 121 bp, Artificial Sequence
  Synthesized
  misc_feature (61): n=a or g
tcaataaaaatctcattgtattctaagggatcacaaattaaaaaaggggttttgcaagacnaaagctctggtttaaaatcagatgtatgatatgtatacgcagcaaattccaaactgattt

SEQ ID NO: 11237 - DNA, 121 bp, Artificial Sequence
  Synthesized
  misc_feature (61): n=a or g
gcaagctctggcttgctgtgggcatcccaaggattgcacaaagctcttgaaatcccccacntctcacctctctgtcaactgcagtgcatcccaccctccttggtgtgaattcccctaagca

SEQ ID NO: 11238 - DNA, 121 bp, Artificial Sequence
  Synthesized
  misc_feature (61): n=t or g
tagacatgtaaccatctgttcttcagtgctaccacggtaaaacaaagctcctagaaattcnaatagtccataaatgtagaagcttgaagctattctcagtcctcttcaaaaactatcctta

SEQ ID NO: 11239 - DNA, 121 bp, Artificial Sequence
  Synthesized
  misc_feature (61): n=a or g
ctgtaattcaaatggcaaagctttgtgcagaaggcctttggtactcaaaatggcactgctntttcctcctccacagaacaagcaacttttttcctcagcaaaatagaagctttgccattgt

SEQ ID NO: 11240 - DNA, 121 bp, Artificial Sequence
  Synthesized
  misc_feature (61): n=t or c
ttgtgcagggaagtatgtgcaagaaaatcactgctgtttatgaactacagaaaaacaatcnccaaatccagcctgtgtcagcaaagagtgggagctgccttctgacagctgtgcaggaggc

SEQ ID NO: 11241 - DNA, 121 bp, Artificial Sequence
  Synthesized
  misc_feature (61): n=t or c
gcccagaccccaaatctcagccctggttttgctgtcacttcataactccttcccggtttangtgagtatcaattctgcctccatcaagctcttgttatctaaattaggttaacagttgagt

SEQ ID NO: 11242 - DNA, 121 bp, Artificial Sequence
  Synthesized
  misc_feature (61): n=a or c
ctatggcttccagaggccgttccaaatagattcctatcaaacagcatcaggcagttaagangtgacattgccaaagttccactgttctgagtgtttttcaggattagcacatttaacaatt

SEQ ID NO: 11243 - DNA, 121 bp, Artificial Sequence
  Synthesized
  misc_feature (61): n=a or g
cttttatttttaaagaaactgaaagcagagacatggcagtacatcaaaataactgctacanaaagcaaatagtcaaccctctcctagagggacaaatcccaaggagatgatttttttttcc

SEQ ID NO: 11244 - DNA, 121 bp, Artificial Sequence
  Synthesized
  misc_feature (61): n=a or g
gtaaatagaaaacctcttctcttttttctgaaatttactagcccgacctctatgtattcangcagtgtgctccaagaagagaataatattcagtcacctcagctgaaggcagaaatgcact

SEQ ID NO: 11245 - DNA, 121 bp, Artificial Sequence
  Synthesized
  misc_feature (61): n=t or c
gtttgtgctccggtgtgggttctgtctagagctttcatccacagcaggatgaaaagcagcntgaagaaactccaaatgtctttcaaaaggttttattcttacagctcatagcattttccac

SEQ ID NO: 11246 - DNA, 121 bp, Artificial Sequence
  Synthesized
  misc_feature (61): n=t or g
tacgtaatattccacaaaacatgagaattcatttcaaagcaaatattctctctctataganggtatttttccctgtactgcctttactatcacttccttgtaactaaaactcgagtcttct

SEQ ID NO: 11247 - DNA, 121 bp, Artificial Sequence
  Synthesized
  misc_feature (61): n=c or g
tgcagcacaccctagagagaacaatcctgcagttgcagtaatgttcaggacttctgaactncattcttaagatctcacatagttaagattcttcccaaagggtaaacagtaaattacacac

SEQ ID NO: 11248 - DNA, 121 bp, Artificial Sequence
  Synthesized
  misc_feature (61): n=a or g
aaatgcccttcagggtatggggattgtaatcatccactcatggcagtacgttaagcgtcantctgtaagtgtcagttgcaacagattaatgaagcacctgtggtggctgcccagacctgct

SEQ ID NO: 11249 - DNA, 121 bp, Artificial Sequence
  Synthesized
  misc_feature (61): n=a or t
agtttgaacaaggacgtctttggttagttttctgtggggtgctccatattggaagtaaaangagctgcttgatgctatcagtagcagtgcggacggggggttttgggcatcggttgaataa

SEQ ID NO: 11250 - DNA, 121 bp, Artificial Sequence
  Synthesized
  misc_feature (61): n=a or g
ttcttggctgtttctcaatagccacaagatttacaggaaaacaaattgtttttcccatgangaaataggtatatgaaacttgtatttggaagtcagaattttctgaacaaaatgcctttac

SEQ ID NO: 11251 - DNA, 121 bp, Artificial Sequence
  Synthesized
  misc_feature (61): n=t or c
acaccaacccatttttaagtataaggattaaagcctgaatgcactgtaagctaacaaggcntttggacctacatgaagatttcgtgttttagcatctgggagactaccataaagacttcca

SEQ ID NO: 11252 - DNA, 121 bp, Artificial Sequence
  Synthesized
  misc_feature (61): n=a or c
ttactgacataaaatcagcattttctcttgagatgtgaaagtcttaggaaacaaactaagntaagtgacaaagctcacacttccagatagatccaaacctcccgtaaaccctggtgatatt

SEQ ID NO: 11253 - DNA, 121 bp, Artificial Sequence
  Synthesized
  misc_feature (61): n=a or c
gcagtgcagggatctggccctggatcaatgaaggaaatgtcttgaacaaattgggaccagngaggtcagtcttctaaaaaacataattaaattgggcctgaactggaaggctcacacatca

SEQ ID NO: 11254 - DNA, 121 bp, Artificial Sequence
  Synthesized
  misc_feature (61): n=a or g
aggtttcttgtagcctgactggtttcttactctgatgcgttaggcagtgacaagtgtaagnctagataaggacatagcatgacacaggcttaggtattttgtgcagctgcatggtgtggag

SEQ ID NO: 11255 - DNA, 121 bp, Artificial Sequence
  Synthesized
  misc_feature (61): n=a or g
atttggtggggccattggtgacagctgtgcctctgtctgtgcatctcaaaaatgtcttacngtaatcccaaaccccattttcccaatgtgcctccactttcccttccctcattttcttgcc

SEQ ID NO: 11256 - DNA, 121 bp, Artificial Sequence
  Synthesized
  misc_feature (61): n=a or g
aaaagtttgaaggaactgtgtatgctatggtattagtagcggagcagaaatacaaaagganaagaatgaccatgaaagtactgagcaaacaatacaaacaggatagtaaatatcaaagctg

SEQ ID NO: 11257 - DNA, 121 bp, Artificial Sequence
  Synthesized
  misc_feature (61): n=a or g
gaaccttctcagtcaaactgcttaataggcatgggtaattaaggtttccattgctgtactncagaagtgtatgcagtgttctgctatctcaggtgcttgctgggatgaacgcgagcaacac

SEQ ID NO: 11258 - DNA, 121 bp, Artificial Sequence
  Synthesized
  misc_feature (61): n=t or c
aatcagcatggttgagaatatgggatagagagacagaacatgagcataggaaagtgcatantgatgcactggactagtgtgtaggatcctttatcactgtggttacctcattgtttctatt

SEQ ID NO: 11259 - DNA, 121 bp, Artificial Sequence
  Synthesized
  misc_feature (61): n=a or g
aggggcacatgagcagaggtctcacactcctgcagttttgggcagtgtgttatggagaatnaatcatccctgagctgctccctccctggccctggaagaggaagcacctctatgaggatca

SEQ ID NO: 11260 - DNA, 121 bp, Artificial Sequence
  Synthesized
  misc_feature (61): n=c or g
attgtatgaaaacaactagtgttggcccagactgaagctgtaattactatatggcaggaanacctttaaactgcttgcacacaatgtccaggcgtgcttagtgttgcagtcctcatcagcc

SEQ ID NO: 11261 - DNA, 121 bp, Artificial Sequence
  Synthesized
  misc_feature (61): n=t or c
agagaaagcaaagcaacacttagcaagaaatggttggggttttactctgaaagcagagggncaccagctctctgcgacgtgttatcaagcttgaaataggaggcaaacgcacagctgcact

SEQ ID NO: 11262 - DNA, 121 bp, Artificial Sequence
  Synthesized
  misc_feature (61): n=t or c
aggatagggagccgccaagctggcagctgtgctggcctcacccaatccacaatgccctgancaggactgtaaggatgggccaggcatcatctttgtccctggacaaacaactctgtcactg

SEQ ID NO: 11263 - DNA, 121 bp, Artificial Sequence
  Synthesized
  misc_feature (61): n=a or g
tggaaggctgtgtggggaagcagctcaggagactggtgttgctggaaactaacgtgccacnaaataaaacacattttcagatcactgcataactgcctgaagactagctgtcttcccactc

SEQ ID NO: 11264 - DNA, 121 bp, Artificial Sequence
  Synthesized
  misc_feature (61): n=a or g
agttggtgtgacatttccatttggggtaataccttttcattattcaatgtatcgttcccanaagactaactttttgtaggtgtaagatttcactatcagcgtggacttggttttattaaaa

SEQ ID NO: 11265 - DNA, 121 bp, Artificial Sequence
  Synthesized
  misc_feature (61): n=a or g
ggcagggaagcacaggcactggctggcacccagggagagggtttgtggatttgagggctcnggagcattagggaggctgttacacaagatctctctgtgatagtggggttgtggctctagt

SEQ ID NO: 11266 - DNA, 121 bp, Artificial Sequence
  Synthesized
  misc_feature (61): n=t or c
ttacaaacctaactccactgcccttgactacagtggtccactctgtgtgtttcctctgtcntccatatgtaattcctcttttaatatttcaaacctttatatttgttccctctaacctata

SEQ ID NO: 11267 - DNA, 121 bp, Artificial Sequence
  Synthesized
  misc_feature (61): n=a or g
gaaatcccttcctacctcccactacttccagtagtttctcagagaagaacaattgctccancagtttgcttttcttgcagttatgaagacagtgaaagaaacttgcccatggcaaatgtag

SEQ ID NO: 11268 - DNA, 121 bp, Artificial Sequence
  Synthesized
  misc_feature (61): n=t or g
tcattactctcttttaccagttactatgccattttaattttatgaattaatagcaattaanagagcattactagcttccttctgcatttagtttactccctacagtcacatgccattgttc

SEQ ID NO: 11269 - DNA, 121 bp, Artificial Sequence
  Synthesized
  misc_feature (61): n=c or g
catgaaatgttcattgggcaattatcttttgatgctgagtactgcagtggttgtctgcagnttctaaggccgcacacagccacaaacactatcatcaaagtacatctcacacagtcacctt

SEQ ID NO: 11270 - DNA, 121 bp, Artificial Sequence
  Synthesized
  misc_feature (61): n=t or c
taatcactgtctagagtatctcagcagacactccatgacaaagttcaaaagaaacttcctnattcctctggaaggcaaaaaacagtgggaaaactagaggaatttatgacccagaggaggt

SEQ ID NO: 11271 - DNA, 121 bp, Artificial Sequence
  Synthesized
  misc_feature (61): n=a or g
tctcttagctgagctctcggggcgtcaccgtgctgccaggctcctcgccctcccttcagcntggctctgctccacgttccgctgcttcctcttttcagctggataacctgacgctgatgga

SEQ ID NO: 11272 - DNA, 121 bp, Artificial Sequence
  Synthesized
  misc_feature (61): n=t or c
cagtaagtggagtggaaatcttcaggaattcatagagagagttgacctctatccatcttcntgtggacaagcagattttcctgtgagctgtttacaaatggtgagtactggctggaggaat

SEQ ID NO: 11273 - DNA, 121 bp, Artificial Sequence
  Synthesized
  misc_feature (61): n=a or t
atagcgttcaactctggcaggcatgaaaatggattatgaaaataacacatgatcagggacnaacactcttccttatgcccaacacatttgtccaaacaattatttaccattacaattcaca

SEQ ID NO: 11274 - DNA, 121 bp, Artificial Sequence
  Synthesized
  misc_feature (61): n=a or g
gcagatctgctactttttcacgtataaactgccctctgcaaataaaagcaatccggccttncagtgaaagatatcaaacacacatggacacaggagctttgtgaactttcccatgagctag

SEQ ID NO: 11275 - DNA, 121 bp, Artificial Sequence
  Synthesized
  misc_feature (61): n=a or c
ttttcaaatattttcagtttgcagatttactgatctgaccttagctaactctttaatttcnaagtaaattactttttcacaaacttggcaaatctcccttttaaactgtgtaaccttttag

SEQ ID NO: 11276 - DNA, 121 bp, Artificial Sequence
  Synthesized
  misc_feature (61): n=t or c
atctagccaaaccacactgggggatgggaagtgaaatggatgtatggatgctctgtgagtntggtggacagcgcaaaattgaacaggtaccaaacaagtgcttttatgttaaaacatgcat

SEQ ID NO: 11277 - DNA, 121 bp, Artificial Sequence
  Synthesized
  misc_feature (61): n=t or c
aaaagtccctattaatctacctcatttatatagaatttagctactgctactttagaggcanggaaaagacatttgatatgcagctatatacagtgagattgggtgaacctaccctttcttt

SEQ ID NO: 11278 - DNA, 121 bp, Artificial Sequence
  Synthesized
  misc_feature (61): n=t or c
gaaaaaggatctaagcagctgcttttgttgccaaaagctcccttgattgcatcacatgcanggctcaaatcagtcacactgaacacagtgtctcactgataattacaacgctttatctgga

SEQ ID NO: 11279 - DNA, 121 bp, Artificial Sequence
  Synthesized
  misc_feature (61): n=a or g
cgtagcctaaccctcatctaattactggaaaaagcctttagctggcacttgtaacttttantagatgctggaagaagatgaggtggagaaaaggatttcatgagctcggaaggtgagtgtg

SEQ ID NO: 11280 - DNA, 121 bp, Artificial Sequence
  Synthesized
  misc_feature (61): n=a or g
tctgccgtttctctgagtaacttgtccaagttgctgaatattctggagacccacttccccnttctgaaaaggggacaacaatactgcttttatcttaggttatgaggcctctggggtagga

SEQ ID NO: 11281 - DNA, 121 bp, Artificial Sequence
  Synthesized
  misc_feature (61): n=t or c
atgaagataaaatatcttttatctcaccgtgcagacagtataccagctggtgtatcagccntcattggatgtcctggtttgactgggacagaactaattttctttgtagtacttcatacat

SEQ ID NO: 11282 - DNA, 121 bp, Artificial Sequence
  Synthesized
  misc_feature (61): n=a or g
ggagatgagctcactgtggagcaagagttgtgatgggagctgcatctcgtaatgagacccncgatggagtagtgtatgccagaatgactttactccttggcttgggtccaaattgcattga

SEQ ID NO: 11283 - DNA, 121 bp, Artificial Sequence
  Synthesized
  misc_feature (61): n=t or c
tgatgtggtgaggtcatacggcttttaaatagagacagaaagaactggtctgaaataattnataatgccatcgtctaagagaatgatgttaaccaggaaattgagaagtgggagtacttat

SEQ ID NO: 11284 - DNA, 121 bp, Artificial Sequence
  Synthesized
  misc_feature (61): n=t or c
tctgtggcagcgggcagcatcttcatatgaactggaaaatgtcagtggagaagctgttttnctgccaccagtcttacatggcttcacatttatctgtcttgccaccatgcgacagctcctg

SEQ ID NO: 11285 - DNA, 121 bp, Artificial Sequence
  Synthesized
  misc_feature (61): n=t or c
aaacaaacaaacagaattcccaaaccacaaagcccacaaattatgtatgtagctagtctangtaatcacaagttccctttatggttacttttatcttccatctctctcaagcttccctctg

SEQ ID NO: 11286 - DNA, 121 bp, Artificial Sequence
  Synthesized
  misc_feature (61): n=t or c
aacaacaccgtcccgtacactttaccacctccctaatatttacgaggcatttaaattcctntgcacttgaaagcacgttaagcacgaagttcaccgtggctggaatttgctgctgcaacaa

SEQ ID NO: 11287 - DNA, 121 bp, Artificial Sequence
  Synthesized
  misc_feature (61): n=t or c
gctccgctagctttaacctgcagagcttggtgtcccagtttatttataatggtttaacccntaatgaatagactcttgcacctctcaccatcttcttaaagattagatgtctaagcacacg

SEQ ID NO: 11288 - DNA, 121 bp, Artificial Sequence
  Synthesized
  misc_feature (61): n=a or g
caacactcttttgaagtactcttgctgatttcagatagagttgcacttgcaaaggtcatcncatatcaagaacaaaaacagtgcttgaataactctgtggatttggcttgaaaaataaaaa

SEQ ID NO: 11289 - DNA, 121 bp, Artificial Sequence
  Synthesized
  misc_feature (61): n=a or g
aagcttccaggtctctgatgtggcaatgggaagttcttctgagctattccccatctggatncatttatggctcctgacagttttgatcatgacttcttgaaatttattctccgtaagcttt

SEQ ID NO: 11290 - DNA, 121 bp, Artificial Sequence
  Synthesized
  misc_feature (61): n=a or g
atcccctataggagaaaaaagaaatccactcggctcttccacaaatactactatgcaaaancaaaaatccttagagcctgagaaagacctctattaaggaggaatttccatatgtttggta

SEQ ID NO: 11291 - DNA, 121 bp, Artificial Sequence
  Synthesized
  misc_feature (61): n=t or c
cttggcagttggaactcatttctctgctgcaggtgggcaaaagtcccaagctaaagcctcntggctcttgctgacaactgggtagaaggttttgttttctaaggatccaatcatacagtac

SEQ ID NO: 11292 - DNA, 121 bp, Artificial Sequence
  Synthesized
  misc_feature (61): n=a or g
actggatcgggagccaaccgtctgatctgtacagaaccccaccagatttgggagctgtcgnggaggcttgcccatcaggcacatcgcactgcaaaccccacttggaagagttaaaaaggct

SEQ ID NO: 11293 - DNA, 121 bp, Artificial Sequence
  Synthesized
  misc_feature (61): n=t or c
ggctaaagcatccttttaattgggttgtactattgtttaatgaagtctcattaatcttttngtatggtaaaaaagggaagcagtaatttaaataagacggtttggtttgctattacatttg

SEQ ID NO: 11294 - DNA, 121 bp, Artificial Sequence
  Synthesized
  misc_feature (61): n=t or c
tgcatttctaaattgccataatgcactaaagtatcatatttgattagagtatcaagctganggtgctacgcaatcataactacatatacattacaaatcactgagaagtgtctaattgttc

SEQ ID NO: 11295 - DNA, 121 bp, Artificial Sequence
  Synthesized
  misc_feature (61): n=c or g
gactgtgaagtgcatgcttgaattgtgtatttcctgcaaaagctggttcttctgctgtctntaagtctgctaataagtttctgtgggcaaagcctcatcctcatgtttcttgtcatctctc

SEQ ID NO: 11296 - DNA, 121 bp, Artificial Sequence
  Synthesized
  misc_feature (61): n=a or g
ttctgtggacaagtaattgcccctaggaatttccatagcaatgacaatgtcctgtgatggntctggtatgtactgatatatgatctctatgtccctacatggagaaaaaggcgtagagtct

SEQ ID NO: 11297 - DNA, 121 bp, Artificial Sequence
  Synthesized
  misc_feature (61): n=t or c
aaactacagtcacattctcaccaatgtcaagtcttagtctaaatatagatgtccatttttnataagttatgaatattgatttctgaatgcatttggcttaggcatatacaacagagaagag

SEQ ID NO: 11298 - DNA, 121 bp, Artificial Sequence
  Synthesized
  misc_feature (61): n=a or g
agcattaagaacatttggacattcatctccatgtccaaacatggcactccagtagaaaagnttaaaaaatgaagttggaggcacagaagaaaaggagaacagaggagagcagagaaagaag

SEQ ID NO: 11299 - DNA, 121 bp, Artificial Sequence
  Synthesized
  misc_feature (61): n=t or c
tgtgctctgggttctcagacagcagccatcacttaccaacttgaatctctacagcactacnggacctctcgaagaagttcagagccagctcaggaagagcacaacagtaccaggtgcaatc

SEQ ID NO: 11300 - DNA, 121 bp, Artificial Sequence
  Synthesized
  misc_feature (61): n=t or g
agtggttttttttgtttgtttgtttgttttgttttgttttcctaatgggtacaaagaacancaactgaatttaatgctgaaatgaggctttatgtgcttatctttggtaagagatcagacc

SEQ ID NO: 11301 - DNA, 121 bp, Artificial Sequence
  Synthesized
  misc_feature (61): n=c or g
aagaaggaagaacaaaggattataaaatgctgctgaaggaggaaaacccaaagctggaaantcagtgcaatatcaccctggaagccccaaaaggtgaggctgtaggaaacatgaatcacct

SEQ ID NO: 11302 - DNA, 121 bp, Artificial Sequence
  Synthesized
  misc_feature (61): n=a or g
tttgattctgtgtagggttttcgaagtggggaccttcactcttcacgtctgcatcgtagcntatgttccgccttcttcctaaacgaggcgaggttttgatggcacgcttcgattaccatgc

SEQ ID NO: 11303 - DNA, 121 bp, Artificial Sequence
  Synthesized
  misc_feature (61): n=c or g
tactcacaagagtcatgctttgtactcagattcttgacacaagagtatacttttgaggtgnttaggacagccatgccttgtctagtctgtttcactcacactgctcacacttctgagtcca

SEQ ID NO: 11304 - DNA, 121 bp, Artificial Sequence
  Synthesized
  misc_feature (61): n=t or c
cgtgcttcgtggtgatgagtgtgcacactggaagagctgactgctcccaccttgattttantgcatagagcacgagtctttttgctgttagtgtggctgcacactgtggggctgagcagca

SEQ ID NO: 11305 - DNA, 121 bp, Artificial Sequence
  Synthesized
  misc_feature (61): n=a or g
caaaatttatggaatcactgaattgctgcagaaagaagaaagtgtgaaaaacaccacaaangagaggaagagaaatctctaagattaataaattttaaaaatctaacagtaagtaatgctt

SEQ ID NO: 11306 - DNA, 121 bp, Artificial Sequence
  Synthesized
  misc_feature (61): n=a or t
ggaattcctcttctgatctcaccagtaatatggtgggctatctctctcaatggcagcaganccagaattcttaagccaaacgttaaaaggtcttggcttttcaaacatgctcttgtagagt

SEQ ID NO: 11307 - DNA, 121 bp, Artificial Sequence
  Synthesized
  misc_feature (61): n=t or c
tctgttcagagcctagaaatcactgcataaatccagccatgactttctgtactagatgatncacatcctcaagaaatttagtctctcacaccaaccagtcatcagcttcccttcaagaaca

SEQ ID NO: 11308 - DNA, 121 bp, Artificial Sequence
  Synthesized
  misc_feature (61): n=c or g
agcttaggatggagtggggggcttcgtaaaaactgaacctatcaggtaggaacatatgtanaaaaatgtgtctgagtccaaataatctttttttttttttttttttttttaagggttacta

SEQ ID NO: 11309 - DNA, 121 bp, Artificial Sequence
  Synthesized
  misc_feature (61): n=a or g
atgggaattatttcgtaaatagcagcaaacattcatctgcgatgtgaattggtctggctcnctgcctcttttttctacttaaacgaaacactgtttgcacggggacgatgggttttggatg

SEQ ID NO: 11310 - DNA, 121 bp, Artificial Sequence
  Synthesized
  misc_feature (61): n=c or g
tcaaagtcctccaggcaaacatacacagcttcatgcattctaagaagcttgggttttcatntatcaaaagtttagttcagtagtcagtcaccatctatttaattactcaattcaactgaat

SEQ ID NO: 11311 - DNA, 121 bp, Artificial Sequence
  Synthesized
  misc_feature (61): n=t or c
agggagatttttcaagtgatacagtgcaggtaaaaagggtgatagatgtggcagacaatangagtttcatggtgcttctgggcagtacaaagaggaacaactcatgaggaggaaacaaact

SEQ ID NO: 11312 - DNA, 121 bp, Artificial Sequence
  Synthesized
  misc_feature (61): n=a or g
atttctgccaggcatactccttgtaaggttcagcgttagctgttgcattgctctgtgtaantagtagcccttagctggattggtgatacctttttccaaaaagctgcttctgctatttcaa

SEQ ID NO: 11313 - DNA, 121 bp, Artificial Sequence
  Synthesized
  misc_feature (61): n=a or g
agcccctgtagtgctgaagcagaagtggcctggtgaactgcctcctttgccaggacatgcnctcagcttcgggtcgatgctggagctgcctcccatgcacacaccatgtgcccgggagctc

SEQ ID NO: 11314 - DNA, 121 bp, Artificial Sequence
  Synthesized
  misc_feature (61): n=t or c
aaattgggatctgaactttgagcttcagagttgaaagttcagcatgttgactcttccgtgncatgcagcatcttctgagtttgcagggaaatgcacaggttgtgcagtcggtgtttttaac

SEQ ID NO: 11315 - DNA, 121 bp, Artificial Sequence
  Synthesized
  misc_feature (61): n=a or c
cagatagttatttcaagattttcattaaatggtcaagatttctattgactccatttagatnatgctcaaaatccccatacgaatattactaattcctttctcctttaacaattcacattcc

SEQ ID NO: 11316 - DNA, 121 bp, Artificial Sequence
  Synthesized
  misc_feature (61): n=t or c
tgtggaaaagacagcaccaagggtgtatggaagtgcttgtaactacattactacaaagatnctgagcagtttattttctggttttttggaacctgcaaaatggttttcctgtttttcaccc

SEQ ID NO: 11317 - DNA, 121 bp, Artificial Sequence
  Synthesized
  misc_feature (61): n=t or c
aattacaaagatgattattgtattttagccatcttaggcacagaggctttcataagtaagngtaagaagtttaatggaacacaactcagtttagaataaaacattatttttcatctgacac

SEQ ID NO: 11318 - DNA, 121 bp, Artificial Sequence
  Synthesized
  misc_feature (61): n=a or t
catttcttccccgtaattgatgtcaactttctgccatacaagtctattaaatgttgctacnttccagtgcacatgttgctgtaactagatattgtactttctaagctcagatgagacagct

SEQ ID NO: 11319 - DNA, 121 bp, Artificial Sequence
  Synthesized
  misc_feature (61): n=t or c
aacacgtgggagcggtttcaagtctaaatctgtgcagagcaggagatggtgtctcaagtcntctcctccagacctcaccttgcaagtggttttccatcagtggcaaatgcagcatgctttc

SEQ ID NO: 11320 - DNA, 121 bp, Artificial Sequence
  Synthesized
  misc_feature (61): n=a or g
aagaatacttcataactctgaagtttatgcatgtacttaaaatggtgtgtttgtttttatntgttttgtgatcaaaagacaaaaggaagtatgtactgtccacgagcaaagacttcttaaa

SEQ ID NO: 11321 - DNA, 121 bp, Artificial Sequence
  Synthesized
  misc_feature (61): n=a or t
attagctgtcattcactttttaacaactttatttagttctccactcaataaccctaccacntattaaaatcccactgtgtaatatttcagtgctcttcttagactttttttcagattgtat

SEQ ID NO: 11322 - DNA, 121 bp, Artificial Sequence
  Synthesized
  misc_feature (61): n=t or g
acttgtccattcttacatgcaccagagcttgtagttgacaagtttatcttagggaccatcncagtagcaagattctgacataatcttagcaggctgtgcaagctgacatttgctactccac

SEQ ID NO: 11323 - DNA, 121 bp, Artificial Sequence
  Synthesized
  misc_feature (61): n=t or c
actattggattaattgccatgtgttgctcaaatacactgcagcttcattaatgacaaggtnatatttcaaacctttcagcccactaatgcattccattttgaattctgctgtgaaaccgag

SEQ ID NO: 11324 - DNA, 121 bp, Artificial Sequence
  Synthesized
  misc_feature (61): n=a or g
gtgtcagcttggaggaacaacagataaatgctctgctggaattatctgcaaacggatggancaatggcatttttgagaacctaactgaaaaattagtgatagaaaacatcaaaatcaaagc

SEQ ID NO: 11325 - DNA, 121 bp, Artificial Sequence
  Synthesized
  misc_feature (61): n=a or g
tggcttttgaaatctaacacctgtcatgcagtttgtgtcttttaagaagtatcttattgangagttatttatatgcaactggaacttattcaaagccataaactttacaagttattattaa

SEQ ID NO: 11326 - DNA, 121 bp, Artificial Sequence
  Synthesized
  misc_feature (61): n=t or c
ccatttacggccatgaacaagactagggataggctggattagggtttaggcttagagatantgagttcctgtacctgtttggcctccaggcctgtgagcaggatcctgatgtgcagaagca

SEQ ID NO: 11327 - DNA, 121 bp, Artificial Sequence
  Synthesized
  misc_feature (61): n=a or g
ccttactacaatgccagggttaccatttgcctctaaaagccgtagcagttagatacagtgnctgagtaggcagtggactcagctgaaaacccttgcatgccaccttgcatctgagaaactc

SEQ ID NO: 11328 - DNA, 121 bp, Artificial Sequence
  Synthesized
  misc_feature (61): n=t or c
cttcatttctccagtagatctaggggtaatcctgcttatcaatgtaatttctctgccagcngtacacctagctattgctgtttcccagctgcaatcagcagctagtgcagtactcctccgt

SEQ ID NO: 11329 - DNA, 121 bp, Artificial Sequence
  Synthesized
  misc_feature (61): n=a or g
tgaatctgtaaaaattattaattatgtaattatatagtccttttttgattatttgccccanaactgatactttcctggatatcaataaaagttgctgaaaatcacgtatatattttttttt

SEQ ID NO: 11330 - DNA, 121 bp, Artificial Sequence
  Synthesized
  misc_feature (61): n=a or g
aagcgagaggcatataaatccttgggctgtttgttgtgatggaatctgggcaagaaaaggnacttggagatcatgatggaaaatacttttaaaagcagttactctgtggcagcagctttgc

SEQ ID NO: 11331 - DNA, 121 bp, Artificial Sequence
  Synthesized
  misc_feature (61): n=t or c
gggtatatttaaaaagtggccttactagatcttctgaaatccttccaaaagtgctactatnatatactagacaggttgtgtattccatgtatttcattttacaccacagaaataattacag

SEQ ID NO: 11332 - DNA, 121 bp, Artificial Sequence
  Synthesized
  misc_feature (61): n=t or c
agctttgagtatactagttttgaaagcaagaggataaataacctcaaaccgtacacttccncctagaaatcatttcacctcctgctatagatttggtgtaaaccagatataactcactcaa

SEQ ID NO: 11333 - DNA, 121 bp, Artificial Sequence
  Synthesized
  misc_feature (61): n=t or g
agatggtaacacctctggccaatacaattatctgtatatttcccttctccagagtatccangttttttcttaagtctcatttactgatccttgtgtgcatactaagacctaaggagaagat

SEQ ID NO: 11334 - DNA, 121 bp, Artificial Sequence
  Synthesized
  misc_feature (61): n=a or g
tgtgatggcctctttatactgaactaaaataggacttggggcaagatagaggctgtaaatntggaaaaactacaagtcaacattagaaactttgggaagttcaattttggttaaactgaac

SEQ ID NO: 11335 - DNA, 121 bp, Artificial Sequence
  Synthesized
  misc_feature (61): n=a or c
cagtcacaacagcaaaaatgtccatattcagtaggtaatattgacaaggatactctactgncagtttgactctgtccaatggattgaatagcagcagctttctcacaagtctaagaactga

SEQ ID NO: 11336 - DNA, 121 bp, Artificial Sequence
  Synthesized
  misc_feature (61): n=a or g
gcaaggaggggacgcctcaccatcagcgtgactttcagaaggccatttgcaggatgaaaancaatgctccagcaccaaataaagtaaaataaaataaaacttgacttcttcgctattgctg

SEQ ID NO: 11337 - DNA, 121 bp, Artificial Sequence
  Synthesized
  misc_feature (61): n=t or c
catcagggagatgagctcatctcacagctacacacagagcagtagctcagcaccactgacncaggtttttgggtctgaatggctctgcagagaaaagtggggcagccatcttccgaggagc

SEQ ID NO: 11338 - DNA, 121 bp, Artificial Sequence
  Synthesized
  misc_feature (61): n=t or g
gccatcagtaactggtttagatttttctgcaataaggtttgctgccacataattagctttnataattcagaccatttgagttgtaactttaaaaaaaaaaattgttgaggtgacatttttc

SEQ ID NO: 11339 - DNA, 121 bp, Artificial Sequence
  Synthesized
  misc_feature (61): n=t or c
aactgaccaggacaggatggtgccctttctctgcataccagctctttttcataccagcttntgcaggagcctgccagcattagtgaacttctgcatgatttaaaggccagttgccacatgg

SEQ ID NO: 11340 - DNA, 121 bp, Artificial Sequence
  Synthesized
  misc_feature (61): n=a or g
attactatgcactagtttatttttttttgttaagcaaggaatcaccaccacctcggtcatntcagctgaagacatcttccagataagccttacccctggggcaaacacgacacacacgtaa

SEQ ID NO: 11341 - DNA, 121 bp, Artificial Sequence
  Synthesized
  misc_feature (61): n=a or c
aaagttttacagtatattttcagttcacttcctttatatatgagcatgcttttgaataaancactccccatttcaaatactaattttgtctgtgactcatacaaaaatgttaaaggaaatt

SEQ ID NO: 11342 - DNA, 121 bp, Artificial Sequence
  Synthesized
  misc_feature (61): n=a or g
tctctaccagcagttttcaactgcctgatctttaggacagctggagtgttctttaggcacntgcgttgtctctcagggaattggtaaataagtaaaaatgatataaaggaaaatggaatta

SEQ ID NO: 11343 - DNA, 121 bp, Artificial Sequence
  Synthesized
  misc_feature (61): n=a or g
tacaactctgatttgcagcctcttatcccagggcttgcatcaggaactccttacaacaccntttctcagacattctgatattttcagtgactccagccagcctgactcacacctccttatg

SEQ ID NO: 11344 - DNA, 121 bp, Artificial Sequence
  Synthesized
  misc_feature (61): n=a or g
ttataaataatctgttttatttacacagtacattattttcatccagctctctaattcttcncagtactcagaggtttgtttgtgatattattttgtcggtgatggttgtttttgtgtttgg

SEQ ID NO: 11345 - DNA, 121 bp, Artificial Sequence
  Synthesized
  misc_feature (61): n=t or c
gttttcctaaggttaactatctgtacttactttctgggaatagtcttattttcagtatcantagctcagtatacaattgttttaaatggcatagtcaacgttagtaatgttaagaaaattg

SEQ ID NO: 11346 - DNA, 121 bp, Artificial Sequence
  Synthesized
  misc_feature (61): n=t or c
agctcccatttctcccttcccaagcaaagtgatgcacagcattacacatcagatttccctnctctgcattgcctgctgtttctaggaggaagcctattcacacaacttctgcttcttttct

SEQ ID NO: 11347 - DNA, 121 bp, Artificial Sequence
  Synthesized
  misc_feature (61): n=t or c
taaggttctagactattcgaaaaggtgtatccaaagacccacacataataatcagtccaangagaaggtaggagatgaaattgtggtgattctgtactcagcatccccttaccttcatgca

SEQ ID NO: 11348 - DNA, 121 bp, Artificial Sequence
  Synthesized
  misc_feature (61): n=a or g
gtgtgctccaaggaaaggaaaaagaaagatggaggtctcgttctgcctatatgagtcagcncagcgagagctggaaataaaactgcattactgtctgctggttcatctttggtttagtaat

SEQ ID NO: 11349 - DNA, 121 bp, Artificial Sequence
  Synthesized
  misc_feature (61): n=t or c
tgccatagaagggtcaaaaacttcaaaaacagctttacttcttgtggataataagttcttntacttctgggccttggttcagcaattatgtagaattatgttttacttttattcctctttg

SEQ ID NO: 11350 - DNA, 121 bp, Artificial Sequence
  Synthesized
  misc_feature (61): n=t or g
tgcaagaacttactttttagacagcgttttcaccaccatgaaaacaataacagattcaacnccaatggcactaaggattattccattataaaaaacagctttttccctggtccaggaatac

SEQ ID NO: 11351 - DNA, 121 bp, Artificial Sequence
  Synthesized
  misc_feature (61): n=t or c
ataatccctctgatgggtaaacaaggcagctaaagtgctcagttagactgattcctgcttntggttttgaaactcattctatattcacctttatgtagccagaagtcaagcattagatcaa

SEQ ID NO: 11352 - DNA, 121 bp, Artificial Sequence
  Synthesized
  misc_feature (61): n=c or g
cactccctcggtgtgtcccagaatagaacacctgcttcttaaatatatctgcagttttcanctccattctgttaagagtttgatggtcattctttattttgaatctttcgctatcatcagt

SEQ ID NO: 11353 - DNA, 121 bp, Artificial Sequence
  Synthesized
  misc_feature (61): n=t or c
ccctagcaaagcagcagagaacccatatcagggagctgggatgcccagagcatcttctccnatcatctcccttaacaaagccctgctgggcactgggatgctcagaccagggcacagcact

SEQ ID NO: 11354 - DNA, 121 bp, Artificial Sequence
  Synthesized
  misc_feature (61): n=a or g
gcaggaaaattgtgtcaggctgcttctggcgtaattccatttgtttctcctgcaatgacanttaatagagaatgaaagcacctatgggacactgagagttcagtttcctttggcagtggtc

SEQ ID NO: 11355 - DNA, 121 bp, Artificial Sequence
  Synthesized
  misc_feature (61): n=a or g
ttctatgattctgagaatgaacagccctaagttttacatggttctgaaatctggaatcatnaattctcaaaaatgaagcgaaatggataatgaaatacaacccagaaccgatcagctagca

SEQ ID NO: 11356 - DNA, 121 bp, Artificial Sequence
  Synthesized
  misc_feature (61): n=a or g
actggtggaggactctactaattatcacagtggaaagaggaacgatttgcctttgccacanaaacaaacctctgcgcttgttaactcagcaaaaggaaaagtacagagaggtgttaatttg

SEQ ID NO: 11357 - DNA, 121 bp, Artificial Sequence
  Synthesized
  misc_feature (61): n=t or c
catgctggtaaaagtggactactaagctactcaaggaaaataaattgaagaggaatattanttgtagacctgaaagctagggaaagttgaagtgttataattaagatcaaagttacatagg

SEQ ID NO: 11358 - DNA, 121 bp, Artificial Sequence
  Synthesized
  misc_feature (61): n=t or g
gcttaaaaaatatagagagagaataaagctaccaataatattgtgctgttttcttcacaanttgggtagcggccttgtttgtaaaataactattcaccaatgtgaatgagcacttagcagc

SEQ ID NO: 11359 - DNA, 121 bp, Artificial Sequence
  Synthesized
  misc_feature (61): n=a or t
atttctgcagtaacaatacacagtgtaaacagctttccaaaactcactcccaaaagtattnacaacaactaacaacaaaagtcaggagcagattttccctcatttttgttatccaacaaca

SEQ ID NO: 11360 - DNA, 121 bp, Artificial Sequence
  Synthesized
  misc_feature (61): n=a or g
gaagcagtttcttttattattttttatttttctagggtgaagaattaataagctaagagancaactcagtttggaggtcacctggttcaggccttccactcaaggtagatccaacttagat

SEQ ID NO: 11361 - DNA, 121 bp, Artificial Sequence
  Synthesized
  misc_feature (61): n=a or g
aacaggttgtctgtggtctctgggctctttggagcatcctccacctctaccgtgtgagtgngggcagtctggagccttgcggagggagagccttgtgcttatggctgagctcaaggagctg

SEQ ID NO: 11362 - DNA, 121 bp, Artificial Sequence
  Synthesized
  misc_feature (61): n=a or g
tttataccatctggctaatggtacaatctgcaaaaatttcacaaaaatggtggaaaagacncaaagggaaatgaccaaagtagagcacaaaaggaggtccagcaggcagggcacagttttt

SEQ ID NO: 11363 - DNA, 121 bp, Artificial Sequence
  Synthesized
  misc_feature (61): n=t or c
accagcagctgctctcctcgcaccagtaggggcacagacaccattaagcatcacctctgcnccaaaacccagcctgcagttgccagccgtggctggaggtgcccaaggccagactggacgg

SEQ ID NO: 11364 - DNA, 121 bp, Artificial Sequence
  Synthesized
  misc_feature (61): n=a or g
ttgtagccttatcaaagattaagaatggattcaatcgagtatacacggaagaaagttttcngagggtacaactcagctgtttgtgtttgtttgctttttctaataaaggtggaagaaacaa

SEQ ID NO: 11365 - DNA, 121 bp, Artificial Sequence
  Synthesized
  misc_feature (61): n=t or c
aacaagaaatatgctttgctaaatcaacttacaatcatctgtcagtgcgttctgtgtatantgatttatatgtaagcctgcatttttctgaaaatgccacttataaaaatgaattaaaaat

SEQ ID NO: 11366 - DNA, 121 bp, Artificial Sequence
  Synthesized
  misc_feature (61): n=t or g
tcatcctgttgggctttgctaatgcaccctcccgaggcagcagtagcactagatatcatancagtgtaccagctagcattaccaacattttgtttccatgtacacatattcaactgtcttt

SEQ ID NO: 11367 - DNA, 121 bp, Artificial Sequence
  Synthesized
  misc_feature (61): n=t or g
tttcctgcactggatctggagcaatctaaagtgaatatgcagaatggggaaggaaaggtgngaagaaaacaaactttgtgtgaatctgggttgcacaaggagtactgcactgatgcatttg

SEQ ID NO: 11368 - DNA, 121 bp, Artificial Sequence
  Synthesized
  misc_feature (61): n=t or c
ctgcttctattgcacttgaatccaatttataacaagtttaggaggagtgattgtgaactgnagaggagggactgattttatcatgcttattgagttgaggatacatggttggttttttttt

SEQ ID NO: 11369 - DNA, 121 bp, Artificial Sequence
  Synthesized
  misc_feature (61): n=t or c
gcatacatctacaccttcccacgttcataactgtagcacagtgagtaacaaaaccatttcntccctcccctgttaatcctacatccagaacctgccaccacctcttacctcttccacagtt

SEQ ID NO: 11370 - DNA, 121 bp, Artificial Sequence
  Synthesized
  misc_feature (61): n=a or g
agcctatgttttatgtgttgtttttgtcaattttcttttactgctagcagagcaaaagacnaatgtgttccatgtgtatttgagagaagggagattagcatagccctgagaaaagaggagt

SEQ ID NO: 11371 - DNA, 121 bp, Artificial Sequence
  Synthesized
  misc_feature (61): n=t or c
atgattcagtttctagctctggctgctcaatcatgctgtagaagctgtgacgcttgccagngttccatctctaagtatgatttgtccatagacttgtttcctttttgctgtttctaacatc

SEQ ID NO: 11372 - DNA, 121 bp, Artificial Sequence
  Synthesized
  misc_feature (61): n=a or g
acagttgagttttttattactgatggtagtatttaattctatgccattgtttcaccttcantgtggttactctgggggatacatttgagttcagcatcttatttcatgttctctgtgggtt

SEQ ID NO: 11373 - DNA, 121 bp, Artificial Sequence
  Synthesized
  misc_feature (61): n=t or c
aaacacttaaaggtgccaagagtcaagcaaccactaaagatacttaagctcccacttaaanctattacacacgctttttttctaacataaaactcagtgtaaaaatagccttcaccaaaag

SEQ ID NO: 11374 - DNA, 121 bp, Artificial Sequence
  Synthesized
  misc_feature (61): n=a or g
cagttctggggattttgattttcaaattattttatgtgttatactttgtatggcttaagcnatagcaatgacaaggaaagagatatggaataagagaagcagatgctggaccaataaaaga

SEQ ID NO: 11375 - DNA, 121 bp, Artificial Sequence
  Synthesized
  misc_feature (61): n=t or g
acctggtgggcatcaggcagtgtgcatctcctgtgctccagtaggagcaagaatggagaanccagactcttgcatacaaaagaaccacttagacccaaatctgagcagtgtccagctcctt

SEQ ID NO: 11376 - DNA, 121 bp, Artificial Sequence
  Synthesized
  misc_feature (61): n=t or c
ttacatctacagtctatatggaaatagcaaatagaaataacttagtggctgagtcctcccngggacacaactatttgaatgtcttagtgactctttttttccctcctcagaaaactcaaac

SEQ ID NO: 11377 - DNA, 121 bp, Artificial Sequence
  Synthesized
  misc_feature (61): n=c or g
tttaactaccataaacacaaacagttcctttataaaatccttcatatgctggtgcaaagantggactgttttgtagcgtaagcagaacatagttaatcagaccaatgtattttgctgcagt

SEQ ID NO: 11378 - DNA, 121 bp, Artificial Sequence
  Synthesized
  misc_feature (61): n=t or c
tttatttgggatcaagtgtagccaatttgtcctctgtgcttattttttccccaattcttantgagctagttcagtatgcaagtaaagtctcacagtcagtggtaccgtatggaagatatgt

SEQ ID NO: 11379 - DNA, 121 bp, Artificial Sequence
  Synthesized
  misc_feature (61): n=t or c
tatcaggactctaatctctctgtagagagctgaatggctatggcaggcttgacaatgctantcatttttggaaccacaaaagcaaaataagcactcggcacaaaaggatacgtaaagtcta

SEQ ID NO: 11380 - DNA, 121 bp, Artificial Sequence
  Synthesized
  misc_feature (61): n=a or g
aattttcaacttaaaaaaaaaaaaagaatctaactcatggttgcctaagaacataattttntttgcttgggtacaacaggatctgttttcatttctgatttttctctagaaaatcaatttt

SEQ ID NO: 11381 - DNA, 121 bp, Artificial Sequence
  Synthesized
  misc_feature (61): n=a or g
atattagcatttatcttgacatctatcaaattaaacaattcataattaaatgcagtgttcnaactacagctttaggtatgccattccacattttgaatgcagaactttaaaacacggggag

SEQ ID NO: 11382 - DNA, 121 bp, Artificial Sequence
  Synthesized
  misc_feature (61): n=t or c
atattatctgcatctaaatggctaaaaatggtctcacctcatttaacatctgctatattgncccataatagagagtgacttcaatccagatgttattctaatacttaggtaagccatactc

SEQ ID NO: 11383 - DNA, 121 bp, Artificial Sequence
  Synthesized
  misc_feature (61): n=t or c
tgcttttgttctcctaacaggtatacggcttagctttacacaatctattagccccccactnctttcatctgtcttattatatttgcttatttttttcctgcagtctgaagactctcctgta

SEQ ID NO: 11384 - DNA, 121 bp, Artificial Sequence
  Synthesized
  misc_feature (61): n=t or c
aggaatggctgtcagacacatgggtgagcaggaaacaccttatgggaaaaatcaattgcangaagtacttttaggtggctctgagttgacttttatcatttcaaattttaaagtatatgtg

SEQ ID NO: 11385 - DNA, 121 bp, Artificial Sequence
  Synthesized
  misc_feature (61): n=t or g
tcatttgtgtttgttcattgtatgtgttcaattctgggatgtaatttacaaaaagtaaaanatttttcttcacacacatgacatatagcatgcactgtgactaagcgtgaggtgtctggat

SEQ ID NO: 11386 - DNA, 121 bp, Artificial Sequence
  Synthesized
  misc_feature (61): n=a or c
gtacttaagtaaccaagcccatggttaagattatacgtgtatattctaagacctagtttanaatgtaatgtacactgtgatccaacataatttagtacacctcaatagaatgcatgattta

SEQ ID NO: 11387 - DNA, 121 bp, Artificial Sequence
  Synthesized
  misc_feature (61): n=a or g
gtgaaaaccaatccactgtttttcaatacaaaacaaatcctttctctcagaagctgtgatnctaagctgaaaccaatgcttgcttgttttgttgttttgcacgaccttatccacagtcaaa

SEQ ID NO: 11388 - DNA, 121 bp, Artificial Sequence
  Synthesized
  misc_feature (61): n=t or c
gggagctgctgctctgcttaatgctgcctggggtactcgcaggagagagcagcctagcttngggaactgcagacaaacacctcatgggtgagggagtgctgggaagagtaatattgatcta

SEQ ID NO: 11389 - DNA, 121 bp, Artificial Sequence
  Synthesized
  misc_feature (61): n=a or g
tacagcttccagtaaaagccatacacattttcatactccttttcactacaagggattgctngatgtttacttagcgacgcactgtgttgaaagttgaaacattcatctttaaacattaatt

SEQ ID NO: 11390 - DNA, 121 bp, Artificial Sequence
  Synthesized
  misc_feature (61): n=t or c
cagtgatgctttgcccaacgttgcaccatctttgcgcaaagcaaccactttcttcttcctngctgtaaatacaaatcagagtgtctaattaaaaacagccccattccgctgaagtttctgc

SEQ ID NO: 11391 - DNA, 121 bp, Artificial Sequence
  Synthesized
  misc_feature (61): n=a or g
gaaaaaaccccgaccatttcctgcgtcagctgcccataaagacattatcccctcatcaganctgtttcttcagctccaacaccctaccatcaagcacgaaagacactcaatgctttacaca

SEQ ID NO: 11392 - DNA, 121 bp, Artificial Sequence
  Synthesized
  misc_feature (61): n=a or g
atagaggctagttctgtgagttaccaggctgcagggcaatacaacctcagtccgaatcagnaacaatgatatatctgttgaattggccggaacacaaattacggtgtttatgccagcttta

SEQ ID NO: 11393 - DNA, 121 bp, Artificial Sequence
  Synthesized
  misc_feature (61): n=a or g
acataatctggaatgcattcatgacacatagcgataggagcacactggtttgagcatcccnaggatattcaatgttcttgagctgttttaactagtctagagaaatatgtaaatgtgaaag

SEQ ID NO: 11394 - DNA, 121 bp, Artificial Sequence
  Synthesized
  misc_feature (61): n=t or c
attaggggcacaaacataaccacaaacgtatgccactgtttcatatactaataaaactacngtagtctcccagcatgaccaagaatatatgtaagggaaagaaaaattcctacagttacct

SEQ ID NO: 11395 - DNA, 121 bp, Artificial Sequence
  Synthesized
  misc_feature (61): n=a or g
aacttttgcaatgcttacatttgcaagtctgcttaaattacccaaacatgatgctgaatgntagaatagagctgtattctcctccttgcagaatatccctttctttaccttctgactttgt

SEQ ID NO: 11396 - DNA, 121 bp, Artificial Sequence
  Synthesized
  misc_feature (61): n=t or c
cacaggtagtagaccacagtgaatgagaaaaggagtgtagatgaggcagagccatgtgcantcctccctagagccacctatgaataattacactcagtacattatacgtttaaatactctt

SEQ ID NO: 11397 - DNA, 121 bp, Artificial Sequence
  Synthesized
  misc_feature (61): n=t or c
gtgtcaacacctattgtctactcaaggctagagatgaaatgctgctccttgaagcacctgnatctgttcctaagagaggccacttactgtgcattcccagatgtcaccaaagggtgccacg

SEQ ID NO: 11398 - DNA, 121 bp, Artificial Sequence
  Synthesized
  misc_feature (61): n=a or g
tcaagctgagtatctgtggcccccctttaaactgaatgtatatattatgtagttcttactnaagaataggagtttcagattctgttagaattgcaataaaaaccaaacactgccttttgta

SEQ ID NO: 11399 - DNA, 121 bp, Artificial Sequence
  Synthesized
  misc_feature (61): n=a or g
caacaatgatgaattgaactggatgttcactgggttattttggggtttttccttacaggcngttcaacagagacaatcattttaaatggagtttccttagaagtaccatgacacgttttta

SEQ ID NO: 11400 - DNA, 121 bp, Artificial Sequence
  Synthesized
  misc_feature (61): n=a or g
agactgtgttcacactacagagttggtctatacaaatgctgaccaatgagtgcagcagggnaagattatacaataagccgctttttagataagcaagcaacagtcagatcctacatcacgt

SEQ ID NO: 11401 - DNA, 121 bp, Artificial Sequence
  Synthesized
  misc_feature (61): n=c or g
tctgtatgactgcatccaccccatccccacagcactactgccatatattccaaaagccacngagcagatcaatgacataataataatatttatgataggtgatacaataagcatataataa

SEQ ID NO: 11402 - DNA, 121 bp, Artificial Sequence
  Synthesized
  misc_feature (61): n=t or c
agaaggacatttatgcagggtgtgagggtgcaagtgagtcagtacttttacaaggcacagngcaggtggacattggagatgtcatctccagtggtgccctatttctttgccatcagtacat

SEQ ID NO: 11403 - DNA, 121 bp, Artificial Sequence
  Synthesized
  misc_feature (61): n=a or g
tctaactgattcctgatttttgttattagtttctaaaagcattatcttcatttggggatangtgactaacttcattatcttcaaaatactgcttctcatcccactcctattatacctgtcc

SEQ ID NO: 11404 - DNA, 121 bp, Artificial Sequence
  Synthesized
  misc_feature (61): n=t or g
cagtagaagcaatggttctactggaattattcagtaactattctctttcattcactgcacnagaccataactgaaatactacatccagttttggacccatctagaacgaaaacaatatcaa

SEQ ID NO: 11405 - DNA, 121 bp, Artificial Sequence
  Synthesized
  misc_feature (61): n=t or g
atttaaggtccaactttctggtgaaacaaagctggacattatatgtctgaatgatgtggtnccacagaaagcagccgcaggctagagaggctgtcagcactgcaagctcaggaatgcccca

SEQ ID NO: 11406 - DNA, 121 bp, Artificial Sequence
  Synthesized
  misc_feature (61): n=t or c
tagaaagcagaagaaattgatagctgtgctgtattccatttagtaacctacataaatgttnatatttgtaagagagcacatcagtaaatgctggatccgtcagaaggcatgaagtctttat

SEQ ID NO: 11407 - DNA, 121 bp, Artificial Sequence
  Synthesized
  misc_feature (61): n=t or c
agtgtttaatacaaaactcaaaagactgaagggcttgggtgggggaatgctttctttctgnacagaaagctccactgaggcggagctctgaaacttcaggagcttctctttctcccatgaa

SEQ ID NO: 11408 - DNA, 121 bp, Artificial Sequence
  Synthesized
  misc_feature (61): n=t or c
tgcctgtgcatcctggcagcacagaggatcaggagggctcattagctcctctctgctgcantgaagcaagtgcagaaaccttttttgctgtttaactccctcagcaggagaactgactcaa

SEQ ID NO: 11409 - DNA, 121 bp, Artificial Sequence
  Synthesized
  misc_feature (61): n=t or c
taatataataggaatttggagagctgtgacatacaagcaggagtccgtgaagcacaattanaatacttagctaatcaggactgcattcagtagactaaattctcaccttttagatgacagt

SEQ ID NO: 11410 - DNA, 121 bp, Artificial Sequence
  Synthesized
  misc_feature (61): n=t or c
actcattgaattgagccttaaatgttgcaaaccaaaaagcacaatgaaggaaagaagcaancagtgtgcatgtactgtgattaactcagtgacagatgcatatcattcagaaatgaaagaa

SEQ ID NO: 11411 - DNA, 121 bp, Artificial Sequence
  Synthesized
  misc_feature (61): n=t or c
tggcaccagtggcacaggacctacagcacatcatggacttactgctattcaataccttganggctatagctgactagccagaaatctttttagaaaccacttttgatacaacctgaaaaca

SEQ ID NO: 11412 - DNA, 121 bp, Artificial Sequence
  Synthesized
  misc_feature (61): n=t or c
ctggatgggggatcggtgctaatgggagggcagagcaatgcatgcatttccagggggctgngagggtgcagcgtctgcagtgagaaggtgctcagaaagtgccatgctggggcattgcaaa

SEQ ID NO: 11413 - DNA, 121 bp, Artificial Sequence
  Synthesized
  misc_feature (61): n=t or c
tttcctaagccaacagcagatagagcctgactccctaaagtcagattgctgttctgaaagngccattgttatcccacttcaacaagacagtgctgccaccagcaggaagataagaaagcct

SEQ ID NO: 11414 - DNA, 121 bp, Artificial Sequence
  Synthesized
  misc_feature (61): n=a or g
taggtaaacagttaaagcaaaccaaaagctttcctgctgcaaaatttatagtttagatgtngaactctgccccggatatatgctcgtagtttatataggttcaaaaatcaattatattaat

SEQ ID NO: 11415 - DNA, 121 bp, Artificial Sequence
  Synthesized
  misc_feature (61): n=t or c
cccacggaagacgcagacctttctgagttaaaataacgcagtaaacgtggcgagggagtgngaaacgaatcccttgtaggaggcacgaaactcggcctctgaagtacgccgccggtgaatt

SEQ ID NO: 11416 - DNA, 121 bp, Artificial Sequence
  Synthesized
  misc_feature (61): n=t or c
gcttccattagtcaagtataacttttatctgtttaagtcaatataactgcatatgtagagngcatcttggatgatgttctcacccctcagagagtagaattcataaaaccgataacccagc

SEQ ID NO: 11417 - DNA, 121 bp, Artificial Sequence
  Synthesized
  misc_feature (61): n=t or g
cacacacatcctctaattaaaacagcctatttttgttcccaaataatacaacccagatatnttaaagcacttctctgtttgctatactgaagtgttgcagtgctgcgttcctctcttcgca

SEQ ID NO: 11418 - DNA, 121 bp, Artificial Sequence
  Synthesized
  misc_feature (61): n=a or g
tagttcaggtgtaaaaggtaggtgtcaccgacacacccagaagaaaacaacagtcaccacntgaacaacagaggtggcccagagagtggcagggtacagcgtgaccagccagcgaccaatg

SEQ ID NO: 11419 - DNA, 121 bp, Artificial Sequence
  Synthesized
  misc_feature (61): n=t or c
acatttaatttgtctatgctgggctgtggatttggagtgacaaaattattaaggtcagaangctgcactgagtggcaagcataacagcttctcagcatacattcatgaaccagaccgtaca

SEQ ID NO: 11420 - DNA, 121 bp, Artificial Sequence
  Synthesized
  misc_feature (61): n=t or c
tggggctaaccgccagtgctaaacctgagccaggagggtcaccaggaggcttgcaattaangtcagtgatttttccaatctgcctgatggacaactttgtccacgaatcaaagagttgtcg

SEQ ID NO: 11421 - DNA, 121 bp, Artificial Sequence
  Synthesized
  misc_feature (61): n=t or c
tatgcactgcatagtaaaacatagtcatatgtctgtacttcccttcagtgctacaagatgnatgtagacatagtgacagacacagctctcacacattaaatacaccagctctgcaatggct

SEQ ID NO: 11422 - DNA, 121 bp, Artificial Sequence
  Synthesized
  misc_feature (61): n=a or g
gtgtgaaacaatcctgtatgtgacctggcataggtccatgacaggtggccttcagggtacngaagctcgagtctcctgggtgctcaggcagtcaagtggaagcatttaggtttccaaacag

SEQ ID NO: 11423 - DNA, 121 bp, Artificial Sequence
  Synthesized
  misc_feature (61): n=a or c
tttgaaatgtacagacagaggttccctctgctgcagagaggcgaggggaagggtaagatgnatgcttagtcccacaaacagcctttttatcctgttttctgcattgcttttctgagattaa

SEQ ID NO: 11424 - DNA, 121 bp, Artificial Sequence
  Synthesized
  misc_feature (61): n=a or g
gggcatttcatacagccgaggcagacagccttagaagtggcagtcagctctgttaaaggantttatgaaacagaactgagatggagcacagtgataagccctgatatctaacttactgcca

SEQ ID NO: 11425 - DNA, 121 bp, Artificial Sequence
  Synthesized
  misc_feature (61): n=t or c
tataaatgctgctgcaccgtagaatggtaactacatagacttaggtgacatttagctttcnttctcgctgaagaaattgctctgtgttccccagtagcagttcgtggctgagatatcagta

SEQ ID NO: 11426 - DNA, 121 bp, Artificial Sequence
  Synthesized
  misc_feature (61): n=a or g
ttaaggaaatttaaatttcccaacttaggaatttaaagctttgaatgtaaacagctctctnttttatttcatatggtattacaaatatcttttagatgggaaaaaattcttaaatgcttat

SEQ ID NO: 11427 - DNA, 121 bp, Artificial Sequence
  Synthesized
  misc_feature (61): n=a or g
ggaattacttgcatttggcgaggattataatgaaaccctgacacctcaaacagaagttgcntgttttgcctcaacagctcacatccatgctgagtaaaatactgccatcttttggttgtac

SEQ ID NO: 11428 - DNA, 121 bp, Artificial Sequence
  Synthesized
  misc_feature (61): n=t or c
agatctgtgcattttgaaaggtatcatacctcttattgcattcattttattaggatccagngaacaccacccttgtgtactcactcctataacactacacaataaagcctccttggggaac

SEQ ID NO: 11429 - DNA, 121 bp, Artificial Sequence
  Synthesized
  misc_feature (61): n=a or g
tcaagcacaatccttaagcctttaaaatgactttagcaatgtaattctgaacttctcctgnagctatgataaaaacatcatcaaggataacaacaaaggtggagatggagcaaagcaaggc

SEQ ID NO: 11430 - DNA, 121 bp, Artificial Sequence
  Synthesized
  misc_feature (61): n=a or g
agagaaaagttcattgatgggtggcctctggatgcaaattcttgaaatgtatgtgctcccntgggccaccctgtgctcttttgcacagtaaaaggagtgacatttgcaaatgacagcagtg

SEQ ID NO: 11431 - DNA, 121 bp, Artificial Sequence
  Synthesized
  misc_feature (61): n=t or c
tttccccaaaccatgaatttcaatattcattaaatcatttgattgtccaggcctctctaangtcccatcaccaaatcctgtgagacttcacaaagtgctagtttaattgttcattctgcag

SEQ ID NO: 11432 - DNA, 121 bp, Artificial Sequence
  Synthesized
  misc_feature (61): n=a or t
gtgcattacacgctgttcagtgcactttaaagacaaataaagagggtttagacagacatcnattatcctactcataaaatagacgacattataaattcacctgtgctgtgcattgtaccat

SEQ ID NO: 11433 - DNA, 121 bp, Artificial Sequence
  Synthesized
  misc_feature (61): n=a or g
aaaaagcaccgcatctccagacttcccgtgcaacaaaacacagaactaccacaagcagatnaacctatccgtcccaaacttaccataaaagaaccatcaaagcaactctacggatccgcta

SEQ ID NO: 11434 - DNA, 121 bp, Artificial Sequence
  Synthesized
  misc_feature (61): n=a or g
gatgatagaacgtctgaacaatgaagccttgtggtgaaggcggatggtttaagcatctgcntttaattagacaaatacctttaaaacagtagggaataaggctgttttcatcgggcagctc

SEQ ID NO: 11435 - DNA, 121 bp, Artificial Sequence
  Synthesized
  misc_feature (61): n=a or g
gccatgttcctacacagtgaattttcttaggctgagaaaagagcatgccttggctattggncattgagacaaaatgctcaggaagcagaccaaatccaccagctctttctgatcagcactt

SEQ ID NO: 11436 - DNA, 121 bp, Artificial Sequence
  Synthesized
  misc_feature (61): n=t or g
aatctgagtttttgtctaatgaagtacgctatatttgcctcttccctctcaaggtctttgnaccagatgttgcttgacccaatacttttcaattttggggctgaaagaatcttttgacatc

SEQ ID NO: 11437 - DNA, 121 bp, Artificial Sequence
  Synthesized
  misc_feature (61): n=a or g
tttgattttttcttccttgttttgcaatcaacattttacagcagtattttccaaaaataanatgctctgtttatggctcatattaaaaagagatagagggaaacaagaaaatagaattagg

SEQ ID NO: 11438 - DNA, 121 bp, Artificial Sequence
  Synthesized
  misc_feature (61): n=a or c
ggaatgcctagggccagaatatattgaaaaccctgtgttggtgacaacaatccagaacatnttgtgttgaactgtctgcaagaagagaaaattcttcacaggcagattttcttctgctttc

SEQ ID NO: 11439 - DNA, 121 bp, Artificial Sequence
  Synthesized
  misc_feature (61): n=a or g
gatccctcggcctgactatgcttctagatttggcaagtatctcaagtctttctgacaactnctactgctcagcatccgtgcttgctttctgctcatcctcagaagtgtttttcagctagtt

SEQ ID NO: 11440 - DNA, 121 bp, Artificial Sequence
  Synthesized
  misc_feature (61): n=a or g
tggttgtctgtgtattgtaggaactttacactggtagattcctgagttccttcttctccanctaatagggcagtgggctaactggcattgcttgctccagcatttggtggcatctaaattc

SEQ ID NO: 11441 - DNA, 121 bp, Artificial Sequence
  Synthesized
  misc_feature (61): n=a or g
aactgcatgttttttaaaacttcatatgaaacaattctatacatcatatatgttgaacggntatggaaataatggatatgctggaatttagaaagtttaagattagggtacaaggggagag

SEQ ID NO: 11442 - DNA, 121 bp, Artificial Sequence
  Synthesized
  misc_feature (61): n=a or g
tcctgaaggactgcagcccctgggatgagtccacattgcagaaggatacagatgtaagagngaaggcgtggcagcagaattaaaccatcacgaactcactgctcaccctctgctcctgggg

SEQ ID NO: 11443 - DNA, 121 bp, Artificial Sequence
  Synthesized
  misc_feature (61): n=a or c
cgagggcagaacagtgatctcagtgacagcttaatttgtcagagttttgttaacaaatacntctacctggcaatgacttgcccttttctttcttccctgagattctttagagcttctagga

SEQ ID NO: 11444 - DNA, 121 bp, Artificial Sequence
  Synthesized
  misc_feature (61): n=t or c
tgctgcctgttgtgagaccatgtcccctgcagtggggctgttagctggaggagtaggatgnatgctagaagcacagcacttctggggctccccaaataaagccacactccacgtcttgctt

SEQ ID NO: 11445 - DNA, 121 bp, Artificial Sequence
  Synthesized
  misc_feature (61): n=t or c
agtactcgatttttacattcagagtcacattcagtaatccatgtcattatgttttagattngcaaaaaggagtttgtcgttaatcaacatcttactaactgatgatgtatacaggtagcag

SEQ ID NO: 11446 - DNA, 121 bp, Artificial Sequence
  Synthesized
  misc_feature (61): n=c or g
aaaccgtattatattctgaactgtatgggctggggaaaactgaaaatgacatagtatcagntgtacattaaacactgggtgagttctcttctctgggctacttatatacactgttttgtgt

SEQ ID NO: 11447 - DNA, 121 bp, Artificial Sequence
  Synthesized
  misc_feature (61): n=a or g
cactgtttgtgcagagcctggcacaaagaggccgagtcagcaacagcccaggtaggagccntaagagggaggagagaggctgctgaaaagaaagtgcttgctctgacaataatcctgcact

SEQ ID NO: 11448 - DNA, 121 bp, Artificial Sequence
  Synthesized
  misc_feature (61): n=t or c
attatttgctgtcggactacaaaatagtctctggcaaagtggttgtgatgcagcaccaggngagttgctggtagctacagttgattcagggcaggcagtgtaggaaggactaaagacagca

SEQ ID NO: 11449 - DNA, 121 bp, Artificial Sequence
  Synthesized
  misc_feature (61): n=a or g
tggaaataaagcaacagcaaaagagatgaaaacggcacgaggctggggggggagttaggantattccttccagaaaaggctgcttgatagaaacgtaatggtaggtacaaaaatcagacag

SEQ ID NO: 11450 - DNA, 121 bp, Artificial Sequence
  Synthesized
  misc_feature (61): n=a or g
gaatggcgttgaatcagaatgactgtacacccccaccaagacaaattttagactgacaacncacattacttcttatattaggaatgtacattccagcatttaagaataaaaattcaaaaga

SEQ ID NO: 11451 - DNA, 121 bp, Artificial Sequence
  Synthesized
  misc_feature (61): n=t or c
attaatagctgcataatagaagtgaatgcagttgctcagcaaaatgaatgatgtgtactgngagggaaagcactagaaagtaaagtggagctggaaagtgtttagtgaaatttctgcttgc

SEQ ID NO: 11452 - DNA, 121 bp, Artificial Sequence
  Synthesized
  misc_feature (61): n=a or g
tttgttagaacaagtagtagtttcctccaaatcctttcagagtaatcatactcttaatganggatactactgtatgcatttgttgtgggagatctcagtaatttaatatttaaacggaatc

SEQ ID NO: 11453 - DNA, 121 bp, Artificial Sequence
  Synthesized
  misc_feature (61): n=t or c
cctcacccctatagacagcatggggagttagataactttcctgcagcagtgcctcaagcanttaccctggagacacttgtatgaagcacctcgaagagtctctcttgttctggcattacct

SEQ ID NO: 11454 - DNA, 121 bp, Artificial Sequence
  Synthesized
  misc_feature (61): n=a or c
cccatggctacttgaataacaaaggatgcagccgtagtggagttcataaatccatcactcnttcttctgctccttgcatatccaggtggatcactcctaaacatgataaactgttgagagg

SEQ ID NO: 11455 - DNA, 121 bp, Artificial Sequence
  Synthesized
  misc_feature (61): n=a or c
aaaccaacagagaccactattaaataactaatcatgttctccttatttgattaaaagatgnttttttccttcacccttgtgaactgggaggataattattctgaaagtacctgttaatccc

SEQ ID NO: 11456 - DNA, 121 bp, Artificial Sequence
  Synthesized
  misc_feature (61): n=t or c
cctctcagctacctctttctataatttctgagtaataatgtgtcttttcatcatccatttnttgctagacaacaacctccatttgaaatgctgcaatgtgtacatcatccttaatatcaag

SEQ ID NO: 11457 - DNA, 121 bp, Artificial Sequence
  Synthesized
  misc_feature (61): n=t or c
cctcacgatacattaccgtgcctgcttatcgggaggaatttactatagaatggataaactngttgaaaaactcttaccaatttgaaataataccctgaaacagttacaattcctagctgtc

SEQ ID NO: 11458 - DNA, 121 bp, Artificial Sequence
  Synthesized
  misc_feature (61): n=t or c
tatctccttctcccatttccaaagagctatgcaggcagtgagtcggggtactgaaatcatngctaccacttcggttactgcatggacatacatgcagtgtttggtgaaaagaggaaactgg

SEQ ID NO: 11459 - DNA, 121 bp, Artificial Sequence
  Synthesized
  misc_feature (61): n=a or g
cccagtgatgtaaggtactgtgtttaaactgtctgcactattttcatgcatcctactaccntttaagaatttgtagtacctaatgagcaccactattcaagtttccttccttaaggcaggc

SEQ ID NO: 11460 - DNA, 121 bp, Artificial Sequence
  Synthesized
  misc_feature (61): n=a or c
attttgcgagatatggtatttgcatgtggtgtctagtcttcaatcctttttagaatggctnttgggatctcaggcactgcaagtccttgtagcattctgttcaactacattggctttgcaa

SEQ ID NO: 11461 - DNA, 121 bp, Artificial Sequence
  Synthesized
  misc_feature (61): n=a or g
aattgcgatgcagacttaatcctgacacagctgctagtactaatataatagtaaatggcanaatacttagcacttataaatattttatttgcatatgaagtatcctcagactgtatttctc

SEQ ID NO: 11462 - DNA, 121 bp, Artificial Sequence
  Synthesized
  misc_feature (61): n=a or g
agctctgctggctgctccaaatggttggcatgttgagaattgacctccttgaccccagttncactggcagggtgatcaatggggacagctgcacccccagctctccccacccactctggga

SEQ ID NO: 11463 - DNA, 121 bp, Artificial Sequence
  Synthesized
  misc_feature (61): n=a or g
agtttcatagtagatatgcagcagcatatgctaaagaaataccaaaagctaataatgatgnttcaagcacttgctcctcccccccaagtataatgggcagaagtgttctgagcaggcagtt

SEQ ID NO: 11464 - DNA, 121 bp, Artificial Sequence
  Synthesized
  misc_feature (61): n=a or g
gtacactggctaagggagtagctttgtggaaagaggtctgatcagttgcaggccttagccnaacatgagatggttatgccatgctactgtggaaaaacaagtatgaaagataagtagtttg

SEQ ID NO: 11465 - DNA, 121 bp, Artificial Sequence
  Synthesized
  misc_feature (61): n=t or c
tagaaacattatttaaaatcatttagctcagtttcataaaatttaacaatcatgaactgcntgcaggtctcagtctcatttgttatgttactcagtgtaacatcctaaagctgttctctga

SEQ ID NO: 11466 - DNA, 121 bp, Artificial Sequence
  Synthesized
  misc_feature (61): n=c or g
gaaatatgcatgtgaccagttcaggagggcaactcatttttagagctgtgaatcagaaganaaggtaacagcttgcattacttttctgtctttgacgtaaaaaatttgtaatactgtgggg

SEQ ID NO: 11467 - DNA, 121 bp, Artificial Sequence
  Synthesized
  misc_feature (61): n=a or c
tgggcttgcttagtgttctccttgattcagtccttggtgagaccttgaagaaggggtctgncaaattcatcctttctccatccctaccatcttggttaggtgtccccatccctttcatctc

SEQ ID NO: 11468 - DNA, 121 bp, Artificial Sequence
  Synthesized
  misc_feature (61): n=t or g
tggatgagcagccatcagatgcactgattacacctcttcaccatgtagagttcactcctcngggtttggttccccaggtgaacttcctttttttcgtactttcagcacactccccccctgg

SEQ ID NO: 11469 - DNA, 121 bp, Artificial Sequence
  Synthesized
  misc_feature (61): n=a or g
tcacttccctgaacaaatgccaaggcttgtaaataaacaaataactgctggagattgtatnccattattcattcatctgaaagcctacaaaatagcaataacttgttgactctaatgttac

SEQ ID NO: 11470 - DNA, 121 bp, Artificial Sequence
  Synthesized
  misc_feature (61): n=t or c
cagtactcatatatgcataatacaacgctgagaaggcacagacaactttggcctgcattcngacaaaactgctgtctagcattcattcttgcacatttcaatagggttgtttgggaagttt

SEQ ID NO: 11471 - DNA, 121 bp, Artificial Sequence
  Synthesized
  misc_feature (61): n=c or g
tacctttctattccaattgttatgtccctgtgtccctttcttcactctctgcttaactcancaaagcagatgtgtctgcttgatctgattgactttaacaggatttctcagaagctgtaag

SEQ ID NO: 11472 - DNA, 121 bp, Artificial Sequence
  Synthesized
  misc_feature (61): n=a or g
ccatgctaaggaaatgctgagtgatcatcagtgtggacgttaataattctttgtccagtanctgagtggcttgattctacaccttaacctgtatccctgatgatccagggaagccatttat

SEQ ID NO: 11473 - DNA, 121 bp, Artificial Sequence
  Synthesized
  misc_feature (61): n=a or g
aaaatagtacatcattgagtacctactacatcctatgaatctgaatcctgagaatcctatnttctaggagcatgttattctgcatctgtacaaatttttctcccagtggtagtttctgatt

SEQ ID NO: 11474 - DNA, 121 bp, Artificial Sequence
  Synthesized
  misc_feature (61): n=a or g
gcagctgaggagtcagcagtttgatttttaatgtcataatcagagcaattagtacatagcntctagattttgacacatcatgcagaggcagaagaggatgaaaaatatggaccagaaagag

SEQ ID NO: 11475 - DNA, 121 bp, Artificial Sequence
  Synthesized
  misc_feature (61): n=a or g
ggatatgaaaacaggttgcttcactctcccttcaaccagttattctgcatgatttctcacnggagaccttgtctgactccagtgaggtattacaggacactttcatgagaaagtcagagcc

SEQ ID NO: 11476 - DNA, 121 bp, Artificial Sequence
  Synthesized
  misc_feature (61): n=t or g
aatccagcaccagttgagtcatctaatatagaaaattaaagaataattagacctgatgtantagaaaagggaagtctcatgaaataatgatgtagaagatagtgagattttatttgtctaa

SEQ ID NO: 11477 - DNA, 121 bp, Artificial Sequence
  Synthesized
  misc_feature (61): n=a or g
tggtattcttcaggagtcactctcacattttgtgtgccctccccttgttgtcagtgccagngactgtctctcttgccattctttcattcagtctgatggctccttgagctgactcccttat

SEQ ID NO: 11478 - DNA, 121 bp, Artificial Sequence
  Synthesized
  misc_feature (61): n=a or g
caaaggctactcttagcatctgcagtgacatgaacccagccctaaacaacggtctttcccngcttttggaggaactgggagctggatctcagccttttgctagagcatatctgtaaagggc

SEQ ID NO: 11479 - DNA, 121 bp, Artificial Sequence
  Synthesized
  misc_feature (61): n=a or g
tgcactccagctctgagaaaatagagataaatgcattgattcattcaaacatttatgcacntacttaaatttttccctggctttcaagctggtcactcgagggagttgtttttttttaacc

SEQ ID NO: 11480 - DNA, 121 bp, Artificial Sequence
  Synthesized
  misc_feature (61): n=t or c
ccaaaaaactgataaaaaaattgaagaaattatatatgaaactgtaatagttaaaatgccnaccttactgtagcttactttgaatacattgaagatcaaagaaacaaatgactgatattga

SEQ ID NO: 11481 - DNA, 121 bp, Artificial Sequence
  Synthesized
  misc_feature (61): n=t or g
aaggacagaggaccatccaaagcacaaagctggtggagctctctggtccctgcctaacttncctctgtggatgtgttctatgtgtagctgatccctaagaaaagcaactgtcaaacaggga

SEQ ID NO: 11482 - DNA, 121 bp, Artificial Sequence
  Synthesized
  misc_feature (61): n=a or g
tgcacattgccagcacagaggtgatgagaggctaccagcagctccgggcaagcgaggaagntgggaagcaggaaaggaagcttgaaaagtttgaaaataactatcagctaattttgactac

SEQ ID NO: 11483 - DNA, 121 bp, Artificial Sequence
  Synthesized
  misc_feature (61): n=t or g
tgctggctaaaatattataatttcactgacaagcatctactccagaccactgtaatgtatntaaacaaagcagttttaaaacacagagaacaaaacgtacctctgttaagtgctctgtaca

SEQ ID NO: 11484 - DNA, 121 bp, Artificial Sequence
  Synthesized
  misc_feature (61): n=a or g
caagagaagggattctggcaagcagctttggtgtgaagttggtggaagaggtgggtgaggnaggatggaaactggcctctctgattggaaagaatgctggggaaggcagggatgagttaag

SEQ ID NO: 11485 - DNA, 121 bp, Artificial Sequence
  Synthesized
  misc_feature (61): n=t or c
tggatgggatgaagcttctaacatcttccttttttccccaagaaggtagaccagataccantaaaaccaaaccttatcgcacagttccaggtcagggtaactttttctctccaggccagtg

SEQ ID NO: 11486 - DNA, 121 bp, Artificial Sequence
  Synthesized
  misc_feature (61): n=t or g
agagaggtgagactttttctcacacaaaccatgttaagtccatgaggaaatgctttggagntcagtagggatgcactgctaacgatcagctggtgcctggaaaacataggggcagtaagga

SEQ ID NO: 11487 - DNA, 121 bp, Artificial Sequence
  Synthesized
  misc_feature (61): n=c or g
ccctcagtaaaccaagaaggtttccagcacagtgccatactcaaagctgtaattacaccancaaagtaaacagctgaatctcatcatagccatcagtccaccgttaagaaagagtgcacca

SEQ ID NO: 11488 - DNA, 121 bp, Artificial Sequence
  Synthesized
  misc_feature (61): n=t or c
tttcattcccactatcccagcttgtctgaataattttaaagttgctgctattttcttcctntctctcatttgggggatgaatattgagggaagagtgtgtatttctggtgagacacacttg

SEQ ID NO: 11489 - DNA, 121 bp, Artificial Sequence
  Synthesized
  misc_feature (61): n=t or c
agtacttagagttttatatgcaattatttatcttagtcagctgtagttatcagtcacctcntattcactgatgactagcacttctatggatcttgcctgaaatttcaggcatcagttctga

SEQ ID NO: 11490 - DNA, 121 bp, Artificial Sequence
  Synthesized
  misc_feature (61): n=a or g
ggcagagcacagctcacaatagggcacgctggccctcagggccacctacatgatcttttcnacaagattggggtctaagatcctggcttgggagcaaggagtggctccagcccttgcccca

SEQ ID NO: 11491 - DNA, 121 bp, Artificial Sequence
  Synthesized
  misc_feature (61): n=a or g
aaaatctaagtatgtattacagaaaagaaatgcaaacgcttgaaagtaaatctgtattgcnttcaaactatgtcacagaagggttcctcatactgcatcttgtagtgactcagctcaacac

SEQ ID NO: 11492 - DNA, 121 bp, Artificial Sequence
  Synthesized
  misc_feature (61): n=a or g
ctgccttcagtgaatctcagatatcaaagccacaaaatacgctcgtaacacaaccacatantgaaatgctgcctgcaaccagatctcttgtttgggatggttggctttagaagtagattct

SEQ ID NO: 11493 - DNA, 121 bp, Artificial Sequence
  Synthesized
  misc_feature (61): n=t or c
catagctccacccagagtaggggaagggtctaacgcgtcacaacccgagaggctcgcacgngcctaatacaacacataatacaccagctgagggcaattgtcaccaaatggcctgacttta

SEQ ID NO: 11494 - DNA, 121 bp, Artificial Sequence
  Synthesized
  misc_feature (61): n=t or c
tacacgtttacttcttgtgtcccatttaatgaagctgaagggtgactagttagccaagccngttcttagtcaatcaccacagtgctggcagcaggcagtgctcagacctgggattaatgct

SEQ ID NO: 11495 - DNA, 121 bp, Artificial Sequence
  Synthesized
  misc_feature (61): n=a or c
ctcaccccagaagaacccacacaatcagactttaaaaaaagttaagacactctcaaaaaanagaaggctactaaaagttgctgatgataaatactgctcttgatttcaggctttgctgtac

SEQ ID NO: 11496 - DNA, 121 bp, Artificial Sequence
  Synthesized
  misc_feature (61): n=t or c
tagctgactcttaattcatgaatcttcataaatgttagattattctaaatgcattcatcangcaatgcatttattgtttgtgctcagcttaaaggtgaagtacttctgaagatcctcttca

SEQ ID NO: 11497 - DNA, 121 bp, Artificial Sequence
  Synthesized
  misc_feature (61): n=a or g
agctggtcccagaacacagcccacgggacctcctgccttaatatctcatcacagagtaatnccagccacaaaatgaacaacaaagcaaaaacagaagaaatgctcctggcttgtccaggag

SEQ ID NO: 11498 - DNA, 121 bp, Artificial Sequence
  Synthesized
  misc_feature (61): n=a or g
gttggccgttaatgtatgttttagtgtattttttttttagttctagcaaattgtatagaancagacaaatcacaaagttgcctgactgcttattgcatctttttcagaacacattggtata

SEQ ID NO: 11499 - DNA, 121 bp, Artificial Sequence
  Synthesized
  misc_feature (61): n=t or c
acacaaaggcagatgaaaaatggggtgctacattactgagttgccatatggaagctggagnattaaatccaaatctttggccattcccattaattgttgaggaaatcagtaattccacagc

SEQ ID NO: 11500 - DNA, 121 bp, Artificial Sequence
  Synthesized
  misc_feature (61): n=a or g
ttaaattaacttttttcagttatttatatgcaagcataatatgatatctgtatatttttangtacaagcaatgactgtgtgcttgaactaaagtcacatactgaaaattgttgttagcagt

SEQ ID NO: 11501 - DNA, 121 bp, Artificial Sequence
  Synthesized
  misc_feature (61): n=t or c
tttacatccttttttccctaccttctcccctccaaaggggcacacacacaggcacaccaangtcacctcagccagagagcagcacgtcgagctgtcaccctgcccagctccacacagcttc

SEQ ID NO: 11502 - DNA, 121 bp, Artificial Sequence
  Synthesized
  misc_feature (61): n=t or c
taacaacattcgtatctatgttcttgccctggaaaaggatctttcatcattctattctaanacttgtgaagtttctatttcagctgagaacttctcagatatccttctaatgtcttaactt

SEQ ID NO: 11503 - DNA, 121 bp, Artificial Sequence
  Synthesized
  misc_feature (61): n=a or g
gcagccagcttgcaacaacatccaacagccttagagaagcactgggaagttcaaacactcncatggccattgctgccatcacattcatcacctctaacccctctggactgtccataaccaa

SEQ ID NO: 11504 - DNA, 121 bp, Artificial Sequence
  Synthesized
  misc_feature (61): n=a or g
gacagccaacccagagattattttcatcctccttagacgtgaagaacattggcttcagtcntggtctgttcatgatacaaaaatagctgttgaaatggattctctcataatgcttaacctt

SEQ ID NO: 11505 - DNA, 121 bp, Artificial Sequence
  Synthesized
  misc_feature (61): n=t or c
agttttcacatgctgcttgctgtgtgcagacagagcacaaatctgaggctgtcatcctcanttgcagctaattctgggatttcacacgtgctgaggtcattccatctcaggagaggggcag

SEQ ID NO: 11506 - DNA, 121 bp, Artificial Sequence
  Synthesized
  misc_feature (61): n=a or g
tgagctggctgtgctgcatgttgatggcctttcctcaagaatcatgccatttaacataaanaattttagcttcagtatactgtatatataacataaacagcaagttcaagcagcaactaca

SEQ ID NO: 11507 - DNA, 121 bp, Artificial Sequence
  Synthesized
  misc_feature (61): n=c or g
cagacaatttcttccatgagcccaattgagttggtgcaaagttcaccagcacgcacacgtntatggcagccagaaatcagcccagaatgccatttaaaattgagaactgggaaaaagaatc

SEQ ID NO: 11508 - DNA, 121 bp, Artificial Sequence
  Synthesized
  misc_feature (61): n=a or g
ataatatgtccaaaaggtttttggagacccatgtcattttggaatatcaactggaagatgngaagtataacctgagacattccaagtcacactaaaaacatatgtttagagcattaaagag

SEQ ID NO: 11509 - DNA, 121 bp, Artificial Sequence
  Synthesized
  misc_feature (61): n=t or c
gacttaatggaccatttattgcagagccctgttatctgtttgctttctgcttctttgaaanttagatacttcgtggactctggtagaaaccttcctgtcttgcaaacacagataccagaaa

SEQ ID NO: 11510 - DNA, 121 bp, Artificial Sequence
  Synthesized
  misc_feature (61): n=t or c
ttttttatcaatatttattcccttataataatattttaacaatctgtggtaaagatacacnaacagcacactctgacacaaaactgttcaccgtcacaccaaagcaagacagacctccatt

SEQ ID NO: 11511 - DNA, 121 bp, Artificial Sequence
  Synthesized
  misc_feature (61): n=t or c
tcaggagtaagtgactccagagttgttctctcaagataggagactttgtacataggctctntcacagtgagcgtgcctgggtttttttgtgttgtgcagacagctgaagaatattggcttt

SEQ ID NO: 11512 - DNA, 121 bp, Artificial Sequence
  Synthesized
  misc_feature (61): n=a or g
tatgtatacaattaagaattttttcttgatgtgtcagtccaccgtgccaaaaagaaatacnaatgttttcagtactggtttcctgtacatgcaaactttgaactcagactacagcactgat

SEQ ID NO: 11513 - DNA, 121 bp, Artificial Sequence
  Synthesized
  misc_feature (61): n=t or g
ggcatagcagcacaactagcatctaatgcttctgctggatagcccaaggctgagctgaatnagggcttatggatgggagctgggagggtaggggttagggggagggggagccccaagtgag

SEQ ID NO: 11514 - DNA, 121 bp, Artificial Sequence
  Synthesized
  misc_feature (61): n=t or c
atagcatgttcaacatcagagcttaagaaaatgttagccacagtttaccgaacagactttnttgtcaaccatcccacaggggggcatagatttttctgccacacttaccatccatatttta

SEQ ID NO: 11515 - DNA, 121 bp, Artificial Sequence
  Synthesized
  misc_feature (61): n=a or g
atcaaattttagggttccagtctggagaagtactctggacagattttaactcatagctggnagaaaaactgtggaagagggagacctggaacaagacagaagtctacagtgtttactggga

SEQ ID NO: 11516 - DNA, 121 bp, Artificial Sequence
  Synthesized
  misc_feature (61): n=t or c
gcatgcacaaaggacccttgaggagataggacaggagttgacaagccagggtttggccttncctgcctaagaataggcagtactgggcattggaatgtctactgtagatttttgaagtgaa

SEQ ID NO: 11517 - DNA, 121 bp, Artificial Sequence
  Synthesized
  misc_feature (61): n=t or c
gtgttactgggtacaatggcagaaaggtcttagagctcacatggccttccagtgtgtgagnggcctccaaatgacacaggccatgctgcgatgtaactgaccaaagtgtattgctccaatc

SEQ ID NO: 11518 - DNA, 121 bp, Artificial Sequence
  Synthesized
  misc_feature (61): n=a or g
ctggaggactgtgcggaagttgccggtgccaacgctgctggagccatcgatcacaaaaccnatgtcagccgaattaagacatgtcttgctgcaaaccagccggtcgatatcacagacccgc

SEQ ID NO: 11519 - DNA, 121 bp, Artificial Sequence
  Synthesized
  misc_feature (61): n=a or g
tgccaaagtgacctaaaaactgcaacccatttcctgaaattattcagtcagtaagagcccntgtttcaatgaaagggaggagaaaagctcccgaaaatgggtctgaagagcccgaatgaaa

SEQ ID NO: 11520 - DNA, 121 bp, Artificial Sequence
  Synthesized
  misc_feature (61): n=t or g
gaatcagaactaattcacctgtcagttgatctttctggcttggttggccctctctgagtcnctgccttacagttggctgctccttgaatataaaggggatgtgctttgaagctctgaggtt

SEQ ID NO: 11521 - DNA, 121 bp, Artificial Sequence
  Synthesized
  misc_feature (61): n=a or c
atgaggaacaaccaacctacagatctcactctgagtctcccaccagcctgtaccaccaagnagcagtgcagtgcatacccagcaaagttcctgcgggccaatgcagatatcagagggatgg

SEQ ID NO: 11522 - DNA, 121 bp, Artificial Sequence
  Synthesized
  misc_feature (61): n=a or g
ttctcttttgaaaataggagacacttgtgacatgttcttaacagaatgtaactattaaggntttaagcaagcagtcactgcgatgctagaaattcttgcacgttttatgtctgctgagata

SEQ ID NO: 11523 - DNA, 121 bp, Artificial Sequence
  Synthesized
  misc_feature (61): n=t or g
gcaggtttccctgaggccatgatgaagaagacttacttggaaactcctgtcctcatagatntgttttcatagtctggtatttaagagaatttgaagtggccataaacaggctcgattgttt

SEQ ID NO: 11524 - DNA, 121 bp, Artificial Sequence
  Synthesized
  misc_feature (61): n=t or c
gagtatactttcattctttattaagctttaaaactgttcacattacagtttttcatacganttctttctaaatcattattcaacgcttaggtaactgtacgtgattcatagcccttcacta

SEQ ID NO: 11525 - DNA, 121 bp, Artificial Sequence
  Synthesized
  misc_feature (61): n=t or c
aggtgagaatggatgcatggccgcctgccgtctctttcttgggtgcctcctcaatccttcngtctatttgaagctcttgtgtgtgccttgttactgctcacaaatgtaggctcaaaccagg

SEQ ID NO: 11526 - DNA, 121 bp, Artificial Sequence
  Synthesized
  misc_feature (61): n=t or c
tgacatcttctctcttaaatttagctgtaacttgtcaccctatttatatacttcacaaagnactaggcatctttgcatgagactattcccagtaggagatcatagaaaaccccatcttcca

SEQ ID NO: 11527 - DNA, 121 bp, Artificial Sequence
  Synthesized
  misc_feature (61): n=a or g
ctgaactggcactgtgtctcatccaatggctttacaaaaataccatttgcagaggaagaanaagttttaatttataacactccttgttataacagaaagatggtatagcagagacaaagag

SEQ ID NO: 11528 - DNA, 121 bp, Artificial Sequence
  Synthesized
  misc_feature (61): n=c or g
agcttgcgtgggacctctgtgggcatctctcttgtatttgttcattatcatcatgaacctnagttttcacccatctatgatacaaagggccctggatcactttcatctctggagttttcca

SEQ ID NO: 11529 - DNA, 121 bp, Artificial Sequence
  Synthesized
  misc_feature (61): n=a or g
tcagcaaacactgtgacttgctgcctcttgcttgaagaagcagacaagagggatttgtgancattacctcttgtaaaaatactgatggagtcttctctgtggctagggcactatgaccttc

SEQ ID NO: 11530 - DNA, 121 bp, Artificial Sequence
  Synthesized
  misc_feature (61): n=a or g
atacttgttcccaccgtgccttgtttaggacttgagtcagcgaagggcttcattcaccacntggataagctttaccagtgccacggaactaaggatttcctataacataggcatgcttata

SEQ ID NO: 11531 - DNA, 121 bp, Artificial Sequence
  Synthesized
  misc_feature (61): n=t or c
acttgggcttaattgttctgtttcttaattacacatgagttaaagggcatactacaccttnagatgcattgcacagatactccatggtaccaaacatggaggagtggtgcatttattgaag

SEQ ID NO: 11532 - DNA, 121 bp, Artificial Sequence
  Synthesized
  misc_feature (61): n=t or c
tacattgctgccctaacataacacaaaatgcaacaccttccacttcacagcgcacagaatntgacctgcctgccactgctgggatcacctcaaccagaaaacaccacacagccgagggaga

SEQ ID NO: 11533 - DNA, 121 bp, Artificial Sequence
  Synthesized
  misc_feature (61): n=a or t
gggattggtgcagcacggaatttcgaacacacatacatgcgagtgagttacatcagcattngctttatgccttgagcgatgctgtcttttgtgcactggcagtcaaatcctatgtatgtca

SEQ ID NO: 11534 - DNA, 121 bp, Artificial Sequence
  Synthesized
  misc_feature (61): n=a or t
tgaggcactctgatgttgctagtttgatttgcagcagttaatgcttatgcattaacttcanctttgggttatgatatattcccattagattatcttacaagcgctgtattattttatgagc

SEQ ID NO: 11535 - DNA, 121 bp, Artificial Sequence
  Synthesized
  misc_feature (61): n=a or g
taaaaaaaaaacagctatcagccaggaaagaatgttagcatgtgcaagtacaactggcagncatacagcagaacaagtttgatttattttgcttgcttaagtggttttatacctcagaacg

SEQ ID NO: 11536 - DNA, 121 bp, Artificial Sequence
  Synthesized
  misc_feature (61): n=t or c
cttctacggagaacccccctcacttgagaaatgggttaggtacacccagtcggcatgcgtngcatcttctccagccgataccccagccggtgccgggggttcgttccgccctgcggaggca

SEQ ID NO: 11537 - DNA, 121 bp, Artificial Sequence
  Synthesized
  misc_feature (61): n=a or g
ggccagtccctgttataacaacaatgccaaggcttggttctctagtttgaaagggtctcanagaccagcctgcagatactttcttaagacagctgtcttccagtatttaagctactaccac

SEQ ID NO: 11538 - DNA, 121 bp, Artificial Sequence
  Synthesized
  misc_feature (61): n=t or c
tcatccctcagctgctgggaacaagttagtttgctgagattctcctcctctgtcagtctcnctgcactcccaggtcgactcctaggagacgggtggatttttcccgcccaaactccaaaca

SEQ ID NO: 11539 - DNA, 121 bp, Artificial Sequence
  Synthesized
  misc_feature (61): n=a or t
tgtggaagtacttacgtaggaaaaaattaatgttcatcctggaaaagataactaaaagatnactgtacagagagcatgataaaagttcataaaatcattggtggcatagggaagctgtgtg

SEQ ID NO: 11540 - DNA, 121 bp, Artificial Sequence
  Synthesized
  misc_feature (61): n=t or c
gcctgggctcacccacactaacagcatgtgttgctgagcagcgttactgacagctgcatgncatggaggctttaagtcctctgctttgtcctgtggtctgttctgcatgtcggtcagcagc

SEQ ID NO: 11541 - DNA, 121 bp, Artificial Sequence
  Synthesized
  misc_feature (61): n=a or g
aaattaattcctttgaaccaaagagctttctgctctcagaatttgctccagtacatccctngtacattgcaacaatgtggaatcccagtgacctgtgttgcacctaaaggataatcaatca

SEQ ID NO: 11542 - DNA, 121 bp, Artificial Sequence
  Synthesized
  misc_feature (61): n=t or c
cacttaaccctttgtcagatatggaaagctctgtcatctattttcagtatgaagcatctantcctctggcatctcagcctaattttagatttctctctacagtctcatattttggtgaaaa

SEQ ID NO: 11543 - DNA, 121 bp, Artificial Sequence
  Synthesized
  misc_feature (61): n=c or g
ctgagctttaaaatggcatgtatgggttttcatcgtgttttattgtctagcagttttgtgntgctggctttcagttaactcatttcactgagcgttaattacgggctaaggggaaacagag

SEQ ID NO: 11544 - DNA, 121 bp, Artificial Sequence
  Synthesized
  misc_feature (61): n=a or g
gtctgctttgacatgtgaatgtgttcttccttgctgtgcttccttctcttacaaaggcctncttactggaggatattgaccagcagtttggcagtttcaacaggacagtccagacttactc

SEQ ID NO: 11545 - DNA, 121 bp, Artificial Sequence
  Synthesized
  misc_feature (61): n=a or g
atttatttttagcacttttggaaaaacaagtagaaatttacctatattgggaacatgagtntattggaaggaaatggatagcacatcttatgtacagttgagtttatcatttgctgctgtc

SEQ ID NO: 11546 - DNA, 121 bp, Artificial Sequence
  Synthesized
  misc_feature (61): n=t or c
aaagtgcagttgcccaggtcttcttccctgtgcttttgccaggatttcctttctcatctgnataggatgcccagaacttttgcttgtttttgtgcttgtcaagatgggagtccttgagctt

SEQ ID NO: 11547 - DNA, 121 bp, Artificial Sequence
  Synthesized
  misc_feature (61): n=t or c
accttcctctggaccccctccaatagctctatgtcaagtggaatggattttaatgagtcanaatcacggactaacaaaatggagatggaattcaatatagataaatgtgaacagaggcaat

SEQ ID NO: 11548 - DNA, 121 bp, Artificial Sequence
  Synthesized
  misc_feature (61): n=a or c
acactaaaccatgccgattccttctggtcctggtgcagtgatgatactttttaaggcgttnagctcccatttttagcttatactaccagaggcagctgtttctatatctctgataacaaga

SEQ ID NO: 11549 - DNA, 121 bp, Artificial Sequence
  Synthesized
  misc_feature (61): n=t or c
tgatcttgtttgtttgtcttaaatgctttttttgggaatctgctaatctcagtgatgatcncccatcttctgagatactgaaaagctgtcagggcgtggtcctggacaacctgctttaggt

SEQ ID NO: 11550 - DNA, 121 bp, Artificial Sequence
  Synthesized
  misc_feature (61): n=c or g
taaccatttacataaaacatacaccctcctcaaaataaaaacagtattggagaaaaacttnatacattgtattatttaacattacagcaatgcacagcaacactgtcattcagtaacacag

SEQ ID NO: 11551 - DNA, 121 bp, Artificial Sequence
  Synthesized
  misc_feature (61): n=c or g
tgtcagtgtctttcatccttaaaaacagataagggtaaaatttataaaatcttgttttcantatatggtctggggcaccttaagcagctgaccttaggaagtaatgtctaaatcacaactt

SEQ ID NO: 11552 - DNA, 121 bp, Artificial Sequence
  Synthesized
  misc_feature (61): n=a or c
tgacataatggataccatcttaatacagtactggcagctagataaataaaatgcaaatgcnctttgtctcttaggctttataatagtaatcagtcaaatcttcgtgtcacagtagctctgg

SEQ ID NO: 11553 - DNA, 121 bp, Artificial Sequence
  Synthesized
  misc_feature (61): n=a or g
ctgtcatagacagagggctcagcaagtactcaaagagctcaaacaaggcactgccaccaanttcaaatgcaggaggcacaagctgcaccattatccttcaggcaggccactcacccacctg

SEQ ID NO: 11554 - DNA, 121 bp, Artificial Sequence
  Synthesized
  misc_feature (61): n=a or g
tctagcagctaagtatcttgatgctggaaagtaaaaatgtgctgatgaatcaactcttacntaagggaagaagtattggaattacatttttcattctctgtcagtatgcttctgtaagcaa

SEQ ID NO: 11555 - DNA, 121 bp, Artificial Sequence
  Synthesized
  misc_feature (61): n=t or c
ggaagaggaatcatgacttgaactcctgcttttgtatagcctgatatttgctcctcactgnagtagtagcttcacagtgggactgctaatttttcagtctgtcatgtgcagaacctcagac

SEQ ID NO: 11556 - DNA, 121 bp, Artificial Sequence
  Synthesized
  misc_feature (61): n=t or c
agctgtcatttttaacctaaactttaacacatattggtagatatcaatgaaacacaattanctgagaacttgaactatttcagttctgatattagagcaaaatgaggggaaaactttctgt

SEQ ID NO: 11557 - DNA, 121 bp, Artificial Sequence
  Synthesized
  misc_feature (61): n=t or c
aagcaacgtatgtacattaaacagtttttcctaaatgcgtctaatctgaactagaacaaangtctatttaacttttgagaagtttataagctaaggatagtttgtggtgaatatgtacttc

SEQ ID NO: 11558 - DNA, 121 bp, Artificial Sequence
  Synthesized
  misc_feature (61): n=t or c
cagcccctctcggtaagagaatttaaaatcaaacccttctgaaataatttggctggaatangctccaggttagctgtatgctgtttgaaagtcagctctttgctactcactcagagttatt

SEQ ID NO: 11559 - DNA, 121 bp, Artificial Sequence
  Synthesized
  misc_feature (61): n=t or c
ttaaaacttatcaccaataacttcaaggtatttccctattaatgctttattaattcaatantaatccaattttagcactataaaggctccttatttgcctgaaagaggcttttagcaagat

SEQ ID NO: 11560 - DNA, 121 bp, Artificial Sequence
  Synthesized
  misc_feature (61): n=t or g
tcctttctttatacaagcaaatctcaattcagacaacatctgtgcatcaggacagcacagnttatatgaaactctatgcatagcattcagaaaggaaatgtctgttcaagcactaacatcc

SEQ ID NO: 11561 - DNA, 121 bp, Artificial Sequence
  Synthesized
  misc_feature (61): n=t or c
cattatgctattgtgaaacctgctttccaagaaatctgtttctcagtattacatgcaggcngcgttcaatagtgctgaatgtgtaacaaatcctctgcgctacaaagcagaccttgcaaag

SEQ ID NO: 11562 - DNA, 121 bp, Artificial Sequence
  Synthesized
  misc_feature (61): n=t or c
ggcaataataacattggttatcttctttccccatgatagcgtattcaagtgttcttttttnagcaatgtcactaaaatgacaaacatttcttattctcatgagtgtgtgatcgtgtgtact

SEQ ID NO: 11563 - DNA, 121 bp, Artificial Sequence
  Synthesized
  misc_feature (61): n=t or c
ttaacagggagctcccccagcgtgtgcatgtggctgaaggagacttgagattgccgtgatngaaacaagctgtatggttgcaggcaaagagcgcatattcagcagtctgtgcatattttgt

SEQ ID NO: 11564 - DNA, 121 bp, Artificial Sequence
  Synthesized
  misc_feature (61): n=t or g
acctggaatgctaggataagaaagggttcattctgagcagactgaaaataagggtagtccnactcaaaacagttattctgcccatgtagtttccgggaaagagaagacccccctcttctgg

SEQ ID NO: 11565 - DNA, 121 bp, Artificial Sequence
  Synthesized
  misc_feature (61): n=t or c
gagtgagaggtgaaacctggctggagctcaccaggctgatgtggaaagccaacatgctacnggttgcttttcctatgtgcttttagcatccagatatcctggttagagagagagggctgcc

SEQ ID NO: 11566 - DNA, 121 bp, Artificial Sequence
  Synthesized
  misc_feature (61): n=a or c
agacttctatacaggcaacggaagagaaaattcagattagattacaaggatattctccacngtgagagtagtcagattttatatgaggttgctcagaaatgctgtgggttgtatgtccttg

SEQ ID NO: 11567 - DNA, 121 bp, Artificial Sequence
  Synthesized
  misc_feature (61): n=t or g
ctcttagtatagccaggacatactatacctgttcaatcaacacttcagaaagccatttagntggtcaaatgcatgctttcatctcagggggagttgtgtaacttcatggactattctcacc

SEQ ID NO: 11568 - DNA, 121 bp, Artificial Sequence
  Synthesized
  misc_feature (61): n=a or t
atacagagaggcattaaatggaaggaaaaccttttattgcagtacgttagtttgtgcatgnctaattgactcttcaagactcttttgcatgagtcactaaacacagttttaaacagactat

SEQ ID NO: 11569 - DNA, 121 bp, Artificial Sequence
  Synthesized
  misc_feature (61): n=a or g
tgttgggttttcagtatgaacatggaagaaacttccaaagttcatttcccatgatcacatntttagtaccagttggcagtgaacattgtgttacacacagttgctgctaagatcttcaaag

SEQ ID NO: 11570 - DNA, 121 bp, Artificial Sequence
  Synthesized
  misc_feature (61): n=c or g
aaccctccatactaaaacaacgctcagcggttgcaacaaacaagatggaaaggatactganctacagaaggatggtttcacagttcagaagtgtttaaaggaaacccaaacttgaaatgaa

SEQ ID NO: 11571 - DNA, 121 bp, Artificial Sequence
  Synthesized
  misc_feature (61): n=a or g
gaagaaactagcaggagttttgtgtagactgtatgttattgggatgctatgaggaacactnttcttcacagagtagtgtatgatccagtgtacatgatctctcaaatgctttgagatcttg

SEQ ID NO: 11572 - DNA, 121 bp, Artificial Sequence
  Synthesized
  misc_feature (61): n=t or c
ttttctctctgtgctttgtctttaagaggtgctggtatttctatttcagcatgcagagtgnctggtttcactagcaagccactgcggtatctgcaggactaaaaataagacatttctcctg

SEQ ID NO: 11573 - DNA, 121 bp, Artificial Sequence
  Synthesized
  misc_feature (61): n=t or c
tcttctgctgcctagtaacagcagagataaagcctactgaagatacagaatagagaccacnaatctgtagtgcacatagcaatttacttgaagagtacataggatatctaaataaggtgca

SEQ ID NO: 11574 - DNA, 121 bp, Artificial Sequence
  Synthesized
  misc_feature (61): n=a or g
gcaactcccttgcaaattctgcgttgctgtcattgcagtgagatggggacgaaggcatccncaggtgaagctgctgagcctccccgctccccattgcagccctgctgtgccatccctcccc

SEQ ID NO: 11575 - DNA, 121 bp, Artificial Sequence
  Synthesized
  misc_feature (61): n=a or c
gtgctacagcttttaacatatcatgcagtggtaaaaagcagtcctggcaataaaactgtgnaacattcgaaagaatttctccacgtttgctctgctctcactaaaagcatttagtaacatt

SEQ ID NO: 11576 - DNA, 121 bp, Artificial Sequence
  Synthesized
  misc_feature (61): n=a or g
ggaatggcttggtttgtaaatgcagtctccttgagggtcatctggtttgaaagcaaggggntaaattcattccaaaaaatggcaaagtgggctgtaagggatgtgccaccagctggagcta

SEQ ID NO: 11577 - DNA, 121 bp, Artificial Sequence
  Synthesized
  misc_feature (61): n=c or g
agctgaatgttttacttgactgagacaagtaagaattgaagaagagaaggttataaagctntgaggagggggaaggtgatacgtatcatctacattaattagcatgagaaaggaaaaagct

SEQ ID NO: 11578 - DNA, 121 bp, Artificial Sequence
  Synthesized
  misc_feature (61): n=a or g
ggatccttcagtaggaaggaattggagtggtcctcaagaatgacaatctctggagtcaacngggcaatgaagaagctccgaaaagaggttgaaagcagcagggaaatcttcactcacacct

SEQ ID NO: 11579 - DNA, 121 bp, Artificial Sequence
  Synthesized
  misc_feature (61): n=a or g
gcagttctgtgctgtgtacaaaggcaagcgcagtccaaagtgtgctaaccaagtgtgaacntaaggtgttggacagcactgggcagttacctggcactggcagggacctttctgaagcgct

SEQ ID NO: 11580 - DNA, 121 bp, Artificial Sequence
  Synthesized
  misc_feature (61): n=t or g
atagtaatagtttcacacataatatgagaggcttggttttccctttctagttttctcttgntagtaatctttatatgttttcctgaaatactttcctctgcatctgcaagaacaagcaata

SEQ ID NO: 11581 - DNA, 121 bp, Artificial Sequence
  Synthesized
  misc_feature (61): n=t or c
aatttgaatcctactcttagaggatgacagaaaaaaagagaaataatgacttttcctcagngtaacctcttcagtgaggactattattgaggactatgttacgatttcaggggggaaaaag

SEQ ID NO: 11582 - DNA, 121 bp, Artificial Sequence
  Synthesized
  misc_feature (61): n=t or c
gcgtgagcatccgtgggtaagcatgggctatgccaatggaaaaaggtgtgatgagccacangatttaaatgcatactcaacacttcataggggttgtaacaaaaagtaagtggtcctggag

SEQ ID NO: 11583 - DNA, 121 bp, Artificial Sequence
  Synthesized
  misc_feature (61): n=t or c
cagttcttcctcttcagcagcctggccagagcatactccttcctataccgtcaaatatacnaccctggcttcaccacgcaaacaagcatcctgtctctgccatctctagctctgcagcaag

SEQ ID NO: 11584 - DNA, 121 bp, Artificial Sequence
  Synthesized
  misc_feature (61): n=t or c
caaatagaaatagcgcaggaaagtgttccttcaggcaagctgtgcttgctgtgtggtaccnactgggaaggaagccagaggaaacaatgcaaaaatggtgtctcaaagaaaggttggattt

SEQ ID NO: 11585 - DNA, 121 bp, Artificial Sequence
  Synthesized
  misc_feature (61): n=t or c
gaatttctttttaccatcttgggttatgtagcacatggaaaagttaagggttgcttttgtnaaatatggttcccagttaggctgtatgctgtatactggtgataaagctgtttgttataca

SEQ ID NO: 11586 - DNA, 121 bp, Artificial Sequence
  Synthesized
  misc_feature (61): n=a or g
cttgcataaggtacatttaaagtacccagcgatcacgctacttaattgtattacacgcctngcgagcaccagaactccaggaggtgagagggcatgcttggcaacatgacgacaactggat

SEQ ID NO: 11587 - DNA, 121 bp, Artificial Sequence
  Synthesized
  misc_feature (61): n=c or g
aataaacttcacctgtgttctggcaagaataatgactgagaatgtcagtatatatatccancattgatagaaagtttcttcagtagttatctgtgcatagctgtagactaaacaaaattac

SEQ ID NO: 11588 - DNA, 121 bp, Artificial Sequence
  Synthesized
  misc_feature (61): n=a or t
gagcatcaggtaacttcatattattctgtcatctgtggtgtgaggtagatagagccctcanttccttgtgagcaggtctaggatgaccaagcttctgagagggcaaactaacagtttgcag

SEQ ID NO: 11589 - DNA, 121 bp, Artificial Sequence
  Synthesized
  misc_feature (61): n=t or g
tacagtctacatgttccaaaaaaaaaaaaagcagtccccttgtttgatcatctcctcagtntctggggactgagccattttcaattcagagcaaccatatttggttaaaactgtattttgc

SEQ ID NO: 11590 - DNA, 121 bp, Artificial Sequence
  Synthesized
  misc_feature (61): n=a or g
cagaaataacagtgtcctggggtaaatgaaggagctcttagatacaattgttccaccttcntggtcatcctgcatatgtatagctgcactatctgatttttgtttttttcctagaactgtg

SEQ ID NO: 11591 - DNA, 121 bp, Artificial Sequence
  Synthesized
  misc_feature (61): n=a or g
cccaatcataatatcctgtatatcacctgtttttacttctcaatgacataacaagatgccnaacagtgacatattatagatgaaatggtgtcagccagctgttaatgctgtacatacttgg

SEQ ID NO: 11592 - DNA, 121 bp, Artificial Sequence
  Synthesized
  misc_feature (61): n=a or g
catgaagataactgtgaagtaaaatcccttatttgcggtgaggggtaaccacaacgtggcntttgaagaactgtgtctttgaaagggttgcccagtaaataaggtgttccttcaagcattt

SEQ ID NO: 11593 - DNA, 121 bp, Artificial Sequence
  Synthesized
  misc_feature (61): n=t or c
tttaaacagtgaatgtcttggtggcagagctgagctctccttgatgctactgatcaagtgntaaagcagaatgtttcccctcccattcacacatcagatcaatatgtacaaggaaggcagg

SEQ ID NO: 11594 - DNA, 121 bp, Artificial Sequence
  Synthesized
  misc_feature (61): n=a or g
aaaaaaaaagcagaatggctcccaacagctgcatcccagcaagccccaggataaatctgtnctgaaaaacatagtccatgactgctgttttccttcgtggctaaaactccaaagagacact

SEQ ID NO: 11595 - DNA, 121 bp, Artificial Sequence
  Synthesized
  misc_feature (61): n=t or c
aggctcacactgccagagcgttcccaaggaagatgccaaccagaacgcactattagaaagnaaggctttggagagtcaaagttagaaaggcagcagcgacttcgggatggatggatgcata

SEQ ID NO: 11596 - DNA, 121 bp, Artificial Sequence
  Synthesized
  misc_feature (61): n=t or c
tctgttgtttttttttttttttttgactgatgcatcccacttcaagtccgcattggtcttntggtcactcctttcccctttcttccacaaaatagagagacttgtcagctgttagaaaact

SEQ ID NO: 11597 - DNA, 121 bp, Artificial Sequence
  Synthesized
  misc_feature (61): n=t or c
gaactgtgggcaaacaacccacacaaacattcttcaccaacacaatcaataggccaaaggngaaacaggctacaagcatctaaccaataaaatacaactttcttagttgtgagacattcaa

SEQ ID NO: 11598 - DNA, 121 bp, Artificial Sequence
  Synthesized
  misc_feature (61): n=a or g
tactgaataaatggaagtgaacagatttgtctttgtaacataaagtaggaagactctcagnaaatcctgatcattgttacctgaggaaagaatgtcatatattcaggtctttgacttcctg

SEQ ID NO: 11599 - DNA, 121 bp, Artificial Sequence
  Synthesized
  misc_feature (61): n=a or c
ttttctttctgtagacttttgagttgcaagatctcaagaggtcggaattacctatgttggnacaccagctccttctcatgatccttccacaataaggcacacaggtgtaattgtacaagca

SEQ ID NO: 11600 - DNA, 121 bp, Artificial Sequence
  Synthesized
  misc_feature (61): n=t or g
tgcctgggcagtaccaatgcctggaagtggctgcagcatgaaggctgggtgctgcatcagngtcatgcagcctgctggacccaattgctgtggggtctttcatttgctttagaagcatccc

SEQ ID NO: 11601 - DNA, 121 bp, Artificial Sequence
  Synthesized
  misc_feature (61): n=t or c
tataactcattataacatttcagtgagcatggaaagttgtgctaggtcatacaaagcatgnagaagcaagggtgacatcaatgcagctggtaagtgccaactctgtaatagcaacataaac

SEQ ID NO: 11602 - DNA, 121 bp, Artificial Sequence
  Synthesized
  misc_feature (61): n=t or c
tgcccaatctttttcatctttttcaggattctacccatttcttccaagtcttgaatgaagncaaatatttggaactaagggggagactaatgcaagatatagagacgtgtattagggcgtt

SEQ ID NO: 11603 - DNA, 121 bp, Artificial Sequence
  Synthesized
  misc_feature (61): n=t or c
cagataaactttaaattatccagtgtaacgtcactaatgatctcttcagcagtagtctccncagctgttatgtagtccagtttataaacagaaaataagaatgtgtgggcttgatgtacat

SEQ ID NO: 11604 - DNA, 121 bp, Artificial Sequence
  Synthesized
  misc_feature (61): n=a or t
ctacaagaggattatacacgcttttcaacataggacaacacattgatctcttaatgagagntatcctcagaataatcacgtctgatatttccccctgtgatttttcccttcctaaattcaa

SEQ ID NO: 11605 - DNA, 121 bp, Artificial Sequence
  Synthesized
  misc_feature (61): n=t or c
gcaggttgctcccatgtctgtttatgcctgtcttggtagtgatgctgctgccatccgcgangccttcctcacccgcctgcagagcaagattgaggacatgcgtattaaggtcatgatactg

SEQ ID NO: 11606 - DNA, 121 bp, Artificial Sequence
  Synthesized
  misc_feature (61): n=a or g
tagacagcttcaaaatgaatttcttctttctcaaaaggctgtggccaagctggctggtgcnggcaactcttcatccaccgcacactcagtagtcacagctcagtgcgaagtacagcgctgc

SEQ ID NO: 11607 - DNA, 121 bp, Artificial Sequence
  Synthesized
  misc_feature (61): n=a or c
ttggctagtgtaactgctgagagatgaagaaaatctggaactgctggagcactaccatatntgctcatggaaatgaccaacagagctgctagagcataatagaacataccagagcacaaga

SEQ ID NO: 11608 - DNA, 121 bp, Artificial Sequence
  Synthesized
  misc_feature (61): n=a or t
ggcactgggatttctaacatcaagagtcaaatgtctttcaaatttcagttatcaacatacncactaaattatgtacttgcactttttgcataattgatagtttgaggaagtgattgttggg

SEQ ID NO: 11609 - DNA, 121 bp, Artificial Sequence
  Synthesized
  misc_feature (61): n=t or c
tcaggaggacagtgcagtccacttggtaaccacgtaagttgaatttctgtacttgatccangaactactcttatgatggatctggaatcaatggtgcaatagtctgagaaaatgctggtga

SEQ ID NO: 11610 - DNA, 121 bp, Artificial Sequence
  Synthesized
  misc_feature (61): n=a or g
acttactcataagtcaacttctcatgagcaagaattgctgtggccagttctccctctgagngagaggagagtgaggcttggtgcattagttacagaggtaggtgcccatgttccttctcct

SEQ ID NO: 11611 - DNA, 121 bp, Artificial Sequence
  Synthesized
  misc_feature (61): n=t or c
acagccccgggacagctcctccagaccaacaacagcaatgggagctttcaagcaaagctgnggtgttctttgctccacgagtacatagaggaagggaataacaactacacctctgctaaca

SEQ ID NO: 11612 - DNA, 121 bp, Artificial Sequence
  Synthesized
  misc_feature (61): n=a or g
ctatgttacagtatatgctcgatcagtttgtgtttgcacataaagattatttttataatgnagaccactaagactacaaagaaaggtaatgcaagatcttgttttgcattcttttaacagg

SEQ ID NO: 11613 - DNA, 121 bp, Artificial Sequence
  Synthesized
  misc_feature (61): n=t or c
attacctcttttcctgtcactgaatattactgagaagtacggcttcatctcttttactccnctgtgaaggagtcctggcactcctccaccagaacagttcctgctctctcgcagtctctcc

SEQ ID NO: 11614 - DNA, 121 bp, Artificial Sequence
  Synthesized
  misc_feature (61): n=t or c
tacagttcatctagtgtttaaactctactctaggtttctagacagcttgcattcaacagtngaaggtagcacagagtcctatctacattgcacaatctttattcaccatctccaattggtt

SEQ ID NO: 11615 - DNA, 121 bp, Artificial Sequence
  Synthesized
  misc_feature (61): n=t or c
ctgtgccagtaaatgtcataagttatttctttagtacattacaactcaataaaggatcttnacctgatatgccactgagtctctgcaaaacgtttgcgttccctgtctctaattcccagtc

SEQ ID NO: 11616 - DNA, 121 bp, Artificial Sequence
  Synthesized
  misc_feature (61): n=a or t
accaccaagtaagtgcaatagttagttaatggccagacctgtgattatgactctgtagatnatttgagtctggggaacttactttcttaggcaaatgactatcatattatctgaagatact

SEQ ID NO: 11617 - DNA, 121 bp, Artificial Sequence
  Synthesized
  misc_feature (61): n=c or g
tgtgcagccacatagaccctattctcaagaagggtgaaaaccaactggaaaagtatccatncttttcaacaagaaaaattagtcccttgttttcctgaacacatccttcatgattgttcaa

SEQ ID NO: 11618 - DNA, 121 bp, Artificial Sequence
  Synthesized
  misc_feature (61): n=t or c
gcccagttttttactggaaaaacagaatgttctttgctcatgaaacttaaatgcttctccncacagaaggagtactttattgtttttgagattgttttgctttgatgtgatttttttcata

SEQ ID NO: 11619 - DNA, 121 bp, Artificial Sequence
  Synthesized
  misc_feature (61): n=t or c
caagtaggccattttagactaaaagttgagaactcagtttcacttctaagaaagccattangagattgcttacaggtattttgacctgtatttataatactgagcaaaacttgtccatgca

SEQ ID NO: 11620 - DNA, 121 bp, Artificial Sequence
  Synthesized
  misc_feature (61): n=a or g
atattttcagaatgacacacaaacaaatacagtgaattctttccacatattgaaatatccntgggttatatagatagtatgtccaacttgtgcaacaaaccaaagtagggttacttcacat

SEQ ID NO: 11621 - DNA, 121 bp, Artificial Sequence
  Synthesized
  misc_feature (61): n=a or g
tgcgagccttcagcttctcgtctccccttcctcagtacctgcccctgtaagctgatgttcngtgacatctgagctgggcagatgtggaggtcgttcaaaagaaaatggtattttcgattgg

SEQ ID NO: 11622 - DNA, 121 bp, Artificial Sequence
  Synthesized
  misc_feature (61): n=t or c
aaagctgactgtcagacacacatagtgctttaccaaaagctgcgtcttcagtcacatcttnctgctgatcactttctccctctgttccacactgccccagtatgcaccactcttggcaccc

SEQ ID NO: 11623 - DNA, 121 bp, Artificial Sequence
  Synthesized
  misc_feature (61): n=a or g
gtctttccctggcactgggatgtcaccaaggatgctcgcttcgccttcacagtaggaagcntcagcctcaattctctctgcagtgtcttgttgctggatgtgttatgctctttacgtgggc

SEQ ID NO: 11624 - DNA, 121 bp, Artificial Sequence
  Synthesized
  misc_feature (61): n=a or g
acgcttctgtgctatgaacaacaccgctttacctctcttcctaacctttgccatccaactnatgcaatatctgacacctgatgtcctttgaggagacctcattgcaccttctagtacctaa

SEQ ID NO: 11625 - DNA, 121 bp, Artificial Sequence
  Synthesized
  misc_feature (61): n=a or g
tgtaaatgttagcattaacctgttattaatgcagtgcattaatcgtgcattaaataacacnttactggaaagccttgagatgcttttggtctgtgacaaatgaattgaccagcggggtata

SEQ ID NO: 11626 - DNA, 121 bp, Artificial Sequence
  Synthesized
  misc_feature (61): n=a or g
cagatgcaactctgctaaaaatcagttgaaactggttaaaacttgttaatttggtaacacntgaaaatccagggagatcttttcggtctttaacccaggcgatccgatagagtcaatagaa

SEQ ID NO: 11627 - DNA, 121 bp, Artificial Sequence
  Synthesized
  misc_feature (61): n=a or g
gcagattatacaggacacgtgtttaagtttaaattctgttaaaatcagttattacagtaantatgtctgcagttccaacaaaggtatttagcatttccctttgcggtagttagtcatcttc

SEQ ID NO: 11628 - DNA, 121 bp, Artificial Sequence
  Synthesized
  misc_feature (61): n=t or c
tgcgtaaatgagcattaatgaaccaatttaaaattatttctctatgagcaatttcagctgngagtcgcttgattatgtgaatccaaatgatgtgggtggggggagggagagcataaaacat

SEQ ID NO: 11629 - DNA, 121 bp, Artificial Sequence
  Synthesized
  misc_feature (61): n=a or g
tttttttttttttttttttttttttttttttagggatacaaataagcagttgtataagaanacttttggtaatgaccgagaacacatagagcttaattcagaatatttctcttcgaagata

SEQ ID NO: 11630 - DNA, 121 bp, Artificial Sequence
  Synthesized
  misc_feature (61): n=a or g
taatgagtgcgcttatcccccatcccattgattagatttgcagctctccctgttttcctcnttttacccaaagccaactgtcttaggattatgagagatgctgctcacgcaggctctccaa

SEQ ID NO: 11631 - DNA, 121 bp, Artificial Sequence
  Synthesized
  misc_feature (61): n=a or t
caattttccttaactgaggcatgcgtaagtgaaattaattctaactcactgtattaaactntcattttttcaacagtgtatttcctatctccagtttatatatacttacgtatattttaaa

SEQ ID NO: 11632 - DNA, 121 bp, Artificial Sequence
  Synthesized
  misc_feature (61): n=a or g
caatgctccttaatggaaggctgagaaaagggcaaggaggtggctatcctctcctcatttntaacaacatcatctaagcaggtccttctgccactttacatacaaaaacatgattaagtca

SEQ ID NO: 11633 - DNA, 121 bp, Artificial Sequence
  Synthesized
  misc_feature (61): n=t or c
tgcttttgcagctttttgggtcttggtgctgcttggagcatctctgagcattgtgcaaggngatgacaacgtgtcccttgtgccatgcacctgccgtgcccccatgttactggtgcctgtg

SEQ ID NO: 11634 - DNA, 121 bp, Artificial Sequence
  Synthesized
  misc_feature (61): n=t or c
tccccctccaaaggggagcatcagtgacataacactgcaagagtgacacacagagcagatngtggggcaactaccagttattcggcatcctgtaacacatggaagaaagcttaaaaaaaaa

SEQ ID NO: 11635 - DNA, 121 bp, Artificial Sequence
  Synthesized
  misc_feature (61): n=t or c
gaagttataatgcttgttgccagttctaacgatgttttccttcagctggaaattttttacnggggatacaatcaaataccttcaccaggaagaccttatcctgagctgaaaagaacactat

SEQ ID NO: 11636 - DNA, 121 bp, Artificial Sequence
  Synthesized
  misc_feature (61): n=t or c
tgctccagttttactttcttgtctcaaatctaaagggggcaaaaaactgaattggcatttnggctttacaatttttcaactattagccttactacctacagttttactcacatcttgtctt

SEQ ID NO: 11637 - DNA, 121 bp, Artificial Sequence
  Synthesized
  misc_feature (61): n=a or c
cacttataatacagctaactttcactggaataactgatgttatattgttcagtcttgtggntgggaaatgcatctcattccttgcctacctgtacgtaacttctgatgggagacctgtatt

SEQ ID NO: 11638 - DNA, 121 bp, Artificial Sequence
  Synthesized
  misc_feature (61): n=a or c
agtctttatgccctacatccttactttacagctgggaaagaggtactctgtatgtgaattnaaacatatctctgattttgaacattggatttaaatgtccttagatctgaatacttaagaa

SEQ ID NO: 11639 - DNA, 121 bp, Artificial Sequence
  Synthesized
  misc_feature (61): n=a or g
ataagtgctggtggaagcagcaaagcgtggctggctgcttgactcccagctgctgcctttnctgtggtatcacatgcttcccttttccttctcgtggaggtgagggaaggtgcaaagcttc

SEQ ID NO: 11640 - DNA, 121 bp, Artificial Sequence
  Synthesized
  misc_feature (61): n=t or c
atctgctacagggaacagagtggcaaggatgtgagaaagcacagagaagctctgagtccanctgatttgttcgacacccacaaatgaacccccacagtgcccagcagaggaggctcctcgg

SEQ ID NO: 11641 - DNA, 121 bp, Artificial Sequence
  Synthesized
  misc_feature (61): n=a or g
aaacagaagccagagagagtattttctattccacgtcaaaataatctatggactagttgtnttatctttcctttttctggagattgtgaattcctaaataaaattcaaaaaagaggcataa

SEQ ID NO: 11642 - DNA, 121 bp, Artificial Sequence
  Synthesized
  misc_feature (61): n=t or c
ggagcagacagcagctaatccctaagtgagagttagtattccctatccattccttaaagantcccattaacttttcctaaactgcaaatccaccagaaaaaaaaaaagaaaaaagaaaaaa

SEQ ID NO: 11643 - DNA, 121 bp, Artificial Sequence
  Synthesized
  misc_feature (61): n=t or c
gccttatattgacactttggtgtatttaccttcttgagtcatttactgtcttgttttcatngtaataaatgataaattagttactggttttttttctttaattaaaagaataatcttaaat

SEQ ID NO: 11644 - DNA, 121 bp, Artificial Sequence
  Synthesized
  misc_feature (61): n=t or c
ccgaagccattctatggttctgtgttacaaacccaaccttgcatgttgctcagccactccnctaccaacagtacagctttctacgtacgttttgtccatctgctgttgttcacttaagctt

SEQ ID NO: 11645 - DNA, 121 bp, Artificial Sequence
  Synthesized
  misc_feature (61): n=t or c
cacacaacacagagctgccccagcgtgagccgacatcagcccacccgcaaccgcgtcctgngcctcctggtgcctggttaacactaaaggtgctcccagagcacaggatgaagcccagcag

SEQ ID NO: 11646 - DNA, 121 bp, Artificial Sequence
  Synthesized
  misc_feature (61): n=a or t
caggaatcatcagtgaaggaagggcaaaagaaacagacaacagttaacaggattaggaacngggatagagacatcctccaaaagggtttaagaagctaaagcacaaagcatctaaactaaa

SEQ ID NO: 11647 - DNA, 121 bp, Artificial Sequence
  Synthesized
  misc_feature (61): n=a or t
gacaaaggacttcaaaactttttcagatcagcctgcatgcgttgtctaaaagggaatcagntgaaaagtttaataacctctaaggcgagcatgattttaacgaagcaagaagcccttgaga

SEQ ID NO: 11648 - DNA, 121 bp, Artificial Sequence
  Synthesized
  misc_feature (61): n=t or g
tagttctggtgttggctggcccattagtaccttaatttgattattcaagccaggtggttcncttcactactcaacctgaatatggtaaggtcagtgcctcaagttaaattatatctctcaa

SEQ ID NO: 11649 - DNA, 121 bp, Artificial Sequence
  Synthesized
  misc_feature (61): n=t or c
ataaaattagatgactttcctggatcataaattttcaatgaagtaaacggcctctttccanacctggcaggaaactttcagcagatgctgttcaggtgtctcctgaccttggatttttatg

SEQ ID NO: 11650 - DNA, 121 bp, Artificial Sequence
  Synthesized
  misc_feature (61): n=t or c
gggtaagttgttctatagaaagagaattcctttgtgtgtttgaaaccagtaacaagctacnagtctgagcacctaaccgcattcaggtgtacagcagcagtcacatttgacagcttgtcct

SEQ ID NO: 11651 - DNA, 121 bp, Artificial Sequence
  Synthesized
  misc_feature (61): n=a or g
cttcaacccagatgacatgtccgaaatggagttcaaaagaggagggacaagagctactgcnggaccacggctgggctggtctagagacctggggcagtctcgcaagtaagacgatcagtgg

SEQ ID NO: 11652 - DNA, 121 bp, Artificial Sequence
  Synthesized
  misc_feature (61): n=t or c
tgtttcggttttttttcctatttattttgtgtaccagttgaaagcctgtacacttaacttnctcttaccattatttaatgtagctgaaatatagagttgaaaatccattatgttgaagagc

SEQ ID NO: 11653 - DNA, 121 bp, Artificial Sequence
  Synthesized
  misc_feature (61): n=c or g
tgagcatgtggtgagctgtgtaaagggatggggtggttaaaagctttggctacggacatgnagcttaggagttacctgcacaaaaataatatcactcataactctagagctttaccaagca

SEQ ID NO: 11654 - DNA, 121 bp, Artificial Sequence
  Synthesized
  misc_feature (61): n=a or g
caaatgcctgtggaagctgtcatgaagcctgtccacagttttgctcagtggttggtatatntcttctcttcctccccagggtaaactgggggtaaactgtgaggataataaaccaagggta

SEQ ID NO: 11655 - DNA, 121 bp, Artificial Sequence
  Synthesized
  misc_feature (61): n=t or c
atgtgtctttcttcctacactgatttaaagcaaatacttagggctattaaaacagccccantgccagaaggagtgatgacactgatgggatggcattctctacataacagcagaggttcca

SEQ ID NO: 11656 - DNA, 121 bp, Artificial Sequence
  Synthesized
  misc_feature (61): n=a or g
ttgttgatttgctgctccctggactgtaatttattagaaattgcttctgatgtttacaggntgcaaaaagagaagttcaatgtaaataaggtgctgctgtatgtttaaatgtcccttctgg

SEQ ID NO: 11657 - DNA, 121 bp, Artificial Sequence
  Synthesized
  misc_feature (61): n=t or c
gatttatgtgctactgaatacccttagtaatggtaggttcttgaagcttctatgataattnttctgttcaagtccagaagtaattctggtataacttgctctattttgaaaagacagaagg

SEQ ID NO: 11658 - DNA, 121 bp, Artificial Sequence
  Synthesized
  misc_feature (61): n=t or c
agtaaggcaaacagaacgtcagcacaaataactgaggtcatcgtatttctgacaagttccntgggtgaaacgctgagctcatattgcaggagtccaacatacatgtacagcacaaaaaggg

SEQ ID NO: 11659 - DNA, 121 bp, Artificial Sequence
  Synthesized
  misc_feature (61): n=t or c
ggtgctggggctggctcctgtcatccctggaacagaagaaggctgtgtcagtctctgaggngttcccctgctagctgcagagcatcacctggggtggagagcaagttcagctaaacccact

SEQ ID NO: 11660 - DNA, 121 bp, Artificial Sequence
  Synthesized
  misc_feature (61): n=t or c
ggccagcagcagcctctgctttcttgctttgccctcagtcaacacagctctccggatcagngccttctccagtacctcggtgcttttcacagggtgctgctttgtgaatgaggtttatgag

SEQ ID NO: 11661 - DNA, 121 bp, Artificial Sequence
  Synthesized
  misc_feature (61): n=t or c
ttcttgcatcattcacaccaatgtttctgtgtatgtgtgcaaggttaaactggttccttcntttagagacaagaagagattttctctagggccagaggagaaggccctatttgcagttatt

SEQ ID NO: 11662 - DNA, 121 bp, Artificial Sequence
  Synthesized
  misc_feature (61): n=a or g
ttcataacacgtatttgtgtggcagcctttaccacacatgtcatatctgcaatggtctgcnctccagatggctggataatgagagcccactggcctggcctggacgaggttcccaagtctc

SEQ ID NO: 11663 - DNA, 121 bp, Artificial Sequence
  Synthesized
  misc_feature (61): n=a or c
aagttttgcttttaaaaatatcaaacatatttaaatacatatttaaaatataaatcaagcntagctttactggcatcaatacaaatcaattctgatgagatcagaattcagttcttctctt

SEQ ID NO: 11664 - DNA, 121 bp, Artificial Sequence
  Synthesized
  misc_feature (61): n=t or c
atgtatattgacgaaatgcataatttatcaggctaggtggaagacaaggatattacaatantgaatacaagcatattcataattatctgtaaaactgccaaattggaacattttcttaact

SEQ ID NO: 11665 - DNA, 121 bp, Artificial Sequence
  Synthesized
  misc_feature (61): n=a or g
gaccttcagacatagatggaaaaaaactttagccagcttgtcagtgtactctactgctccnttagaaattcagtgcttatcaaagcctgtcttccgtagcgtaatggagatgtgagatctc

SEQ ID NO: 11666 - DNA, 121 bp, Artificial Sequence
  Synthesized
  misc_feature (61): n=t or c
acttgctttgggatgattacccacagcttaacatatttaacattgacattttaaacagtangtaggttaactgactactgttccatgcattaacacaataaggatgtgggaaaataaaaag

SEQ ID NO: 11667 - DNA, 121 bp, Artificial Sequence
  Synthesized
  misc_feature (61): n=a or g
ctattttggctctcctgtagaggatatttggtggctgtttctgatacctgccaggaaatcntgttcaacctgtctgaacaacaggtgaattggtgacctgcctcagcagttaggtatgatg

SEQ ID NO: 11668 - DNA, 121 bp, Artificial Sequence
  Synthesized
  misc_feature (61): n=t or c
cacagcagttcgtatctgtgaccaagatttaagatttcttcccagttctgcttcaagatgngctgtaatcttgctagaagctgttaagagaaaaatttaagtgactccatgaatgactctg

SEQ ID NO: 11669 - DNA, 121 bp, Artificial Sequence
  Synthesized
  misc_feature (61): n=c or g
tcagctgatcaaggccatttcctgaagctgttcctatgcaaattaagatgaagtgacaggnctgtggtcgatacagccattagtacctgagacataaactaatatcacatactaaaggcag

SEQ ID NO: 11670 - DNA, 121 bp, Artificial Sequence
  Synthesized
  misc_feature (61): n=t or c
ctgaaggacaaaaaactgagaagaaagtctcaacataccattgtgctgtgttatcttccanatggaacccaggctacggtcagtcacgcgatagactaagggcatgctgtaagaagtgtca

SEQ ID NO: 11671 - DNA, 121 bp, Artificial Sequence
  Synthesized
  misc_feature (61): n=a or g
gggcagattcaaagtcagatagtacccatctgcgggctacagccagcaaggtgaaaactangagagagattttaaagtaaaaatatcagaacactgagcaaaattccatttcagtactgat

SEQ ID NO: 11672 - DNA, 121 bp, Artificial Sequence
  Synthesized
  misc_feature (61): n=t or c
cagcactgtggtgccacgagatgggcctcggtgcattacgtctgatctctggttctgagangttcgtagagcaggaggcagcgatgggagcacaggtctgcctcccacttcacccagcctc

SEQ ID NO: 11673 - DNA, 121 bp, Artificial Sequence
  Synthesized
  misc_feature (61): n=a or g
tcctgaacgctaacaaagaataagatgtaacaaaaaactactttagaacaagccagatagncttcacttgcaattaaacaccttctgttaatccaatgaacatctagtaggaagcagagaa

SEQ ID NO: 11674 - DNA, 121 bp, Artificial Sequence
  Synthesized
  misc_feature (61): n=t or c
ttgttttgttttttaatatatatctttgtgatcttgctttcctttgaatggatactgtttngtaatctcatcaacatttcttaggtgtttcttacccttctacacataagaatgtatttta

SEQ ID NO: 11675 - DNA, 121 bp, Artificial Sequence
  Synthesized
  misc_feature (61): n=t or c
gtggccttccgcagcttcaccccaaagctgtcttaacctcttgcgcttctgcttttggaangggcccgaatacatccataaagcatgccattaccttcctcggagactgggaggttttcta

SEQ ID NO: 11676 - DNA, 121 bp, Artificial Sequence
  Synthesized
  misc_feature (61): n=a or g
gttcctagccttgatctggattatttctttgatactgtccagtaattaacttatttctcantgaaaaattagaaatcttatgctcctagatggctacactactttggcaccaccaagccta

SEQ ID NO: 11677 - DNA, 121 bp, Artificial Sequence
  Synthesized
  misc_feature (61): n=a or g
ctttccgtctatctatttaaatctctttgttgatgccactcagctgattcattatgccacnagcatatattgctacagtttggagataagaacgctctgctagattaaccctatggcccct

SEQ ID NO: 11678 - DNA, 121 bp, Artificial Sequence
  Synthesized
  misc_feature (61): n=a or g
ttctttttctggtgagtatctactgatttctctgccaccataatcccatgaaactatagcnggcttctgtcatcaactgttaatagatttttctcacccttatttggggattcatcatcac

SEQ ID NO: 11679 - DNA, 121 bp, Artificial Sequence
  Synthesized
  misc_feature (61): n=a or c
aaagaaagcagctgaactgtcaagcagaacgtgggcttatcagctacctcaacatcacaanctttgtcaaacttgcttagttcctcactggaattccacgcacaatttgggccacagatga

SEQ ID NO: 11680 - DNA, 121 bp, Artificial Sequence
  Synthesized
  misc_feature (61): n=t or c
cttcactctatttgttctgcttacactctgtatgccaaaggaatttgcaagtgttctgtgngagcctgcatatggacctcttgctaatctccacatcaaggatttgcaaatgtttcacagc

SEQ ID NO: 11681 - DNA, 121 bp, Artificial Sequence
  Synthesized
  misc_feature (61): n=t or c
ttggtctgagagttagtctcttgagatactgcctgcagtacagacacagccttagatgaangtcatacttctcaacaagatgtaattaatgtgctttactggaaaattggtaaagccaacc

SEQ ID NO: 11682 - DNA, 121 bp, Artificial Sequence
  Synthesized
  misc_feature (61): n=a or g
aggacataattgagcgcagactttatagattacttgttatacagtactggtctgtttttcnttttggatgatgtttgagaaatggcaacagaacagaaacaacataccacattatgagctt

SEQ ID NO: 11683 - DNA, 121 bp, Artificial Sequence
  Synthesized
  misc_feature (61): n=a or g
tagtgaagtacatttcttaataaaagaatttaaaactatgatattacaataaatagttttnagtagtttccgtttgttgtgttgagatagtatcagaaagacacaggaaaattattcaatg

SEQ ID NO: 11684 - DNA, 121 bp, Artificial Sequence
  Synthesized
  misc_feature (61): n=a or g
ccctgcagcgacacagttgtgcatggggaaaactggggggtgggggttacaaacctgtcanaggaaatctgttgccagagcagagtgggcgttcagtctgtgctgaggtgtcgtgtatctg

SEQ ID NO: 11685 - DNA, 121 bp, Artificial Sequence
  Synthesized
  misc_feature (61): n=a or g
tggttttcattgccctcagaatctaatcctgcattacctttgaactgttcatgagagtgangtctttagcccaggctggccccagcccaagctgaacatgtaccccaggaacagcagtcaa

SEQ ID NO: 11686 - DNA, 121 bp, Artificial Sequence
  Synthesized
  misc_feature (61): n=a or g
aaatgcaaatggtaagttccagaaaacaaaacttttagggtaagacatcttaaatgctctnttatgtcaagaaagctctgtgtggccttggacaaatgaagaaaggcttcacatctaccat

SEQ ID NO: 11687 - DNA, 121 bp, Artificial Sequence
  Synthesized
  misc_feature (61): n=t or c
atgcagggagagagacaaacaccccaagtagatcaaagacattgtaaagggtaggaggganggctgaaggcatcagcatctccacacagggttggggagcagagggaacagtacatacctc

SEQ ID NO: 11688 - DNA, 121 bp, Artificial Sequence
  Synthesized
  misc_feature (61): n=a or t
attgctgcattgtttgttaaacctctccttcaaagcagatataaccatcccatttttgganggtgtatgcaggttgatcagtgaaacaactgacgttttagtattatgtgacctggcaccg

SEQ ID NO: 11689 - DNA, 121 bp, Artificial Sequence
  Synthesized
  misc_feature (61): n=t or c
attacgctggataaagccagatgagtcaaaagcaaggatttatataggtaacagggagtgngtgttgatactgatggcaagaaagttgaactggagctgggggcagggagaaattttacca

SEQ ID NO: 11690 - DNA, 121 bp, Artificial Sequence
  Synthesized
  misc_feature (61): n=a or g
gattcaattttaatcattttaattttgttactcagtgccagggtagtcttgtagggcatgnaaggggtttaaaaacaccagctaggttacagcctgcctccccagctgccttgcattttta

SEQ ID NO: 11691 - DNA, 121 bp, Artificial Sequence
  Synthesized
  misc_feature (61): n=a or t
gctgttcaggatgagccgtcttataataagtgacagaaatctgtaattgtaaatgctgaanaaatactgtgaatggtaaatggtgaaaacaatcagattgtactccattcaaagaatgacc

SEQ ID NO: 11692 - DNA, 121 bp, Artificial Sequence
  Synthesized
  misc_feature (61): n=t or c
atccccgtgcagcacagcagtcagaggttgctctatgggctgcaccttactggctgttttnctggatgcagctgagtcatagaaccttagatggtttgggttggaaggggtcttaaagatc

SEQ ID NO: 11693 - DNA, 121 bp, Artificial Sequence
  Synthesized
  misc_feature (61): n=a or g
aggacctgcatgccagtgggaaaacaccgtcttttgaagcaatgttgtgcaaatttagtanggttttccctgggacatagattcagttattgcaggccgtatttcagttgtaagatgggct

SEQ ID NO: 11694 - DNA, 121 bp, Artificial Sequence
  Synthesized
  misc_feature (61): n=a or g
aaatctccaggaccagacaaagtttatttcaaatttctggaaggagtaaagagagaattcngctgaacacctaccaaaatatgcagaaaatatcaagatagccactccgtaaggagagcac

SEQ ID NO: 11695 - DNA, 121 bp, Artificial Sequence
  Synthesized
  misc_feature (61): n=a or g
ggagaagctcctgtcttacacaaggcaagaatcatggcaaatgaatgagatgtaccaaatngaaaagagttggttcaggacatgaccgcagactttccaattatacctctctagatgctgc

SEQ ID NO: 11696 - DNA, 121 bp, Artificial Sequence
  Synthesized
  misc_feature (61): n=a or g
ctgcactgcacagtttgaactgtctctctgcagtgatttatgatcacctggaggaaaaatnaaattaccagtgcgtctttcaatgtgatggaagcaattagctcagagcttccatccgtat

SEQ ID NO: 11697 - DNA, 121 bp, Artificial Sequence
  Synthesized
  misc_feature (61): n=t or c
ctttggagtggtcagtgggtagccaaaaggcattggaggtgtccagaaccctttggagatngttaaaatcctttgggggtgatcaagattcacatggcttcagtgggcaatgactacaggc

SEQ ID NO: 11698 - DNA, 121 bp, Artificial Sequence
  Synthesized
  misc_feature (61): n=a or g
taatttggagaaatactatgaagtgcccagcttaccaactttattaaaaatgctttgcagnttactaaagaaccttctgagatcaagggctcatacagcttccaaccctcaccattttttt

SEQ ID NO: 11699 - DNA, 121 bp, Artificial Sequence
  Synthesized
  misc_feature (61): n=a or g
ttttaagagctttctggtgtgttgttatctttcaccatgaaagagtttcacccctttcccngagatgcaaagacagctgactttgcccagacaaaactggccaagaacctgtataatgtaa

SEQ ID NO: 11700 - DNA, 121 bp, Artificial Sequence
  Synthesized
  misc_feature (61): n=t or c
tgatctatcattggactaatgttgtgttcttaagctcagttaagtgtcccactgcctttantgacatagcttaaaaacataaacatccttgctgagtgtcagtatttcaggttatctaaaa

SEQ ID NO: 11701 - DNA, 121 bp, Artificial Sequence
  Synthesized
  misc_feature (61): n=a or g
aagtctttacaccggtagctgttacctgtcattaacacagtaactcacacttaactgcatnctcacacacactcactcagagcatgggcagccttttaggaactagcatttctacattttc

SEQ ID NO: 11702 - DNA, 121 bp, Artificial Sequence
  Synthesized
  misc_feature (61): n=a or g
ggaagcttttcctgtgctggatttgggggtcgcacccatgggttacgtgggatattaggancaatttcctctcagggtgggcagtgctgcactgcgcagctgccagcggggggtcaccaac

SEQ ID NO: 11703 - DNA, 121 bp, Artificial Sequence
  Synthesized
  misc_feature (61): n=c or g
tgatacgcttcaaaagcttataatacagctgtactagataatatttatgtactaattagtnctataataaatgaaagcatacttgtaacaggcttaattctgtttacatcagttcagaatt

SEQ ID NO: 11704 - DNA, 121 bp, Artificial Sequence
  Synthesized
  misc_feature (61): n=t or c
agtgatgctaactagccaggcttcttcatgttaagacagaaattggagtagaagttcagcntgtgtgctgtacagatgagagtaactccatacatgtggtatgtatggatagtggttctgt

SEQ ID NO: 11705 - DNA, 121 bp, Artificial Sequence
  Synthesized
  misc_feature (61): n=a or g
tcagacactgtatgcgtatattcagataaatacaacagtcattcagcacagggtgagaagnaatacaacaagctactcaccagaaagaggatctttgccaatcattagaacatttggtaaa

SEQ ID NO: 11706 - DNA, 121 bp, Artificial Sequence
  Synthesized
  misc_feature (61): n=t or c
agtattgtattttcatctttctaaaacttctcatatgctttctataaccatgacatcacantatgctgaataagaagttccagagtgtggacaattagtactaacttttacttatttttat

SEQ ID NO: 11707 - DNA, 121 bp, Artificial Sequence
  Synthesized
  misc_feature (61): n=c or g
atgagctctgagcaggaagggagagtgaacactggaaatggtgggaacaggggactgctantgagggacacttaggtacagctcacacacaggtgcaatgtgggaacccctccatccatcc

SEQ ID NO: 11708 - DNA, 121 bp, Artificial Sequence
  Synthesized
  misc_feature (61): n=c or g
ctctgttacacacgagccattttgctcatgcctccagctgtatttagtaatagtataatgnctgagtttgagttttctccaatatttaagtataacagtctgtagtgaaaatcagttttta

SEQ ID NO: 11709 - DNA, 121 bp, Artificial Sequence
  Synthesized
  misc_feature (61): n=t or c
gcagagacccatctacctgtcacaacctgatgtgttttcagtgcagttttatgtgatgganggtttgggccccctaccatttactggccaaaagttaatgcgaatgctccagaaatttgca

SEQ ID NO: 11710 - DNA, 121 bp, Artificial Sequence
  Synthesized
  misc_feature (61): n=t or c
gggtgctttgtcatgggcacctgagtttaactgctgcatgccaagatctatggaaattccnatttccaagtgtaaataccttcctgctgtctctcttgacctttatattaggagcagcact

SEQ ID NO: 11711 - DNA, 121 bp, Artificial Sequence
  Synthesized
  misc_feature (61): n=t or c
catggatgagaatctgcctcacagctcaaaacaatgaagggtgttggggagcccattctgncttttatgctacttgatggcacaaaaccaactcaaaacaggcactctcagtatctgcttg

SEQ ID NO: 11712 - DNA, 121 bp, Artificial Sequence
  Synthesized
  misc_feature (61): n=t or c
cccgggcctcccgcgtggcaggcgagaattctaccactgaaccaccaatgcacgacttgcnatgttatatggatggtctgtcctacaatatatcaaacattgggtttctgctgtgcttttc

SEQ ID NO: 11713 - DNA, 121 bp, Artificial Sequence
  Synthesized
  misc_feature (61): n=a or g
ccaagatacaaacattagtggatcaacagcagttactcaaatacataactgagttacattngatctttatcagaaggcaggatacagagtcttcacgctcagatttcttttaatcagaaca

SEQ ID NO: 11714 - DNA, 121 bp, Artificial Sequence
  Synthesized
  misc_feature (61): n=a or g
gttttaagtttgtcctctcctctctattggtttaattccatgtttttcactattgaagtgnaagggcttcagtaaaatatcagatcgtattttttttctgaacagtccaggccatttatca

SEQ ID NO: 11715 - DNA, 121 bp, Artificial Sequence
  Synthesized
  misc_feature (61): n=a or g
tgagaagtgtagaggagtacacgcataggatgatagctgaggccttgaaagaagagacatngatgataccagaggccccagggttataaacaaattccccgtggtcagttactggtcacta

SEQ ID NO: 11716 - DNA, 121 bp, Artificial Sequence
  Synthesized
  misc_feature (61): n=t or c
aagtatgaaaggagaaaagagggtatcaggcacaacagtaaaggtaaatttgctgaagtgntgcagattgagaagtaaatgcatgaactccaagagtgaagtcttgatcctaaggcacccc

SEQ ID NO: 11717 - DNA, 121 bp, Artificial Sequence
  Synthesized
  misc_feature (61): n=c or g
gtttaatcccattctctgggaaaataaccgggctctggcagaggataatgtgggctggcanaggcagggctgctgaagggaccagtgagagcagcaatgtgtggcatctctcaagatcggc

SEQ ID NO: 11718 - DNA, 121 bp, Artificial Sequence
  Synthesized
  misc_feature (61): n=a or t
tgtctcttgctgatttcaaggactagcattccttttttacagtgtgactctaatttgcaangtatctcttggcatctttgcagacattgttaatatgggcttctgtttcttcttcccctat

SEQ ID NO: 11719 - DNA, 121 bp, Artificial Sequence
  Synthesized
  misc_feature (61): n=t or c
tttctaaggagacaggtgcatgcaggactatgctaatgcgtgttctgcttttaacccctgnacaacctgcagggcagttctggccaagtgctgcaggaggaagagctttcagaaactgaaa

SEQ ID NO: 11720 - DNA, 121 bp, Artificial Sequence
  Synthesized
  misc_feature (61): n=t or g
gaaggactgtggccatggacagcttggcagcacccacctttatatccctatctccaccctnagcaacaaaaccctgcagcttctcatcgtaatcacagcactgctggaaaatcccaactcc

SEQ ID NO: 11721 - DNA, 121 bp, Artificial Sequence
  Synthesized
  misc_feature (61): n=t or c
tctcaagaagcgggtcaataagtgctttgataattcatttaattacaaaatgttacaaacnactttataaaaatccacttttctagttgcaaaccaagattacccaatttgcacagaaaat

SEQ ID NO: 11722 - DNA, 121 bp, Artificial Sequence
  Synthesized
  misc_feature (61): n=c or g
agcacgttaacttgtcccatgtaaactctcctatctagattgttacattacacagactttnaactctagagcgcaatctgttgtcattgattgcttttgtactatgtataccagctactga

SEQ ID NO: 11723 - DNA, 121 bp, Artificial Sequence
  Synthesized
  misc_feature (61): n=a or g
gtcacccaattcccaccaagcttctttggctccagcctggacttcgcttcctctcccatanctgatatccttcacgcttgtgtgccattttgaagcgatcacggtgaaggaattttgtctg

SEQ ID NO: 11724 - DNA, 121 bp, Artificial Sequence
  Synthesized
  misc_feature (61): n=t or c
aatatagaaaatgcatttagaaggttgtggactcacctttcaattctttgtgaaattctangtacaaaaagaaacattcatttttaagctcatttctaaatgtgatggtgccgtactttac

SEQ ID NO: 11725 - DNA, 121 bp, Artificial Sequence
  Synthesized
  misc_feature (61): n=a or g
aggtggtctcacaacagatgctgacttcccatgggatccagacacatccacatggattgcngcttccagccacaaataatgaatccagattggctccactgtcatttcctgggagaactct

SEQ ID NO: 11726 - DNA, 121 bp, Artificial Sequence
  Synthesized
  misc_feature (61): n=c or g
attatgtgccagttcagttaatgctgtcttgtagacattggtggtttaaattcaaagtatnttaaaggttttcaccttgttctacagaaatctacaggttaaaaaaaaccaacaacataga

SEQ ID NO: 11727 - DNA, 121 bp, Artificial Sequence
  Synthesized
  misc_feature (61): n=a or g
ctgctttcagtggagctgggaacttgcctcaggcaaaagcaaaactgcagaggttacaatntatgctcttccactccagctcccagtaacaagacctgaatggcagatgtattataattta

SEQ ID NO: 11728 - DNA, 121 bp, Artificial Sequence
  Synthesized
  misc_feature (61): n=a or g
gtgtcttcatgaagccatcattgagggagggctgactcctgacatggacctgtgaagatcntctttacataccccttcttctcctcccccactaaaagagctcatttctgtgccatttcca

SEQ ID NO: 11729 - DNA, 121 bp, Artificial Sequence
  Synthesized
  misc_feature (61): n=t or c
catttgcaagattttatggttggagaagataaaagggtgaaagaactaagacacaaatgtngggtcatcctgacaggctactgtgaaagagaatggcacagaaaattatggcagcatcaca

SEQ ID NO: 11730 - DNA, 121 bp, Artificial Sequence
  Synthesized
  misc_feature (61): n=a or t
aaattgcttttctccctagtcaaaggaaagaaccctgatgacaattcaaagtagatgcatnactaacacaaggaaggcattttcttggaatcacagcaactcatttttgccaggacagcgg

SEQ ID NO: 11731 - DNA, 121 bp, Artificial Sequence
  Synthesized
  misc_feature (61): n=c or g
atgcgaaatagacataaatgccaagcagtagtgatagttgtatctctatagcaaggcaaantcttaagtgattgcgtgatcaaccaacagaagaccggtctgtgaatattgcccatacttt

SEQ ID NO: 11732 - DNA, 121 bp, Artificial Sequence
  Synthesized
  misc_feature (61): n=a or g
taacgagtaatgctgcaattcttgcccaatactattggttctctccaacgcaggcatgganaacagattatttcatcatagatttctatgatttgaaaacatatcagatcaatcttttatt

SEQ ID NO: 11733 - DNA, 121 bp, Artificial Sequence
  Synthesized
  misc_feature (61): n=t or g
actgaagtgagactgcctgttagcaatgccattaaaataaatacgaggcatctatgtagtnccattcatttccttggaatttcaatcttattttaagatagcggtacagaagaattcagct

SEQ ID NO: 11734 - DNA, 121 bp, Artificial Sequence
  Synthesized
  misc_feature (61): n=a or g
agtgtagctcaggtaacctagagaatgctttggctacgggatgctcccagatggatcagtncctgctcctcctcaagctcacacctcacccagcccactaaggacacctccaagcatctcc

SEQ ID NO: 11735 - DNA, 121 bp, Artificial Sequence
  Synthesized
  misc_feature (61): n=a or t
agcacatttacatcacatgaacatcagaagtcagaaaggataaatcaaaccaaagcaacgnctcatgtttcctgttgttctagcatcaacaaaaaattcatcaaaagatagttacctgcct

SEQ ID NO: 11736 - DNA, 121 bp, Artificial Sequence
  Synthesized
  misc_feature (61): n=t or g
tttcattgtctcagaaaatagtgtttctccacaagttcaactttttaatgagctatgatgntactaatataagctgtgatttgactcagctggctttgtattgctcttccaaggtacagta

SEQ ID NO: 11737 - DNA, 121 bp, Artificial Sequence
  Synthesized
  misc_feature (61): n=a or g
ggcaatttgtcttctctttgaaatagattttcacttgattgtgttgtatttgtcacttacntctatggttgttactgcaaaggactgcattatcctgcaaagtacaaaatgtttctccaaa

SEQ ID NO: 11738 - DNA, 121 bp, Artificial Sequence
  Synthesized
  misc_feature (61): n=t or c
tattagagccgtattagaaaggctacagttcagagcaaggagttttactcgccagtagagngatgttgggttgtttgtgtggtaagaatagatttcttggaagagaagttttctccgaagg

SEQ ID NO: 11739 - DNA, 121 bp, Artificial Sequence
  Synthesized
  misc_feature (61): n=a or g
tgggaataatattttactgttacttattttattgtgtatatagagatcttgctcggtgacnctgccccaaccttgggaaagtgcagtaaagaacaggtactacactggctttcaactgaag

SEQ ID NO: 11740 - DNA, 121 bp, Artificial Sequence
  Synthesized
  misc_feature (61): n=a or g
atcaaatttgtccctgacctcatgtggctcaccaagaccaagctgcaggatactatcgtgngtagggcaggatgccaacaaatgagttctctgcatgagttttatgacttttgttgctttt

SEQ ID NO: 11741 - DNA, 121 bp, Artificial Sequence
  Synthesized
  misc_feature (61): n=a or g
gcaggtaatatcagaacacacagtataacttcatctctcttttctaactacttcagaattnaaaggcaagaggttgctttttcaacgtctgatggacagcagtaatttatcatgacagaaa

SEQ ID NO: 11742 - DNA, 121 bp, Artificial Sequence
  Synthesized
  misc_feature (61): n=a or g
aaataactacagcagcttatgggcacagaagtctgcagcctcactgatacgtctgccagcnttggtgctcagtctcatagatagaaatgaccagaaaaacatttttttttacctgcagtaa

SEQ ID NO: 11743 - DNA, 121 bp, Artificial Sequence
  Synthesized
  misc_feature (61): n=t or c
gaaaatcatacttgcctgcaccatttctgtgttttcgtattttcaattttgctgctgatantccttgctccagcactaagaagtagtggtactctcagaccttagtttgagtcataacaat

SEQ ID NO: 11744 - DNA, 121 bp, Artificial Sequence
  Synthesized
  misc_feature (61): n=a or g
ccaaaaaaaaaaaaaaaaaaaaagccacaaagcaaaattagggtataatcactaaatgtgncatttcgagtgccctgcattttccaggagagcatctcaggctgttgcactcccacataag

SEQ ID NO: 11745 - DNA, 121 bp, Artificial Sequence
  Synthesized
  misc_feature (61): n=a or g
aaaaacatgaaacaaaggatgaacagaggaaaatggaagtgatacaagactatttaatttngactacattcttcacattaagaaagagaaaactgagctaaccatcagggaacacttcctg

SEQ ID NO: 11746 - DNA, 121 bp, Artificial Sequence
  Synthesized
  misc_feature (61): n=t or c
gtggatctctagcatattcaacaacaaaatcaccaagtgctctttcacattgggacatggnaggagagaggaagacgctaagcagatcggtcaaaggtagcaaaaggaaaaatccgatgcc

SEQ ID NO: 11747 - DNA, 121 bp, Artificial Sequence
  Synthesized
  misc_feature (61): n=t or g
ttaaaataggtagtgttgaaagtgattttgaactgcttaatgaaaccccatgtcagatgtntctgggtgcataggatttttagagaaagtaaggcaaaaccctctagaatgttacggatgc

SEQ ID NO: 11748 - DNA, 121 bp, Artificial Sequence
  Synthesized
  misc_feature (61): n=c or g
agggcagaagggaaaatggaacaaaattgcatacacatcagagaggattttgttggtacantgctaaaaaaaatccctgtggctgcgctcatgtagatctcctaatgagcagggctcacta

SEQ ID NO: 11749 - DNA, 121 bp, Artificial Sequence
  Synthesized
  misc_feature (61): n=t or c
gagttgtcacaaatacatacatatattattataatagattaagacatttatatattgtttntgtacttaaaagtcaaagacagcttagcaccgaaagatattaataggaaagacatcagaa

SEQ ID NO: 11750 - DNA, 121 bp, Artificial Sequence
  Synthesized
  misc_feature (61): n=t or c
cttttgttatacaacagtgagaataatctgcagactgatggcagggctgaggacttggaanaggatacgtagtaggattttcatcttcagagagcaaaagctgatgttcagacatagcagt

SEQ ID NO: 11751 - DNA, 121 bp, Artificial Sequence
  Synthesized
  misc_feature (61): n=a or g
aataccaggcaaaatccctcaattcatgcacactgcctggctctggtagattcacctcccntcagagagggaggcagcccgtttgcttgggacatttagttgtacactatttattttttgt

SEQ ID NO: 11752 - DNA, 121 bp, Artificial Sequence
  Synthesized
  misc_feature (61): n=t or c
aaacaagttcctaccccactggtttttgactcccaagccttgagtgaaccagtgtctgcantccctcttctctttctgaacctgatttactgcaatatttatctcattgagggttgctctt

SEQ ID NO: 11753 - DNA, 121 bp, Artificial Sequence
  Synthesized
  misc_feature (61): n=t or c
aggatgaaagagaaacgtttaaaccttagctcatgtgcctctgccgttagtctaacaggcnaagttcatccttggtgtaactcaggggaagtcaaactgcgtacagctttttttcattttt

SEQ ID NO: 11754 - DNA, 121 bp, Artificial Sequence
  Synthesized
  misc_feature (61): n=a or t
ttaatcagctcaaaaatttcaaagtcttttataggaagatagagctattgttcatctgtcntggctataggaagcagtgctagtagttaagtgtaggtgttgaaaaattccacagtcatat

SEQ ID NO: 11755 - DNA, 121 bp, Artificial Sequence
  Synthesized
  misc_feature (61): n=a or g
ggctgtgattctgatttctaagcaagattttattgtctctaattgcatcatttcagagaantgacgatatccatacactcacctgttatgtttgccaggtctcctcctcgcccaagcccgg

SEQ ID NO: 11756 - DNA, 121 bp, Artificial Sequence
  Synthesized
  misc_feature (61): n=a or c
ctgagatcactgttaggatcccagaataacatcacctgccctaaagcacatccgagggganctcaaactgaacgacacagtggtcaaaaccaacagcctccgaagccaacgtgtcccacca

SEQ ID NO: 11757 - DNA, 121 bp, Artificial Sequence
  Synthesized
  misc_feature (61): n=a or c
gatcaggaaatactcatttaggaaatttaattaaaaagataataattaacaatatctgtangggcatgagatactgagatataactgtttatctataagcatgtgaactaggaccaggttt

SEQ ID NO: 11758 - DNA, 121 bp, Artificial Sequence
  Synthesized
  misc_feature (61): n=a or c
ttaaaacctatgaggacttatattagtgtaacatggactacttgtggtctgaagattgtgngaatatttcatttcctccctgaatgaaagtttaagaatgccacagctcttccccctgaat

SEQ ID NO: 11759 - DNA, 121 bp, Artificial Sequence
  Synthesized
  misc_feature (61): n=a or c
acaaagccaaagtcaggcatctggttcgggcaattcctgtttgaacccctaaaatttaacngcattatagcatctgaaatttgcaatcattctgcccacaatttctgttgaagtttgtagt

SEQ ID NO: 11760 - DNA, 121 bp, Artificial Sequence
  Synthesized
  misc_feature (61): n=t or c
atggttttatgcttcagatgcagattaataacactcattcaacgaaagaatgatatcatcngcataaaatccctcccagcgccatagaatattctctggctttgtgatcattgctggtcca

SEQ ID NO: 11761 - DNA, 121 bp, Artificial Sequence
  Synthesized
  misc_feature (61): n=a or g
cccttggaagcctctccttaacctataaaaggctgttaataacgagtgtttcactctagtntctctaaggattgtaatttctgacttctgtattgcatttgttcagtttttggactctccg

SEQ ID NO: 11762 - DNA, 121 bp, Artificial Sequence
  Synthesized
  misc_feature (61): n=t or g
tttctctttttctccttttcaccaaaagataggaattaaactacagaatggatggttcttncagcttctgtgggaaacagaggatatctaaagtcagatttaaccccactttgaacagttt

SEQ ID NO: 11763 - DNA, 121 bp, Artificial Sequence
  Synthesized
  misc_feature (61): n=t or g
tcattctttgcccagcttgtatctgtgttgggattaccctagccaggtacagaatcttgcncttggccttattgagcttcatgaggattgcatgggcccagctctacagcctgtcaaggcg

SEQ ID NO: 11764 - DNA, 121 bp, Artificial Sequence
  Synthesized
  misc_feature (61): n=t or c
gcttttggagctgtgtgtgagaatggtgtctctttgctcctcgttactttcatgtagttancactgcactgctggttttacctactactagaagttcagcatgagaaaggtttaggtaaat

SEQ ID NO: 11765 - DNA, 121 bp, Artificial Sequence
  Synthesized
  misc_feature (61): n=a or g
cttattctttaaagtgctggggaaaaaaatctctgtaagttgataatgaaaaaggataaantcagtaaggggtataattgctaatatcagatcttaaggagggagcataagtattgaagaa

SEQ ID NO: 11766 - DNA, 121 bp, Artificial Sequence
  Synthesized
  misc_feature (61): n=a or c
aaaagttcaaacttctcctgatacacgtctgtttatagccatgagctggctagttctgttncatactacagcttctacaaatttgcccagtgtgagccacgctttcccttaactataattt

SEQ ID NO: 11767 - DNA, 121 bp, Artificial Sequence
  Synthesized
  misc_feature (61): n=t or c
atgagtcctggctgcagtctcttgccaggttagatgagctctgaggagaagtgctcagcangcctgggctgggagctttaacccagatgcagacattcctgcattgccttcctgctagtgc

SEQ ID NO: 11768 - DNA, 121 bp, Artificial Sequence
  Synthesized
  misc_feature (61): n=a or g
aaaagacaaaagttacaaaacaagttctaagagaaaccacagtgtgtcttgcatcttccantctaaaactaatcagacaccagatgagtcttggaacagcactactgacatagtgaatctc

SEQ ID NO: 11769 - DNA, 121 bp, Artificial Sequence
  Synthesized
  misc_feature (61): n=t or c
tacacataatacaaggaaagttaaggaactaaagaacaagtaccagtcagcttaaatggtnatttttagcttattcttaggttaaagagaagaactgaccttcctaacatgttgtgtatgt

SEQ ID NO: 11770 - DNA, 121 bp, Artificial Sequence
  Synthesized
  misc_feature (61): n=t or c
atatgcccgctctcaaatgtgtttccacaggatatgtatgcactggaacttcaacatctgntcagaaacacgcacacaatgcctgcatattaatttatttgccctaaggttttacagagca

SEQ ID NO: 11771 - DNA, 121 bp, Artificial Sequence
  Synthesized
  misc_feature (61): n=a or g
aaaaaaagcagtttgtccatcaaagaaaaactagaatactacagtgagataacctcaggtntcaggtactacagcacctgagaaattagtttttaattttcgcgctattacaaacttacag

SEQ ID NO: 11772 - DNA, 121 bp, Artificial Sequence
  Synthesized
  misc_feature (61): n=t or c
aaacagcattgatttgagttgaattataactgctttccttactggatgggaagctgactgngtttctctttggtgggttttacttcagtgcttgggggttaaaaagagctttctgttttgt

SEQ ID NO: 11773 - DNA, 121 bp, Artificial Sequence
  Synthesized
  misc_feature (61): n=a or g
atgttggcattgttatgatgaaatatgcaagcaatacctttaatacctttcttttctcacnctgttttaagtcatggagcaagtatttttgtcttaactgctgtttcaaaaatgtgtaata

SEQ ID NO: 11774 - DNA, 121 bp, Artificial Sequence
  Synthesized
  misc_feature (61): n=t or c
agcttttgtcatatttttcttttttaggttaaagaacttacatttggcattttctccctcngaagattcttatacattggaactgagtcacctcccagtttgtcttttgatgaactaatta

SEQ ID NO: 11775 - DNA, 121 bp, Artificial Sequence
  Synthesized
  misc_feature (61): n=t or c
tggagggctgccctgctctactacactgtctatcaggccagccagatgtccttcagccagntgttccaggatgtggggaaatttgtccaggaccccaataccaggtgggattactgtgtac

SEQ ID NO: 11776 - DNA, 121 bp, Artificial Sequence
  Synthesized
  misc_feature (61): n=a or g
gctgtgatgcataaaagctgcttaaaattaatcaaagcttatttttcctcacatcacgacntcccagatgtgttttccccccactgctgtcatttcactcatctccgagggccgagacgtc

SEQ ID NO: 11777 - DNA, 121 bp, Artificial Sequence
  Synthesized
  misc_feature (61): n=a or g
gagctccagctttgaaacccgggtctggcacgattccaaggcttcctagagatagaaaacnagaatcagggcagctctattcccacacagcgcttcttgttttagcagcaggaccatccgt

SEQ ID NO: 11778 - DNA, 121 bp, Artificial Sequence
  Synthesized
  misc_feature (61): n=t or c
ctttgctgccttcacactgctaccctgggctatgaagccctcctagatcagtaaggggtangagcacacttacctaaagatgactttcctgggctgtcctggaaagtgctctgatttccta

SEQ ID NO: 11779 - DNA, 121 bp, Artificial Sequence
  Synthesized
  misc_feature (61): n=a or g
gaataaattaatggaacaaaaccacagcatatcccttcttaaagaaggctctgaaataagnaaaactccctaacctcaagcttaacattttagaaatatttccattcgtaataaatttatt

SEQ ID NO: 11780 - DNA, 121 bp, Artificial Sequence
  Synthesized
  misc_feature (61): n=a or g
gttggaaatttcattccttattgtatcttcttcttgcactcttctcaaagtttgatccctntctcagccaagaatcacactggaagactgctgaccttcaggcattatagggaagacagta

SEQ ID NO: 11781 - DNA, 121 bp, Artificial Sequence
  Synthesized
  misc_feature (61): n=t or c
agatcttcatgctcactgacaataacaaggagctgaagtattgttgtgcaggaattgaaanggtggctttgtgttgctgctggaggtgcaaaaatattatcccaggtttgttttgatcccc

SEQ ID NO: 11782 - DNA, 121 bp, Artificial Sequence
  Synthesized
  misc_feature (61): n=t or c
cagagtcacattaggaaagcaaagcctttcaaatacttaaaaaagcctcagaactaccaangtagtcatttacagcagattcttcacgccaagacagagaggcatccaacaaccgcagttc

SEQ ID NO: 11783 - DNA, 121 bp, Artificial Sequence
  Synthesized
  misc_feature (61): n=a or g
gcgtttgcttctaaccatgaattaaacacttgatgcttcagatgccatctctgcgtcctgntagtggcatctgtttcccaagtgcatggcatttgcttccattagttggagaggaggtaac

SEQ ID NO: 11784 - DNA, 121 bp, Artificial Sequence
  Synthesized
  misc_feature (61): n=t or c
cctttttctgattgtctcacaggactgtcctgtgaatccatttgtaggtactagcataggnctgtgaagatggagggatttgttcccgttcttgacctgttgtcctgtggcaagaggtcag

SEQ ID NO: 11785 - DNA, 121 bp, Artificial Sequence
  Synthesized
  misc_feature (61): n=t or c
aagatgaaaactgtaagggcttttactcatagtcataggcaaatagggataaagtagctanagggaaggcaggtccatctttcttccataggttaatgcacctgtagcagagatgtgatta

SEQ ID NO: 11786 - DNA, 121 bp, Artificial Sequence
  Synthesized
  misc_feature (61): n=a or g
tttaaaatgtgttccagtgctttgtattctactttgtatcctatagttgcctatgttggcncattacataatgccatatggtttctctccctttcccctgtcccattttcaggtggaaggt

SEQ ID NO: 11787 - DNA, 121 bp, Artificial Sequence
  Synthesized
  misc_feature (61): n=a or g
tgtcaggtagttctgtgtttgaaggatttcatttctatccttcatttcacaggagacagcnatgccagatgggtaccctcactctgcgtaaccatccactgccacggggctgtggacacac

SEQ ID NO: 11788 - DNA, 121 bp, Artificial Sequence
  Synthesized
  misc_feature (61): n=t or c
gcccaccccaaatgatagcagaacaccagcaaggtctggccaggcagataaggaaactgangctgtgcagatctaaggtgaggattggctccagactgagacacacatccagggatgtgag

SEQ ID NO: 11789 - DNA, 121 bp, Artificial Sequence
  Synthesized
  misc_feature (61): n=t or c
ttttgtgtgtgtgtgtgtgtggtatggctctctcaaacatcctgttgttgtttaaccaggngatgtctaagcaccacacagtcgtccgctcacccttcccaccccactcccaatgtggggg

SEQ ID NO: 11790 - DNA, 121 bp, Artificial Sequence
  Synthesized
  misc_feature (61): n=a or g
atcagctgttgatagacttcagcctggcacatgtcacagcaggtacaagctactctctgcnccagcttgcttcgtgctgttatctaccactgacctgaggctgccttgtcagcagtggcaa

SEQ ID NO: 11791 - DNA, 121 bp, Artificial Sequence
  Synthesized
  misc_feature (61): n=t or g
aaaatccatccactgcattttcttgttcccattgtcatcctgtggacacaaatcactaaantctactaccaagcatattgtaaaacttggttgtggagggagcacagaaaacagccactct

SEQ ID NO: 11792 - DNA, 121 bp, Artificial Sequence
  Synthesized
  misc_feature (61): n=t or g
aggtcacagggtgtatagtgtaactaacaatgtatttctgcattggcccctatttctttcncaggggcctttagtattttgttttgtgcttttgatttttgctgagcactgagctgacact

SEQ ID NO: 11793 - DNA, 121 bp, Artificial Sequence
  Synthesized
  misc_feature (61): n=a or t
gaagctcatgctgtttctgtgaattggacttcttcctatcactttgtattctataaacagnatgtttgcatggtagggcttctacagacagtcttgaaaattgaaaaaagcttcctattcc

SEQ ID NO: 11794 - DNA, 121 bp, Artificial Sequence
  Synthesized
  misc_feature (61): n=a or t
atttctattttctagtaccttagcaattttcccagagaatgggcaacatcactttcctcanccagataatatgaaatagcgtaaaaatatacagtaagtgttcatagtaaaaacaaaaagt

SEQ ID NO: 11795 - DNA, 121 bp, Artificial Sequence
  Synthesized
  misc_feature (61): n=t or c
agagagagagcaacagaatatttattttacctctctgaacttctgctttctctactataantcactatgccatgctgtatttcattaagctttatatattctttagtgctcaaagtctaat

SEQ ID NO: 11796 - DNA, 121 bp, Artificial Sequence
  Synthesized
  misc_feature (61): n=t or c
gctgagctccctggcctcagtccagaggcctgtaaatcattgctctgaaatcaagaaatangctcacatgtttagaagttaagcaaatgctgaagggatctgctgcacaggggccagagta

SEQ ID NO: 11797 - DNA, 121 bp, Artificial Sequence
  Synthesized
  misc_feature (61): n=t or c
acagagaaccagaagatgttaaaggactccttttggtcacaatcaaagctatgattctaancacttcatagaatatatacttggctaatatcatatccttatgctgaaagaacatctgcct

SEQ ID NO: 11798 - DNA, 121 bp, Artificial Sequence
  Synthesized
  misc_feature (61): n=t or c
atagaaaaatcatcgaggataattctcatgaaggctgttctaatgttaaatggaaataaantgacattttcactcccctcaagcaactgaacgaaaaacccacatgtatgaaacaaaactg

SEQ ID NO: 11799 - DNA, 121 bp, Artificial Sequence
  Synthesized
  misc_feature (61): n=t or c
cctatgactcattctgtaagagatgtgtaagaaggcaatcccaagggaatgaaaatattcntctaatcaaatcagtatagactatttctcaatgcagccctaaaaagaatatggaagaaag

SEQ ID NO: 11800 - DNA, 121 bp, Artificial Sequence
  Synthesized
  misc_feature (61): n=a or g
tttcccctgtttctgacacatttatgaactgttacaaagttcggtaaaacccactttttcngtacttccacgtgaagggtggtgtggtgctcctggagcatgggaacaaacataaaatgcc

SEQ ID NO: 11801 - DNA, 121 bp, Artificial Sequence
  Synthesized
  misc_feature (61): n=a or g
ttctgtgattgattctatgattggttctatgaaaatgaagccctccagcttaatgaactcntttttgtttttctagcatgatgaaaataagtgcttgtgtggacaggaacccacggagaga

SEQ ID NO: 11802 - DNA, 121 bp, Artificial Sequence
  Synthesized
  misc_feature (61): n=t or c
taagaagtcgacatcagacccacacacgatcataagtaatcatttctaactgactaatgcngaattcttgctaattttacaaaacaaccactgtgcactcaaaagacatcaatcattgttc

SEQ ID NO: 11803 - DNA, 121 bp, Artificial Sequence
  Synthesized
  misc_feature (61): n=a or g
ttcactgaatgcagtataacttaaagaaatagttataaaggcctttttctttaaaatgacnttgattattattctctttatagaatcttctatgcatctcctccctcagattcgtttgctt

SEQ ID NO: 11804 - DNA, 121 bp, Artificial Sequence
  Synthesized
  misc_feature (61): n=t or c
tgagcaacagaaagaagactgaaattctgttctgtcagctagtttggggaaagtaattaantctcccaacttacaaagaaaccaggaaaatatcaggaagtaatgccagaagttccctaag

SEQ ID NO: 11805 - DNA, 121 bp, Artificial Sequence
  Synthesized
  misc_feature (61): n=a or c
cacaagcttataaactagtgttatagcacagtgacactgtatttctacattcagtgtttcntaaaaacggcactctctgggtagaactggtagcacccctaaatgagctgcagccatgaat

SEQ ID NO: 11806 - DNA, 121 bp, Artificial Sequence
  Synthesized
  misc_feature (61): n=c or g
acaacattcagttcccagaaacagcccaaggaaaaacaatgagccggaatgagccttgctngaaggttaggattttgtgccgctgctgctgttttcatgaccagtctggaaactggctgtg

SEQ ID NO: 11807 - DNA, 121 bp, Artificial Sequence
  Synthesized
  misc_feature (61): n=a or g
aaacaaaacaaaacaaaaaaccctcaagaatgccttttgggaggctaaaaaaattcactgnattcatatgagttattagatcaaatgcacagtactggtacaaataatgccatggaaagca

SEQ ID NO: 11808 - DNA, 121 bp, Artificial Sequence
  Synthesized
  misc_feature (61): n=c or g
gactctctgaaaaccagttctgtgaagaaggctcttattctcaggtttctgagatgtgcangtgtactgatgtgcattctgttatgtcacaaaccatggagtggtgaaggatgtgggaagc

SEQ ID NO: 11809 - DNA, 121 bp, Artificial Sequence
  Synthesized
  misc_feature (61): n=a or g
cacttagagcacaagttcagaggtaggtgataaaaaattccttaaacttaacaaactttcnatgtgaaactaatccattgcagacagttttagggaagggaaaacaggagtttacaaatac

SEQ ID NO: 11810 - DNA, 121 bp, Artificial Sequence
  Synthesized
  misc_feature (61): n=t or c
aatgcttggtctgagttttctcttgaggttttggaggagggaagaataccttgcactatcnagtgttgtcagtgtaaaaagtcttgtttttgcatttgttttggagcctgttcagtgcatt

SEQ ID NO: 11811 - DNA, 121 bp, Artificial Sequence
  Synthesized
  misc_feature (61): n=a or g
aaagtaatgaatataggtagtatttaaacctcattttgctagtaagactagtaaggttcangctgaaatatgtctatatcgctagtgagcacatataggcatacaatatagtaagctaatt

SEQ ID NO: 11812 - DNA, 121 bp, Artificial Sequence
  Synthesized
  misc_feature (61): n=a or t
tcaaggcgctgaagcaaaatagctgtcaggatgcagagaagacagtgatgaaaagacagcntgaaagaaagtggtaatgctccaagttggcttataggtaaagctacgaggaagagcagct

SEQ ID NO: 11813 - DNA, 121 bp, Artificial Sequence
  Synthesized
  misc_feature (61): n=t or c
acttttagaatggcttagtgaaaaactgatgagtttttcctttccaaggccttggctggtngtatgtttagggctcataagggacttttacttgcacaaggagtgcttcacaaacactact

SEQ ID NO: 11814 - DNA, 121 bp, Artificial Sequence
  Synthesized
  misc_feature (61): n=t or c
tccatacatgaaaaattaatatttagcagatggaaactaagaaagaaagtcagagccctgnaattagcttgttctccatggacttgcagataccttcagagcccatgcaggcagcgagctg

SEQ ID NO: 11815 - DNA, 121 bp, Artificial Sequence
  Synthesized
  misc_feature (61): n=c or g
gctcttcatttccttagagattctcagttttcaacgtaactacacatacgcattagagttnacagctatatttccacagtcagatcttaacttcttcagtattaattcaacttcaaaattt

SEQ ID NO: 11816 - DNA, 121 bp, Artificial Sequence
  Synthesized
  misc_feature (61): n=t or c
agctcgctaatcaaaggttggggtggtaggtagaaaaggtggctcattccagaagtatttngaagcaacaagagggaaaacatggcagcttgaaacagaaaggcaagaacacagacaagtg

SEQ ID NO: 11817 - DNA, 121 bp, Artificial Sequence
  Synthesized
  misc_feature (61): n=t or c
tttgttttgcttagcacacgggattctgcaaggcaagaactgttagtgatccagatgaacncaatggaatagaaataaactgtgaactctatcatccctgggtaggtactcaattattgca

SEQ ID NO: 11818 - DNA, 121 bp, Artificial Sequence
  Synthesized
  misc_feature (61): n=a or g
gctgttcctgaataccctcctttgatacaaagggccacgcttagtatgtgaaatgatgtcntattactgcacagttttaaaagttgtctttaaaatgacctcagctcatttctttctttct

SEQ ID NO: 11819 - DNA, 121 bp, Artificial Sequence
  Synthesized
  misc_feature (61): n=a or c
tgcaacttagcttttgttctaagtattactctcccttttatttgggagacttagaaaaaangtagctacacatccctttgatcccatgagcacttcttgttgctttcttgatgttggtact

SEQ ID NO: 11820 - DNA, 121 bp, Artificial Sequence
  Synthesized
  misc_feature (61): n=a or c
agtgctgagctctgcagtgcctttgcaggagggctgtgctgagctccccacgggtggtttnttccccagctctgtgctcgtggtcagaacaaagcaaagtgccaacccgtgcagccccctc

SEQ ID NO: 11821 - DNA, 121 bp, Artificial Sequence
  Synthesized
  misc_feature (61): n=a or g
gccttttccaaccttaatgattctatgtttctatgattctatgctatggagctgtctctgnaaggccatgggtggcagtgatgggttgtgtgatttaagccatggagcaccaggtcggaga

SEQ ID NO: 11822 - DNA, 121 bp, Artificial Sequence
  Synthesized
  misc_feature (61): n=t or g
gagctctgcgctggacatcagtttaatgtagaaaaggaggtagaggggaagggtaggtatnaagagaagctgggtatgaagataaacttcttctctgaaagggtggtaatacactcgcaca

SEQ ID NO: 11823 - DNA, 121 bp, Artificial Sequence
  Synthesized
  misc_feature (61): n=t or g
ccattaaaaacacccaatttctttttaatattcctggagtagtaagaataaagccaaaggnaaagctgaaattggaataattgttttagacttcacttgtctcatttgtgtgtaggcctat

SEQ ID NO: 11824 - DNA, 121 bp, Artificial Sequence
  Synthesized
  misc_feature (61): n=a or c
tgctagactttcatgcaaaggagctgtgtaaactggtttttttttaagcggaattcttatntgaagtggttgatacccactgaaaatctctgtgtatagttaacatcggatgttttggaac

SEQ ID NO: 11825 - DNA, 121 bp, Artificial Sequence
  Synthesized
  misc_feature (61): n=a or t
ctgagaacacacagtgctgcttatttacttgagattggacaatgccaccagaatataacantttttaatgcaataaatacaatcttctattatttctccaggcagccagacaaagtccttt

SEQ ID NO: 11826 - DNA, 121 bp, Artificial Sequence
  Synthesized
  misc_feature (61): n=t or c
attacctgatccagcttcagtacagcatcatcacaggcaaggtttgtgtgcttgttgtcantgctataaacatttctctcagttgtgggaggcttactaatttttctctcaagcagtggca

SEQ ID NO: 11827 - DNA, 121 bp, Artificial Sequence
  Synthesized
  misc_feature (61): n=t or c
caagcagagaataaatttcaggaaattgtcatctgtttgcagaatataatgtttctgaganacacatgtaagttacttgtactcggacatctaccagtctgagcacagggggaaaaaaaag

SEQ ID NO: 11828 - DNA, 121 bp, Artificial Sequence
  Synthesized
  misc_feature (61): n=t or g
gtagaagacacaagaaagtgtatcggttccctagccaatctttaggagaagccaataattnaaattgactcaaaaatttcacattacattttagaagtgacacagttcttacagaaaggat

SEQ ID NO: 11829 - DNA, 121 bp, Artificial Sequence
  Synthesized
  misc_feature (61): n=t or c
tagcagagaaggcagcagcctaggagagtgagaagagttagaggctcaccacagtctgaangctgcttagcatccagcccaccccagctatttgggctgggagttgaggaaaagatccagg

SEQ ID NO: 11830 - DNA, 121 bp, Artificial Sequence
  Synthesized
  misc_feature (61): n=a or g
aacatgtttacctctgctacaaagcaggtttgttttccaccacagcagttctcccgctcgntgtttccacagtgatctgtgttacaaaaaaggctttcctccagagaaagttgaaccaatt

SEQ ID NO: 11831 - DNA, 121 bp, Artificial Sequence
  Synthesized
  misc_feature (61): n=a or g
tcagcaagatggtatctttaagttgaccactgagagatggtttgggtcccaatacaaacanattctccttcctaatactactctctcattctgatccataacaatattttctatacctagt

SEQ ID NO: 11832 - DNA, 121 bp, Artificial Sequence
  Synthesized
  misc_feature (61): n=a or t
cttatttaaatatctggtcttgaaaaatcagaacccgtgcacgattgacttattgctccanccagaaattctcctcctctccgaccagtctgttttccaaaatactcttggtccttcccaa

SEQ ID NO: 11833 - DNA, 121 bp, Artificial Sequence
  Synthesized
  misc_feature (61): n=c or g
aaggcagctgcttgagcaatgtttgttccttcctgtaacgggcctacaatatagaatgaanggattaagagacacaaaggcgctgaaacatatgaataaacagatttgtactgcaggtttt

SEQ ID NO: 11834 - DNA, 121 bp, Artificial Sequence
  Synthesized
  misc_feature (61): n=t or c
accttgatagtctaatgaagagtatggtacgccatgtcttaaacttcattctcttcctgcncttcacccatggggaagaagtgctatgtgcttacagtgtttttaaaaatgttatgttgta

SEQ ID NO: 11835 - DNA, 121 bp, Artificial Sequence
  Synthesized
  misc_feature (61): n=a or g
agcttgacacactcactcaaagcatggctactcagtactcacttctatctgcattggacantgtgcagccatatgtatttttttgccaaataccattaaatcctagcttggagcgcaagaa

SEQ ID NO: 11836 - DNA, 121 bp, Artificial Sequence
  Synthesized
  misc_feature (61): n=t or c
atcctctgtaagaaacctaggcctggggaaaagcaaaggggtaacagaggagcaactagtnagccaaccacttgtattctgctaacagtatacactaacccgcgttctgtaaaagagtggg

SEQ ID NO: 11837 - DNA, 121 bp, Artificial Sequence
  Synthesized
  misc_feature (61): n=a or c
cccactaactgaactgcactttgaaacaatggagcataggctgtttctggtttgttcatgnaaataacctggagatataaatctaggtcacttcttagctctgctatcactatcatcacct

SEQ ID NO: 11838 - DNA, 121 bp, Artificial Sequence
  Synthesized
  misc_feature (61): n=a or g
ctcttaagtagattggcagcttatctttacacttctgttcaagtcaggagaggaacattcntgtgtgttagtcatgctgtcctgtaatgactttccttaaagaacctgctcctatatgtgt

SEQ ID NO: 11839 - DNA, 121 bp, Artificial Sequence
  Synthesized
  misc_feature (61): n=t or c
tagcaacttagcatgagtggataccttttagttcgagccttactgttggctccagcaaagnagatgagtctgttcagatcaatacgcatcccagtttccacagggacatcgctgtcctgtt

SEQ ID NO: 11840 - DNA, 121 bp, Artificial Sequence
  Synthesized
  misc_feature (61): n=c or g
tccttaaacatggcattcttaagtactcttgtttaggctgtaagttattctctaagcagtnctgcttctcctggttgctttttgtggctgtaggttcctgttgatgttttttaatgatgct

SEQ ID NO: 11841 - DNA, 121 bp, Artificial Sequence
  Synthesized
  misc_feature (61): n=a or g
cggtgagttttgtgcttcccagtgccgtgcatttacatccattctgctccctgcagcaggncaggctttccagtgggctgtcgccatttggtaattacaaatataaatgtcgccgctgtca

SEQ ID NO: 11842 - DNA, 121 bp, Artificial Sequence
  Synthesized
  misc_feature (61): n=a or g
ttgtctgtgctgtgacctgtgagcatcgccaagtttcatatttattgcagcaaagaagaanagatgtgaaaggacagcaggagtctctcgtaacttatcagtgggggggagagagcactcc

SEQ ID NO: 11843 - DNA, 121 bp, Artificial Sequence
  Synthesized
  misc_feature (61): n=t or g
gaaatggtttaagacaatactagtgtggatatgacataaacttgtagagtttgtactgaancagtgtgtgcacaaatgattttgtttgaaaattttcaatgcatcaattctgacaaaaaat

SEQ ID NO: 11844 - DNA, 121 bp, Artificial Sequence
  Synthesized
  misc_feature (61): n=a or g
ggctatcatggataaataatttgtgcacagtattaatttcagtaagttttgctgtggagcntttggtggtcaggtagcaggaagacagcaaatggcaaagctcttagttttcactgttcat

SEQ ID NO: 11845 - DNA, 121 bp, Artificial Sequence
  Synthesized
  misc_feature (61): n=a or g
catatagtattaagaatacacaccactgactgcaagacctcagagaaaatgcagatactanctcaggataaggcacaacatgacttaaaaagcaatcactggtgatttcatcacaatccca

SEQ ID NO: 11846 - DNA, 121 bp, Artificial Sequence
  Synthesized
  misc_feature (61): n=a or g
actgaaggcagctcgaggctgatctgtcaccctgttgcatgtatttgaagtaaatctacancacgcctctgtaataaggccacacaggcagagggcaacgggaacgtgtaaagttcatgct

SEQ ID NO: 11847 - DNA, 121 bp, Artificial Sequence
  Synthesized
  misc_feature (61): n=t or c
tagtctgcttttcataggagagctttgaaagtgagaattatttttccctccttgttctcanatgctgtttatgtttccataagtgatgaaatgtcagaaattttccagctcattgaaacta

SEQ ID NO: 11848 - DNA, 121 bp, Artificial Sequence
  Synthesized
  misc_feature (61): n=a or c
ttgtttaagaaacaacactttcaaacttagaacagtgcaggataagatttctgaaaaatcnttgtgaaagtctgagagtctaagtgcagtacagagatgttgaagagttcttttatatatt

SEQ ID NO: 11849 - DNA, 121 bp, Artificial Sequence
  Synthesized
  misc_feature (61): n=t or g
aagactaaaattaagtagcaatactgtaagaaaaagccttgtttattcttctgacctagcngtgtcatttgtcacctcacaacacggcagtcagaacgctggtgggagctcctggttgtgc

SEQ ID NO: 11850 - DNA, 121 bp, Artificial Sequence
  Synthesized
  misc_feature (61): n=a or g
ctgaatataattgtaatgcacaacccacagatcaagtacacacaaaaaatacactattgcngccaaataaaatgatagttcctctgctcctcacaccacagagatactgaaagaaaacttt

SEQ ID NO: 11851 - DNA, 121 bp, Artificial Sequence
  Synthesized
  misc_feature (61): n=t or c
aaatacaaagaggctgctactgatcagcttgtgtcttatttagaagttatttaatttatanttacagctactctctgcatatgaatagcgtcagtgctatttccagttcttttgacctgtg

SEQ ID NO: 11852 - DNA, 121 bp, Artificial Sequence
  Synthesized
  misc_feature (61): n=t or c
aatttccttaggatttcttgtttatcccaaggagaaagtgttggcaattgtgtgctgcctnggtaatgtatgggcttacgcttatgttttcagttaaattattccttgccttacaaagtaa

SEQ ID NO: 11853 - DNA, 121 bp, Artificial Sequence
  Synthesized
  misc_feature (61): n=t or g
tcagatatgttttcttttcaagggattgtatgagtccaatgaccaacatttgtcatttctnccagtcgccttcccagttttattaatattactcctactttataagtaagaacagcaggag

SEQ ID NO: 11854 - DNA, 121 bp, Artificial Sequence
  Synthesized
  misc_feature (61): n=t or c
attagatcaactgaaaaagcaaggaaagaacagacaggctgtcaggtgcacagggcaagcnacatcactaagtccaagaaaagaatctgactctctacaaactccatctcatttatatcct

SEQ ID NO: 11855 - DNA, 121 bp, Artificial Sequence
  Synthesized
  misc_feature (61): n=t or c
gcttaaatgactgctttcagcagagggctgcaggttctgaatcctgaagaaaggtacatanctacacattgaccttctccatggattttgtcattatcatttcctttagcactttggtgtt

SEQ ID NO: 11856 - DNA, 121 bp, Artificial Sequence
  Synthesized
  misc_feature (61): n=a or g
caagtgaggactatcatgaattatttcagtaaacttcaagtctgccaagtcatttgagcangcataattagcgcatatgactttcctcagcacaaagtttagccttgatgccctagagcta

SEQ ID NO: 11857 - DNA, 121 bp, Artificial Sequence
  Synthesized
  misc_feature (61): n=t or c
gctctcagaaggttaagctgatgtctgggcagtagcctatagcaattggaaaaccacacanttctctgcctgcgccgctggcagcaaaacccagtgcaggagggccgaggccggtcgaaga

SEQ ID NO: 11858 - DNA, 121 bp, Artificial Sequence
  Synthesized
  misc_feature (61): n=t or c
gaaagaagaaaaaattgtggcttaataatgaactgtccattcagtgttgctaaccacagcntggcaggttgaattcagtttgattcttcttgtttgttttctcttgagaatgggcaaaaca

SEQ ID NO: 11859 - DNA, 121 bp, Artificial Sequence
  Synthesized
  misc_feature (61): n=t or g
gtatataattagatgcatcacaacatcatactcagtttcacaaacatgtactgctagagcngctaatacttaaaaatgccagcaccagcagctttctgtgacccctatttgcctctatgaa

SEQ ID NO: 11860 - DNA, 121 bp, Artificial Sequence
  Synthesized
  misc_feature (61): n=t or g
ctggtttatcagatataagcaaatgtctttcccagtctgtctgaagctagcagtgctaaantttaactctgcagaaagtatttagcgtaatatatgtaaatattatgttaaaagtttcaca

SEQ ID NO: 11861 - DNA, 121 bp, Artificial Sequence
  Synthesized
  misc_feature (61): n=a or t
caccaggatgccctctaaaaggcagtgcaccgatggaagaggtcaagtaattagcaatcantgtcttctgacacattttctagctttgtgtttgtttgtttgtttcaagaaaagaatggca

SEQ ID NO: 11862 - DNA, 121 bp, Artificial Sequence
  Synthesized
  misc_feature (61): n=a or g
acagcaatacctgggctgtgcgtttcagtaaggaggaagcaaggaacttcaccaatagacntggttatcccaaagcagcaggaggggaatctccagcagcactcaggatgggatgctgaga

SEQ ID NO: 11863 - DNA, 121 bp, Artificial Sequence
  Synthesized
  misc_feature (61): n=c or g
ttttaaatagttcagcgtgtggaaccatgctcaacaagtagagcaatggttaattataagncctgcactggtctaagggacttaaaaatatatgctcttgcttcattatatgctaaagttc

SEQ ID NO: 11864 - DNA, 121 bp, Artificial Sequence
  Synthesized
  misc_feature (61): n=a or c
ataaaagactagagacaaatgatgaacctcactatagacagaaagataaaaaagacctaanggcagagtgtataagaactggacaagattggttacaagagggacatatacccttgccatt

SEQ ID NO: 11865 - DNA, 121 bp, Artificial Sequence
  Synthesized
  misc_feature (61): n=t or c
tgtaaatgcagtttcaatctgagttaagttcttttcctgccaagggcaaactggtctttcncactgacgaaccctttaacaactttccagacttcctctcaagttaaacagccacataaag

SEQ ID NO: 11866 - DNA, 121 bp, Artificial Sequence
  Synthesized
  misc_feature (61): n=a or g
tgtaacttccccagcttttgtttggctaaatgctgtttaaatatttacatcccacaaactnttttatcatcatagctcattgttaaaaaagcaggccactgaataagcaaagtgacaccgt

SEQ ID NO: 11867 - DNA, 121 bp, Artificial Sequence
  Synthesized
  misc_feature (61): n=t or c
aattgtctgcattcgggtctggctcactggccagtgaggttgctccgtatttcatgcagcnctcatacttccattattcagacggacttaccacatgctgcaaggctcttttctgcttctc

SEQ ID NO: 11868 - DNA, 121 bp, Artificial Sequence
  Synthesized
  misc_feature (61): n=t or c
attttaatttcaaacttgcccacatttttctaaaccctcactaaattctctgccctactgnatcagatttgagataagctagtaaaatctcagtggcataaaactgttgtggcagagaaga

SEQ ID NO: 11869 - DNA, 121 bp, Artificial Sequence
  Synthesized
  misc_feature (61): n=t or c
ccaaccgtcagcctgctcgtgcagcctggaagggctctgctttaacttctgaattgtttcncccttcaggagaggaattactgccctatttcttcatgccagaatgaggaactggaaacag

SEQ ID NO: 11870 - DNA, 121 bp, Artificial Sequence
  Synthesized
  misc_feature (61): n=t or g
gtgaataatgcctgtacaagcaaatacgtgcatacgcaagccaagaaatatctactgcctnctctcttacaatctgctgtatgttgcagtccacttaaatatagaaatatgaacataagag

SEQ ID NO: 11871 - DNA, 121 bp, Artificial Sequence
  Synthesized
  misc_feature (61): n=a or c
aagcttagcagttgcccaagaactggaaagaactggagcagggcttccgtttccttaatgnagttcactttgtctctcccacatctcagaagagaactcttaaacccagtgttatttggga

SEQ ID NO: 11872 - DNA, 121 bp, Artificial Sequence
  Synthesized
  misc_feature (61): n=a or g
aggagctcagctgactggaactgcaaaatgggctccataatatgtaagtccaaggaacaangaagtgtacaatatgtcgttgtaaaacacctgtttccttttgggaatcagttaatgttaa

SEQ ID NO: 11873 - DNA, 121 bp, Artificial Sequence
  Synthesized
  misc_feature (61): n=a or g
cttatgtaattcatgagaatttgtaggatacagccctcactcttcattcttactgaacatntaagaaagattgcagtttaaatcagaagtactgatttaaactgttcaaataggtagaaaa

SEQ ID NO: 11874 - DNA, 121 bp, Artificial Sequence
  Synthesized
  misc_feature (61): n=a or g
tcgagtgatacattttatttttaaaggaaattttcactgaagatgtgtactgaataaaccnaagtagtcaaataatagtgacgtagaactctgtatttttactgcgttgatctgcttctcc

SEQ ID NO: 11875 - DNA, 121 bp, Artificial Sequence
  Synthesized
  misc_feature (61): n=t or c
aaatggatataagctgcctcaaaatggcagtaaggatcatggagactgcatgggtcggttngtgttattgggttcatgcactttggctgcaggggctcaggtcctgctggtaacccagagc

SEQ ID NO: 11876 - DNA, 121 bp, Artificial Sequence
  Synthesized
  misc_feature (61): n=a or t
aatgttatatatgaaagttttctggtaacattttcattttatgcacatattgctcaccatncacagagaatgctgcatcgaaaagagaacactgggcacaaatttaattttttcttaggga

SEQ ID NO: 11877 - DNA, 121 bp, Artificial Sequence
  Synthesized
  misc_feature (61): n=a or g
ccatgccaagccagccctgcagctcggtttccaccacgagctcctttacgttgagaactcnagctacacagtttgaacatttgcaaacaaaaaaacgtgatgtgacattttccctccctgc

SEQ ID NO: 11878 - DNA, 121 bp, Artificial Sequence
  Synthesized
  misc_feature (61): n=a or g
acaaagtaccatgtaaacaaaccatgtgatctatattccagctttacttatgtgattttancaaattaaatgtctatcagcttgaacttgcagatatcccagttttacacaactgtcttgc

SEQ ID NO: 11879 - DNA, 121 bp, Artificial Sequence
  Synthesized
  misc_feature (61): n=t or c
accagtacagcaatgattgtctaatccaggtattaagatcaagaaaccaaattgcttcaangcctttcctaaaaggtcctttttttatttatatataacttggactgatttattaattgca

SEQ ID NO: 11880 - DNA, 121 bp, Artificial Sequence
  Synthesized
  misc_feature (61): n=a or g
actgtttctgtctgggctggaaattgaagtgctggactcaggtgtgttagtggggtcagancctgcagctgctccttgggcagagaaactgcaggtgtcttcagctgcctgcctgaaatca

SEQ ID NO: 11881 - DNA, 121 bp, Artificial Sequence
  Synthesized
  misc_feature (61): n=a or g
tgtccaactggcttccctggtaacatgttcagaggttgtgtaggtcattttccatgctccntgcagttgcactaataggtgctaaacgtgcttggattgcctgttctttggattgtctgag

SEQ ID NO: 11882 - DNA, 121 bp, Artificial Sequence
  Synthesized
  misc_feature (61): n=a or g
tgttccagattacacagtgagcttcacagctcagtgcatgaactcctgtatgtactgatgncaacatacaccgagcagacacagtgctcagcagatttctatggtttcaggtgtatgggaa

SEQ ID NO: 11883 - DNA, 121 bp, Artificial Sequence
  Synthesized
  misc_feature (61): n=t or c
agcagcagcaatcaattcagttcactctccactctgtccgctgaacagcataggaatttancctgtcatttgttcaattacttctaatgttgcctggcctggtgactttgcagcatggcat

SEQ ID NO: 11884 - DNA, 121 bp, Artificial Sequence
  Synthesized
  misc_feature (61): n=c or g
tcaaaaaggtgcagtaaaagctcaaaatgtggtaggaagagggatgcttggatatgtgaantagcttcactcggaggaatgtcttgataactattaagtttcttttgaaagaagcatgtta

SEQ ID NO: 11885 - DNA, 121 bp, Artificial Sequence
  Synthesized
  misc_feature (61): n=t or c
aaatattccaagctttgttattgcaagagaatcttgatgaatattaattctgtaggtgaanggctaatacagcatttttgctctctaataacgtccacatcagtgctgaaaatagcagcct

SEQ ID NO: 11886 - DNA, 121 bp, Artificial Sequence
  Synthesized
  misc_feature (61): n=a or g
aagctctattttctttaaccctgaggcagttcagtgcctcttgcctttcctgcaccaagcncctgtccctgggtggatgaaggtccttgcaaccgaagcagaggtgcagatgaaggcacaa

SEQ ID NO: 11887 - DNA, 121 bp, Artificial Sequence
  Synthesized
  misc_feature (61): n=t or g
gagcttccatctgtgtatagcaaatacaacttctgggacagtaactataggtactgtctgnctcgttcctggctagaaaacatactagtgtatctttagagaggagggagagaagagaagg

SEQ ID NO: 11888 - DNA, 121 bp, Artificial Sequence
  Synthesized
  misc_feature (61): n=a or g
gagactgggccaggaagatgtaaaattctcaaaatgtgtataaacttttggttgtcttatngactgatgatgtccggatgaccacacagatgctctctgctttggacactctttagaaaag

SEQ ID NO: 11889 - DNA, 121 bp, Artificial Sequence
  Synthesized
  misc_feature (61): n=a or g
ggcacttaatcatagtggagtatgttgttggtactggacagacattctaatttgtgaatgnataacctccttctgacatgagaaggatggcaagaagaatgtggagcacagaagaaatgga

SEQ ID NO: 11890 - DNA, 121 bp, Artificial Sequence
  Synthesized
  misc_feature (61): n=c or g
cttttttaagcatgaagcagcacacaaaccatgagtttgatcgtatgtcattgttgcatantgtcacagtgctgaacagcccaatgaaagatgaagcttttcataaagccgttcatgctaa

SEQ ID NO: 11891 - DNA, 121 bp, Artificial Sequence
  Synthesized
  misc_feature (61): n=a or c
gctatgccaacacactctcctatgaagccccatgacaaaagatcattgaagccccccacanacaccatctgccatcttttctacagccctgtgctctttgagtccatttctctgtgctctt

SEQ ID NO: 11892 - DNA, 121 bp, Artificial Sequence
  Synthesized
  misc_feature (61): n=a or g
tatatgctaagggaacacccttctgcgcctattacaacaagataattgttgtagaaggagntattcctaacagtgtactggaagaaaacagtggttacctgtagctatttcattctttaga

SEQ ID NO: 11893 - DNA, 121 bp, Artificial Sequence
  Synthesized
  misc_feature (61): n=t or c
cttacagacgttgatttgatttgtagattttcaaaatgatttttgtagttccagttcctgnctgtgttttcacaggtgttaatgctttactaagatgcctttgctgctggctgcctccctg

SEQ ID NO: 11894 - DNA, 121 bp, Artificial Sequence
  Synthesized
  misc_feature (61): n=t or c
tgattaatatcattctccataactgcttttaattaggttcatagaaacacttggcagcatnattgcttagctctgttttggtaatcatagaatcacaaagtgtggaagggaccactaagat

SEQ ID NO: 11895 - DNA, 121 bp, Artificial Sequence
  Synthesized
  misc_feature (61): n=t or c
caacaacaacaacaaagtcctctaaacacttcttaaaatcccaatatgtatttatctgggnctctgggaagccaaatatttgctgagaatcaagtcttctgtgacttttgctctttttcag

SEQ ID NO: 11896 - DNA, 121 bp, Artificial Sequence
  Synthesized
  misc_feature (61): n=a or g
gagataaagccaattgctgctttttgtactaaatcagtacttctcacagcctttcatatcnattttgggtaaactgaaatactagcaggaaaattgttaaccatttgctccatggaagtta

SEQ ID NO: 11897 - DNA, 121 bp, Artificial Sequence
  Synthesized
  misc_feature (61): n=a or g
cagtatgggatcctagggtatgcagaaattaaatacagaagccttaaaactttcttccagnttaaactgatgctaaacagaactgttttaacatgtaggtcaacccatcagacagatacca

SEQ ID NO: 11898 - DNA, 121 bp, Artificial Sequence
  Synthesized
  misc_feature (61): n=t or c
aaatttagatccagtatctaaagcacaacattttagacaggggaatgtaacagaagcatangaagttaatttccattcccaaatgtacttcttctaaaagtaagtagtttgccaactgttt

SEQ ID NO: 11899 - DNA, 121 bp, Artificial Sequence
  Synthesized
  misc_feature (61): n=a or g
tctacacagtgttccagttcttctgatggggctgagcacagcactcctaaatggaaagacnggtccacttttgctgtggcacccagaagaagtctgtaagccaccagtcaccgtttccaac

SEQ ID NO: 11900 - DNA, 121 bp, Artificial Sequence
  Synthesized
  misc_feature (61): n=t or c
aagaaaagtagcctaagaaggaactcttgaagaggatttccatggccttgaactgtacttnggctatgatccacttcgacaggagagtttggtgtctcttgccagtgccactgctccctca

SEQ ID NO: 11901 - DNA, 121 bp, Artificial Sequence
  Synthesized
  misc_feature (61): n=a or g
gaagtgaagtagagatgaagaacatcttggaggtgttgttggtgtccttaaaaacctcagngaaaccacaggaaaagatggagccactggtgagtatttgtgattcctcctggaccttcac

SEQ ID NO: 11902 - DNA, 121 bp, Artificial Sequence
  Synthesized
  misc_feature (61): n=a or g
aacttaagatgtccagaccctcaattcaacaaaactaggctctaattttctagtaaaattngctgtgacattggagtttaaatactttgcttgttgtggctttagagatttataacatggg

SEQ ID NO: 11903 - DNA, 121 bp, Artificial Sequence
  Synthesized
  misc_feature (61): n=t or c
tttttatgcacattagccacagtcagggtctctatatgttctttttattaagtgcaccccntcttcccttattaaaaatctctccatttatttcaatatattctccttaatacgtatctta

SEQ ID NO: 11904 - DNA, 121 bp, Artificial Sequence
  Synthesized
  misc_feature (61): n=t or c
ctctgcctcctgtgagcccagctcatctccctccctctggggatgatgctttagttgtctnacaaagccttatctgaaatgttgcaaagcagattccttccttctcatcctccacagagga

SEQ ID NO: 11905 - DNA, 121 bp, Artificial Sequence
  Synthesized
  misc_feature (61): n=a or g
tgataaggccttgtggaatctccagcagctgaaggagagcaagctgttgaaaggatttacntcagggctactgaggtcaaagaagtcaagttaaagtaaccaaatcttactggcaaataga

SEQ ID NO: 11906 - DNA, 121 bp, Artificial Sequence
  Synthesized
  misc_feature (61): n=t or c
atatggttttggttccctaaaagcacagtgcctattctgagctactgtgttagactccctncatacaaggtagagactgcagttcttctaggttgaatctccttacccttacaatcctgtg

SEQ ID NO: 11907 - DNA, 121 bp, Artificial Sequence
  Synthesized
  misc_feature (61): n=t or c
atcctgcagtacccaggcagaggcctcctgctcccatctcagatgtacgagctcaaaaagnacaagcttgcagtcttgtgtttgaccatccttccggctcagctgtttgccttgctcacca

SEQ ID NO: 11908 - DNA, 121 bp, Artificial Sequence
  Synthesized
  misc_feature (61): n=c or g
aagtgtcttggggataccctcttcttcaccgaaagagaactatggggcattgctcattgcnttgtaggcaattggcataaatgactgccatcctgagggacttctgttgtgaaagagcttg

SEQ ID NO: 11909 - DNA, 121 bp, Artificial Sequence
  Synthesized
  misc_feature (61): n=a or g
aggttcactgtgctgctctcctttggctgaagctgagttatccctatggaaaatcaccccnggagagcaaatggccgtgggtggagatggagtcacttctggttttgcttcgcagccatat

SEQ ID NO: 11910 - DNA, 121 bp, Artificial Sequence
  Synthesized
  misc_feature (61): n=a or g
tgactctgtgcggttttattccccatcttttctccttaattgcagttgcagctgtgtctanctgctattacaaggaactgaattagaaaaatgaaaggagctattccatggtgctttggct

SEQ ID NO: 11911 - DNA, 121 bp, Artificial Sequence
  Synthesized
  misc_feature (61): n=a or g
ctgaatatggtttttgaaaacagagccttcactgaacacccagcgggtcatctgggtggcnagatatgagttgttgcatctacagttgtgctttgattgtccgtatcatcctccatggaca

SEQ ID NO: 11912 - DNA, 121 bp, Artificial Sequence
  Synthesized
  misc_feature (61): n=a or g
tccagaatgagctttcttggtattgcactgtggcactgaagttccataaaagcaaaagcanagcgcaaggccaagaggtgtttgataagacaatctggattgacatgaaaataatgacttt

SEQ ID NO: 11913 - DNA, 121 bp, Artificial Sequence
  Synthesized
  misc_feature (61): n=a or g
ccacctcatgattctggtctccatttcagagtgtgatacaaaggagggcatacgcccatancaatctcagccaaggatggggaagcagcacttctttaaatctcattgtagctctctaatt

SEQ ID NO: 11914 - DNA, 121 bp, Artificial Sequence
  Synthesized
  misc_feature (61): n=a or g
taaagccatttttcttccgcagccttggtcaggcaggtctgcttgggatgcagatcaacancttagcttcacttgggtgccttggaacaagcccgactctttcaaggccaagtggaaaaat

SEQ ID NO: 11915 - DNA, 121 bp, Artificial Sequence
  Synthesized
  misc_feature (61): n=a or c
ttcaagtgctggaagaaaaaaaggcttagattgaattgtacagctaaagcggaggccatanaatgcaaagtaaaaaaaacggtatctgataccattcaggtttctaagtgtcccaaacctt

SEQ ID NO: 11916 - DNA, 121 bp, Artificial Sequence
  Synthesized
  misc_feature (61): n=t or c
ttgctgtttctaaataatgttttggtagaaacatggatgtttaaaggcccagctgggcaangtcaccacaaatttagtgtatctggagcatcattgtctaagtatttttcaaaacattatg

SEQ ID NO: 11917 - DNA, 121 bp, Artificial Sequence
  Synthesized
  misc_feature (61): n=t or g
aacactaggcatgagagggaagatgtttcagttgaattttttattttcctactaatgacanccctttattgatctaaggggatttttgaaatattttgattctgttctctgtgtatgtcaa

SEQ ID NO: 11918 - DNA, 121 bp, Artificial Sequence
  Synthesized
  misc_feature (61): n=t or c
gtagctcggacttctctgccgtgagcatcactgcattgctgcaaagcaaagggggatcttnaggaaaaaggagcaaagatgggtcagagcggggtgggggaaggagcctccagacccggtg

SEQ ID NO: 11919 - DNA, 121 bp, Artificial Sequence
  Synthesized
  misc_feature (61): n=t or c
tgcagggtcggttactctgctactacttaatagcacacgtacactttaccatttattcagnaaggatttaggagatgaggtgacttgagtgtgtgatcgttagaaatcagtggaggtcaca

SEQ ID NO: 11920 - DNA, 121 bp, Artificial Sequence
  Synthesized
  misc_feature (61): n=t or c
cctttgccttttatgtctttgtggctcttaaggagacgtaaagtgcttcttcagaatgttncagaaatgcgtctggggtctcagatggttgccaggcctcctctaatggtgtgattgaggt

SEQ ID NO: 11921 - DNA, 121 bp, Artificial Sequence
  Synthesized
  misc_feature (61): n=a or c
ttcactgcattagggccaggattcctctggcttcacaagcctgacactctatttttcaacntgtgattccacagactatggggcatatactctggagtaagatgactccattgagagaatg

SEQ ID NO: 11922 - DNA, 121 bp, Artificial Sequence
  Synthesized
  misc_feature (61): n=a or t
tctctctgtttagaaccgtggaagaataagtcctttggttttggtgcgtacggcttgtgangctaccaagacccttctctgaccttctggcagtggctaaataaaggtttacctattcaga

SEQ ID NO: 11923 - DNA, 121 bp, Artificial Sequence
  Synthesized
  misc_feature (61): n=t or g
acagcattagaaaaagcatactacggttcttatttaagagaaatgcctgacatttggcctncctgtataacctgacaatactactgcttgacagtgcaatattcacccaaacaagcaccac

SEQ ID NO: 11924 - DNA, 121 bp, Artificial Sequence
  Synthesized
  misc_feature (61): n=c or g
agcttataaaccagatgaggacaagacaaaagatgctccagttatgtttccagaagcctanctgagtttagggacatactacaactaaaagagtggtgtgaaattcgagaagtagaaagca

SEQ ID NO: 11925 - DNA, 121 bp, Artificial Sequence
  Synthesized
  misc_feature (61): n=a or t
aaagcactctgcagttgctgatacactaattctcagaagagctcttctatgtggacagacnacagttatctgctttataaacaaaacagctgtggaagctgagttgctaaaacaaagaagc

SEQ ID NO: 11926 - DNA, 121 bp, Artificial Sequence
  Synthesized
  misc_feature (61): n=a or g
tctcaccttttgcacttcagtaactacaaactcatccttcgaagcagtctaatgagagacnttaaaagaagaaaattaattttatccttcagtgaaaattcgactcattttacctaacctc

SEQ ID NO: 11927 - DNA, 121 bp, Artificial Sequence
  Synthesized
  misc_feature (61): n=a or t
gctccaagggagctggggctaaagcttcctctgggtgcacatgctgtggtgtactcccagngatgtgacaggacaagccagaagtcttgatataggctaaatgcaacaagagctgaatttg

SEQ ID NO: 11928 - DNA, 121 bp, Artificial Sequence
  Synthesized
  misc_feature (61): n=t or c
taagaaaacaacatataagcagctttcagagccaaatctgaaacatgaaaggtcataggcngagtggagtttgtacatcttagtcaagatcccaaggtgtgagccctgagcaacctatcct

SEQ ID NO: 11929 - DNA, 121 bp, Artificial Sequence
  Synthesized
  misc_feature (61): n=t or c
gcaccacagcttctctgggcagctgtgccagcgcctcagcgccctcggaggaaaaagtttnctcgtaagtacagagatcttctcatgtataaccctcacaacactcgataagagttatatt

SEQ ID NO: 11930 - DNA, 121 bp, Artificial Sequence
  Synthesized
  misc_feature (61): n=c or g
atatgctgtcagatttatatttttttgttgaggtgaccaaatggttgaactactttggtgnatctctcagtcctcaaaatagctagacacagtgttatgcttaggatattctttctgtttc

SEQ ID NO: 11931 - DNA, 121 bp, Artificial Sequence
  Synthesized
  misc_feature (61): n=t or c
cctcctccatatcactgcaagaattatctacagcatcagatttacagcctttagacgttgnaagtgacagtgcatcattttcagctgacatttgaaaactcctcagaaattgtgttttttg

SEQ ID NO: 11932 - DNA, 121 bp, Artificial Sequence
  Synthesized
  misc_feature (61): n=t or c
gttttcccccccctacctgttggtataacactggctgctcatatctgtttgtcaggacttnttatttttattttagtaggcgctaaaccttattacaaggaaagatacagtataccataca

SEQ ID NO: 11933 - DNA, 121 bp, Artificial Sequence
  Synthesized
  misc_feature (61): n=a or g
ggatcttcagaggcttgcattgacaggaactgcaacaaaagagacaacaaagagaaattcngagtcctgcacctgaggcagagtgacccctgtgcaatgtcactgactgtagcagttctcc

SEQ ID NO: 11934 - DNA, 121 bp, Artificial Sequence
  Synthesized
  misc_feature (61): n=t or c
ctcactctctagctcagtgaggtacggtgacttttgaatggaagctggttttgtttcttcncagatcttctgaggctgttactgagatacacacggtcacatgaagatacactgttgtcat

SEQ ID NO: 11935 - DNA, 121 bp, Artificial Sequence
  Synthesized
  misc_feature (61): n=t or c
cgctgatccacagatatctctacaactcaacttgaatactcacacaagtcactatgtttgnttattgccacaacacatcctacaatcaagaagatgctgaaaaaaatgaggaggattacaa

SEQ ID NO: 11936 - DNA, 121 bp, Artificial Sequence
  Synthesized
  misc_feature (61): n=t or g
atggacttctgtatatctagtttaaatgcacctctacttaggtcagtccaccaccactgangttagctcttccttgtttcaggattcctttctggtttcagggggctaggactcctggtca

SEQ ID NO: 11937 - DNA, 121 bp, Artificial Sequence
  Synthesized
  misc_feature (61): n=a or g
caccccaggggtgtacagtggggtgtacagtgcgagcacagtgcaaaactcactgccaaanggttctacagaggtcttaagtgaggtttggaaaagaaggatgggattatcactctttatt

SEQ ID NO: 11938 - DNA, 121 bp, Artificial Sequence
  Synthesized
  misc_feature (61): n=a or g
ttgggaggaccctacgcataaagagaagcaggcagagtttgtccagagacatggggaaatnaaccaggtcaccttgagtcacctgctaacctctctcccttgcagctactccattgaatca

SEQ ID NO: 11939 - DNA, 121 bp, Artificial Sequence
  Synthesized
  misc_feature (61): n=a or g
gagcaaacaaacccagcctctgagcactgagtttgcattacttcttgcaagctaaaaagcntaagaaatgaattaagggtagctcaccttgtcaaaagaacggagatcataaagcttcacc

SEQ ID NO: 11940 - DNA, 121 bp, Artificial Sequence
  Synthesized
  misc_feature (61): n=t or c
gtatggtcaaaaagtttttatatctctaacacagtaaagtcaatgtaaatactcctttagnggagttagaagatgcactcaacttcctactcctgctcagcccccatacttgtctccattt

SEQ ID NO: 11941 - DNA, 121 bp, Artificial Sequence
  Synthesized
  misc_feature (61): n=t or c
ttcctccttttattgacaaaattttctcacagactgttaattttagtcttgtgttagttgntctgtctcctgcaatccttaagtttctttgtccaacatgatagttttaaagatacactat

SEQ ID NO: 11942 - DNA, 121 bp, Artificial Sequence
  Synthesized
  misc_feature (61): n=a or g
ctcttctgtatgtatgctatcattatcatctgagttgaatggttctaactgaaaagtaagntcagaagggagaacttatattgtgctttttaccagatgacaggaaaaaatcagctggggg

SEQ ID NO: 11943 - DNA, 121 bp, Artificial Sequence
  Synthesized
  misc_feature (61): n=t or g
aacagaagtaattttccataaatacttcactgaaacgctcccaaacctgaaagagaactangctcagattcagaccatcctcaaaaaggcagcaagccctctcaatcctaacacatccaac

SEQ ID NO: 11944 - DNA, 121 bp, Artificial Sequence
  Synthesized
  misc_feature (61): n=t or c
aaggggctgctcccctcagaacagcagaccagaagccaggatttattctctggttgctgcngtagctctggtgagtgttggcagcccagcatgccctgcctgccagcagcaggtgctgatg

SEQ ID NO: 11945 - DNA, 121 bp, Artificial Sequence
  Synthesized
  misc_feature (61): n=a or c
tgatcagttctttcccacacaaataactgaactcatcacatagagccaggagagaaacaanacagcactaattcccagttttaactgttgaggtggaatttcccatgccccagtccagcgg

SEQ ID NO: 11946 - DNA, 121 bp, Artificial Sequence
  Synthesized
  misc_feature (61): n=a or g
ataccaacatcctcaatgtatggaacagtttttgtttctttcacacttgcacttaagacanacataaacaatttgtttgcttgacaatgtatgtaaggggaatcacagttattttctattt

SEQ ID NO: 11947 - DNA, 121 bp, Artificial Sequence
  Synthesized
  misc_feature (61): n=t or c
atttctaacacacacagttcccagtggctggatttctaagtgtgggtaaaatggggacatnttcagaagatgcatttctgcacacttctgcccttgacagctttgtgctgtgcggatgctc

SEQ ID NO: 11948 - DNA, 121 bp, Artificial Sequence
  Synthesized
  misc_feature (61): n=a or t
atagctctactgagttcagtcacattgtccttccacactctacacctgttcaatttagcangctatcaaaagtcaaagatttcttcactttcacaatggtaagtgtaaattatgctgctat

SEQ ID NO: 11949 - DNA, 121 bp, Artificial Sequence
  Synthesized
  misc_feature (61): n=t or c
aaaagttgctcttttcctttagcatgtaacctggtggatagcactgggcattgccttaccnggctcctcacggagcacttggctttcctctggcaatgaagtaaagctgaatccatgctgt

SEQ ID NO: 11950 - DNA, 121 bp, Artificial Sequence
  Synthesized
  misc_feature (61): n=c or g
aagcaagaacgttcctgatttagtcttctctgtgtttctgcctgtgggagtgtttgtaganctcacaaatggaaaagacaactccaagatatgagcactcgtacaccttctactcttcttt

SEQ ID NO: 11951 - DNA, 121 bp, Artificial Sequence
  Synthesized
  misc_feature (61): n=a or g
agtagcagtgtgtggagccttgagtggggttctcagctcatttgctttgaaagtcctgagngcaaagggcttctgagctgctgtgtttggtctagaagaaaagtcaggagagtgcccttac

SEQ ID NO: 11952 - DNA, 121 bp, Artificial Sequence
  Synthesized
  misc_feature (61): n=a or g
cccatatattgcagtgtgaatgcactacaaacttcccatttcttaactattaaagtaagtnatatatttagaggtgaatattctcctgaagggcaataaacactgactaatcaagagtaca

SEQ ID NO: 11953 - DNA, 121 bp, Artificial Sequence
  Synthesized
  misc_feature (61): n=t or g
tcttaattttattaatctccttatgctactgtgcattgttctgagtcaccaaaatatgcanagtttctgaatagcttgacacattgctttgcattccatgttatattttaaggaatgctta

SEQ ID NO: 11954 - DNA, 121 bp, Artificial Sequence
  Synthesized
  misc_feature (61): n=a or g
tgacatcacagagactctaaaataaataggtccttattttcccattccttcgcttcatatncttgcttaaatctgtacctacacattaatttctgatttccccaaaatttaatgtgcccct

SEQ ID NO: 11955 - DNA, 121 bp, Artificial Sequence
  Synthesized
  misc_feature (61): n=c or g
ctgatccacatcagtggacgctctctctgattgcccctagaagattgttaatggagactgnatatgagcaattaactgcagtacccagttcacagaatccctgcaattataaccagatcat

SEQ ID NO: 11956 - DNA, 121 bp, Artificial Sequence
  Synthesized
  misc_feature (61): n=t or g
gagactttgcttttgatcagaatttgaaactctcgtttctagctgcaccactgttttctgngtagctgtgtgcaagttctttcacgtctctacatttctccattccctggtttgagcacag

SEQ ID NO: 11957 - DNA, 121 bp, Artificial Sequence
  Synthesized
  misc_feature (61): n=a or g
ttttcttgagaattaatgatttttttttttcctaacaatgaagagtcagcactggggaggntgctccagctttgaagcaaactttgcaaagctctaagcaacagtttatatacagaatatg

SEQ ID NO: 11958 - DNA, 121 bp, Artificial Sequence
  Synthesized
  misc_feature (61): n=a or g
attgaaaggtttggaactggaatatctgactggtagaactgtaactcagaaatagatcccntagctttttctctacaattattgaaagaaagaaaaaaaataaaaccaaaatgccctcacc

SEQ ID NO: 11959 - DNA, 121 bp, Artificial Sequence
  Synthesized
  misc_feature (61): n=a or t
gcagtacatgctgaacagagaagggttattatatagtatgttctgaccatttttagacttnaactgccacctgatgcctctgaaaatatacatggaagactaacaaaacagttgtcttagt

SEQ ID NO: 11960 - DNA, 121 bp, Artificial Sequence
  Synthesized
  misc_feature (61): n=a or g
agcaaaatggtaaaaacagttccagttcaattcagactagctatttcaacagttatcaccncagatcattaagagaaagtttctcaccatgtaaaacaaaatatgcccagttacagacctc

SEQ ID NO: 11961 - DNA, 121 bp, Artificial Sequence
  Synthesized
  misc_feature (61): n=t or c
cttgatttggcaccaagtaacctcctgtctgtaccctttgcacacagtatgcatgcttganggctttgcctctcataccataaactatgcccctttggccccattagggctggagaagtac

SEQ ID NO: 11962 - DNA, 121 bp, Artificial Sequence
  Synthesized
  misc_feature (61): n=a or g
tctgagtaggtctgggtcctctgacttggttatttctcattccaagtgcagcgaaaggcanggctgctgatcagcgctcttttcaatattgtctgtttgcaattaactgagcctgctaaag

SEQ ID NO: 11963 - DNA, 121 bp, Artificial Sequence
  Synthesized
  misc_feature (61): n=a or g
agtgtgaaagaaagtagtttaagtaactacgcttatgtcccatatcccaacaactgatacntttgagcaagttattccataagtaagttataaaaattgtcagatacacattaaatgccac

SEQ ID NO: 11964 - DNA, 121 bp, Artificial Sequence
  Synthesized
  misc_feature (61): n=t or g
ttgtttattgtggttttttttataaatctgaaatcttggggaggaacaaaatggtagcgtntatgggattatttgttttcatttactatcagagtattaaaaggttttttgccttttatcc

SEQ ID NO: 11965 - DNA, 121 bp, Artificial Sequence
  Synthesized
  misc_feature (61): n=a or g
ttgtaagatgctctgagtgaccagcggagtgtgtggggtaaatagatgggcaataatgaancctaacctttaagtattctgtatcaggtattttggtttggcactttccattacttggtct

SEQ ID NO: 11966 - DNA, 121 bp, Artificial Sequence
  Synthesized
  misc_feature (61): n=t or g
gtcttaacgtggcctcattgctttaacgtatcttctggggtctgttcatgttcagagcccnctgcaaattcaacccgtgttccccaagatgcattctgaaattcttcagtctctgtgttat

SEQ ID NO: 11967 - DNA, 121 bp, Artificial Sequence
  Synthesized
  misc_feature (61): n=t or c
cataaaacttaatggtgaatactgcttgtagtggaagctgtgcaacaataccctttatcantggaaaaactgccagtaaatcaccacagagaggacagtcacatgtgccccctgcacagtc

SEQ ID NO: 11968 - DNA, 121 bp, Artificial Sequence
  Synthesized
  misc_feature (61): n=t or g
cgttgttgaggtcccctggctattttgcttttctgtagtcacaaaactagattgtgggttncctttgttgccccaaaatggagaagacatccaggctgataatgtgtcctttcattgaagt

SEQ ID NO: 11969 - DNA, 121 bp, Artificial Sequence
  Synthesized
  misc_feature (61): n=t or g
tttaaagtattttcttaccctccatcacattaggatgtagtttgtacattgttagtatttncttcagcaattgcctggatcataataatgctgaaatatcaccaccgaaatattatatgaa

SEQ ID NO: 11970 - DNA, 121 bp, Artificial Sequence
  Synthesized
  misc_feature (61): n=a or g
ctcaaaatctgtcactaaaacaagaactgtcagggcaaatcacagattgtgaggtgctacntgtgactaataaagttcaaccacgtaacacaattaggatgtgctcacagttgggtgtatt

SEQ ID NO: 11971 - DNA, 121 bp, Artificial Sequence
  Synthesized
  misc_feature (61): n=a or g
actgaatatctgtccttcttgcttcaggcatccccacattttcatggtttgcaaagtcctngggaggaccctgagctgctgtgcacctcctgggttttggcacgtggaaaggggaggagag

SEQ ID NO: 11972 - DNA, 121 bp, Artificial Sequence
  Synthesized
  misc_feature (61): n=a or c
cctgccggatttcctgctcagttcactctggacacagcagactgcgctgccagcagacccncactcagcaccactcctttctcacacatcttttctctctggggacggcagagctgtacca

SEQ ID NO: 11973 - DNA, 121 bp, Artificial Sequence
  Synthesized
  misc_feature (61): n=t or c
caagcaaacactgaaggatctttagcactaatcctcagtggactttcttcttttgcacacngcattctaccagtgtggtgctcactgggaccaaatatgtgaaagcctttagcaaaaggag

SEQ ID NO: 11974 - DNA, 121 bp, Artificial Sequence
  Synthesized
  misc_feature (61): n=t or c
ttaaaagatgaggtttgcacgttctattttatttattcacagtaactcatgcaatcatcantgtaaggtgaagcagatacgctgctgtaaaggggtgtgttgtgatggcagaaagattgat

SEQ ID NO: 11975 - DNA, 121 bp, Artificial Sequence
  Synthesized
  misc_feature (61): n=a or g
actcaggcccattttcagactgatttggcctgcttcagtagattcccagcattgccatctnaatgttccagaaactcagactgaggtttgtataatagggttaaactttacacaggtaaag

SEQ ID NO: 11976 - DNA, 121 bp, Artificial Sequence
  Synthesized
  misc_feature (61): n=a or g
tcctcacttccacatacagatgagccatggacaccagtccatgttctgctgttccctgtcnagcctctgagacacagggatgccagaaatctgcagaagtttccaatggcccacgaagccc

SEQ ID NO: 11977 - DNA, 121 bp, Artificial Sequence
  Synthesized
  misc_feature (61): n=a or g
tgtgccccaggcagagcagttcaccaaatctacattttggagcttgttgcagccttttgtntgttttgggccataacacttctcttagaaggttctcaaacttaggtaaatacgtgtgaat

SEQ ID NO: 11978 - DNA, 121 bp, Artificial Sequence
  Synthesized
  misc_feature (61): n=a or g
tttgtaatatgctgtctcacggtgctgtctaacatcctggctgaaaaaactgcaggcaggnaaatgtttgcgcatgccaggctgctcctgtgcttcatccctggtgggaattgtgcagaat

SEQ ID NO: 11979 - DNA, 121 bp, Artificial Sequence
  Synthesized
  misc_feature (61): n=a or g
tcactgcacattgtataagtctgactttggtaattctaaataactgtgtaccgtctgcagntttgactaatggcctgctctctgacctcttctatatgttccttacatacacaccttaagc

SEQ ID NO: 11980 - DNA, 121 bp, Artificial Sequence
  Synthesized
  misc_feature (61): n=t or g
aaaaaaagaatagattcttagtctgtttaacgttttattttgtctctagtttatgaaaaanataggaagtagtaaagtagaaggccttgaagaaggttgcatatgaagtctttatcaaaag

SEQ ID NO: 11981 - DNA, 121 bp, Artificial Sequence
  Synthesized
  misc_feature (61): n=t or c
agagaagggaattcctatgctttggagctttcatttggaaaagctccatttgcttgctatngggtcaagttctctaggcccagctatgccatatatagaggcttctctctgtgtccacctt

SEQ ID NO: 11982 - DNA, 121 bp, Artificial Sequence
  Synthesized
  misc_feature (61): n=a or g
ggaaaaaaagatttttctgggctctttttttttttttttgccagatttcccccatgctacntgtattaacatctacttgctttatattcaagtgctgcctgtgatttaagcactctcctga

SEQ ID NO: 11983 - DNA, 121 bp, Artificial Sequence
  Synthesized
  misc_feature (61): n=a or g
gccccctctgcagcagttgagctacctccatatatcttcattattccagcatcaaaacccnagtctgaaataaaatggtagggctcgctgaagggcttcaacgctgagaagaacagcacca

SEQ ID NO: 11984 - DNA, 121 bp, Artificial Sequence
  Synthesized
  misc_feature (61): n=a or c
ccggaggggctggacaacgtggaaaatatttctgatcattatctaacaaataaagcatttnaattgctgcctttcaggtgtggtatgtttgacagttgtttttaaaagattgcatcagtat

SEQ ID NO: 11985 - DNA, 121 bp, Artificial Sequence
  Synthesized
  misc_feature (61): n=t or c
acatcaagccctggcttctgctctttctcttgtgggagaggactatcagagcatagaaganatttatagtgcaataaatgggaagatgggagagggttgtgaggagcacttgtatgtttgc

SEQ ID NO: 11986 - DNA, 121 bp, Artificial Sequence
  Synthesized
  misc_feature (61): n=a or g
gagcatgggaaagtttatttttttccatctccagtcccatactgatatatatgcaaactcnagagtaagcagacaggtgtggcagaacactggacttgggctgcctgtgttgttggttatc

SEQ ID NO: 11987 - DNA, 121 bp, Artificial Sequence
  Synthesized
  misc_feature (61): n=c or g
gcccatactggtgtacattttatcattgatttgcaaaatgagaaaagctctttttctgccnaagagaaccaactaaagaatagggagagaaaccattcagtatctcacagaatcacagaat

SEQ ID NO: 11988 - DNA, 121 bp, Artificial Sequence
  Synthesized
  misc_feature (61): n=a or g
ttgggaccaacggttcctctcttagaatttatcatttgcccctcctgtaaggctgaagccnttgcacctggacctcaccatctctttttctgaaatgcttaggtagacgagagagtgaatg

SEQ ID NO: 11989 - DNA, 121 bp, Artificial Sequence
  Synthesized
  misc_feature (61): n=a or g
cgagcactgagaggtgagctcttctctgcctaacaggctctgtagcctgaaaaataaagcntaactaactctaaaaagaaacttcacagccttcctgggtattactgcatgtaggaacaac

SEQ ID NO: 11990 - DNA, 121 bp, Artificial Sequence
  Synthesized
  misc_feature (61): n=a or c
aaccattcagaacatcatccttgtgaaaaatctgttcaaatactcaaaagaaatctattanatttccttttctttccagacagtacaagatagatattgatttcagccattaagcatgtaa

SEQ ID NO: 11991 - DNA, 121 bp, Artificial Sequence
  Synthesized
  misc_feature (61): n=a or g
atattgtgctaagaatcctacattcgtcaggcaccagctgatctctgaagtctgtgcactnagaacatatctgagacaagacaaacaacaacggtctacccactgttctgatgggctctgt

SEQ ID NO: 11992 - DNA, 121 bp, Artificial Sequence
  Synthesized
  misc_feature (61): n=t or c
tacctagcttagagatgcagaggaaagacaaacaggaactaaaatgcatttgcacaattgncttcactaaatcttgtgatttgcagtactactgatggaaacacccagaatctgctaacaa

SEQ ID NO: 11993 - DNA, 121 bp, Artificial Sequence
  Synthesized
  misc_feature (61): n=t or c
aaaggacataaattgtccactgtttctttgaacattagaaataaggaacatcaaaggagangggagaagttatttgtgcagttgggtaccttagctgtgatactccttgacagaggatgct

SEQ ID NO: 11994 - DNA, 121 bp, Artificial Sequence
  Synthesized
  misc_feature (61): n=t or c
aatgggtttccagatgtcaatttatatatagtatacactacactcacacttgatcccagtnaccagaccagaacactcacacagtaaagcccctgacacaccaatgttttgctgatttagc

SEQ ID NO: 11995 - DNA, 121 bp, Artificial Sequence
  Synthesized
  misc_feature (61): n=a or t
cagataaccaaacagattattttttacactgaaacacagcataagatgtactgttcttgcncctccaaatctcacaggagtcctcagagcattctagtcctcaacaagcattacaaaacac

SEQ ID NO: 11996 - DNA, 121 bp, Artificial Sequence
  Synthesized
  misc_feature (61): n=a or g
aatccatagcttttactctattatttagcacagcattgcttttgtcctattccacccattntttttaacaccacaggttttcactggacttattcactgtactgtatttactttaaataag

SEQ ID NO: 11997 - DNA, 121 bp, Artificial Sequence
  Synthesized
  misc_feature (61): n=a or g
tcacataaaaataagtgtttctttgattcaaaaatgcttacttagctgtgcttcatgctgnggactttgggaatggcagttctgagacttcctgtaaatcatctctcctgctttcaaagcc

SEQ ID NO: 11998 - DNA, 121 bp, Artificial Sequence
  Synthesized
  misc_feature (61): n=a or g
cagtgagcgagcaaataggaggaccctgagcctggagtgccacatcgcaccagacagagtnggggaagctgtcaggagcccactgagcgctgctgcagagggcaggggccagcagagctgc

SEQ ID NO: 11999 - DNA, 121 bp, Artificial Sequence
  Synthesized
  misc_feature (61): n=a or g
ttctgcagggcgccatgtcttttgtggacatgtcctggagatccatgatttgtattcaggntgaacccatttgatggtttaatttttccagcatcgcttgttacactgtatacagttagac

SEQ ID NO: 12000 - DNA, 121 bp, Artificial Sequence
  Synthesized
  misc_feature (61): n=a or g
ttgttctaacaggtagaaaaagcagaagaaatatcaattactcatattccctcattttccntatgtgtataatctgatgaaagtggagtgcattccaattaaacctcataacattgaaaca

SEQ ID NO: 12001 - DNA, 121 bp, Artificial Sequence
  Synthesized
  misc_feature (61): n=a or g
attacactaacaaatcattacagtgaaagaagcagaaaagactagaggagctaaagttagnagttaaaatgctagagatttcttccatagaaattctagtgtagatttaccgagacatcta

SEQ ID NO: 12002 - DNA, 121 bp, Artificial Sequence
  Synthesized
  misc_feature (61): n=t or c
atctcccagcgggcacattgttggtgtgttggtgggtgttgttgtcccagtgataatgggncctcactgtttgctctgcaggcttctcgggatggagctgaccttcgctcccatctgacct

SEQ ID NO: 12003 - DNA, 121 bp, Artificial Sequence
  Synthesized
  misc_feature (61): n=a or g
ttgcagatctgaatggcttgttttgaagtcacaaagcttctccgtattctgtgaggagctntgaacataattcctctgtgaaactatgcagattgctgaagtgctgtaatctttcagaaaa

SEQ ID NO: 12004 - DNA, 121 bp, Artificial Sequence
  Synthesized
  misc_feature (61): n=t or c
cagttatttcagacatgggctctgagagagcaggacttgggagagcttctctttaaaacanctgcaaccagggcacctgtctgtatgtttcctcaccatattcacatacctgaccccatat

SEQ ID NO: 12005 - DNA, 121 bp, Artificial Sequence
  Synthesized
  misc_feature (61): n=t or c
cattttgtttttgtgtatgctgtttccagaattttaaagaacaaccacttctatgttcctnctcagtgctaaagttctgacatgaaaaaataaaggtccaacagcagaaagaaacaatatt

SEQ ID NO: 12006 - DNA, 121 bp, Artificial Sequence
  Synthesized
  misc_feature (61): n=a or g
aagactaaattctaagatactagcacagtacatcaatcttctattgaaaaagaagcagaanattcttttggctctttcctagacagcttctttttatttatgagacctcacatagttatat

SEQ ID NO: 12007 - DNA, 121 bp, Artificial Sequence
  Synthesized
  misc_feature (61): n=a or g
ttagataaaacattatgttaaaattcatgtacttctgactttatttacgtttcctagtgantgtatcttcctggctgagtttttcctttttctacagggatcaaacagaatactccaatta

SEQ ID NO: 12008 - DNA, 121 bp, Artificial Sequence
  Synthesized
  misc_feature (61): n=a or g
gtgataaaaagggaaggaaaacaggactgtgggagtcatttagcttaccaaaaagagatgncagtagaagggctgagatagatatgctggtagcctttacttttaaagaaaaaaatataca

SEQ ID NO: 12009 - DNA, 121 bp, Artificial Sequence
  Synthesized
  misc_feature (61): n=a or c
aggtccttcatgtgttcttgttagatgctcatacagaaacatggttttaattaaggcatgnattgatccaagtccaaaaaatacatttatttcaggagataaattcattagccataagcat

SEQ ID NO: 12010 - DNA, 121 bp, Artificial Sequence
  Synthesized
  misc_feature (61): n=a or g
agcacaatcgtggcagctttatcgtagagactgaaaatatggaacctgtgttaatgagtgnaatgtatttacagcaattacatttgaaagctagttcgctagttagcaaatgcgagggcat

SEQ ID NO: 12011 - DNA, 121 bp, Artificial Sequence
  Synthesized
  misc_feature (61): n=a or g
aaagttcagttgaccaattttttcgggtggtaatttagaagagctgaaatcataacaattncaagtgtggttcagttcactaactgcaggacttgggcctactccatttctcctcagtcat

SEQ ID NO: 12012 - DNA, 121 bp, Artificial Sequence
  Synthesized
  misc_feature (61): n=a or g
caagaacaaattataactttctgtttgaaataggaatatgccaggtatctttgccagtacnagagtttattttccagcactctgaacttggtgtagtaatgacagtttggtaatgctgtta

SEQ ID NO: 12013 - DNA, 121 bp, Artificial Sequence
  Synthesized
  misc_feature (61): n=t or c
tatttttttaagtctagttgtttgctgtgtggtttaatggcgaaacatcacaacatgacgntatgtgtatggcacttctgacacttcaggcagaggttttctgctcaacaacaaagcttca

SEQ ID NO: 12014 - DNA, 121 bp, Artificial Sequence
  Synthesized
  misc_feature (61): n=t or c
tctgctttgcattataatcgttttatacactatttctttccttgatacagataacattttnggacaaatttgaattctacattgatggcattcttttaattcaatctgatctcacataatt

SEQ ID NO: 12015 - DNA, 121 bp, Artificial Sequence
  Synthesized
  misc_feature (61): n=a or g
agtatttgacatatttctttccatgcagagtggctgattcaggcttgtgttttgttctcantgtaagccctgagtctggatgcagtttgggaaaaccagcccagctggtggtaaaaccagt

SEQ ID NO: 12016 - DNA, 121 bp, Artificial Sequence
  Synthesized
  misc_feature (61): n=t or g
tggcagaaggaagagggaaataagtagcacgtagccacttggaaaagccattaaacacacntatcagttaaggcattttctatggcttttagtaattattttccaaaccaaaaagcctcta

SEQ ID NO: 12017 - DNA, 121 bp, Artificial Sequence
  Synthesized
  misc_feature (61): n=t or c
acaggtcccaagcctcaacgtgtacaccatcgagctgacccacggggagttcacatggcangtgaagaggaagttcaggcacttccaggagttccaccgggagctgctgcgctacaaagcc

SEQ ID NO: 12018 - DNA, 121 bp, Artificial Sequence
  Synthesized
  misc_feature (61): n=a or t
acaccccagtgcagggctggaggaaaattactgcagaaatcctgataatgatgaaaaaggnccctggtgttacacaacagatcccaataccagatttgattactgtaacatcccagagtgt

SEQ ID NO: 12019 - DNA, 121 bp, Artificial Sequence
  Synthesized
  misc_feature (61): n=a or c
attggtagaagggacaagttctagtcacagtattttacaactaaaggcatactggtgaaanaccagcacagggtgttttggatttctgagctggaacaagaggcagtggtcaagtcaagga

SEQ ID NO: 12020 - DNA, 121 bp, Artificial Sequence
  Synthesized
  misc_feature (61): n=a or g
gctttgagaagatgataggcataggcatgtgttaacctccttatgaggacatactggcatnagcaccagggagcatcagcttgaccaggctgagtgtgtgaggctgacagttctgtaaaga

SEQ ID NO: 12021 - DNA, 121 bp, Artificial Sequence
  Synthesized
  misc_feature (61): n=a or c
tgacttcactgtgtttggggcaggccccggatgaatatccctcgggtgagacagtttaatnatccattcagcagtacacaaagcagatcacatacacttttagcctgcattgtatggtgtt

SEQ ID NO: 12022 - DNA, 121 bp, Artificial Sequence
  Synthesized
  misc_feature (61): n=t or c
ctgccaaaaatgtggtcttaagatgtgtttttacagatcaatataattatatcttctgcangtgtgtacagggctcagtacaatttaatgcttatcacatatatcactgaaatgcaaaaca

SEQ ID NO: 12023 - DNA, 121 bp, Artificial Sequence
  Synthesized
  misc_feature (61): n=c or g
aaagtgtgtgcactccaaaataagttcaaagatgtccggtcactgttgactgtatagaaangagaaggtggagaaacagtgttactgagagtaggcttagactgtgggcagtgggagggga

SEQ ID NO: 12024 - DNA, 121 bp, Artificial Sequence
  Synthesized
  misc_feature (61): n=t or c
tcgcccaagtaaacatcaattaggaacgagaaaaacctcaattttgtccatcagaccgcantgtgcagtttcacttcgagcagtttttcagccataactcctccacacaaccaggtttcca

SEQ ID NO: 12025 - DNA, 121 bp, Artificial Sequence
  Synthesized
  misc_feature (61): n=t or c
gagtgagataaacattcatcttcctgagactgaactggattggagactcttttttggctgntccaaatagtgtctaaactatactgacagaaatcaagagagattttacaattgccacgtg

SEQ ID NO: 12026 - DNA, 121 bp, Artificial Sequence
  Synthesized
  misc_feature (61): n=t or c
aagccttctaagtgcagtttttggagatactcaaaataaaaagtagaagcaaaggcagacnttccaggagcttattgctgctcacttgggtctaatatagagttagcactttgcaggtcag

SEQ ID NO: 12027 - DNA, 121 bp, Artificial Sequence
  Synthesized
  misc_feature (61): n=a or t
taacacttttcataactgactggagaagcattaagtgtttgccacagctgctgaagaattngtagcctgtatgacaaaagaatctcatgactgtatgtttattctttactaaaaacggtat

SEQ ID NO: 12028 - DNA, 121 bp, Artificial Sequence
  Synthesized
  misc_feature (61): n=t or c
ggagggcaggtaggtggactcaatcccaacagtgcagtagtcgctgttgctctgtcaaganggaataaccgtgttggaaagctctgggttgcacagctccagctggcaccctccagctgtc

SEQ ID NO: 12029 - DNA, 121 bp, Artificial Sequence
  Synthesized
  misc_feature (61): n=t or c
tccctttccttatttgctatcttgcctactaaactgtgatcctattatctgatggggcttntgtctctctcaagggagagatgaaatcagtgggagaatagggtggggactgaacttgctc

SEQ ID NO: 12030 - DNA, 121 bp, Artificial Sequence
  Synthesized
  misc_feature (61): n=t or c
ggaaatatttttaaaaagcagaaacagaaatgttgagttgaatagagggatgagtatcttngggaagaaaagcatatttaaagagatgacatcattctgaaaaatgctcagattcaaataa

SEQ ID NO: 12031 - DNA, 121 bp, Artificial Sequence
  Synthesized
  misc_feature (61): n=a or g
gaggaggaaaaagaagaaaattctgatgtacttctgggctctgaaaaagtctcaatatttngcagcgatttttggtgcacttgtcaaagaacagtgagagactctccagcacaagttccat

SEQ ID NO: 12032 - DNA, 121 bp, Artificial Sequence
  Synthesized
  misc_feature (61): n=a or c
tgtggtgttaatcacatgagaaggaccctgctgggagttgtggtaattacggtgggatagntcatcactgcttgaactctcttcaggacttcattttttcttgatagcaacaatgatgcta

SEQ ID NO: 12033 - DNA, 121 bp, Artificial Sequence
  Synthesized
  misc_feature (61): n=a or g
gtagccatggacagggggatagcttttatcctgccgaaagtgcatcatgtttcgcttgatnggaattaatttattgatccaattagcccccaacctgtttacagggtgatcacagatgaaa

SEQ ID NO: 12034 - DNA, 121 bp, Artificial Sequence
  Synthesized
  misc_feature (61): n=a or g
agctgctaacataagaagttcctttgatattaaggctgaggtaagcagaattgttgcaagnaaaacaccagaaaggttaagattttcaagacaagctaagggatttaggtccatttttgat

SEQ ID NO: 12035 - DNA, 121 bp, Artificial Sequence
  Synthesized
  misc_feature (61): n=t or g
ggtgttcaaggacaaccagcaataggcacccacacattgctttctccaggcccttgccatngcaaagggagtgtaggtccaccaaggcttcatcaggtggtctcgtttgttctctaggggc

SEQ ID NO: 12036 - DNA, 121 bp, Artificial Sequence
  Synthesized
  misc_feature (61): n=a or g
cagtgagtgttagctcctaaagatggcaaaagacctgcccaaaagggtgtcggtgccatcnaggaagaacgcaagggacacagtgaggacacttggcatctatgaaccctggtcccccact

SEQ ID NO: 12037 - DNA, 121 bp, Artificial Sequence
  Synthesized
  misc_feature (61): n=t or c
aaattgaagaaaaagttttcccagtaagaatctgtttcacctgaaattattctgttgtctnaacaagtactctgcatttcaaggaacactgcaggatccacagataatttacttcataatg

SEQ ID NO: 12038 - DNA, 121 bp, Artificial Sequence
  Synthesized
  misc_feature (61): n=a or g
cattgcttccagacgtctcccagctgccccagttaatattacaaccaacttctaattgagngatatacacacagtagggttgtgcagtgctgcttgctgcaaatatgtcagctctgcaagc

SEQ ID NO: 12039 - DNA, 121 bp, Artificial Sequence
  Synthesized
  misc_feature (61): n=t or c
tttcagacacccaactctttgcctcaccacagcaatgtgatctaatttagattttatgaangttacactcagctgtttcaaaactcaaggagcagctccaacgtgcttcacagaccttgtt

SEQ ID NO: 12040 - DNA, 121 bp, Artificial Sequence
  Synthesized
  misc_feature (61): n=c or g
tttcacactgctgtattcttttacttaagcaaggcaagggtgagaacagtttgttcattcntttccccccccgtgcctcttgctcggttgctgaaagtgattttcatggtacatagtcttg

SEQ ID NO: 12041 - DNA, 121 bp, Artificial Sequence
  Synthesized
  misc_feature (61): n=t or c
ccttacagacagagatgacagcagtgctccaaatgaagaaccagaagctcagagggagaantgcaaagcatcctggtacactatagaatatccttgggatattctatgattttatgatggt

SEQ ID NO: 12042 - DNA, 121 bp, Artificial Sequence
  Synthesized
  misc_feature (61): n=a or g
gtgatcgaagtggcttactgccatgtagatatccatataaattcaaatgcaacatcaccantaggacagtgtcttcacaatcaatttgcattatacatgcacattaattttgttgctatac

SEQ ID NO: 12043 - DNA, 121 bp, Artificial Sequence
  Synthesized
  misc_feature (61): n=t or c
gcatgactttgttatgtaataacatgaaagacagagaagtcaaacctggaacagactgcangcacgatttgcaataaagcagcaaatgtggctcaactgagtcttctcttttacattttgt

SEQ ID NO: 12044 - DNA, 121 bp, Artificial Sequence
  Synthesized
  misc_feature (61): n=c or g
ccaagatgagcaaccaagggtaggtggacctcttacaccacaatgatcacacaagactttntataaagcagtggtggctttgcttatgtcattattggtcttcaaaaggagttaatttttt

SEQ ID NO: 12045 - DNA, 121 bp, Artificial Sequence
  Synthesized
  misc_feature (61): n=t or c
gaagaaaggggccgagcaatcacttccatccccaacatacagctcatttcaactcccctangggttccacagaagcaggggacaccgccagcaactgaagcagctctgctgtgtcccagca

SEQ ID NO: 12046 - DNA, 121 bp, Artificial Sequence
  Synthesized
  misc_feature (61): n=a or g
ctgaacacagtacttgagctgcataatactataactcatagcccatacattgaacattacngggcttccaatcttcacaagtgcttgcaacgcaactttcagaaactatttaatttaggtg

SEQ ID NO: 12047 - DNA, 121 bp, Artificial Sequence
  Synthesized
  misc_feature (61): n=t or c
ttgggaataattgaaatgttaatattgaataatctttgaaaacagaagtacagttgaattngatagttgttcactcacggggaatttatccgtgttgtacagccatggagagtgtgttgta

SEQ ID NO: 12048 - DNA, 121 bp, Artificial Sequence
  Synthesized
  misc_feature (61): n=t or c
ggagtggcagtaatgactgtactgaggctggcacaaatatttgtattaaccgtatggtttntgagagccctgctgctcccacagatgcagatggccaacaccatgtcctgcctgctcccca

SEQ ID NO: 12049 - DNA, 121 bp, Artificial Sequence
  Synthesized
  misc_feature (61): n=t or c
gtgatggggggatgatacacacgagatgagagcacagaagggcatttttggcttagcaganccttctgaagggaatcagtaccagcaggactccagacgtatctgcctgaccaccgcatca

SEQ ID NO: 12050 - DNA, 121 bp, Artificial Sequence
  Synthesized
  misc_feature (61): n=a or g
agtcttctagcttaaagccacatgagtgcttttgttggctggctttgactgatgtggtacnagaaatctgattatatacaagagtcttctagacaatcactggttcttgagaagcagatct

SEQ ID NO: 12051 - DNA, 121 bp, Artificial Sequence
  Synthesized
  misc_feature (61): n=t or g
ttacagaattaataacctggattggtaatgcaagtgtgtgtatttggttggaagcagaatntgagaaagatttggagtctcactgttaaggaaatcaaaaagggatattttatcacctaca

SEQ ID NO: 12052 - DNA, 121 bp, Artificial Sequence
  Synthesized
  misc_feature (61): n=c or g
tggactgccagcttctggggtttactcatttataaacttcagcagccgggctagttatccnttttccataagaggtttcagagcagcacctggggacaccctcgatgtgagtgtcattgtg

SEQ ID NO: 12053 - DNA, 121 bp, Artificial Sequence
  Synthesized
  misc_feature (61): n=a or t
aattagtaatttagggtttttgggtggagtgggagagggtatgttctgaaaacagcttcanactgcacttctgtgtatcctaacttctttttttcctcctgttcagaagtctgttccatga

SEQ ID NO: 12054 - DNA, 121 bp, Artificial Sequence
  Synthesized
  misc_feature (61): n=c or g
ggtgaggaactgatggattgatcagggttaaaaaaaaatagaggtttttcacccttgatgncttatggctgagcaggtctgtgagactgaggatgatttatatcttctctgcatggccatg

SEQ ID NO: 12055 - DNA, 121 bp, Artificial Sequence
  Synthesized
  misc_feature (61): n=a or c
cttggtagttggcttagacaagctgccagatggaagatcctctgtcttctgtgcatcccanctgcctttcacgtttctgaagcacaggaggtgaaggtggttgggtgctcagcaatgtggt

SEQ ID NO: 12056 - DNA, 121 bp, Artificial Sequence
  Synthesized
  misc_feature (61): n=a or g
ccacaagggatccaagcagcaagtgggtgcttctgcctaagatacaatgcttacagccacngacttccctgttcacatgagatccaataacctccaaacacccgctccacacacgtgaagc

SEQ ID NO: 12057 - DNA, 121 bp, Artificial Sequence
  Synthesized
  misc_feature (61): n=a or g
ctgcttcatggtccagtacatgtgctgcaggaagggagaggaggaggctaaagcaacagangacaaaccattctcacgtgcctatgcagaaggtattgcatactctggatgatgctggtca

SEQ ID NO: 12058 - DNA, 121 bp, Artificial Sequence
  Synthesized
  misc_feature (61): n=a or g
caggatatatattaactcttgaactgatagatgcaattaaatgtagcaataaacagttttnctgtcatttaataatatcagaatatctaattcctgaatgttggagcacctttcctgttta

SEQ ID NO: 12059 - DNA, 121 bp, Artificial Sequence
  Synthesized
  misc_feature (61): n=a or g
cctgggggctgcctgcgctgtgtactgcagacacccggatctccagcccacagagctaacnaagttaacgaggccatcacatcactccgcttgcattgcctgctttgctttcccctctttt

SEQ ID NO: 12060 - DNA, 121 bp, Artificial Sequence
  Synthesized
  misc_feature (61): n=a or g
accagtgttcactgtctgctctttcttaccacagcattaacaaaattttaaataaactaanctcttcagagaattaaacaagctgagataaacaagatttcccgataaactggcattatgg

SEQ ID NO: 12061 - DNA, 121 bp, Artificial Sequence
  Synthesized
  misc_feature (61): n=t or c
ctagtgctgaacaggttaggccgccaggcaaagtatgtgcatccaaaacaaaggaatctgntttgaacacagtagcgaatgcacatcttgagggaaggccctatgttgtatttaaacgcac

SEQ ID NO: 12062 - DNA, 121 bp, Artificial Sequence
  Synthesized
  misc_feature (61): n=a or t
agtgcatcgatccaaagagaaaaccattgagaagcagcaaaggtattgggtttgtccagangtaaccaatttttccacgcacatttcttaccatagaaaaaaatgaagagccttggatatt

SEQ ID NO: 12063 - DNA, 121 bp, Artificial Sequence
  Synthesized
  misc_feature (61): n=t or c
atcttccatcttaaagatggaaacagaaattatttgatattgttaatgtggagttgagganaagggttaaatcatattttccaaaggaatactacttgtaaagcattgaccatttggtctg

SEQ ID NO: 12064 - DNA, 121 bp, Artificial Sequence
  Synthesized
  misc_feature (61): n=t or g
acctaagagtggtagacataaaataaagaaagacctggaatgtctgcttgtctcaatttancaggtttcagttcatattggtgttcagctacaaaatcgattggatgtgaatagaaaacag

SEQ ID NO: 12065 - DNA, 121 bp, Artificial Sequence
  Synthesized
  misc_feature (61): n=a or g
taatcctcgtaatacattgcaactttgtattgtgcattcattttattactagataaactanaacacaaagaaaataagtaacttactcatagtccaaaagaaatcacagtcaatgatgaca

SEQ ID NO: 12066 - DNA, 121 bp, Artificial Sequence
  Synthesized
  misc_feature (61): n=t or c
aatcacacaacatgtgtgggactacctaggcttcagtaaagactttgactctgtttcccanagtattcctggagaagtggctgtacccatggcttggacaggtaaaaaaattggctggaaa

SEQ ID NO: 12067 - DNA, 121 bp, Artificial Sequence
  Synthesized
  misc_feature (61): n=a or g
cccagtgagcagggctcaattcctgcactgaagcctgttagtctcaggctggtatccactngggcaagaagggtttgatctagacataaagcagtaaaagtacttcagtggcacccagccc

SEQ ID NO: 12068 - DNA, 121 bp, Artificial Sequence
  Synthesized
  misc_feature (61): n=t or c
ctgggtgatgatattattggatcactgttagtcacaagcctagatttaagcatcctacatngaaacttaggaggaaatatgatcagagcagctctcttagagatatttgttgctcattggg

SEQ ID NO: 12069 - DNA, 121 bp, Artificial Sequence
  Synthesized
  misc_feature (61): n=a or g
acaaagaaaaagaaacacacaacagaatatatagaatggtttggaaacatattcttgtatnaaacaggttctaatgaagtatttagttcttgcaagtctgtgcattagtgcatgcctttgt

SEQ ID NO: 12070 - DNA, 121 bp, Artificial Sequence
  Synthesized
  misc_feature (61): n=t or g
ttggcacatatatatggtagcatgggagtacctgggaaacactgtacagaagcatcccaanggaactgcaggtagatcctgtaatcttttgaaacagcaaaagggaaaatcagaagcacgg

SEQ ID NO: 12071 - DNA, 121 bp, Artificial Sequence
  Synthesized
  misc_feature (61): n=a or g
aaaaatagacagatagatagatagatagatagataagtctataaggctgtggtccccagangtacttctcccctctgtctccactgtgggcaaaaatcactaagtgatctgttgggttaca

SEQ ID NO: 12072 - DNA, 121 bp, Artificial Sequence
  Synthesized
  misc_feature (61): n=t or c
atttgcacacaggacgtcttgccttgcaagacacccatgagtaatggcacagtaggtcaancacattcctcagtaaaatttaataaagcacacattgagtgtgtgagctttacaattcatc

SEQ ID NO: 12073 - DNA, 121 bp, Artificial Sequence
  Synthesized
  misc_feature (61): n=a or g
ttattgcttataccaaaccatcagcttcttcacgttatgcagaaataccataacaacaacntgagggctaaacagggaaaaggtaagatgaggagattttctgcagggagtattttagcaa

SEQ ID NO: 12074 - DNA, 121 bp, Artificial Sequence
  Synthesized
  misc_feature (61): n=a or g
gagcagagcacaatgctgcccccccagcagtcctgcaggcatcctgcacaccttgggttgngtctggcatcactgcaacagcaacagctcagcatcccacagccctcctcattgggctttt

SEQ ID NO: 12075 - DNA, 121 bp, Artificial Sequence
  Synthesized
  misc_feature (61): n=t or c
agaaacagaaattgttatccaagtcatatccacacctacctaatgctagacaattagctgncctttgtttgggccatcttgcaaacaaagatatgccatctttgtttgctgtaccatggtg

SEQ ID NO: 12076 - DNA, 121 bp, Artificial Sequence
  Synthesized
  misc_feature (61): n=t or c
tatgccgatcttaattcctcatttccctgacttcagcaagaacatcatttttgcacatatncctaccattgcataaaggtaaaataagacatttaagaattagaaaactatattgagactt

SEQ ID NO: 12077 - DNA, 121 bp, Artificial Sequence
  Synthesized
  misc_feature (61): n=t or c
atcagtcaatatggaagagatatcaagaggcaatatggaatgtggatattcagatttcagnaaacaacagctctgctaataacacaagaaaataaaacatttcactattttttaacaaata

SEQ ID NO: 12078 - DNA, 121 bp, Artificial Sequence
  Synthesized
  misc_feature (61): n=c or g
acgcagatccattggctgcagtggctgacagcactgtttgccccgagcaggaaatgaacangttgagaatgcaccaaaaacccaaaaccttctgttcagccaaaggacagtggaagaaacc

SEQ ID NO: 12079 - DNA, 121 bp, Artificial Sequence
  Synthesized
  misc_feature (61): n=a or g
tttcacattaagtgtttctccttattgtttcaactgacttcttgtgatcagaaagccagancccacctacaccagtaagatcttggctggccaggattaaacctagtgatcgggacacatg

SEQ ID NO: 12080 - DNA, 121 bp, Artificial Sequence
  Synthesized
  misc_feature (61): n=t or g
tacatataatattcacttcccacttctttttccactcttcctaatagtaaataatgcacanaaggcctcacctgttgtttgtaatgtgcaggacaatcagccacgtatctctcccaccatg

SEQ ID NO: 12081 - DNA, 121 bp, Artificial Sequence
  Synthesized
  misc_feature (61): n=a or g
aattatctccacatgcgtatagcttgtagacatgtatccatattgtaagtgcttttcggangatactcgactacattacttccagtcatgcattttgcactcttttgcatgcttcttggca

SEQ ID NO: 12082 - DNA, 121 bp, Artificial Sequence
  Synthesized
  misc_feature (61): n=c or g
tgtcatatctgtctgcattaaaggtgtcactgatagtgttgtaagtctggtagtacatcantatagtcaaatttctacttaatgtctctgattccttgatgttcatgattcattttgcttt

SEQ ID NO: 12083 - DNA, 121 bp, Artificial Sequence
  Synthesized
  misc_feature (61): n=a or c
aaggtatctatgtgacaccagacaacaacagtgtgtgacagaaatgtcgagttcgtccagntgatttgacaggcagccgaacatttacagaatactgaaggtgacaggaaataaaccttaa

SEQ ID NO: 12084 - DNA, 121 bp, Artificial Sequence
  Synthesized
  misc_feature (61): n=t or c
ccctttgttaggccaaacattcatgtataaagaattgtcttctttacatgcacttacaaanaaggggagtagtttatctacctctttctctctctcccatttacttttgacaattatctgc

SEQ ID NO: 12085 - DNA, 121 bp, Artificial Sequence
  Synthesized
  misc_feature (61): n=t or c
atggattcttaaaattcttctcaaagcgtcagtaaaactaagggtgatatttgaagtgttnaccagagctggttgaatgtaatgcacttttctattgacaaatagtacagtaagaaagcca

SEQ ID NO: 12086 - DNA, 121 bp, Artificial Sequence
  Synthesized
  misc_feature (61): n=c or g
gatggtactcaaaagccactgctgatggattgttgttagcactggaagcaccacggtctantttagtatattaaaaaacttagttcaggaaaataatcaggttagtgaggaaagacatgca

SEQ ID NO: 12087 - DNA, 121 bp, Artificial Sequence
  Synthesized
  misc_feature (61): n=t or c
tgcccgcattgccagcaggaagcagctcgaggtgcaggctgcagaactgccaggagatacngaacgtttcgggtctgtgctttgtttcatagcctttcattttgtgttgggtttttttttg

SEQ ID NO: 12088 - DNA, 121 bp, Artificial Sequence
  Synthesized
  misc_feature (61): n=t or c
agcagataatatgcctgggtggacacaatatccttcagtatctctaaggaattttttgtangtcagtttgcaacagtgagatatatatccagtcacgtatcgagtttgcttaatggagtaa

SEQ ID NO: 12089 - DNA, 121 bp, Artificial Sequence
  Synthesized
  misc_feature (61): n=a or g
ttttttttgtgtccatcaatattaatttgcacattagcacttttttactgagcattcctcnggtaattcacatatgggcaaaccaagatattccaaccttgtgcaaacaggcacacagaga

SEQ ID NO: 12090 - DNA, 121 bp, Artificial Sequence
  Synthesized
  misc_feature (61): n=a or g
ttttttcaatcactgtacctgtgattcatatacatgtagatgtctcctctctagcctgatncttagctaactgaacagaccagactaaattactggacttgaaataagaagcaggggaaaa

SEQ ID NO: 12091 - DNA, 121 bp, Artificial Sequence
  Synthesized
  misc_feature (61): n=t or c
ttagtaagtctcctacttatctagtttcttcccttcgtctatacatccacagcatcatcanacaatgaacgtacctcctattgtacaaagaagtttgtaccttcttcattttacattcctt

SEQ ID NO: 12092 - DNA, 121 bp, Artificial Sequence
  Synthesized
  misc_feature (61): n=a or g
tgaaccaaatgccacaacctaagctaaacagaaacatctcctacttcacacgtactactgngtctctacctttcaatccctttccttctttacttctctggttcctataaacaaaatgggt

SEQ ID NO: 12093 - DNA, 121 bp, Artificial Sequence
  Synthesized
  misc_feature (61): n=a or t
aagtaagtaaaaacccatctgtagtcatttgaaaggtaatttctacctatgcttttacctntgaatgactaccaatactaatatcgtcatttgcacaatttgtccatttattaggctacaa

SEQ ID NO: 12094 - DNA, 121 bp, Artificial Sequence
  Synthesized
  misc_feature (61): n=t or c
gccaagtcagccttcctgtctttcattaaaaacaccaccaggacaaaagtcaagtgcatcnacctctggttttgctacagatcagacacaacaggacaatacctatggaatcgtgtcagat

SEQ ID NO: 12095 - DNA, 121 bp, Artificial Sequence
  Synthesized
  misc_feature (61): n=a or g
atataagcacaaaatagctctacttctagagagcgtagtgcctgtacaatgacagtttggngctagacatcaaggaagaggcagaggcaaaatcggttactgttcctcactgaatcacaga

SEQ ID NO: 12096 - DNA, 121 bp, Artificial Sequence
  Synthesized
  misc_feature (61): n=t or c
tctggtcctggcactgcccatcgctgtgcttgcagcagggcccatctgacactcagttacnttatgaaaattactgcttccctccatgctgttgtttctcttaagtgtgttattgcttctc

SEQ ID NO: 12097 - DNA, 121 bp, Artificial Sequence
  Synthesized
  misc_feature (61): n=t or c
tggattccttaaaagcagactttcacatgagaatataaaatacttctcgttatatacagangttttaacagagagaaaataccacatatcaacatcccctacaagtggccatgcttcatag

SEQ ID NO: 12098 - DNA, 121 bp, Artificial Sequence
  Synthesized
  misc_feature (61): n=a or g
tccatgtgagtgatgtttgcattcctttccaacacagctggtttgatttgtgacctgaatncagtgacagacataccaacaatccattacatgaactaaggtatttgggattcttgaacgt

SEQ ID NO: 12099 - DNA, 121 bp, Artificial Sequence
  Synthesized
  misc_feature (61): n=a or c
agcatcttatgcacatttacctgaatcacagctttagattaaaaaatttcctttcccatgnagacatttcttagctcacataggggatgcctacagaaaaggggattcatgtgctgggtaa

SEQ ID NO: 12100 - DNA, 121 bp, Artificial Sequence
  Synthesized
  misc_feature (61): n=a or g
tgtagtagtgaaatataatatcaattgataatatataaaactttactgttcagtacaacantgcagggcaaattagatctgccaatacctgatgacaacggatgagcactgggcaagcctt

SEQ ID NO: 12101 - DNA, 121 bp, Artificial Sequence
  Synthesized
  misc_feature (61): n=t or c
catcactatcactgtatatttgaaaaaaataaattatcggtttgtttgtttggtaagttangtaattcatcattttcctcaccccgattcattgtaaaacatcccttgtttcagcgggacc

SEQ ID NO: 12102 - DNA, 121 bp, Artificial Sequence
  Synthesized
  misc_feature (61): n=a or g
tgtgccttttgacacgtctgccctccttacacaggagctgtctgatagctgcacagtacangggtatttgggaagaggcatttttatgctttagagtaggctgaagatcaaagctgctgga

SEQ ID NO: 12103 - DNA, 121 bp, Artificial Sequence
  Synthesized
  misc_feature (61): n=a or c
cccaagggatacatggatctggagctccagaggtcagtttttgtcaactttttcaaaactnttccaccagccaaataaacagtcagatttataaacattcatctgttctgttcttctataa

SEQ ID NO: 12104 - DNA, 121 bp, Artificial Sequence
  Synthesized
  misc_feature (61): n=a or g
cagggcagcccattgttaatcaattaaacacgcggctaatgaaaaaaaaatacacgtcganaaggcgctgctgcagtcccgtggacgcagcgggggaaatgccgtctgaaacctctgctca

SEQ ID NO: 12105 - DNA, 121 bp, Artificial Sequence
  Synthesized
  misc_feature (61): n=t or c
gaagcattaggagtttgcctaatctgtaccttctctgttaccatcttcagtctgtccctangaaatacttaaagaacctgtcagagaactgctaacccactattgccaaataaaagatcat

SEQ ID NO: 12106 - DNA, 121 bp, Artificial Sequence
  Synthesized
  misc_feature (61): n=a or g
aaactagttccttcccaggacttgctttcatgttctgaacagttatgagtggtacagttantgttattttggaaagaatcagcaattatgtatcatgtaacattattctgtatttaagtgg

SEQ ID NO: 12107 - DNA, 121 bp, Artificial Sequence
  Synthesized
  misc_feature (61): n=t or c
caaaagaaaaaatggaattatgcaaactagctgggaaagatgcccatgtaagtatattctngatgtttttgttattgctggtaatattgcacatctgtatatttgtttctaaatgcactaa

SEQ ID NO: 12108 - DNA, 121 bp, Artificial Sequence
  Synthesized
  misc_feature (61): n=a or g
atgagatcggttggagtcatcctgaacaaacaagtgggggcctgtttaggcaagagcagcnggagagacacatggacacaccgacaggacattttatttcatgactgggctcaagggtcca

SEQ ID NO: 12109 - DNA, 121 bp, Artificial Sequence
  Synthesized
  misc_feature (61): n=a or g
tcgtggcagcagtccaaagccacgtggcaccctgcttccaagcagacccaaacgtgctgcntgtcctgggggcttttaaataatggtatgttcaccccagcagcgcgtgttggaagagctg

SEQ ID NO: 12110 - DNA, 121 bp, Artificial Sequence
  Synthesized
  misc_feature (61): n=t or c
aaagaacagttttgaaggtcttatccccttaccaagggttgttatcagggaagaataccanagactgtataacaggagaagccttgagcttccatggaaaccaaggcaaaaaaaaaaaaaa

SEQ ID NO: 12111 - DNA, 121 bp, Artificial Sequence
  Synthesized
  misc_feature (61): n=a or g
gggaaactttgtactgttaaaaaaaaaaacagcaaataaacctcacgtcatggaaaatcanttccttcctttgatctgggaacttttctgtggctttgaatcacctccatcccaatatccg

SEQ ID NO: 12112 - DNA, 121 bp, Artificial Sequence
  Synthesized
  misc_feature (61): n=a or g
caagcctaacatttaaacagttccaattttctatggttgacatttcagtagtattcacatnggttatgatcatcccaagtccttcattttagtggggatggtttgtatatacattcctgag

SEQ ID NO: 12113 - DNA, 121 bp, Artificial Sequence
  Synthesized
  misc_feature (61): n=a or g
aagtagtttgtgctgtatggtctgagcaagggtgagtggttgtatgctgctaagtgacagngtgatggcaagcaggtcagcagggaatgaagggttttctatatacacctatctgaagcag

SEQ ID NO: 12114 - DNA, 121 bp, Artificial Sequence
  Synthesized
  misc_feature (61): n=a or g
gatacttattagcggtccttgttattttacaccactttccaaagattaaaattcttcattnatatttacttaagattaacttccctgaatccaagttcttaatttgaacctgcctaagatt

SEQ ID NO: 12115 - DNA, 121 bp, Artificial Sequence
  Synthesized
  misc_feature (61): n=a or g
attcctcatttacgaatctgtgaaaggagtttttctattcagcagcacactgaattttcanaagtgttttggtagctgagtactttatcacatatactgattgtaagttgttcctacagtt

SEQ ID NO: 12116 - DNA, 121 bp, Artificial Sequence
  Synthesized
  misc_feature (61): n=a or t
cttgaaagagaaagcactgcccccgagcaatccatctgttaaatgcaagcccacagtattncccatcttgcagactgggaggacagaaccagaggaactcctgctttgctttgctgagccc

SEQ ID NO: 12117 - DNA, 121 bp, Artificial Sequence
  Synthesized
  misc_feature (61): n=t or c
ttacagcgctgtggagtagcaaaggcaatttgggatcgtggcatttcacactgctttctcnaggggggagtctggaggaaaataaaacccctgggaggatgggagctgtgggacccccgac

SEQ ID NO: 12118 - DNA, 121 bp, Artificial Sequence
  Synthesized
  misc_feature (61): n=a or g
aaaaagttttttccatgagactgtcttagcaagcaacaagtgaataggaagaatgcttctncctacattacagtaattacacttcaaatgtgacataatggatttttggatgctagagatg

SEQ ID NO: 12119 - DNA, 121 bp, Artificial Sequence
  Synthesized
  misc_feature (61): n=a or g
ttcctatctgtgtgagagatctggagttgggcatttcctgcaagagagaggtgctagcaangcgaaaaggttgcagcaagcaggaaattgtctgtcactgggatgttataggaaggcggga

SEQ ID NO: 12120 - DNA, 121 bp, Artificial Sequence
  Synthesized
  misc_feature (61): n=a or g
atttggtactttgtccctaaggggaaaatgaatgtgctgggatctgtccataagttcagcncctcagtgtaaagaacaaatcaaggtcaaaatgcagctgaatgcacactgatgtttcata

SEQ ID NO: 12121 - DNA, 121 bp, Artificial Sequence
  Synthesized
  misc_feature (61): n=t or g
aggacaagtagtattcaagcattagcccagctttctatgtacaagtggaagagtttccagntacatccaatgccagtgcatttccattgctgtttgtgattactcagtgttagaaagaaaa

SEQ ID NO: 12122 - DNA, 121 bp, Artificial Sequence
  Synthesized
  misc_feature (61): n=c or g
tgctagccctttgcctggtgctggcctggtctactgggattatcacccacaggctgagcanaagggcctgtgagacttccaagcccaaacatctcctgtatgcatgcttattgcaaatgtg

SEQ ID NO: 12123 - DNA, 121 bp, Artificial Sequence
  Synthesized
  misc_feature (61): n=a or g
ctgaacagaaacaaacaggaacagctttggtacattcccgtttatgcacacaccaatggcncaggtaaaaaaaccacactgttaatgatggagtcctgattttgggatcttctttgacagg

SEQ ID NO: 12124 - DNA, 121 bp, Artificial Sequence
  Synthesized
  misc_feature (61): n=t or c
acaaaaagagcccatatgattaagcagcctatataattaagatatctctgctcagcagccntctttttcaaaaaagtatatgaacatatccactctcccagactgtttgggagatttataa

SEQ ID NO: 12125 - DNA, 121 bp, Artificial Sequence
  Synthesized
  misc_feature (61): n=a or c
gtgacttgcccatgagcagacagataagtggggacaagcagggagctgaacccaggttgcncatatctgtctataccttggtgtcagatgattttatgctctgttcagacagtggtttgga

SEQ ID NO: 12126 - DNA, 121 bp, Artificial Sequence
  Synthesized
  misc_feature (61): n=t or c
atggacttctggtcagaggggcacagtagactcttgcagtgcccagactgcatctgtcacngggtctgtggagagaagggcatcagggagcagctaatgcctttttagtttaagcagaccg

SEQ ID NO: 12127 - DNA, 121 bp, Artificial Sequence
  Synthesized
  misc_feature (61): n=a or g
taatcaaacaccaaatgaaaggctgtatgacttgccttatacatgctcttccaatgcaatntgcaaaagcagggctcaccaggtatgagtaatttcatacatggatcttgtttgcaagatg

SEQ ID NO: 12128 - DNA, 121 bp, Artificial Sequence
  Synthesized
  misc_feature (61): n=t or c
gcaaacaccggggttctgtgcagggtcacaaatctgctttacctggggaggtaaggagaanttacagccgtagcccagggctgtgctcagagccacgaaagcagcgggggctgctggctgc

SEQ ID NO: 12129 - DNA, 121 bp, Artificial Sequence
  Synthesized
  misc_feature (61): n=t or c
aaatttgtatgtaaaactttgcagagagatgtggttgaattacgtgaagcttttaatatcntctatgtgaatgcaaagtgtctatatactcagtttctctcattttgtgattaacccatct

SEQ ID NO: 12130 - DNA, 121 bp, Artificial Sequence
  Synthesized
  misc_feature (61): n=t or c
tttttcccacaaagattcatgtgttcttacctgtctttgctgtagctcttaaagcatgcancatacacatcatgatactgtaactctaactacttctgaaggcatccaaacttcttcaagc

SEQ ID NO: 12131 - DNA, 121 bp, Artificial Sequence
  Synthesized
  misc_feature (61): n=a or g
atatcgtgaagtttgtgccaaatgggtcccaagaatgcttacacataaagaacacagtttncaagtttgtcaggttctaaaaaaacaatacaaggcacaaggtgacagtttcctggattgc

SEQ ID NO: 12132 - DNA, 121 bp, Artificial Sequence
  Synthesized
  misc_feature (61): n=a or g
aggagcttatctcaaggatagggaaattcaaggtataagggaaggccattaccacctttgntaggtgcaaagctcacccttcttcatgcacctgattgtgtgtaggaattaaaagctaaag

SEQ ID NO: 12133 - DNA, 121 bp, Artificial Sequence
  Synthesized
  misc_feature (61): n=t or c
tgcctgttagcaagaggaaactgggaagaaagctctgctgtccttggaggatcgccagagnccagtaattcatgtgtcttagaaacatgtcaaagagactgttcaaagagaaattgtcccc

SEQ ID NO: 12134 - DNA, 121 bp, Artificial Sequence
  Synthesized
  misc_feature (61): n=c or g
tcctcaaatttagaccaatatttgtaacaaattctataccatttacatttaaaagtctgantttgcagtatagatagtgctttagatggttggaaagccaggtttatagttcttcttgcaa

SEQ ID NO: 12135 - DNA, 121 bp, Artificial Sequence
  Synthesized
  misc_feature (61): n=t or c
aaatatttatctggttgatttataaagaaataagacaaccgccaagtttgccagataacanagtgacagttcattccgcatatttagaataacagatgagtagctaactgcagcagccagg

SEQ ID NO: 12136 - DNA, 121 bp, Artificial Sequence
  Synthesized
  misc_feature (61): n=t or c
gtgtctttgtgcttaatagagagaaagaaagaccatcagaaactggatcaacttatgcccnagcccatctcagattaatgggatgaatcactctctagaggtgcattaaccacagcaaata

SEQ ID NO: 12137 - DNA, 121 bp, Artificial Sequence
  Synthesized
  misc_feature (61): n=t or g
ttgaaataaattcccatgtgacctactatagggccaggtgtaccatctctggacttggttnctgctctctcttgtaagcaatgaccaacttacaggtaagaagtgcaataaaaaggttctt

SEQ ID NO: 12138 - DNA, 121 bp, Artificial Sequence
  Synthesized
  misc_feature (61): n=t or c
ggaaattttgttcttataaataatatttaagttttgggcatgcacttgaaacctaagacangtgaaagaataataagaaaatgcagtaagcctgactttggaaacatctgagatctcagtg

SEQ ID NO: 12139 - DNA, 121 bp, Artificial Sequence
  Synthesized
  misc_feature (61): n=t or g
ggtgatgctaattcttggtgctgtacttgtggttatattattacctatacttttgtagctnctttagttttaatatttaaatcttgttttagataataatttatcacacttcaacaagatg

SEQ ID NO: 12140 - DNA, 121 bp, Artificial Sequence
  Synthesized
  misc_feature (61): n=a or g
ataaaccatgtggctgataatctgaagttaatttagcacatacttttattagtaaactagnatcagacaaacctccacaggttgttggctttcttttttagatgctattggaatgctttca

SEQ ID NO: 12141 - DNA, 121 bp, Artificial Sequence
  Synthesized
  misc_feature (61): n=t or c
gatggataggcgctatgtatcttattacataccacagcctagaattcacacagatttcttnattaaaatctcctactggctatgactggtaacactgccagcaaggtagaggtagatattg

SEQ ID NO: 12142 - DNA, 121 bp, Artificial Sequence
  Synthesized
  misc_feature (61): n=c or g
agaaaaaaagcaacgggattcctagaactggagcttcttaaatgcacgcctgatgtagcanacaggggatttctcataagggtcagagcaccttcagtcagaaaggctgcatggattatta

SEQ ID NO: 12143 - DNA, 121 bp, Artificial Sequence
  Synthesized
  misc_feature (61): n=t or c
caatgtcagaaaggcagtgcagagctggtagagcatgagcaaggagtgaaataacagaagnaggctaaactttagatgaagtaggcatttagggaacagaaccataggaagacaaggaaga

SEQ ID NO: 12144 - DNA, 121 bp, Artificial Sequence
  Synthesized
  misc_feature (61): n=a or g
atcgatatgacttagtttggagagagacagttccccattttgtattataatgctgtgaacncagagacctgggaacgcaactgaattcattattaggtatccgatctgtacatgaaatccc

SEQ ID NO: 12145 - DNA, 121 bp, Artificial Sequence
  Synthesized
  misc_feature (61): n=a or g
ctgcagtatctgagcactgcagcagagaacagcacaacggggctccatgaaacctgagccngagcttagtaacactgctatgcctgaacccctcagggacatatttctgtagtttcacttt

SEQ ID NO: 12146 - DNA, 121 bp, Artificial Sequence
  Synthesized
  misc_feature (61): n=t or c
ttcattgcaaatcttttgatgttttcagctcatgcctctatagtcttttgttggaatgtantgattttgatattttctacactggatatgaaaacagagattacaaataatttatgagaag

SEQ ID NO: 12147 - DNA, 121 bp, Artificial Sequence
  Synthesized
  misc_feature (61): n=c or g
gttaatgaacagttaagtcagcagcaccttttaggtacagcttcacactttgtgttgtgantcgattttaaccagcatgtgcatatactgaagcagctattttcagaagctcccctgacca

SEQ ID NO: 12148 - DNA, 121 bp, Artificial Sequence
  Synthesized
  misc_feature (61): n=a or g
ttgagcaggggaatttaccttctcccatcacttttactgtctccctcagttgagtgctgcntggttaaatagaatctgttacctcccagaaatggctgcactttagcaaggccatgcagga

SEQ ID NO: 12149 - DNA, 121 bp, Artificial Sequence
  Synthesized
  misc_feature (61): n=a or g
caagcgtagaatgtgtttttatggtaacactctgcatgccctgctgtgttacgttttgcantatagaatgcttcagtgtcctatattcagtgcagatgattaatcattgtcagttaaattc

SEQ ID NO: 12150 - DNA, 121 bp, Artificial Sequence
  Synthesized
  misc_feature (61): n=a or g
tgcttagtacacaagttcccccagccacgccgtggatcattaattcccggcgcttattacntaacaaatatatgatctgcaaatgagagacatctcagactgcttgcaaagcagagctggg

SEQ ID NO: 12151 - DNA, 121 bp, Artificial Sequence
  Synthesized
  misc_feature (61): n=a or c
tattttcgaggctgttaagtctatttcaaagccagaagaaagatcatacaacttcacaaanacaagaacataaagccatggagatccattgaccaaacaaacctccattaggcttcacatt

SEQ ID NO: 12152 - DNA, 121 bp, Artificial Sequence
  Synthesized
  misc_feature (61): n=a or g
caagagatagctgaacgtgcctcagatattacagaaacaaaaacacagcagcctttcttcnaagctcaaagtcctgtaaatgagataaaccacacatccggtcaaatatttgttacagagg

SEQ ID NO: 12153 - DNA, 121 bp, Artificial Sequence
  Synthesized
  misc_feature (61): n=t or c
gacgagatgcagaagagcaactgtgctgaatgtactcctgtacctgtactagcacagaganatgtttacctttagttggaattactggagatgaaagttataatgttacactttggaatat

SEQ ID NO: 12154 - DNA, 121 bp, Artificial Sequence
  Synthesized
  misc_feature (61): n=a or g
cagacaacaaaaaagcaaccaagccacaaacaaacaggtactagaaaacagaaatgtcccngaagtaatgctcttgaatgaatgaaatctttgtcagcagcagagataatctgaaggttct

SEQ ID NO: 12155 - DNA, 121 bp, Artificial Sequence
  Synthesized
  misc_feature (61): n=c or g
ataaggcaacatttctccttctgacgtttacagcagaagctccttggagggggagctgttnctttacccctgtctgttcagtgctgcactctgtctcatcaccaccagccatttatcgatg

SEQ ID NO: 12156 - DNA, 121 bp, Artificial Sequence
  Synthesized
  misc_feature (61): n=t or c
aaaacctgctggggaagcaggaggtgtatcaccatgctgtgaaatatcctgaggactttcntcatcaagcataccttcaggcaaggatgaagtcacacatcatttaaatgttgtttcacac

SEQ ID NO: 12157 - DNA, 121 bp, Artificial Sequence
  Synthesized
  misc_feature (61): n=a or t
agagcatggcaacttcttcaaaatgcatctcagcagaaacacaataacatcagaccaaaancaatatctgacctcctcatgagaggcacagtaatgctctaaggcctaaaattagacttta

SEQ ID NO: 12158 - DNA, 121 bp, Artificial Sequence
  Synthesized
  misc_feature (61): n=a or g
tgttaggcaattacataaagcaataattgatacagttgcatttaggagtctagaagagggnggggaaaaagtgcttgagttctaagaactctgctagtagttcttttgtttttaactacag

SEQ ID NO: 12159 - DNA, 121 bp, Artificial Sequence
  Synthesized
  misc_feature (61): n=t or c
tgattttgtgtttctgttaagagtttgcccttcactgtagtcaaaccattcatttttctgntctcctacataagataatgaagggctacgacaaggggtggggagagaaggagcactctaa

SEQ ID NO: 12160 - DNA, 121 bp, Artificial Sequence
  Synthesized
  misc_feature (61): n=t or g
ctggagaaagattgtgctgatttctgcaggaccaaagcagcagtgggaagtgctcctgctncctaaggacacctcacttgtcacttatggtggcactgtactcccctgaccccctctgaca

SEQ ID NO: 12161 - DNA, 121 bp, Artificial Sequence
  Synthesized
  misc_feature (61): n=a or g
ttataaggatcaaatgagaattatcaagcttctttcctctcaatacctttcagtactattntccacaaggtttgtaatgagcctttttcactgatgtccttgattttagggttttattttt

SEQ ID NO: 12162 - DNA, 121 bp, Artificial Sequence
  Synthesized
  misc_feature (61): n=a or t
ctctagctggtgctggatatgttctcgcaccatgctatgcaattgtgcagctccccacacnacttgttgccatacccccactcatcctagctttcctctctttactgtacttatggttgag

SEQ ID NO: 12163 - DNA, 121 bp, Artificial Sequence
  Synthesized
  misc_feature (61): n=a or g
taagccagtgagagtggtgcgtagttcaaaaggacgacggatcagcaaatatgccccagangaaggcaacagatatgatggcatttacaaggtattttgatttcttctgggtacagcataa

SEQ ID NO: 12164 - DNA, 121 bp, Artificial Sequence
  Synthesized
  misc_feature (61): n=t or c
acaaaagcatcaagttagaaaacagcaaattatgcagtgtggtattaggtcggtcctatantctgatcttaaagtgaaaaaaatgaaagaggattgaaatcagcaaggtaggtttgaactg

SEQ ID NO: 12165 - DNA, 121 bp, Artificial Sequence
  Synthesized
  misc_feature (61): n=t or c
gcataaagaatgttaaacagtgttcagtgcagtaccagttattaaagcaactgtaccaganattaagatgaagtaaaaacttttcctcgggtataataaacataatttgcctaccttcccc

SEQ ID NO: 12166 - DNA, 121 bp, Artificial Sequence
  Synthesized
  misc_feature (61): n=t or g
gctagaagtctgattctcttcagaaaaaaacaaaatcagaaggtttgagcatcctcaggcnatacctaggaactcagctgtattttactagctgagtcacaatcatatctagattaaatgc

SEQ ID NO: 12167 - DNA, 121 bp, Artificial Sequence
  Synthesized
  misc_feature (61): n=t or c
tgtaaacaaaatgaagacctcgtcaaactagttttatcttacagcgaagagagtatcgagnctgcagtattacaaatcaatagttaaactgtttgaagaattcagttgcctttttctggtt

SEQ ID NO: 12168 - DNA, 121 bp, Artificial Sequence
  Synthesized
  misc_feature (61): n=t or c
tccgggaggttccgacgtcaccttggcacaaccagcctcatccctctgatgagggtcctgnaccaaactggcccctctgagcaactcttcttcctcacaggacatcagcagctccatgacc

SEQ ID NO: 12169 - DNA, 121 bp, Artificial Sequence
  Synthesized
  misc_feature (61): n=t or c
ctcctagttacctgttgaaatagattgcattcatattgtgaaaatacacttggatacctcngttcaggattacttaagatggagttatatatgcaggtctgcggaggaaaatagtcaataa

SEQ ID NO: 12170 - DNA, 121 bp, Artificial Sequence
  Synthesized
  misc_feature (61): n=t or c
ctacgtgctgaaagggacagatgtgtcctgttagaaatcacttcatctgtttttacttgangtattatagctgacaaatcgttgcttattacaatttccccccgtattttttgtcgaccac

SEQ ID NO: 12171 - DNA, 121 bp, Artificial Sequence
  Synthesized
  misc_feature (61): n=a or g
tttatatttactttttaaggagcaacactgtatgtggaaatagagtccagtgaacatcatntatcaaggaactgagattcttaaatattctgtatcacttcaggaaaagaagtatcaagaa

SEQ ID NO: 12172 - DNA, 121 bp, Artificial Sequence
  Synthesized
  misc_feature (61): n=t or g
tatttttctacagttcacagggcagttatgctgcttcttgcatggaatcacaactctaatntatttctccttttccagtggtcatgttacaccttcattttcctttctaccttggtgacag

SEQ ID NO: 12173 - DNA, 121 bp, Artificial Sequence
  Synthesized
  misc_feature (61): n=t or c
ggactagtaacaccttgactatattcaggaaatgtttggttaaagagaaacagttttgtgngctattaatacatgaaatagtgtagcagcaaggcacagcttagccaagtgtgcctagaga

SEQ ID NO: 12174 - DNA, 121 bp, Artificial Sequence
  Synthesized
  misc_feature (61): n=a or g
cacagggtgcagagcggggctgctgggtgccgcttcaggcagttacatgaaggtgtttttncctctgggtttcggtacagactttggtccctcagagttggtttctggaggtgttactgca

SEQ ID NO: 12175 - DNA, 121 bp, Artificial Sequence
  Synthesized
  misc_feature (61): n=a or c
gttctgtatctcctggatatcagcggtaaatcctgactgactcaggagtgtggtagcaaantgtagcattgagtttggcaagacttgcttcccagtgaaaaccagaggcataggcacgggg

SEQ ID NO: 12176 - DNA, 121 bp, Artificial Sequence
  Synthesized
  misc_feature (61): n=t or c
caagtaatttgtgcataaattaaacacccaacctattcatcccactacagcccacgaccgngcagttgctcttgatagatgagtgctggtgattcttgctgcagcacttttacaagttgct

SEQ ID NO: 12177 - DNA, 121 bp, Artificial Sequence
  Synthesized
  misc_feature (61): n=c or g
tacaggtaatactcaacagtttggcattttttcaacatgaccatatctgaaaaattgagancaacatgaactgagtaaaacattgctgtaatagtcattccctccagcctatttaaaatgt

SEQ ID NO: 12178 - DNA, 121 bp, Artificial Sequence
  Synthesized
  misc_feature (61): n=a or g
tataagcacaagtccatgcagatgttactgagggatgaatttggtggctcaagcacagcantgttggacagcattgctgcatccaagccagagcacaggcagagcatacaccaatatccac

SEQ ID NO: 12179 - DNA, 121 bp, Artificial Sequence
  Synthesized
  misc_feature (61): n=c or g
ctcttgaatgtctgacagcaattggttgtttcagagatacttacgagtctcattaatcatntaatttatggcttatcacctgatccgtgatttaatcatcaacttgcatttaataaccaca

SEQ ID NO: 12180 - DNA, 121 bp, Artificial Sequence
  Synthesized
  misc_feature (61): n=a or g
aaggcagataaaaggagaggaaaacattggaagaataatgtccataagtcaagggttaaangccaaccaaaccaaccagccacataactctatgaggtcagaatatgaattttgatgaaag

SEQ ID NO: 12181 - DNA, 121 bp, Artificial Sequence
  Synthesized
  misc_feature (61): n=t or c
gtcaccatctttgcctccaattacaaactgagaatccatttatgatggcagggacgaaganccccatacctctttatttcagatatttaagatttatataactgagcctatgttgatcacc

SEQ ID NO: 12182 - DNA, 121 bp, Artificial Sequence
  Synthesized
  misc_feature (61): n=c or g
aggaggttccagctccaagtttcgaaaggaactatagcatgtcctggccaggactctacanaaatgactgaaagatcacaattttgcagtgtatcatagcactcgttcagactctaacctg

SEQ ID NO: 12183 - DNA, 121 bp, Artificial Sequence
  Synthesized
  misc_feature (61): n=t or c
ataccgaggattcattctgggtccaccccaaggcactggcatagcagcactacaaagtggngagtgagttttcaggctgctttcctaaggaaatggtgcttataagactgtgctatctttg

SEQ ID NO: 12184 - DNA, 121 bp, Artificial Sequence
  Synthesized
  misc_feature (61): n=t or c
atcaccatcatttattgatttcacatttttttgttttgttttccttcgaccagagcaaacnttctcctctccacattccagctaatgcatggtatgactttggcttcatgcttggcaccca

SEQ ID NO: 12185 - DNA, 121 bp, Artificial Sequence
  Synthesized
  misc_feature (61): n=t or c
gcaaaggaagtaggataaaaagctccctctaactaatctcaagcctctcattaatgctgcnagaaagggtacagaaaattggcttatgctacacagccactgctgagggctgctgcctgct

SEQ ID NO: 12186 - DNA, 121 bp, Artificial Sequence
  Synthesized
  misc_feature (61): n=t or c
acatacttactgcagggaaaaaaaatcctacaattcatatcaaagactttatttaagcctngcagtgatatccttgagacatttagtaacaaaattcccactgatttcaggaaagatgtct

SEQ ID NO: 12187 - DNA, 121 bp, Artificial Sequence
  Synthesized
  misc_feature (61): n=t or c
gagcttgttaaatcaatgctatacagatgttgtgatgttgtgtagttcaggcatccagtanatcatgctgccattctaatacaaaatgagacaaaattcaaatatagggatttaacttgca

SEQ ID NO: 12188 - DNA, 121 bp, Artificial Sequence
  Synthesized
  misc_feature (61): n=t or g
aatccaggattcaaactgccccagttagaaccaaatgctgatgccctcactcagtagcaancatgtgctcaacagtaaattaatgaagtgttctaacccacttaatggattatgagcagtt

SEQ ID NO: 12189 - DNA, 121 bp, Artificial Sequence
  Synthesized
  misc_feature (61): n=t or g
tctgttcaacattttgctattctacctctcgttttcatcacaaggccagagaataataacntaattatactctatatgctaagatcattttcattcagaacttaatgcagttgtttaaatg

SEQ ID NO: 12190 - DNA, 121 bp, Artificial Sequence
  Synthesized
  misc_feature (61): n=t or c
ctcaagctgagcagaagcattttcaccatgtcagtcactcctcctggcttacaggaacagnaaagtcaagtcgaattccccactgcgccaacagcagctgcgtgcccggctcccaggatgg

SEQ ID NO: 12191 - DNA, 121 bp, Artificial Sequence
  Synthesized
  misc_feature (61): n=a or g
atcggggaaattagagcattgctgcaaacaaacctaagggaatccaacaaatacctgcccnctgctgctgatgcgtgaggactctgtgtcacgatgaagcctcttctgtggcagaagtcag

SEQ ID NO: 12192 - DNA, 121 bp, Artificial Sequence
  Synthesized
  misc_feature (61): n=a or t
ctgtttaataaaactccttctccttcctttggtatccccattcttttgtagacttgactcnttgccaatatatatctgatacttttagaaatgttgctggttataaaggtgctactcttat

SEQ ID NO: 12193 - DNA, 121 bp, Artificial Sequence
  Synthesized
  misc_feature (61): n=t or c
aggtacacctgaacctccaagcctataccatcttggctctgtattctcacccaagagagcnggctaaatgaaagtcacataggggatgaactgcagagctagaaaccttcatgtacaattt

SEQ ID NO: 12194 - DNA, 121 bp, Artificial Sequence
  Synthesized
  misc_feature (61): n=c or g
atggctgtaatgtaagaattccttttaaaagtctctgttccagtcttttggaataatacanaaattgaaatgcaagctcatatcaaaagctatcaacttgaatattaataaaggaatggtc

SEQ ID NO: 12195 - DNA, 121 bp, Artificial Sequence
  Synthesized
  misc_feature (61): n=t or c
agacaaacagaaggagacagttccttccctatgaacacacgttcggacctgcaaggtgatncaaacaaacacacacagcttaaaccacgaagcgatgctggagaaagaactgctcggttct

SEQ ID NO: 12196 - DNA, 121 bp, Artificial Sequence
  Synthesized
  misc_feature (61): n=a or g
ttattttgggtgacaattacatccctgatgtagaatgaattatgtcacatggctgaagaanacagagtccacagcactgaccttttccaaggatttttagaagtacctgagaataagagaa

SEQ ID NO: 12197 - DNA, 121 bp, Artificial Sequence
  Synthesized
  misc_feature (61): n=a or g
actaccatgttctttctctaaaggaagaggtgcatcctgtcttgtcatgaactacaaaccnacaaaataagtggctacaggataaagaaataaagtctaaggtgcaagttaaacatttatt

SEQ ID NO: 12198 - DNA, 121 bp, Artificial Sequence
  Synthesized
  misc_feature (61): n=t or c
ctctgtgttttattcttcttcttaactactcctttgtcaatatagttttggcagccactgnattgttgtttactgctaacattttcaatagctctatgtaactttgtttaattactgtaaa

SEQ ID NO: 12199 - DNA, 121 bp, Artificial Sequence
  Synthesized
  misc_feature (61): n=t or c
ttccagcccaaaccgttctgtgatgctatgcctgcctgctttctgagcctgtgtagactcntgctgttcccttttgggaggaattggtacgaccggggtcagcattgtggtttttttttcc

SEQ ID NO: 12200 - DNA, 121 bp, Artificial Sequence
  Synthesized
  misc_feature (61): n=a or g
caattttcatgctggaagatgatgtgcctttggtacagctaaaaagatctagctcgatacngcttgagtttgtaaaaagaatatttcatatacatatgaaggagcttcagaaatgtccttc

SEQ ID NO: 12201 - DNA, 121 bp, Artificial Sequence
  Synthesized
  misc_feature (61): n=t or c
gcagcagagctgagtctgtgctgtgaacccagaaggtgctgccctggtgcaagggtggagntccctgcgtaggactgcagtgagtggccctgctcaggaaaaggagattttgggggttatt

SEQ ID NO: 12202 - DNA, 121 bp, Artificial Sequence
  Synthesized
  misc_feature (61): n=a or c
tcctcttaaagtaaaagcagcatgacagaaccctgagatttgatctttcctaatagctttntgctccctaagtacatggcagctcaagccaggtatgaatggtgactttcttaccctagtg

SEQ ID NO: 12203 - DNA, 121 bp, Artificial Sequence
  Synthesized
  misc_feature (61): n=t or c
tgctgggatcctcagaagcaccacgatggagaaggagccacgaaatggcagagctgctcgnggtggtacacgaggacactgctccctgagggctgcagaaagcactccgacagagcaatga

SEQ ID NO: 12204 - DNA, 121 bp, Artificial Sequence
  Synthesized
  misc_feature (61): n=t or c
aagagatcttctaccaggtgatctgtacaatcaggtgggctcacttacacagcattaattnctttcagttaaatgaaaggtcacgcagttgggacaataagaaggtaggtcaagtttacag

SEQ ID NO: 12205 - DNA, 121 bp, Artificial Sequence
  Synthesized
  misc_feature (61): n=c or g
tgacgaatgtcttttgcaaaaagaggctgtcagttaaccacgacaaaagatgtctgacttnagaaggtaattcactccacgttacttgttgtgatgaatgaaagacaaatatgaatacttt

SEQ ID NO: 12206 - DNA, 121 bp, Artificial Sequence
  Synthesized
  misc_feature (61): n=c or g
attataacattttacaacaaaggtccagatacaccccaatgtgtctgagccagaaaccagnttctcgtgtcttaataccaaatggagccataattctgtgtaattgcctttccagaagcaa

SEQ ID NO: 12207 - DNA, 121 bp, Artificial Sequence
  Synthesized
  misc_feature (61): n=t or g
atcctctgagtgatacaaccaggtgcaccatatccacttaacaaatatgttacacaaatcnacaaagatgtggatctggtcttatattaacgataaaccaatgcttatgtaataaaaaaaa

SEQ ID NO: 12208 - DNA, 121 bp, Artificial Sequence
  Synthesized
  misc_feature (61): n=c or g
actaaaaagaatagtcagagatatctgcaacaccaggagagcaacactaatctagaaacangagagtgcagatatagcctgaacatttcaaattatcaagaattaaaactagcctaagact

SEQ ID NO: 12209 - DNA, 121 bp, Artificial Sequence
  Synthesized
  misc_feature (61): n=t or c
tggaaaggggttattcaccgcagagtattgctctgtgctgccattctagaaaacagatggnttttcaaagcaatggctacctgaatgaggctggaaagctgttaggtgtgaatgctgcttt

SEQ ID NO: 12210 - DNA, 121 bp, Artificial Sequence
  Synthesized
  misc_feature (61): n=c or g
tgcatcttcagtgttctttatttgtttttaaaagtctaatagcaatactaacattttttcnttctaaaaaaactggatggcactaatcagcttcaaagcagtaaataatgctatgagtagg

SEQ ID NO: 12211 - DNA, 121 bp, Artificial Sequence
  Synthesized
  misc_feature (61): n=a or g
catgttggattaaagtttacctgaatgagagctttatccagctccgttaggagctaatggngaaggtatttcaatatatacaatgtggctattatctcaggggaaaaaagaagaaagacgt

SEQ ID NO: 12212 - DNA, 121 bp, Artificial Sequence
  Synthesized
  misc_feature (61): n=t or c
ctgtaggcttaatgcctccgtgatggtggttcaggcccttgtctctctcttgattgagcgngtggccatgtgggacgtgccagttttgcacatttctgctatggaatccacctgttcctcc

SEQ ID NO: 12213 - DNA, 121 bp, Artificial Sequence
  Synthesized
  misc_feature (61): n=t or g
tctgaaataattgatttttattatttagactgggaggagcatacaacctaacccttgagancttctcttttaaaaattccttgggaagtgagcactaacttttttatattaaggtgtgtca

SEQ ID NO: 12214 - DNA, 121 bp, Artificial Sequence
  Synthesized
  misc_feature (61): n=t or g
ataagtcactggttggaagcattcattgggatactgtgaaaatgaaaatggttgaagaaantgaattgcaggcatgttaggatgatactcctaacctcctaatttgcttaggctatttatt

SEQ ID NO: 12215 - DNA, 121 bp, Artificial Sequence
  Synthesized
  misc_feature (61): n=a or c
gtctttgcacaaaggaagaatttaaaggaattcagtactgaaacaagtttactctgacaantacatcctcatccaggatctaatgccattgccagtggagaacgcagccctgatctgaatg

SEQ ID NO: 12216 - DNA, 121 bp, Artificial Sequence
  Synthesized
  misc_feature (61): n=t or c
gctattgatgtggttgaacaagtttgttcctatctcaaatacttctttctcttctacagcncactctaagaaatggctgaccaggagctaaattcagagaagacttcataccgtcaagaac

SEQ ID NO: 12217 - DNA, 121 bp, Artificial Sequence
  Synthesized
  misc_feature (61): n=a or g
tttgtttgtttcactaagccttagaaagtatttttgcaatttactgaagtgaaaggttgcnaagtcaacgtgactaatagactggtgactgaactttgaaaatatgtaatgcctttaaagc

SEQ ID NO: 12218 - DNA, 121 bp, Artificial Sequence
  Synthesized
  misc_feature (61): n=t or c
atgcatctagtcacagcctctgaactagaacatctagtttcagacctgttatccgctgttnacattcacatctgagtgtcagacctcagctggccgcctcgctcctgtgctgcagcaccca

SEQ ID NO: 12219 - DNA, 121 bp, Artificial Sequence
  Synthesized
  misc_feature (61): n=a or c
agagccagtactgagttgtgtcactttttagcatgtgtctctttgtttgtcatttttgtanagatgaaaaaggaagagagctattgttaaatacatcctgttcttagctaataggaacccc

SEQ ID NO: 12220 - DNA, 121 bp, Artificial Sequence
  Synthesized
  misc_feature (61): n=a or g
atctttatgaaaggggttggcttttccttttcagcaaagcaatatttattcttaatatttngttgacttaatgttaacgtccttctacacagaatttaaacggataaaagtaacccacttg

SEQ ID NO: 12221 - DNA, 121 bp, Artificial Sequence
  Synthesized
  misc_feature (61): n=a or t
ctctgctttcatgctgcctctctgaggtatcccaagacgtgcaaggaagcagtgtttctcntgtttcttttgcgctttttccgcagtcagctcaggaggagaatcattcacctacgcagtg

SEQ ID NO: 12222 - DNA, 121 bp, Artificial Sequence
  Synthesized
  misc_feature (61): n=t or c
tcagattacagcaagcattacataaataactttaggcagtcctgtttatctcgtgcagacngggacctggtacatcctcagtatcacctggccattgtgtcctggcaaaatgcctctgaca

SEQ ID NO: 12223 - DNA, 121 bp, Artificial Sequence
  Synthesized
  misc_feature (61): n=t or c
agaggctaccagaatgctttgctgtatcataaatggattgactttttggctagacaaattnctacctgagtcaattgaaagaactcctttttttgtgtgcgtgtgtgctctatttatacaa

SEQ ID NO: 12224 - DNA, 121 bp, Artificial Sequence
  Synthesized
  misc_feature (61): n=a or g
tcttctctgtttggattggaagctttgcaatgcagggcttcttgtgctttggttttatacngtgcctaatggactggagtctggctgtagagtgggtctcaaactgctcctaaaacaacgc

SEQ ID NO: 12225 - DNA, 121 bp, Artificial Sequence
  Synthesized
  misc_feature (61): n=a or c
taactgcttataaacaggcactgatgtagtatggggaatctctgagcatcttaacagtgcnaaattcagcaagaaaacaaaggtcagggttcagagagtaactaccaaattaagaaacaca

SEQ ID NO: 12226 - DNA, 121 bp, Artificial Sequence
  Synthesized
  misc_feature (61): n=t or c
gttgccctggttaggtttcatggacatttaaaaacaagaaaggttgtttaaagtgttgtangagtgttctatagccatgtaaaactcgaagattcagacaactacagcaaaactgaattta

SEQ ID NO: 12227 - DNA, 121 bp, Artificial Sequence
  Synthesized
  misc_feature (61): n=a or g
gacaaaccctcatacaaggatgtcagcagaagcgcgtggaggcacgtcagtaaggtaagcngtagaaagcacaattgagatgctttatctcctggttttgacctcaagctagctagaacgt

SEQ ID NO: 12228 - DNA, 121 bp, Artificial Sequence
  Synthesized
  misc_feature (61): n=c or g
gtctggggtgctgacagtttctcacacacttatttaattattgtaaaactgagatgtaganactatggaaatttttgctgcatttttattaatgatatgcatgactcaagtttccttacct

SEQ ID NO: 12229 - DNA, 121 bp, Artificial Sequence
  Synthesized
  misc_feature (61): n=t or c
gaagaaaaaaacaaaacaaaaaaacacccaagccatgatcaaagcaattctagaataatangggctgtatttcaaatgaaataaatatatacgtatgcaggcagttcgtataaaaacaaac

SEQ ID NO: 12230 - DNA, 121 bp, Artificial Sequence
  Synthesized
  misc_feature (61): n=c or g
agacaaacatactgaaaaacagcaagaatgctcttccctctccacttcccttctgaagcanacaatacttccagactatgtggctgaaaaagcaaagagagtgtctgtgctgaggaagaga

SEQ ID NO: 12231 - DNA, 121 bp, Artificial Sequence
  Synthesized
  misc_feature (61): n=t or c
gcaaatactgatggctggagagaaaaacagagacaactctcctgagcttagagacacttangcttctcaaaataacagaagacaatttagtccaagatgtgctcactacaattcatcatcc

SEQ ID NO: 12232 - DNA, 121 bp, Artificial Sequence
  Synthesized
  misc_feature (61): n=t or c
ccagtctagagtgaatgtgtactttgagtaatgagcaaccttttcccagagagatattacnaaaactacagaagtgaatattgaaatcctttgtggtatgttgcaatgtacatgagagatt

SEQ ID NO: 12233 - DNA, 121 bp, Artificial Sequence
  Synthesized
  misc_feature (61): n=t or c
ttctcaaacaagacaaagctcccagaaataactgtgagctcgctgaacgctaatggaaggncagtaccaaaacatatggaactgtatataattaaccacatcagcatcacatgtgtcagct

SEQ ID NO: 12234 - DNA, 121 bp, Artificial Sequence
  Synthesized
  misc_feature (61): n=a or g
tcttcctggttttgaaaatgctgtggggaggcgttgaaagctttcagctggtggggatagnggtgggttaaatgtggaagtgaccaaaaggattgcaacagtagatgggaagaacatgtga

SEQ ID NO: 12235 - DNA, 121 bp, Artificial Sequence
  Synthesized
  misc_feature (61): n=t or c
tctacgcaatagaaaccaaaggcagcagtttggtgagaatctagcttggaatatattatcngggctgtataacagaagccatgcattaataaacaatggtgagagattcaaatgaaatgat

SEQ ID NO: 12236 - DNA, 121 bp, Artificial Sequence
  Synthesized
  misc_feature (61): n=a or t
tatattcactttggactgaggaacacagagatacaacagccagctttatcctctacttatntgtggagcgttaaagatagtttagaacactggaataagtttagagcactgtaagaactgt

SEQ ID NO: 12237 - DNA, 121 bp, Artificial Sequence
  Synthesized
  misc_feature (61): n=t or c
gcacgacagagcaggagcattaagatatctgtgaaggcaacagaatattcagtagatatgntcagtaaggtgagacctgttagaccttcatgtcccatagcctacgatggcagatatcaaa

SEQ ID NO: 12238 - DNA, 121 bp, Artificial Sequence
  Synthesized
  misc_feature (61): n=t or g
ccactggcttctgaatgccatctggaattggttattccccaaaaagcagtcctgctaaatnttctacggactccaaaccacagtgtaactcttctgctttcaggaactcgtacagcatgag

SEQ ID NO: 12239 - DNA, 121 bp, Artificial Sequence
  Synthesized
  misc_feature (61): n=a or c
gcgttgcacagggtccctttgtgccacaccacaggtgcacaaacccaaggagcatacaatngagcaacctgtccagatccagcttttaactaacagggtcagggaacagagtgaaaaatga

SEQ ID NO: 12240 - DNA, 121 bp, Artificial Sequence
  Synthesized
  misc_feature (61): n=a or g
gtgtgagcagccggagtcgcctgacagcttaagtagcagctgagaataatgcttggcgtcnggaagagctggagcaaatgagtctccctctaactatcttaaaggtcattagcagagcctg

SEQ ID NO: 12241 - DNA, 121 bp, Artificial Sequence
  Synthesized
  misc_feature (61): n=a or g
gttatcaagggctagctgcaaaaagctccttgtactaagtagcattaatatacatgtacanttacattcacctgggactgctgctgaacactacatcacttcaagctgtacaaaattaaat

SEQ ID NO: 12242 - DNA, 121 bp, Artificial Sequence
  Synthesized
  misc_feature (61): n=a or g
tccaacaacatttgctattattgaaaatctcaagtatttcttactgaagaaagaccccgcncagcctttttacataggccatactatgaaatctggtgacctggaatacgtagatggtgag

SEQ ID NO: 12243 - DNA, 121 bp, Artificial Sequence
  Synthesized
  misc_feature (61): n=a or c
tctctactctggcatatgtgacacatactcctgggaatccaaaagaactgttcagtgtggngctgggaaattgagatgctgagaaattagctcttgcatgcttcagttctttgcagatttc

SEQ ID NO: 12244 - DNA, 121 bp, Artificial Sequence
  Synthesized
  misc_feature (61): n=t or c
acagcatgggtaggatgctttggagtcccaaggtcaagtgccatgaattgtggacacatanacacagctgctctgtgttatttggcctgaggacaaaaagcagagttcttggtttatatat

SEQ ID NO: 12245 - DNA, 121 bp, Artificial Sequence
  Synthesized
  misc_feature (61): n=t or c
aggccactcccaacctaatttgctctaattctgggctggtaatcatttacaaaggatatanttattgactgtctcactccttaatttaagcagtatttccatctatctacttttcaaggtc

SEQ ID NO: 12246 - DNA, 121 bp, Artificial Sequence
  Synthesized
  misc_feature (61): n=a or g
ggctgctggcctgtgcacgtggggaacagcatcggcttcaacggtgccagactgctgcaanagaaaggaacccagcagcgtttcctggccccaaaaaccataagggtgtgctggggggtgc

SEQ ID NO: 12247 - DNA, 121 bp, Artificial Sequence
  Synthesized
  misc_feature (61): n=a or g
taaggaagaaatcaatatttaaaataaactgggctgtttgattcaagatggaatagcaccnaaaactttaaaaccatatattgcttgtaaaaataaaatcttccaactacggctttgccat

SEQ ID NO: 12248 - DNA, 121 bp, Artificial Sequence
  Synthesized
  misc_feature (61): n=t or g
tcttcctcactaccccttgcaggcctttaatgccagacatccggatcctggggaacaaatnaacagcaaaatgctatttatctctatgcgttactttacatttacatatagatatatatgt

SEQ ID NO: 12249 - DNA, 121 bp, Artificial Sequence
  Synthesized
  misc_feature (61): n=a or c
cttctgatttgacactgtctgccaagttctgtgtttgtttgagactggaggcaactgcaantccattgggactgctggcagagttttttcaagatgcttaccataggaactggaagataag

SEQ ID NO: 12250 - DNA, 121 bp, Artificial Sequence
  Synthesized
  misc_feature (61): n=a or c
caatctgtcatggggtaaggaccatactcagcactagtgccatgttttaatgccattctcnttcaccatgctggaatctgtacgcagcttctattgctttgttttaactgcatgggtttgt

SEQ ID NO: 12251 - DNA, 121 bp, Artificial Sequence
  Synthesized
  misc_feature (61): n=t or c
cagaaacacacattcccctctttttggattctgaccaaaacatgacttcaaaaagcacaanggctgtgttatataagttctatttcatctgctagtcttctcttccattgaaggaaggaaa

SEQ ID NO: 12252 - DNA, 121 bp, Artificial Sequence
  Synthesized
  misc_feature (61): n=a or c
tattcatatactatacagcgcttccatgtaaatctcagtgatgaaatctcatgatctcggnaacaaggcatcagataacagatgttattgaaaacagcaattgcattcctgtgcaaaaaaa

SEQ ID NO: 12253 - DNA, 121 bp, Artificial Sequence
  Synthesized
  misc_feature (61): n=a or c
ccaggtagtcggacaaggagggtagcatttctgcagcaattaaaacatgactatctaaganactatccctgcacacagctcttatgaaacctaccacatgccctcttcagattggctgagt

SEQ ID NO: 12254 - DNA, 121 bp, Artificial Sequence
  Synthesized
  misc_feature (61): n=a or g
ctcccagagacgctcaatagtttctatcagcaggtgaaatcccaaactcatttcccacacnacgcagcaggttccagcagcacagctgtccacctccaaatgcaccggaattgcccgtcca

SEQ ID NO: 12255 - DNA, 121 bp, Artificial Sequence
  Synthesized
  misc_feature (61): n=t or c
acttgcatatgttcagattgcttaagtgttcctggacctgatcatctatcaacaagagtgnatattccttgccttttccctagactctgagaccctggcctcacagggctttttgctgtcc

SEQ ID NO: 12256 - DNA, 121 bp, Artificial Sequence
  Synthesized
  misc_feature (61): n=t or c
aaggtttaaaataagacttttttattccagtatttaattccaacaggactaagtcctgtangtcaaaggaaacaaagtcaaagagtacatctaccttggtactcatctgctaatttccatt

SEQ ID NO: 12257 - DNA, 121 bp, Artificial Sequence
  Synthesized
  misc_feature (61): n=a or g
aagaattttcatgcaacttattctcaacatacaatgccaaattcacatgatggaagcccanagacaaactatgtcactttattctgagttatttcacaggaatgcagcactagctacattc

SEQ ID NO: 12258 - DNA, 121 bp, Artificial Sequence
  Synthesized
  misc_feature (61): n=t or c
atttgtactatggttgtccaagaggagggcactgtgcaagttcagaaggacccagctctcncagggccttgtgggactgtgctcaattggtatctccctcccttggcaaggcttcaggaga

SEQ ID NO: 12259 - DNA, 121 bp, Artificial Sequence
  Synthesized
  misc_feature (61): n=a or g
cgtatttggaatcttttgcttctcagaatactgattaaaatcctattttgagagacttttntccccggagtgctatagcaggaaatatggtcctcttaactaatgattttcaagcaatctg

SEQ ID NO: 12260 - DNA, 121 bp, Artificial Sequence
  Synthesized
  misc_feature (61): n=a or c
caggcggaaaatgtgtattaatgcgcttatgggggtaaggcttcatcgccgcagagagganaagtttgtcccaccagcagacccttcaccatcccaaacagagcaagccttggttttggtg

SEQ ID NO: 12261 - DNA, 121 bp, Artificial Sequence
  Synthesized
  misc_feature (61): n=a or g
gcagtataaataaacctttccccttttagatgaggagtggtgcagttataatcagcttttntgtggttatgccgtagaacaaaacttggttacgttaatgaatctacagtgtgaatatgga

SEQ ID NO: 12262 - DNA, 121 bp, Artificial Sequence
  Synthesized
  misc_feature (61): n=a or t
tttttcaattaaaattttaggtactatctaacaaacaaagaatttaaggcagagtgctgangctgtagcactgtagcctggaatcagaacatcagttttatatgctttctgtatacagtag

SEQ ID NO: 12263 - DNA, 121 bp, Artificial Sequence
  Synthesized
  misc_feature (61): n=t or g
ccaacaaagagattgctggttgattaattactactagtgctggtttggaaggctgctgtgntcttcacagtcaacagttcatagtccctatgttttcttagggggcagaagtgtgagtaca

SEQ ID NO: 12264 - DNA, 121 bp, Artificial Sequence
  Synthesized
  misc_feature (61): n=t or c
ataagtttaatcaaaaacacaaaaataggagctagaaagcggcgtgttgtcgaggtagaangctaaagaggacccgagcagagcagcaatgagcctgggctggtgtggagtgggcgctggg

SEQ ID NO: 12265 - DNA, 121 bp, Artificial Sequence
  Synthesized
  misc_feature (61): n=a or g
caaatttcctcttgattcagaatcacatatcatcagaccatgaagcacaagtgtctccccngcagccatgtgacctaggcaaattctgctgtcccgagagctccacagaagaactttgttt

SEQ ID NO: 12266 - DNA, 121 bp, Artificial Sequence
  Synthesized
  misc_feature (61): n=a or g
tgacacaagggatctgagagaaaacattttcaaatacaagtgttctttaatttctgatttngtgttaagaaagcccgagatcctcttgcaaatagagcttagcggtgtcctgtgcttgtta

SEQ ID NO: 12267 - DNA, 121 bp, Artificial Sequence
  Synthesized
  misc_feature (61): n=a or g
tgggataggtttacttcctttccccccccccccccaaataaacccaacatgtcaggactcnactaagtatgttcgcaagctgcacacagctacataaagtagtggcatgtgctgtagttgg

SEQ ID NO: 12268 - DNA, 121 bp, Artificial Sequence
  Synthesized
  misc_feature (61): n=a or g
agcctggggctgctgaagctgtagaccccactgctgtgctgatgtgtccctgtgtgtgcantgcttctctgtgcccatcacagtccccgcttggagcagcacccagaccccacaaagagaa

SEQ ID NO: 12269 - DNA, 121 bp, Artificial Sequence
  Synthesized
  misc_feature (61): n=a or g
ctcgtaatttactggcacaagcagcataactcccttctcattatcaataagtaagaatcanttactgatttgatgtcagttgtttgttgtcacaagaaaacaactggagaggtcaaaatgt

SEQ ID NO: 12270 - DNA, 121 bp, Artificial Sequence
  Synthesized
  misc_feature (61): n=a or g
ctaagaccctgctatgacacaacaaacagcatcatttggaatacaaagacatttgtcagcnctggttcaaaacagcaagcagttgattggtacgaggggaatgcttttttactgagcgctt

SEQ ID NO: 12271 - DNA, 121 bp, Artificial Sequence
  Synthesized
  misc_feature (61): n=c or g
agcagtacagcactgcctgcatgctggaaggcaatccaccttgggtcctgtatctctactntcaaaattcagataaaggaagaaggccaaagtgtaggacttgcagttacaagcactaata

SEQ ID NO: 12272 - DNA, 121 bp, Artificial Sequence
  Synthesized
  misc_feature (61): n=a or g
tgggaagttcatttggatctatcccctccactcagataccgattttcagggaacattcacnaacatcctttcagatttccattcctttgtttgacttctctaaaagtggtatgcaaggtca

SEQ ID NO: 12273 - DNA, 121 bp, Artificial Sequence
  Synthesized
  misc_feature (61): n=a or g
agaaatgtcaggctggttaaggcttctccttgtggcggaagtcagactgggccagtacatnggcttcttgcaaataccatggagggggaatactggctagtaatgggaaggcatatatgaa

SEQ ID NO: 12274 - DNA, 121 bp, Artificial Sequence
  Synthesized
  misc_feature (61): n=a or c
atgaagtctgaatatttttatgaaaaacatctagaaaagtttccaaatacatttagtacanatgctataggaatactgtttcatttctgttgctatgaagagatgttgggtagaagttaga

SEQ ID NO: 12275 - DNA, 121 bp, Artificial Sequence
  Synthesized
  misc_feature (61): n=a or g
aaacacagacacagaaaatattcagtcacctgtaccagctttctttaaaaataaggaaatnaactttgcacagttggttcttcccctccctcactgaattttatatttaaaaataacaaat

SEQ ID NO: 12276 - DNA, 121 bp, Artificial Sequence
  Synthesized
  misc_feature (61): n=a or g
ctcatgctaaatgcaacttgctgctctattggtgcaaaccagcattggctcagatggcctnattttagaggagtgtgtgtgaatggaatctcaaagtatgtctcctttgtagtgtctgctc

SEQ ID NO: 12277 - DNA, 121 bp, Artificial Sequence
  Synthesized
  misc_feature (61): n=a or g
atttaattcagtttttaccaataaaaacaatacttggaaaaggcttgcattcctgatgtangatgaagggattagttatgtgagtatcaacctacattaaggaaatttaaaatacatgaat

SEQ ID NO: 12278 - DNA, 121 bp, Artificial Sequence
  Synthesized
  misc_feature (61): n=a or g
tgaggtgaattctgccataatttgtagggaagaaaaaaagccaacaccttagctatcaacnatgagctaattagtagacatagctttcttcaaaataaatctgtcaacaatattattacct

SEQ ID NO: 12279 - DNA, 121 bp, Artificial Sequence
  Synthesized
  misc_feature (61): n=t or c
aggtgatttatctgatcattgtatttagcattaggttttttttagttttaagtccctccanagtaaatcacttgctttaaagcagcctttttatatttcaggtgcacacaggggcagtact

SEQ ID NO: 12280 - DNA, 121 bp, Artificial Sequence
  Synthesized
  misc_feature (61): n=a or c
taatccaggagcaaaaactagagagaatcatgcctgtgacctagacagaagggcactctgnactaaaaaaggaatctacccagaatgacccaagagcctacaaaggactcataagtgagcc

SEQ ID NO: 12281 - DNA, 121 bp, Artificial Sequence
  Synthesized
  misc_feature (61): n=a or c
ccttatttttgtttttaatgtgtccaatctcctgaagaaaaaccgatgtattgcaaatttngctcagagtagtgaaaaagcagctttaaaatgtcagctggtgaaacgtggcatgaagcag

SEQ ID NO: 12282 - DNA, 121 bp, Artificial Sequence
  Synthesized
  misc_feature (61): n=a or t
tgcaggcaaatagattcagatctcacagacaggtttaccttccatctaatggcacatagtncaggaaaatcactccttagtgacaccagagaacaaagaatctacctggagggggtgaaac

SEQ ID NO: 12283 - DNA, 121 bp, Artificial Sequence
  Synthesized
  misc_feature (61): n=a or g
ctgataagaacaggaaaaattggaacactttgattacttgaagctaaaccaaggcagtctntactgcaaagagtgcttctcatcgtacatcagattattctgtttttcccgagagcacagc

SEQ ID NO: 12284 - DNA, 121 bp, Artificial Sequence
  Synthesized
  misc_feature (61): n=t or g
cactgaaagctgtatggagctcagacagagcaggcagctgaatttcctcctggtctactgnaggatacagctgaggcagaatgtgtagttacagagaggcacatagaccacatcagttctc

SEQ ID NO: 12285 - DNA, 121 bp, Artificial Sequence
  Synthesized
  misc_feature (61): n=a or g
actgtaaggaatgtttaatatcttcactggggcataactccaagccaagtctaccactggnaggttgctgtggttctggattcagtgtttagtttagtggaccatcgatttccatgtgcat

SEQ ID NO: 12286 - DNA, 121 bp, Artificial Sequence
  Synthesized
  misc_feature (61): n=a or g
aacaaatagctaattagtaaaaacctgtaatttcttttaagacactaccggtagaaaggcngtttttaattcaaacgtcctggcaatcacataaaaataaggcagtaatagtttgcttttc

SEQ ID NO: 12287 - DNA, 121 bp, Artificial Sequence
  Synthesized
  misc_feature (61): n=a or g
tatgtaaaatatagttagtaatgatctttagagtgagacaagcccctttgtgctatgcctngggactgatctgtcctacgtgaccaggtcgtgtcctgtaccctgccccgtgaatatgcaa

SEQ ID NO: 12288 - DNA, 121 bp, Artificial Sequence
  Synthesized
  misc_feature (61): n=a or g
tccatgctgcaaagacttcctgccgcagctttacagctctttaccatctctgagttttcgnttgttttgcagacagattaattgtgcttcttgtgaactggggaagattgatggcttcaga

SEQ ID NO: 12289 - DNA, 121 bp, Artificial Sequence
  Synthesized
  misc_feature (61): n=t or c
gtgttcagcaactgtaagactgggggcttctggtgggtttggatgcatatagggcaacagnaaacagcaaacattcccatagctatctacccagagtagggtgcaagtgcaagacttcacg

SEQ ID NO: 12290 - DNA, 121 bp, Artificial Sequence
  Synthesized
  misc_feature (61): n=a or g
tgcagtcttggcatcagattactatcttagcttttgttctaagttatccagtaacagaacngggagttacacaccgggctgtgctacctgggttatttagggttcttcatggcttttcttc

SEQ ID NO: 12291 - DNA, 121 bp, Artificial Sequence
  Synthesized
  misc_feature (61): n=a or g
aaacagaatactgaactgtgagggctagtggggttcctggtgctagcagccctggatcttnaaaggcttttacagctgtagcaggatgtcttgaaacacctgctcatagttcagtgatgag

SEQ ID NO: 12292 - DNA, 121 bp, Artificial Sequence
  Synthesized
  misc_feature (61): n=a or g
gagaagaatgagctaatcgctgtacataaatgaatatggaaaagcaaatctggcaggttcngatgatattagtgaggtttctctccaccttccttgcatgagttgtaggcacctgaaatta

SEQ ID NO: 12293 - DNA, 121 bp, Artificial Sequence
  Synthesized
  misc_feature (61): n=a or t
actcactttggattttatttgatgaagtttctgaaggttggggttatttaacaggtatgangacgatctgggtaaaaatgtgctttttccacttcattggctcacctggtacaaattcctc

SEQ ID NO: 12294 - DNA, 121 bp, Artificial Sequence
  Synthesized
  misc_feature (61): n=t or c
agtcactgtgccaattctacagctctgttctttgacacaggatgggacaaactggcagagntcacaggctctgggaggtagcttcacagctcagggaccattgctggtgcatccctggact

SEQ ID NO: 12295 - DNA, 121 bp, Artificial Sequence
  Synthesized
  misc_feature (61): n=a or g
gggttcatgaaaggcatgtcctgccggaccaacctgatgtcctcctatgaccagcgacccncctggtggatgaaaggcagtaggtgtaacctacctagagtgtagcaaagcttctggcact

SEQ ID NO: 12296 - DNA, 121 bp, Artificial Sequence
  Synthesized
  misc_feature (61): n=t or c
actgaagtacagccaacataaactattttagaactggctcaggaaaaagtaacttttcatntgagctgtactccctcaaaggatagattctgaatttcaagaccagtactattaccagtca

SEQ ID NO: 12297 - DNA, 121 bp, Artificial Sequence
  Synthesized
  misc_feature (61): n=t or c
ccactcatcagtacatccctctgccccagcttgttcctgactgtagcaagggtgattgccnaagcaccactatcacatcccagtgcccacagaggtgtaaagcccctataccaaactcttt

SEQ ID NO: 12298 - DNA, 121 bp, Artificial Sequence
  Synthesized
  misc_feature (61): n=t or c
atggcttggttgttgtcacctacccatcccttacaaattaactccagcataaaatagatgnaggtgatttaatgagaagctcagatgaggacttaagcagatacagtcacaagctcagtgc

SEQ ID NO: 12299 - DNA, 121 bp, Artificial Sequence
  Synthesized
  misc_feature (61): n=a or g
atcaggttagaaatttggttgcctcttctccctgtcctttaacaagactaaaaaattaccnccacaaaatcacgctcctattttcttactccacgtgaaaatgaatgatgctgtatcaaag

SEQ ID NO: 12300 - DNA, 121 bp, Artificial Sequence
  Synthesized
  misc_feature (61): n=a or c
ggaaagttcacatcttgcatggttgtttatattacaccacagtaagtttacagtttcaacnctcgttattagtgccaaaagctgtctccaggatgaaggagtagcatcaaaacagattttg

SEQ ID NO: 12301 - DNA, 121 bp, Artificial Sequence
  Synthesized
  misc_feature (61): n=a or g
actcatactgtaaagctgaaagtcttttctcttaaaagagggagaaaggagttacttagcntgttaaacaggtagctgtggaaagaaaagaactagtttactatttttatttacggtactc

SEQ ID NO: 12302 - DNA, 121 bp, Artificial Sequence
  Synthesized
  misc_feature (61): n=a or t
caaaattgggataacgtttcaagaagtgtctccgcagcttaaaaaccagaatctgttgtcngccctgagttaagcactcaaacttcagtttaaatgttgagtgcatgagatggttagggtt

SEQ ID NO: 12303 - DNA, 121 bp, Artificial Sequence
  Synthesized
  misc_feature (61): n=t or g
ggggggaaaaaaaaaaaaaaaaaaacaacacaacaaccacaatagcaacaaccagtcttangttagcaagcattaattgtatgacagtccttcgatttttctttgactgaatccctctgtt

SEQ ID NO: 12304 - DNA, 121 bp, Artificial Sequence
  Synthesized
  misc_feature (61): n=a or g
ttactgagagttggatcaatatctctataatccgttctgtctgcaaaatatcatttaaacntagcctaaagccttttcccccatcgtgagcgactccttgttttttttctgtttgttttta

SEQ ID NO: 12305 - DNA, 121 bp, Artificial Sequence
  Synthesized
  misc_feature (61): n=a or g
ttggtacaagtgccaaatgttaagtatttccatgtaaaagaaaaatgcctatattttatcngttctgttggttgagttgttggtcattcagcttttttggtggagagtttgttctttgaat

SEQ ID NO: 12306 - DNA, 121 bp, Artificial Sequence
  Synthesized
  misc_feature (61): n=t or c
cagccagtgaggatgcacggccaatggtgaaggccttgtgtgcctatggctctccatcagngcctcacactgccctctggcaaagttctcatcctgcatccacacagtggcctaatagcac

SEQ ID NO: 12307 - DNA, 121 bp, Artificial Sequence
  Synthesized
  misc_feature (61): n=a or g
aattcacagcagcaagctctgcatgaccctctcttcagctattgttcatgctgtaatcagncatatccaccacacagctttgcatctgtctgtgtcctccttcctttacctaaccctcttc

SEQ ID NO: 12308 - DNA, 121 bp, Artificial Sequence
  Synthesized
  misc_feature (61): n=t or c
agagatttcaaaaatgtgtttgctgtaattttcccttccttctaggatcgcaggtgttcanttggtctggctttagagggagagtgatgtgaaaactgcaccagtgaaaaaaaaaatcata

SEQ ID NO: 12309 - DNA, 121 bp, Artificial Sequence
  Synthesized
  misc_feature (61): n=a or g
aacaaaataaaaagctcttcctttggttgaaatcagacaaagtaaaatattttgttctganttttcagggagtcacaactttcctaaaagaagtgtcaatattgcagacattgtatttccc

SEQ ID NO: 12310 - DNA, 121 bp, Artificial Sequence
  Synthesized
  misc_feature (61): n=a or g
gatgttggtggagttaaaagttagattgttcataggaaaatgcaaatgactttttggcagnaaacattttcttggtctaaaaggaactgcagtcagagagagaacacaaatgaaaactcgc

SEQ ID NO: 12311 - DNA, 121 bp, Artificial Sequence
  Synthesized
  misc_feature (61): n=a or t
ttttggcaaagcataaaaatacacctagagattaactgcaatacataagtcagttcattcncaatttcatcgtttattcttcttatttatagatatagttttaatgggtctctgttctgtt

SEQ ID NO: 12312 - DNA, 121 bp, Artificial Sequence
  Synthesized
  misc_feature (61): n=a or g
tatgactacataatagctttttaatgaggaaatgtgcttcagggctgtgtcttggcccttntgtctttcctgccagtgaccgtcctgtgtgcacgtataggatgggttctccatccttagg

SEQ ID NO: 12313 - DNA, 121 bp, Artificial Sequence
  Synthesized
  misc_feature (61): n=t or c
ttgaaacatagcacatcctgtttagatttgtaagtgccaaacacttgcattccctatatanctcctggttttagcactactttttcctaataagtagtattctgaatagtagaggaagaag

SEQ ID NO: 12314 - DNA, 121 bp, Artificial Sequence
  Synthesized
  misc_feature (61): n=a or g
aatctgattttgtataaataatattctaaagaatttgagtcccttttgggactgattcggngcacctgaaaccttctaattactgaaagcaggtctacacaatgtcaaatattagtgtggc

SEQ ID NO: 12315 - DNA, 121 bp, Artificial Sequence
  Synthesized
  misc_feature (61): n=a or c
caaagggtgtcataaatagaaaagaaagtgtgttgagtcctgctgacagccagctgcccancctgacaccgtactgctgggacctcacgccatcattctcttgcaggccttggtaactaca

SEQ ID NO: 12316 - DNA, 121 bp, Artificial Sequence
  Synthesized
  misc_feature (61): n=a or g
cctatcaagagtgcttagttcctagagacttgataaccacctcagatgagactctaccgcntatgtgtatttttgctgataggagttctttcaggtacttactgagagtgatacatactct

SEQ ID NO: 12317 - DNA, 121 bp, Artificial Sequence
  Synthesized
  misc_feature (61): n=a or t
tagcctctctcaagatgtatttctttattttgggaaagtgatctgagacatcataccaacntaaacaccaatagaaaaaaagatggatgatgcaaacacacactgaaaagacagaccgtac

SEQ ID NO: 12318 - DNA, 121 bp, Artificial Sequence
  Synthesized
  misc_feature (61): n=t or c
acagcgtatgcccccagcgttgcttacttctgggtctttccaggaaaccattggcagtgtnagcacatttctgctgatgtcagaatggtgctgcattgtatctggagcagcaaatccccag

SEQ ID NO: 12319 - DNA, 121 bp, Artificial Sequence
  Synthesized
  misc_feature (61): n=t or c
acctttccctctccacatgacctgtaaccagggtgcaaatctatccctctgcaccccacancaatcttttcagacacagacccgatggagagtcattgggtcgtcgcacaggaactgcctc

SEQ ID NO: 12320 - DNA, 121 bp, Artificial Sequence
  Synthesized
  misc_feature (61): n=t or c
ctgggtccaaaaagtcatataagtcgcttttggtttttgcttaaagcagggaagcgacaantcagaggtctttggaatacaggtgacaaaccagagaagtgcttacagtgaaataaagctg

SEQ ID NO: 12321 - DNA, 121 bp, Artificial Sequence
  Synthesized
  misc_feature (61): n=a or c
catggctgtacatagcttctcttgagataaacaggaacagaagagatggtcttttctgctngatctataaccagctgctgttttccaggtgctaacccagcagaattaaatgcatttgaaa

SEQ ID NO: 12322 - DNA, 121 bp, Artificial Sequence
  Synthesized
  misc_feature (61): n=a or g
ctctgaggtaaagtcctttactagtacataagcaaaaggaaatattaatacttagccattncaggctggaaaagaaacacttggacattctcactgaaactgtgtgttgctctccatttaa

SEQ ID NO: 12323 - DNA, 121 bp, Artificial Sequence
  Synthesized
  misc_feature (61): n=a or c
attttctcttatatcctatttattatctttttgctacagcacatagcataagtgtcttctnatacttacagcctaatgaataatcatgtgttccaagaccgaatatcatcatccattgtag

SEQ ID NO: 12324 - DNA, 121 bp, Artificial Sequence
  Synthesized
  misc_feature (61): n=t or c
tttgttaagttaatgagatcctctttccttattttttcttcttagcccgggctgctgttangaaactgcaatgaccaggcgtttctatcacggccgcacggagaccataagaccgtgtacc

SEQ ID NO: 12325 - DNA, 121 bp, Artificial Sequence
  Synthesized
  misc_feature (61): n=t or c
aaagattagaagagggctgaatgaaggttgcaaaagcctttccttgtgacttttcagcagngaggatgtagttgagtggtgttcttctttcatgcgcaactgaccaattaactgtctgcac

SEQ ID NO: 12326 - DNA, 121 bp, Artificial Sequence
  Synthesized
  misc_feature (61): n=a or g
ccaccctctacctgctgcacagagaggtggctctcatctgctctgcctcttctagggcatnagcctatgctatgttgaactgaaaccaatgcaatccaagctcccatttctttctgccagc

SEQ ID NO: 12327 - DNA, 121 bp, Artificial Sequence
  Synthesized
  misc_feature (61): n=t or c
gagctgaaggcttctgaaacagaaaagttgcattacattttactgaatatgctcagaaacnccaaacatatctgttaagtgttttgttttgctttttaaaaataaacaaattcagggggaa

SEQ ID NO: 12328 - DNA, 121 bp, Artificial Sequence
  Synthesized
  misc_feature (61): n=a or g
tcgggaccttcaacggcagccatccaaaaagtcaatcgcaaaccgactccttgctaatacncgcacccttccttactccctcttagttctatatcacaaaggttttggtggcttgttttcc

SEQ ID NO: 12329 - DNA, 121 bp, Artificial Sequence
  Synthesized
  misc_feature (61): n=t or g
ctttttttctggggaggagggaaacaacttttgctgcacacttgtttgcacacgaaggacnaacatgaatacaacctgtgtttaatgtaatataacacatgcaaaaacttgaaggaaggaa

SEQ ID NO: 12330 - DNA, 121 bp, Artificial Sequence
  Synthesized
  misc_feature (61): n=t or c
tcttgtatttacccagcccaacagatatattttagctccagcaattttcccttgtaaagcngttacagctgacctctattcagagttattgttcatcagtgaacaaaccctctggtttatt

SEQ ID NO: 12331 - DNA, 121 bp, Artificial Sequence
  Synthesized
  misc_feature (61): n=t or c
cccggagcccccttacaggggacatcctcacatgttgtatgggaactgctataaaacatcngttgtgaaagagggattaattctggggttccctttcccagatgcagcgttgccccaactg

SEQ ID NO: 12332 - DNA, 121 bp, Artificial Sequence
  Synthesized
  misc_feature (61): n=t or g
gaaagcacatgcaagaaaaaagaaaagcaaacagaaaaaaaacaagtgtggacaggccctnctgtagaccaaatgctcacaaagttagtccacatactttgcaacttatgtaatcttagtt

SEQ ID NO: 12333 - DNA, 121 bp, Artificial Sequence
  Synthesized
  misc_feature (61): n=a or g
cttgtggtgggtgtcagaagaactgtggcttaactctgcaggcaactcagcatcacacagntggtcactcactgtcccctaggtcgtatggcggaaagaactgggaatgtaggagtgtggg

SEQ ID NO: 12334 - DNA, 121 bp, Artificial Sequence
  Synthesized
  misc_feature (61): n=t or c
tgggagactttcatgtcttaatccagcaatgcagggttattccaggaagggccactgtacngagcgatacatacttagctatgaatttttttggatccttttgcttgttctgagataaatg

SEQ ID NO: 12335 - DNA, 121 bp, Artificial Sequence
  Synthesized
  misc_feature (61): n=t or c
tcaataattgactgaagatatactaaggaaacaggggtgtatacattccagtttcagctgnagatattaagcttccaaaagtaaaacccagatgtttataccatgaaacaaatttaaaaag

SEQ ID NO: 12336 - DNA, 121 bp, Artificial Sequence
  Synthesized
  misc_feature (61): n=a or g
attctggaggtcccatgttagctgcattacgtcaggggtgcaatgtgcaagctatgccaanagtgctgtctggtccagcacccattacacatgtgcatttgcaactcaagtgtctgatttc

SEQ ID NO: 12337 - DNA, 121 bp, Artificial Sequence
  Synthesized
  misc_feature (61): n=a or g
ggtaactatagctgctgcgatgtgttgacactacagcaagttaccagcttaaacaaagttnattggttgagcattttgaatccaggactttctgtgtatttcctctgtgctggtgtaaacc

SEQ ID NO: 12338 - DNA, 121 bp, Artificial Sequence
  Synthesized
  misc_feature (61): n=a or g
cgtttttcagcagtgccattcagtgcttgaaaaactacggcggatgatccggcttccttancacctctgtgataaagcgctttctgctgtcagtaaaatgtgtttgaagctattctgcctc

SEQ ID NO: 12339 - DNA, 121 bp, Artificial Sequence
  Synthesized
  misc_feature (61): n=t or c
aaacatgtagaataacaagaagcaactgaaagatagttcataaaatgtttcctccagggtnatccacaatgctgccagcagtaaaggaaaaaaaaggtgttttggaaatctagacaggtaa

SEQ ID NO: 12340 - DNA, 121 bp, Artificial Sequence
  Synthesized
  misc_feature (61): n=a or g
tcttcagggcattggcatggagcgaggaggaggagtacgcatccactgtcctcaggcaatnatggcatagggatacccagcctttgcactcacatgtcctcactcagccacctgtacagtg

SEQ ID NO: 12341 - DNA, 121 bp, Artificial Sequence
  Synthesized
  misc_feature (61): n=a or c
agggtctctgcttctcgatgcggggaattgtcccttcatcacgctgcggggcatcgaaaancaccgctgatgggaataagggagaacctaacaatttgggtgtcgggtttttagcgcctta

SEQ ID NO: 12342 - DNA, 121 bp, Artificial Sequence
  Synthesized
  misc_feature (61): n=t or c
gaagagggcacatttttactgctttgattttttaattttggtctctttattagatccacancacaggtactaaatgtttttccattaagatgtgaccaagtcagaattaacttagacttaa

SEQ ID NO: 12343 - DNA, 121 bp, Artificial Sequence
  Synthesized
  misc_feature (61): n=a or t
atgagttataattacctccttcaaaaccttctttcttcttgtaactggctacagacttgangaaaagtattcagtcttttcctttcacacaatacaaatggtgtgctaatttttgcccatg

SEQ ID NO: 12344 - DNA, 121 bp, Artificial Sequence
  Synthesized
  misc_feature (61): n=t or c
cctccaaacaaatattctcccaaatacttagtgcctccctagccaccatgcattagaaatnctgctggtcaatttatctgtgaatttaactgtctttatgtttgtatgttgtgtttttgtt

SEQ ID NO: 12345 - DNA, 121 bp, Artificial Sequence
  Synthesized
  misc_feature (61): n=t or c
gaccacccaaaaatcagaccatatgcaggtctatgcttggctttctcaaaccataacacgntcaattcaagcatctgggaggagcttttagcattcccccactagtcaggagcttcttact

SEQ ID NO: 12346 - DNA, 121 bp, Artificial Sequence
  Synthesized
  misc_feature (61): n=t or c
atgcctggctgatttttctgcctatctcctggaaattctcaccctctccccaccaagcatnctctcccccgcctggaaaacatgccagcagcatttgtgagggtgacagcagctcagctca

SEQ ID NO: 12347 - DNA, 121 bp, Artificial Sequence
  Synthesized
  misc_feature (61): n=a or t
gtacttcagtaagttacttaaaagtgtgcttggataaatttctttgcaaaggagaaaatancacacatatgaaaagtggatagacctcagtttaataaaaagcaaaaccttagttaaacgt

SEQ ID NO: 12348 - DNA, 121 bp, Artificial Sequence
  Synthesized
  misc_feature (61): n=a or g
gctcttgctctgtgtgcaactttgattttacattggctttatgcatgtctcctctgcaaanctgtgtatgtgtgagagagaggagcctgcattggagggatgcgcagctgtaagggcaggc

SEQ ID NO: 12349 - DNA, 121 bp, Artificial Sequence
  Synthesized
  misc_feature (61): n=t or g
atcaagggctgctttgttaccatttcacctgaaaagttgtaaagcctcacttaatctaggnaagatgtgccaacaaacagattcacttaaatcagttgcacaaagttcagaacgtttcatt

SEQ ID NO: 12350 - DNA, 121 bp, Artificial Sequence
  Synthesized
  misc_feature (61): n=a or g
gtagatgaacaaaagctgtcttaaatctaactcggggacaaaaaactgtggtctaagtaantattcactaatttatagataaagaacctttggccttcttgatacagtaagcttgcaaaac

SEQ ID NO: 12351 - DNA, 121 bp, Artificial Sequence
  Synthesized
  misc_feature (61): n=t or g
aaagcacgtaaacacccgaatccatactaaaagaaacatctccatctcagaacaaagctcntacaacttaatgcatcagtaaaatggtagcttcttatgctccagtcagctgctttgctgt

SEQ ID NO: 12352 - DNA, 121 bp, Artificial Sequence
  Synthesized
  misc_feature (61): n=c or g
ttgaagaaattggcatcactgcagaatgtggttacctatgttaacagcagtcacaaaacanctcctggactcctgaaatatttgcatctgctatatttgcagtttttacggtcatataagg

SEQ ID NO: 12353 - DNA, 121 bp, Artificial Sequence
  Synthesized
  misc_feature (61): n=a or g
gcttagctcccaaatgcagctgtactgatgtttccatgggtccagagctcatcctgggagntggttgccaacccaaccatagatgtgaagttcagagcagcgagcatgggaaattccatgt

SEQ ID NO: 12354 - DNA, 121 bp, Artificial Sequence
  Synthesized
  misc_feature (61): n=a or t
gtttctgtagtttctctcattatcaataagataaactgcatacagcagcagctgtcatgcntcagtttctcactttttcatttcttcctggtcatggtatcactgtccagcagcggtgatc

SEQ ID NO: 12355 - DNA, 121 bp, Artificial Sequence
  Synthesized
  misc_feature (61): n=t or c
ttaccaagctgtcagcataaaaagcatttgtgcaactaatatataagtaacaataaattgnaggtctattgacttcacctgagactcagacttacactactcgaagtgggagcacattaaa

SEQ ID NO: 12356 - DNA, 121 bp, Artificial Sequence
  Synthesized
  misc_feature (61): n=a or g
ctataatatagtagctgcatcatttcaagtccttaccaaacttatattaaaagtcttgggnaataaggagaagtcattgctttaagaaattacaaaggcaatcccttcagagaagaaatat

SEQ ID NO: 12357 - DNA, 121 bp, Artificial Sequence
  Synthesized
  misc_feature (61): n=t or c
gagctctttgtcctgtgagcagaaatagaaatccagttagtagaattgttataattgttanggtgtggcaagcttagcacatatacaaagcataactctgcttttttaggtttgactcaaa

SEQ ID NO: 12358 - DNA, 121 bp, Artificial Sequence
  Synthesized
  misc_feature (61): n=a or g
cacggcggttgctaaaccagacctacaaatgatttaattaggcatatttgatttctgtacntttaataaaggtgcatcagaaataatggcatcatatttaaaatgcaatcagtgcctcaga

SEQ ID NO: 12359 - DNA, 121 bp, Artificial Sequence
  Synthesized
  misc_feature (61): n=t or c
gactgaagattagggagcaggagacactgaaaaagggactggaaatttctgctattacttntagtggtttgggtgttattattagcatctttgaaatacacgtcaccaagaaagcacaact

SEQ ID NO: 12360 - DNA, 121 bp, Artificial Sequence
  Synthesized
  misc_feature (61): n=t or c
gtgtaggcacagcttaaagccaggtgtctgactacatgtccagactgtgccccagagaacntcatccagaagcaaacaggtaaagtgggtcagtggatcatgttctacaagtgagtaattt

SEQ ID NO: 12361 - DNA, 121 bp, Artificial Sequence
  Synthesized
  misc_feature (61): n=t or c
cctggagaatactgagtttgtagattatatgagcaacacacattcactatgccaaagcatngggctcttaggataagtgtgtggtttgaagtcactgatgtccctcagctaggcagggtga

SEQ ID NO: 12362 - DNA, 121 bp, Artificial Sequence
  Synthesized
  misc_feature (61): n=a or t
ttcccagactgcacggccagggcaaagccttgcacatccattctggtaccagcacctcacngaatctattttccctcatgtttccctcacatcttccttataattccctttcatttcctca

SEQ ID NO: 12363 - DNA, 121 bp, Artificial Sequence
  Synthesized
  misc_feature (61): n=t or c
gacataatgaagagcaagcgtgagaaccagcacctatgtacagactcaggcaacttgagtnggggggttcaagcacaattcttcttaaataacctaattccaaccataccagaaagaaata

SEQ ID NO: 12364 - DNA, 121 bp, Artificial Sequence
  Synthesized
  misc_feature (61): n=c or g
gagtaatgatcttgccagttatcataatattctggaatctggcttctcagtgtccttttanactggctcctggcactgtgtgacagctgtcatacacttttaacagagccaaggtgaaaaa

SEQ ID NO: 12365 - DNA, 121 bp, Artificial Sequence
  Synthesized
  misc_feature (61): n=t or c
aaatgaatctccctttctcttacaggccaaatcttggtaactggttgagaaaaataaatgngttttggttaagacggggggaagtaaatgtgtatatcaaggatctactgacagagttaaa

SEQ ID NO: 12366 - DNA, 121 bp, Artificial Sequence
  Synthesized
  misc_feature (61): n=a or t
tagaaatcctgctttgaatctttttaccttactggtgcttgagaactaattaaatgatcgnggcgtggtttctgtctcctgtttggtgaggacttaagcagatcagactttcaaggaactg

SEQ ID NO: 12367 - DNA, 121 bp, Artificial Sequence
  Synthesized
  misc_feature (61): n=a or g
aacaagaagacacacctaacccatcagcaggaaggggaggaaggaagaagactggtagacntttccagctagctgcctgtatttagatttttttaatattgttgcttatttgaaggggttt

SEQ ID NO: 12368 - DNA, 121 bp, Artificial Sequence
  Synthesized
  misc_feature (61): n=t or c
ccagtggtaaagaagtctacccaatttttctgcgtaaacatagtgagaaagttaaacatantgatggagaaatgctatgtttaggaatcaattatttaggcacagtgaagattctcccttg

SEQ ID NO: 12369 - DNA, 121 bp, Artificial Sequence
  Synthesized
  misc_feature (61): n=t or c
attactgtcccttttttgctgatctggaagataatgatgtttctcatttcaaagctcatgntgtataggagttgtttttgctgcctgctctcagattattttattttctgagatgcattaa

SEQ ID NO: 12370 - DNA, 121 bp, Artificial Sequence
  Synthesized
  misc_feature (61): n=a or t
agatggttcagaatcacagaatttaaacaaaatttaaatttgatcaaaacctgaagaattncaagcttggatgtggaaatggtggcagatgtttctaataagaattcagtcttgtacagta

SEQ ID NO: 12371 - DNA, 121 bp, Artificial Sequence
  Synthesized
  misc_feature (61): n=a or g
ccgctgttgataaataaatgatcagcagagtaagtgctgttgatctcttactttccagtcntgctcctccttggcagcaaaaatcttagctttctaacgtgctgtgtttaagttattggaa

SEQ ID NO: 12372 - DNA, 121 bp, Artificial Sequence
  Synthesized
  misc_feature (61): n=t or g
caagtggagaaaaagcatcaagaaggaagtgtcattctatacaaattccgtaattcattcntgctattcaaagcatgtaattaaccatcaattggttttgaggaaaaaaaaataaaaccat

SEQ ID NO: 12373 - DNA, 121 bp, Artificial Sequence
  Synthesized
  misc_feature (61): n=a or g
tggtaaagacacttttcagagtctttatgtcaactgtatgattttctgttctgccttttcntacgtactagcttaaatttactccacctaatactgatcccacacaaccttttcacgatgt

SEQ ID NO: 12374 - DNA, 121 bp, Artificial Sequence
  Synthesized
  misc_feature (61): n=t or c
aatactaggtactagtacttaaagggagggtagaaaaaggggatgtagtcaggctcagtgntgcccaggcacaagagaagaggcagtgagtgcagactgaaacacagtgtcactatgaaca

SEQ ID NO: 12375 - DNA, 121 bp, Artificial Sequence
  Synthesized
  misc_feature (61): n=t or c
agcacacgtagagggataattgtgtcacctttgggacaacattctgcttttttaaacagcnagggctccagcaaagagctcttaggattctgaaggatgagtgacttggagtgcttcacac

SEQ ID NO: 12376 - DNA, 121 bp, Artificial Sequence
  Synthesized
  misc_feature (61): n=a or g
aataattgttttcacgttgatatgcaaaaaaggaaagtagatcagttcctttctttttgcnggaattttgaatcacgtgcaatttctgatgtcaggagacccacttctgattctcaagaag

SEQ ID NO: 12377 - DNA, 121 bp, Artificial Sequence
  Synthesized
  misc_feature (61): n=a or g
aaaattcctttgcttccacatgctactgcctaccagtttctcaagggcaaagaggaataantgatctgttaagactatagcaaaagcaaacaagattaatttcatataaactggtgaagca

SEQ ID NO: 12378 - DNA, 121 bp, Artificial Sequence
  Synthesized
  misc_feature (61): n=t or c
tggacaagcacaaacatgcacacgtcctggcaaagtgcagctaggaggctggctgggaagngtgctcttcagaaagagtaacaagacgtccctggtgctgctgatttgcaccctaacagcg

SEQ ID NO: 12379 - DNA, 121 bp, Artificial Sequence
  Synthesized
  misc_feature (61): n=a or g
tgcaggcagcccagggagacaactctctgatgccaacatccctgctgctacgtatttcccnagcgctctcagctttccagctagattgtgattctttgatttctcctcctgtcctcggtaa

SEQ ID NO: 12380 - DNA, 121 bp, Artificial Sequence
  Synthesized
  misc_feature (61): n=t or c
agaaggaagctataacaactgggttggctgggctttttgcagcccaggtactttaaatcancctctgtttcctgaagggtcatctacaaggactgcaattaatacttttctctctggttac

SEQ ID NO: 12381 - DNA, 121 bp, Artificial Sequence
  Synthesized
  misc_feature (61): n=t or c
atgaggtagcatggggaatataaattagaccactgccttgaatttcttgtgtaccgtgaanaccagtagttgtttatgagagatttgggatgtagattgaggcaaaattaactgtgctctt

SEQ ID NO: 12382 - DNA, 121 bp, Artificial Sequence
  Synthesized
  misc_feature (61): n=t or g
aacacttgcaaaaggataggcacaacagcacaagccaatctatggccacactagagaagtntcccttttactgaccaacagcttggtggcatttccctgcagcaacgaggaaaacttatcc

SEQ ID NO: 12383 - DNA, 121 bp, Artificial Sequence
  Synthesized
  misc_feature (61): n=t or c
ttcaaagaacgcaaaaaccgataccaaccacagctcagaactatcatttcacttcatgctngcagtctgcttcaatgctgtccatggcagtccaagctatagagcccttctaactctcatt

SEQ ID NO: 12384 - DNA, 121 bp, Artificial Sequence
  Synthesized
  misc_feature (61): n=t or c
gagcattccagcagcaatgcagtaagttgtacatctccagtagctggtatctaaaggcttnctcattgctaaggagtgctgggaacttttgaggctagattcttattggcaggagtcagga

SEQ ID NO: 12385 - DNA, 121 bp, Artificial Sequence
  Synthesized
  misc_feature (61): n=t or c
cttggcatctggagaatgaaggtaagaaggatgggctcaccaaaacggaatcatctcagtnttcataactctggttctcacaagtttcttgttacagctatttaagttgttaaaacttgtt

SEQ ID NO: 12386 - DNA, 121 bp, Artificial Sequence
  Synthesized
  misc_feature (61): n=t or c
gacacaaggatgtcacaaaatcacaccatccacttgctctcatttcaaacaagcaaatcanggctttcctatggaaatatccatagcttcatacttctcattcagctttcttataccagta

SEQ ID NO: 12387 - DNA, 121 bp, Artificial Sequence
  Synthesized
  misc_feature (61): n=a or g
atcaactaatgttctgaaatccattagattttaacagtgtcctgcttggctctactttagnaggagatgaatttctgggtgaggtgcatggtcgaagttacattacgtgagcacataggga

SEQ ID NO: 12388 - DNA, 121 bp, Artificial Sequence
  Synthesized
  misc_feature (61): n=a or g
gagctgtgggaaacgtaccactgctagaggctagcaaagatgataaacactgctttcttancctgctgcgacctgagcaccttcccatgtttgtatttccagatgagctgttctgggagta

SEQ ID NO: 12389 - DNA, 121 bp, Artificial Sequence
  Synthesized
  misc_feature (61): n=a or g
catgagtcccatacagtttttcttacttttgtcggagttccatttttgagaatgacagaanttgcttggcgcagacttggtttagttttgaagattttggtatgatcacttttgtttaaca

SEQ ID NO: 12390 - DNA, 121 bp, Artificial Sequence
  Synthesized
  misc_feature (61): n=a or g
gatagcggtacacttgcccgggtgtgacttccctgcaggaacagaaggcatgaacaaagancaggagagaagaatccattcagctgcaacaaatttgctcacccaggctatagaaatcacg

SEQ ID NO: 12391 - DNA, 121 bp, Artificial Sequence
  Synthesized
  misc_feature (61): n=a or c
gaatctgtcacccaaattcatttctatccatccatgatatcaaccttggaacaaagttccngaacttcacagtggctgcacatacacagtgggaaaatagcttttgaaacagaagtcagat

SEQ ID NO: 12392 - DNA, 121 bp, Artificial Sequence
  Synthesized
  misc_feature (61): n=c or g
cctataacatctgctcctagaggaaatcctggactatgagagaggcagagtcaacgatcanagtgatgtgcagtgtaacatcagcagaagttattagtgcccacatgcaatttatgagtgc

SEQ ID NO: 12393 - DNA, 121 bp, Artificial Sequence
  Synthesized
  misc_feature (61): n=a or g
atcactctgttcagggaggcattctgacagaggagctgtgttggtacaatgtagcatatanagtatactgatcaccattaatcacctattcaaatatgatcagctttttgcaaagaacaat

SEQ ID NO: 12394 - DNA, 121 bp, Artificial Sequence
  Synthesized
  misc_feature (61): n=t or c
cacaaggagaaagcagttaggttggcatccatctgactattgggagaaatctgtttcatcnagtcccccagagttcccttcctggtccatggaggactaccacttctgtactgagatatta

SEQ ID NO: 12395 - DNA, 121 bp, Artificial Sequence
  Synthesized
  misc_feature (61): n=a or g
ggagaggcggtgtgaaaacatcctttgaatcaataaaaatagttgtaagaccaaacaaacnctccagattagaacagtccatgatcttcaggatcaaggtgtgtattttttttagcggatt

SEQ ID NO: 12396 - DNA, 121 bp, Artificial Sequence
  Synthesized
  misc_feature (61): n=a or c
ggtggatggatggacggatggatgcatggatggatggatggccacagtgaattttttcaanggaaactctgatttgctgatctcaaagctgtcagtatgaaacggctggcttggacaaaca

SEQ ID NO: 12397 - DNA, 121 bp, Artificial Sequence
  Synthesized
  misc_feature (61): n=a or g
agcctgcaatgtaacatggcatgcttgatgaataacatttgcagtgatttagtttggagcnagtgattggcagttagtgatttcgataacaacttgctgcctgacacgcaacgggcaactc

SEQ ID NO: 12398 - DNA, 121 bp, Artificial Sequence
  Synthesized
  misc_feature (61): n=t or c
aatggtaaaaataaactactatgttttctattacaatacttgattttaaattatgtaagangagtgatagtacatagactatgtatagtaccactagaacaacatcctttacgtttaagat

SEQ ID NO: 12399 - DNA, 121 bp, Artificial Sequence
  Synthesized
  misc_feature (61): n=a or g
gctctgataatgactgttgttcttccctgagtgaaagttccagctgccctgcagccttaancctgcctttggacagtctggcctccagtacaactcttaagtagaagctgcttatttgttt

SEQ ID NO: 12400 - DNA, 121 bp, Artificial Sequence
  Synthesized
  misc_feature (61): n=t or c
gccaccagggcagagaagatgggggacgctgcattttatttgggcttagcccataggccangttgggaaggagacaaaacagctgcgtgctgcgggagggtaagataggatggggttgtgg

SEQ ID NO: 12401 - DNA, 121 bp, Artificial Sequence
  Synthesized
  misc_feature (61): n=t or c
caataggaattcgacacaacaataagctgtaactggtactgagacaagcatcagaactgtnattacagcacagacacatcaaaaccattatgatggagtggcccagaaatactgtgcctag

SEQ ID NO: 12402 - DNA, 121 bp, Artificial Sequence
  Synthesized
  misc_feature (61): n=t or c
catgaggatgtcggtgtctctaagacagggacatcaaatctacttaatcatcttcttgggnttaatgtaggttactttagcaagctggaacacagagaatgatgcctggagaactgattta

SEQ ID NO: 12403 - DNA, 121 bp, Artificial Sequence
  Synthesized
  misc_feature (61): n=a or g
gtgaactgtagcaaagtttgcctggaagtagatgaggtacacaataaaataatccatgacnggaaaataaaatgacacacaggactaactacatgataaaatatcatttcttcagctctct

SEQ ID NO: 12404 - DNA, 121 bp, Artificial Sequence
  Synthesized
  misc_feature (61): n=a or g
cgctaaaacattttccgagtccacccactggtggtgtgtgatacatgctccattgtcaacnttattctcagcaaaatcataactagtcttaatatgatatgaagtatatgatgcttgtatg

SEQ ID NO: 12405 - DNA, 121 bp, Artificial Sequence
  Synthesized
  misc_feature (61): n=a or g
ttttctaggtaatagtagacaatgtgaaatgtttgtaaccagggagatctttgaaattcanagttcatatttgcactacactaatagagaagagtaattatgctaatgtgtttctttaaga

SEQ ID NO: 12406 - DNA, 121 bp, Artificial Sequence
  Synthesized
  misc_feature (61): n=t or c
agtccaccatgggtggaaagtggttcttcaaactgacccaaagtcaccagaaacagcaagngatgttccaaacagcagctcaaggcagcccaggtttcagctctgcttggcagcacaggaa

SEQ ID NO: 12407 - DNA, 121 bp, Artificial Sequence
  Synthesized
  misc_feature (61): n=c or g
ttcagtgttatctgttggttagtgaatactatactgcttattcagcagccatttttgttcntagatatactgttgtgtcaaacatctgaagaattttagtgcagcatctgaaagatttcag

SEQ ID NO: 12408 - DNA, 121 bp, Artificial Sequence
  Synthesized
  misc_feature (61): n=c or g
cactaaccccagatgactgggttatttataaacatgtgcttgaaagacaatactgccgtgntagttatgtgtctccccttaatttagtttaatcctttttttataagtgattagtgattgg

SEQ ID NO: 12409 - DNA, 121 bp, Artificial Sequence
  Synthesized
  misc_feature (61): n=t or c
ctcgtgtcaggaggaaaactgtactctgctggtctctactccaggtttgagcaagccagangacaaaggcaaatgatgaaccatttaacagctctgtagtttccatttggtacactacaag

SEQ ID NO: 12410 - DNA, 121 bp, Artificial Sequence
  Synthesized
  misc_feature (61): n=t or c
agtatacaaatatccctgaattagtagcctataaagctcactacatagtgatttctaaatnatgaaagttctttggaaagtcttaactcatatctatgtataacaactctctgcattaaag

SEQ ID NO: 12411 - DNA, 121 bp, Artificial Sequence
  Synthesized
  misc_feature (61): n=t or c
gtgcagtagagccctttctctttgacatcttgaaaggacttgtctgcattcctctgtgctngcaaagcccttgctgctgtttaggtccaaggcagctatcccctgtccagcccacggaaga

SEQ ID NO: 12412 - DNA, 121 bp, Artificial Sequence
  Synthesized
  misc_feature (61): n=a or g
tcagaggctgaaagcatgaggctcaaaaacatcaggagatcttcaataggacaaccaggcntcaagaacacatctctggaactctttccacccgtgttgtgcagcagaggctttcctttgc

SEQ ID NO: 12413 - DNA, 121 bp, Artificial Sequence
  Synthesized
  misc_feature (61): n=a or c
agaaggaatttggtatcaatcacttcagaaatactctgatcagtccaaacgaacaacattnagcacttgggtattacatccatagcattgtacctttcggcatacgtatcctgaatgaaaa

SEQ ID NO: 12414 - DNA, 121 bp, Artificial Sequence
  Synthesized
  misc_feature (61): n=a or g
aaacagaaaaacaaaatgtcatagaagactacttaggctctcttcagagaagcctctatanccagtggcttccagtaaaattcacaacagagaaaataattttcatttctgttcatcattt

SEQ ID NO: 12415 - DNA, 121 bp, Artificial Sequence
  Synthesized
  misc_feature (61): n=t or c
cgcagttgctaacacaatgtatggccatgttaaagcaataagtgtaattaagtttttaggngatgtgagatattcaataagaaatcgcatgattaaggtcagatcagaaaacgatgttctc

SEQ ID NO: 12416 - DNA, 121 bp, Artificial Sequence
  Synthesized
  misc_feature (61): n=a or g
gagagcttatttttagctctgcaaagtatttctgggagtcgaggagacgctgttaccatcnccatgcagagaaggcactgaggtattggcctcactgatgcttttccctctatagcttgtg

SEQ ID NO: 12417 - DNA, 121 bp, Artificial Sequence
  Synthesized
  misc_feature (61): n=t or c
ttcagacagcccttaggaaagtgaaattggagtatctttaagtctagagtgcccaaagagngcaaccaaagggtacagtaaagctcatactcctaacagaggatagagatgatgcttgacc

SEQ ID NO: 12418 - DNA, 121 bp, Artificial Sequence
  Synthesized
  misc_feature (61): n=a or t
agtttggctctgcatcagaaaataatccctgaaagacagaagagatactctttagcaggancttttcatgactgggtacatagttgttattttctttccttttcaaaatattactcctcag

SEQ ID NO: 12419 - DNA, 121 bp, Artificial Sequence
  Synthesized
  misc_feature (61): n=a or g
agagcaattactgcttgcgggccttgtttgtacaaggtgaaaaagagggtagtcatttatntgcttgtacagagaatgtagaccagagtcaagtgaggagaaaagctatttcttaatctac

SEQ ID NO: 12420 - DNA, 121 bp, Artificial Sequence
  Synthesized
  misc_feature (61): n=t or c
tgatgttaaaggtagcagaaatgaggaaaagctctaagacacctcacagaaaacactacanttccagagcaaggaaaacattaaacccagctaagacctatgctgaaaaggcatcatcatc

SEQ ID NO: 12421 - DNA, 121 bp, Artificial Sequence
  Synthesized
  misc_feature (61): n=t or c
actgtcaagacacaaacaagtctacagacttttaggttaatataaatagctgaaaatgtanatattctcaaactatttcatgttcagttgaatacagtaagcagaggttatgcacttgtga

SEQ ID NO: 12422 - DNA, 121 bp, Artificial Sequence
  Synthesized
  misc_feature (61): n=a or t
caagaaaccaccctttttccttcttgtaaaagcacagcttacacaagcaccacatttacgnactttaaacttgattgaagtcattgtgataagaataccgagcagcagtaagcaatcacaa

SEQ ID NO: 12423 - DNA, 121 bp, Artificial Sequence
  Synthesized
  misc_feature (61): n=t or c
cctgtgcaaggacagcaaaaggagccaggtcagtatgcatccacggcagccatcccaatcncacagattataaacacatgacatgtgaacctcctttcccaaactaaagccctggccagag

SEQ ID NO: 12424 - DNA, 121 bp, Artificial Sequence
  Synthesized
  misc_feature (61): n=t or c
aaatttatttaattgtaatgtgcccagctcctagaactatgttaagagatccaaatttganataaaagaaggaaaatacagccataaaactaattttagaggctggattggatatgcacaa

SEQ ID NO: 12425 - DNA, 121 bp, Artificial Sequence
  Synthesized
  misc_feature (61): n=a or g
tcctgacatagttgaagcactctgaggatctggcaaccagctgttctagcttttttagagnagaactaaagtataattgaattcctaaaccatatgtgtgtatcactgtagttgaatagca

SEQ ID NO: 12426 - DNA, 121 bp, Artificial Sequence
  Synthesized
  misc_feature (61): n=t or c
aagtttgaatttagagccatttcttcagctcttcggcctccttaactgacaaaacacaganacatgtgcaggtataaccgaaatcttaactacacttctgagattacaaggataacctgct

SEQ ID NO: 12427 - DNA, 121 bp, Artificial Sequence
  Synthesized
  misc_feature (61): n=a or g
taggaagacagtaacattccacactaaggagatattaataagaaagtaataatcaatgccnttttttgacttccatttcttttgattcagcattacagtaatggaaaagaattgctgtaca

SEQ ID NO: 12428 - DNA, 121 bp, Artificial Sequence
  Synthesized
  misc_feature (61): n=a or g
gaacagataggagagagatgagttgaagtaaatcactgcttgatttttcaggtggtgaagntttggagggaatgtcagcacaaactgtctagcaactgattgggtgtgtgtaactaagcat

SEQ ID NO: 12429 - DNA, 121 bp, Artificial Sequence
  Synthesized
  misc_feature (61): n=t or g
catgtccttcaagtttttccacattactctcacccatgattgaaacaaaaacataaccaanatttctattttttaaaggacaaaaaggcagtggtggatgccatgaaaaatgctccctgaa

SEQ ID NO: 12430 - DNA, 121 bp, Artificial Sequence
  Synthesized
  misc_feature (61): n=c or g
cctccaggatcaacccaaggcctctccctagagatgatatacctgtgataggatccagtgngggctggtcctgcatttgtcagtcacttgaggaggcagaacagctctcagaggagggaca

SEQ ID NO: 12431 - DNA, 121 bp, Artificial Sequence
  Synthesized
  misc_feature (61): n=t or c
tgcgtgctgtatacacctggtgctgtgcgccgtgtgttctgtgctgtgtactttgtgctcngctccatgcgtggtgcgctgtatcctctgtgctgagcaacgcgagctgtgcagtgtgtgc

SEQ ID NO: 12432 - DNA, 121 bp, Artificial Sequence
  Synthesized
  misc_feature (61): n=t or g
tatgatcatatatactttatgcttaagagaatttagtgtccttctcttgaatcatttgtgnttttggctaatatgtcttgcaagtgagcttttcaatggagtatttggtaaatgtaaatat

SEQ ID NO: 12433 - DNA, 121 bp, Artificial Sequence
  Synthesized
  misc_feature (61): n=a or g
tgtttcatacttgcacttaagaaaatatcacctttcccttcacatatgaaggtctatgtanttgtagcatttcttctgacttaaaatacaacactatattttatcagttttccaactttga

SEQ ID NO: 12434 - DNA, 121 bp, Artificial Sequence
  Synthesized
  misc_feature (61): n=t or c
ctggcccaacttaatgatcttcttccttctttcagagctcctagtggtacttgcaaagatntgattgcataagttagctgcagtttagatggtctcacgatttattagacagctagtttgg

SEQ ID NO: 12435 - DNA, 121 bp, Artificial Sequence
  Synthesized
  misc_feature (61): n=t or g
agaagcagtgtcgttccaaaggctaggcaactctttacacgtctaccacaacactgcagtncatcagtactactttccatgtgccacagtcagattttttaagccttctgtgacagctcct

SEQ ID NO: 12436 - DNA, 121 bp, Artificial Sequence
  Synthesized
  misc_feature (61): n=t or c
ctgtgtgaggttataaataccagctgcagctctgtaacaagtaaatcctcgctttgaattnacgtagagcgcgttttggagaaacgaaaagtcttaattgaaggaagagagcagaaatgcc

SEQ ID NO: 12437 - DNA, 121 bp, Artificial Sequence
  Synthesized
  misc_feature (61): n=a or g
cagacatatattctccaacttcagaatttaaaaacaacatatgctacactcttattaaacntaagatgagtccttttttacctcatcattcatcaatttatggctataagaatatgaaaac

SEQ ID NO: 12438 - DNA, 121 bp, Artificial Sequence
  Synthesized
  misc_feature (61): n=a or g
caaagccaggattaccaaagtctgtgatcagggatcaaatgccagagcagaagtgaaatgnactacatgctgcatgatcagagggttccctagcttgtgttagcaaagcctttctgccctt

SEQ ID NO: 12439 - DNA, 121 bp, Artificial Sequence
  Synthesized
  misc_feature (61): n=a or t
ggtttggtttaacgtgaaatcagatccttgggtagaacttgagttgtttttccgagtatcncttgcttctgttgcatgtagagtagaagatgcccagtttggtgttggggttaagccttta

SEQ ID NO: 12440 - DNA, 121 bp, Artificial Sequence
  Synthesized
  misc_feature (61): n=t or c
tgtctcagtccccatggaaccagccccaggctcagctgcctctgctcagaggtacttgtcnaaccagctcttcgatttctgtgtctccctgaggcccccttgttaccttccttggttcctg

SEQ ID NO: 12441 - DNA, 121 bp, Artificial Sequence
  Synthesized
  misc_feature (61): n=a or g
agggaggggaaaagaggccaggtgcagagtgagcccattcccaatggaggtaaatgaactncagctgtggaggtggccaagccccagtaactcactgggacaccaatagatagaggcaggg

SEQ ID NO: 12442 - DNA, 121 bp, Artificial Sequence
  Synthesized
  misc_feature (61): n=t or c
tgtgcttttgggaatcctcttttgaggtcccctttggggtcaactcttggccatccacttnttgggatctgcttttggctgtccacatttggggatcccctttttagatgctctgcttttt

SEQ ID NO: 12443 - DNA, 121 bp, Artificial Sequence
  Synthesized
  misc_feature (61): n=t or c
gagaattcactgaagggtgggatttcttcatttgtttgttaccagtataataatatgcttnggatccttagtaaagaacttcattctctgctgcactgtgaggcagggattgaagaatgct

SEQ ID NO: 12444 - DNA, 121 bp, Artificial Sequence
  Synthesized
  misc_feature (61): n=c or g
ggagccaacccaggcagttctgcatgggtttcttcctcctgaaatatttaatttccttacntcctatggccaggttgaagtagatgctccctctgcagaaagtgttttctgatatccctaa

SEQ ID NO: 12445 - DNA, 121 bp, Artificial Sequence
  Synthesized
  misc_feature (61): n=t or c
gaagcaggcttttacctaacaccagcctcaccaggcacttgaaaaataaatagcccccccngagctgttctatttacccagcagctataagacaccagccctgcgcctcaggctgagctgt

SEQ ID NO: 12446 - DNA, 121 bp, Artificial Sequence
  Synthesized
  misc_feature (61): n=c or g
tggctttgctgccaaattataatctgaactacgttgatttttagcacccccagaactgctntacttaccagatgatagctgaaaccccactggaagtcactgtaggcaccagaagtacagc

SEQ ID NO: 12447 - DNA, 121 bp, Artificial Sequence
  Synthesized
  misc_feature (61): n=a or g
ttcatttcactaccctatttcactacacacagaaagtttcaagacatcatgatacaaatangctttggaaagtaaacagtgatggttacgactagcaatctaaaactctagtccatacatt

SEQ ID NO: 12448 - DNA, 121 bp, Artificial Sequence
  Synthesized
  misc_feature (61): n=t or c
gttttctgcaaagacctaatgaactgggttttactgaggcagatgtgaaattgaactcctnagaaatgcttatactgtatttgctggctcttcccactgaagacagaatgtttctgaatcg

SEQ ID NO: 12449 - DNA, 121 bp, Artificial Sequence
  Synthesized
  misc_feature (61): n=t or c
agagtgtaagagctgcatcagtggggtaacccttgtgcggcactgcatcctgtcgtggggncggctgcagcagatggcaatttgtgatatgtctgtagatgtatctgcagattgggccttt

SEQ ID NO: 12450 - DNA, 121 bp, Artificial Sequence
  Synthesized
  misc_feature (61): n=t or c
acttcaagctctgttcaagatggaaatgtctcgggcaactcgcaccttcctcccaagcccnttctatttatgccactgagttaatcaatcattaaacaacacatcttcaacagtcaaaatc

SEQ ID NO: 12451 - DNA, 121 bp, Artificial Sequence
  Synthesized
  misc_feature (61): n=t or c
aatggagcgtgacagggttgttatgaccattattcattataagtattacgggcttgctttntctgttttaggtgagagctgctagtgatgtgctgaataaggagggactcggctccttctc

SEQ ID NO: 12452 - DNA, 121 bp, Artificial Sequence
  Synthesized
  misc_feature (61): n=t or c
ggctttattcctgttttagattagtttcaatttggatgtctttcatgaaatgttgttgganctttttatttcctctagttgctctaccattttgatcacgtttacagtaatccttttcttt

SEQ ID NO: 12453 - DNA, 121 bp, Artificial Sequence
  Synthesized
  misc_feature (61): n=a or g
tcatagcaggctgttttcttctggtcattaggatcaacactgggggcatccacaagaaagnaaccagaaagagtgagtagttcaagaagtcatcacatcaaatcgtgactctagggtgagg

SEQ ID NO: 12454 - DNA, 121 bp, Artificial Sequence
  Synthesized
  misc_feature (61): n=t or c
gcaggatgacagggtctgaatcagaataaaggtagtggccttagtgtgaaaaaaggagtgngcctctccaaaatttctgtatgctagttcagttactgggtcacttccagggttcaggcag

SEQ ID NO: 12455 - DNA, 121 bp, Artificial Sequence
  Synthesized
  misc_feature (61): n=t or c
ataaccaaacagagggcatactgagccagccattacctttgttctcactgtaagaaagcanatctgaacagaattgttcacatacctcctgtttacatcaaaaattaaaaataaacagaaa

SEQ ID NO: 12456 - DNA, 121 bp, Artificial Sequence
  Synthesized
  misc_feature (61): n=t or g
ggaaatattgcaatagcatgatactgtatgatccaaaattattttccactttcaaatcccntattaacagactgaactttgcatttgtggtcttaagtatttgtaggactaaaacttttaa

SEQ ID NO: 12457 - DNA, 121 bp, Artificial Sequence
  Synthesized
  misc_feature (61): n=a or t
gcttgatgccagctctgtagaactcaagcacttttgtgctcatttagcagaatattactgnaaagctgtttaacaattatcatatctcttgtgtttcaacattgcaaacaggcacatttct

SEQ ID NO: 12458 - DNA, 121 bp, Artificial Sequence
  Synthesized
  misc_feature (61): n=a or c
gtagtgtacaaaggaaaataacgtgggggatcctttgtgcactaactgctggcttagagcntcagcaaaataactttgtttttagtgctgttttcaaatatttacccgtacctctgtgcac

SEQ ID NO: 12459 - DNA, 121 bp, Artificial Sequence
  Synthesized
  misc_feature (61): n=a or g
gttttggaatgctcaggaatgatacaacagaatccattcttattctttcttttgccatcanccactctatagtactatgcgtgtttatttttataaagacgggcaaagacaattcagtttt

SEQ ID NO: 12460 - DNA, 121 bp, Artificial Sequence
  Synthesized
  misc_feature (61): n=a or c
tcactagaaaaacagacagtgtacccagcaacgggagtagaatggaaaaaagagtaaattnaagacttgtttcaatagtataatttgtatagattaaaacagtgtaaatcttagactgcca

SEQ ID NO: 12461 - DNA, 121 bp, Artificial Sequence
  Synthesized
  misc_feature (61): n=t or c
ttccaaacaaccagagtttcttcccctctctttcctgacttgaagcaaagcaagcatctgngaacagtaaaacctctggtacacaattaaataacttacatcagcatttcccatttctaaa

SEQ ID NO: 12462 - DNA, 121 bp, Artificial Sequence
  Synthesized
  misc_feature (61): n=t or c
ctgcctaatgacagaatgactcactcagagtataattctatgtcgtaaggatttttgctcnggccttagacccagctctttctgttcagtattgtcattaatccagtgggtgataaaatag

SEQ ID NO: 12463 - DNA, 121 bp, Artificial Sequence
  Synthesized
  misc_feature (61): n=t or c
ggatctgcatcatgtagcaggaaacttctgcttgttatctgaggcttccagccttcaaacncagcaaggtgtcagcagaacttggcaaccttgcaatgctcaggccttacaaggccatggt

SEQ ID NO: 12464 - DNA, 121 bp, Artificial Sequence
  Synthesized
  misc_feature (61): n=a or g
ggttaccagagatgcatttatatgcaactctacctctccgagtcttgtgagacattctggntgatatctttttaatggtaatagccacaagttataaggtgtgccttgagacaggatggct

SEQ ID NO: 12465 - DNA, 121 bp, Artificial Sequence
  Synthesized
  misc_feature (61): n=t or c
aacactaaatctccacagtgattttgtctatgcagctccaccaccattctgcatcctgtgngcttatggcttgttcccaggacccttgcagttcctctgcccttcctaagtagtagagaaa

SEQ ID NO: 12466 - DNA, 121 bp, Artificial Sequence
  Synthesized
  misc_feature (61): n=t or c
taggaacatataaagacattcctgagaagactgcattaccagcacatcacagccactgttnagtactgtagacttcactcattctctgtctgaataagatcaagcttaggtagcacctgtg

SEQ ID NO: 12467 - DNA, 121 bp, Artificial Sequence
  Synthesized
  misc_feature (61): n=a or g
cagttcctcacttgaccaccagtatttgtcaaacaaatacagcagtacttcctcctagggnaagaaaaaaaatagcaggaagagtcatcttaggacaacaacactgtttggaaagagaggt

SEQ ID NO: 12468 - DNA, 121 bp, Artificial Sequence
  Synthesized
  misc_feature (61): n=t or c
actgagatgacatcgacaaatatactttataatccagaatactatacaatatagagtcagncaaagttgcatttaaccctatatcactggaagctctcattaggcaaacatttgttattgt

SEQ ID NO: 12469 - DNA, 121 bp, Artificial Sequence
  Synthesized
  misc_feature (61): n=a or g
gatgggttggtggttggatgaggggatcttaacagacttttccaacctcagcgtgtccacnattcctacacaaccccacacatttcgtggcacttcggttcattttctgaacaccattcca

SEQ ID NO: 12470 - DNA, 121 bp, Artificial Sequence
  Synthesized
  misc_feature (61): n=a or g
ctccaacaccaacctggcgaaagcagcgtttgtagcaagtggtcacatctccttcagcccnctcctgttcctgactcagagcttaaaagcacaaagccgaatgccccaagcctgcagcacg

SEQ ID NO: 12471 - DNA, 121 bp, Artificial Sequence
  Synthesized
  misc_feature (61): n=a or c
acaaggagagaaaaacagatttgaaaatttgtgatttaaacataagagaaattcagacagnctttcagcctcaagaaggataggatctgcagcctaaggagggaggataaggttatagcct

SEQ ID NO: 12472 - DNA, 121 bp, Artificial Sequence
  Synthesized
  misc_feature (61): n=a or g
tttgtagccattttactattcctgtcttgcagctcccactatctctgcatcatctcttgangctgattgaccagagctgaacgaattaccgtcagggcagacttgacacttactgaacatt

SEQ ID NO: 12473 - DNA, 121 bp, Artificial Sequence
  Synthesized
  misc_feature (61): n=a or g
ttccaacccaaactgttctgtgattctagggttctgtgatgctgtgatcttcaagccaaantctcacagaatgtcagtaactgatacttgctaactctggcccaaattcactccccatgtg

SEQ ID NO: 12474 - DNA, 121 bp, Artificial Sequence
  Synthesized
  misc_feature (61): n=c or g
tgtatccttggaccttggattgttacagaacccctgaaagcctgagtgtcttcatgtgtgnccctcacccaaagcagtaacagacttgctgaaaatgattcgtgtagatgatagcacccca

SEQ ID NO: 12475 - DNA, 121 bp, Artificial Sequence
  Synthesized
  misc_feature (61): n=a or g
tatgaattccatcatgtagttcagagcacaagttgggccctaacttctgtgtttgggaaantattcagggttaagtgctttggataaggatgcagctgaactaacattctctgaaatctat

SEQ ID NO: 12476 - DNA, 121 bp, Artificial Sequence
  Synthesized
  misc_feature (61): n=t or c
ttttgtcagcccttctctaactttctgtgattgctttcagtttgaggcctgtcatggcctncttgcccaaccagctctgctaccagtcacacacttgccatggttgcagaagagcatcctc

SEQ ID NO: 12477 - DNA, 121 bp, Artificial Sequence
  Synthesized
  misc_feature (61): n=c or g
gggctcttctgccagggaagggtatggcagagggcacagggaaacattcactcgaaggcanagactgacatgctgcttgctctgcagagtgggagaagaaacctgtgtgcagttatcacta

SEQ ID NO: 12478 - DNA, 121 bp, Artificial Sequence
  Synthesized
  misc_feature (61): n=t or c
agagaaagaatatgaagaaaagtttatagaacagatcctcttatcaaggtttccggactantgaaaggcacatttcactgatgctgaatgacaatggagttcgtggacacatacagtgctc

SEQ ID NO: 12479 - DNA, 121 bp, Artificial Sequence
  Synthesized
  misc_feature (61): n=a or g
gtgcagccatcctttccccagccacgtgctcaatccacccatggggcaccagtgggtaagngacagcagggacattttggactgtgtatgcttttagcctccacggtgagcgcaccgaagg

SEQ ID NO: 12480 - DNA, 121 bp, Artificial Sequence
  Synthesized
  misc_feature (61): n=t or c
tttgtgagagttatgtaaatacggcgcagttgaaccaacattatacaaaatattaaagatnatctgtcttccttaccttgtacttctcatcttatgctgaaataggttcatattcatttgc

SEQ ID NO: 12481 - DNA, 121 bp, Artificial Sequence
  Synthesized
  misc_feature (61): n=a or c
ttattattttgcagcaacactgaaagctcaacattcaagctgcaattgctaatcctggtangtccacattaaccaagatcacattaagtaagattagtaatagacagcgtgcagttattgt

SEQ ID NO: 12482 - DNA, 121 bp, Artificial Sequence
  Synthesized
  misc_feature (61): n=t or c
ttcaccttgcgcatccagggcatgcagcggtgcaacccggccttctgctttcagctgcacngtcagaacgtaactgctgcaaactgttgggctgcaagtgctgcaaaccccagcatcagcc

SEQ ID NO: 12483 - DNA, 121 bp, Artificial Sequence
  Synthesized
  misc_feature (61): n=t or c
ctgcctgagagctgctagctctggccttgcgtgttgcccgtgtgctgtttccaaagctgtnggaaaccagagttggggaggaacataaatccatgttcgtgtccgaagtcagaaatattac

SEQ ID NO: 12484 - DNA, 121 bp, Artificial Sequence
  Synthesized
  misc_feature (61): n=c or g
atagtaatttctttaggaagtaagctcaccctccctcatggaagggcttttagaagacagnggaactccttctggtgccagctacacagcagtgtactgaagtacatgctctctttattta

SEQ ID NO: 12485 - DNA, 121 bp, Artificial Sequence
  Synthesized
  misc_feature (61): n=c or g
tttgattgttcctagtccaaaacatcccttacttttttacaggatagatggtgttgttaantatgatatgaacagccatttctgtaacatgatatgatgtgtccatacttcccaaaggtga

SEQ ID NO: 12486 - DNA, 121 bp, Artificial Sequence
  Synthesized
  misc_feature (61): n=t or g
atttaatcagttcaagatcactgccccaatttttctgactccagttgactgacatcgcaantagaccgacatcatagtaaaggtgtgctccacaatttggcttacaaatgaagtactggaa

SEQ ID NO: 12487 - DNA, 121 bp, Artificial Sequence
  Synthesized
  misc_feature (61): n=a or g
atattctattgaaaaatgaagaaaagtctaatgaaaatgttttctggcatgtgactgaagnttaactgtcacttatctctcagaaatcatgtttgacataatgttttcagaaattttaaag

SEQ ID NO: 12488 - DNA, 121 bp, Artificial Sequence
  Synthesized
  misc_feature (61): n=a or g
aaaccgtggaaatccttcccttccaatcagtagacagacagatctcctaacgaacttcttnccaattacagaactgctgggacttcagcgctcactgctctgaactcactgctgcacgtaa

SEQ ID NO: 12489 - DNA, 121 bp, Artificial Sequence
  Synthesized
  misc_feature (61): n=a or g
tttttgggttttgttttgttttgtttttttggtaggaatacaaacatcaaggaagaaagancatcagtcatagattcacaattaacatatgcattagtgctaaaggattccatttggttta

SEQ ID NO: 12490 - DNA, 121 bp, Artificial Sequence
  Synthesized
  misc_feature (61): n=a or g
tcaaattcactctacagtcattgttggacactttcaacactctgcttctgttcactgacantgtgcgttacactatactatcactattgcacttttcctttgctttaggtcaaaaataatt

SEQ ID NO: 12491 - DNA, 121 bp, Artificial Sequence
  Synthesized
  misc_feature (61): n=t or c
aaggagaatttcccataagtcaacttgtttctgtaagagataaaaatgagctattctaatntctctacatcagatttaatttgctgattttttttactttaactacagatcagtgctcttc

SEQ ID NO: 12492 - DNA, 121 bp, Artificial Sequence
  Synthesized
  misc_feature (61): n=c or g
tgggcataatcaatcctcatctccatacagcaatcaggtatggttttggaacctccttagntaactcaactcctcctggccatatctgaacataacaacataaatgcaactttcactgtgc

SEQ ID NO: 12493 - DNA, 121 bp, Artificial Sequence
  Synthesized
  misc_feature (61): n=a or t
atgacagaaacgtcagctgtcgtaaaaaacggcatcgtttgaaacctctaaaatattccangtatatcgatgccattttaattgcgtaattttttcggataaaataaacgtagacaatata

SEQ ID NO: 12494 - DNA, 121 bp, Artificial Sequence
  Synthesized
  misc_feature (61): n=t or c
aaagtagaaaatataaatgcaaaggtagaacatgcaactcttacagtgtcccttactttcngcattctttccatagaagtgatgtacctgaaacagactaccatgttgaattagcgttttg

SEQ ID NO: 12495 - DNA, 121 bp, Artificial Sequence
  Synthesized
  misc_feature (61): n=a or g
tgattcaagtcttattattttggcttagtttcagaaattttaattgaacttatttcttcantcttgtgagatcatggaactgtatatctttctcttagctgcttaagaccttcaatgacta

SEQ ID NO: 12496 - DNA, 121 bp, Artificial Sequence
  Synthesized
  misc_feature (61): n=t or c
aatgacaatatttccttatttcagccataagaacagaatctgactgccagacaacttcccntcctctggcaccaagtgcagaggagaaagtaactcatggcttaatactttcagaatgggc

SEQ ID NO: 12497 - DNA, 121 bp, Artificial Sequence
  Synthesized
  misc_feature (61): n=a or c
tactaaacaaagattttgtctcagtttaagatgtcccaaactcagaagctgtgtctatttnttctccccatgcttttcacatctgaacttctaggctgggtatggggagcaaaatctgtcc

SEQ ID NO: 12498 - DNA, 121 bp, Artificial Sequence
  Synthesized
  misc_feature (61): n=a or g
cacacatctcttactggttgacaatggcacccacgggcacccaacaatagaggcagaagtncgaactcagttagaaaagtacatttcggagcgagttatcccaggtaggtgtggatgtcag

SEQ ID NO: 12499 - DNA, 121 bp, Artificial Sequence
  Synthesized
  misc_feature (61): n=t or c
tcaagagcaatacagcaacatcacagtgacatgaggaagctcttacagcactccccgacantttttactcaagtgtttatgtctgtgtgttcacaggactaaatgtatgaagttgctgaag

SEQ ID NO: 12500 - DNA, 121 bp, Artificial Sequence
  Synthesized
  misc_feature (61): n=t or c
tgatatccaaccaaccgagatctcatcatctcctgcccatgcacagctgctgaaccagctntgcagatattctcctcccccaaaaatggaaccatagcttaaagccctctcagtccacagg

SEQ ID NO: 12501 - DNA, 121 bp, Artificial Sequence
  Synthesized
  misc_feature (61): n=t or c
cctaaaagattttatacacctgtctttggactgtctcaatattttcacttgaaatagtctntctgttcaactcaggtgagcttgagcaaatcaagaaaaggaaggactggtttggggcaca

SEQ ID NO: 12502 - DNA, 121 bp, Artificial Sequence
  Synthesized
  misc_feature (61): n=t or c
agctccttagctacacctctgtttctatcttgctggatggtctggggcaagtcacctcaancttctgggccctagtttcctcacatatgaaatggagttaacaagacttctttgaagcttt

SEQ ID NO: 12503 - DNA, 121 bp, Artificial Sequence
  Synthesized
  misc_feature (61): n=a or g
ttgttccctgggagcagggatgctgctgactcagggatccacagctgcctctggacagctnagttgaggtttgtgatctagatcccactgtgtttgttttgcccatgcaatgagactgcag

SEQ ID NO: 12504 - DNA, 121 bp, Artificial Sequence
  Synthesized
  misc_feature (61): n=a or t
gccaagagagccagtaaagccttcgggaaaataatagctaaagcagtgatgattttggagntgtctaaaagatgtgcattgtgtgaactgggaaagagaggagagttatgaacatgggatt

SEQ ID NO: 12505 - DNA, 121 bp, Artificial Sequence
  Synthesized
  misc_feature (61): n=a or g
gccgccccttacatggagcttgattgagcctgagatgacatttagggtgacttctctcaanctggccatacagttatcttttctttatctcattctgtgatttctcatttgccttcccttt

SEQ ID NO: 12506 - DNA, 121 bp, Artificial Sequence
  Synthesized
  misc_feature (61): n=a or g
gttagaagatccaggtgcaattaaatgctttcccttgagcttcttctgtatatatgtaacncttgaaaaatcacaaaattgttgtgacctaagctgcttagagttttctgcttaaaataat

SEQ ID NO: 12507 - DNA, 121 bp, Artificial Sequence
  Synthesized
  misc_feature (61): n=t or c
actttcatttggggggaaattaactcagccttcaagctcaatagctttcctttccctctcnctacttctttaagcttgatagaaaggcagattgatggacgtgaagaaaaggcaagtgtaa

SEQ ID NO: 12508 - DNA, 121 bp, Artificial Sequence
  Synthesized
  misc_feature (61): n=a or g
gctgtcagagctctttcttgaccacttcatcacgacagggcaaggcagaaaaagaatcacnctacagcagctccgagaggtctgttctttaatacagaggatccactggagggcaagactg

SEQ ID NO: 12509 - DNA, 121 bp, Artificial Sequence
  Synthesized
  misc_feature (61): n=t or c
gcgacagcatggctgtgatacagatgctgcccactctttctgggaaaaaatgtgaatggtngaaagggccagagcagactgcattagtgaaagccactctctcactggtgcagcaactacc

SEQ ID NO: 12510 - DNA, 121 bp, Artificial Sequence
  Synthesized
  misc_feature (61): n=t or c
cctatttgtagattcttggagggcaggaaattgccttcctgctatggagagagagactganccttgtgctttgagtcagctgaacagtaagtagatgatcctgttgtaactgatctctgca

SEQ ID NO: 12511 - DNA, 121 bp, Artificial Sequence
  Synthesized
  misc_feature (61): n=t or c
tgactaatccaggtgaaggtaaaaaggtgatgttggcagactacacaaattccttagtgantttgatagataacttaaaatgaggcacagttcttttatacctgtgcctaaatgagtgttg

SEQ ID NO: 12512 - DNA, 121 bp, Artificial Sequence
  Synthesized
  misc_feature (61): n=a or c
agtctccttaaacatgtatacacagcttaaaaatgtcttttctgtaattttatagcccccnaaaatcccactctaacatagaagatatgttcatatagatctgtcaggcttttaacacagt

SEQ ID NO: 12513 - DNA, 121 bp, Artificial Sequence
  Synthesized
  misc_feature (61): n=t or c
tggagagagctggaactaaggacaaagatatctggctttctgactattgtaacatatctangtgatgcttctgtccctttcttaaaattccttaatccttaaaataccttcaaaaatatta

SEQ ID NO: 12514 - DNA, 121 bp, Artificial Sequence
  Synthesized
  misc_feature (61): n=c or g
gctgccagttcacagcagttcagaagcaccttttcattaataagtagtccactaagatganaattgggtgaatgctgttgcctggtgaaattcatctgctttctggctcatggtctgcttt

SEQ ID NO: 12515 - DNA, 121 bp, Artificial Sequence
  Synthesized
  misc_feature (61): n=a or g
tctgcgtggccagctcagcaggctccttactggctccttaccagcacatctgaaggagagngaaaagcagctctgctcaaagcgatccccagactttttgctcgtaggctctcaaacagtc

SEQ ID NO: 12516 - DNA, 121 bp, Artificial Sequence
  Synthesized
  misc_feature (61): n=a or g
ctttgatctctggtgcatcccagcacagggcagcaagttcacaaggaggaacacacagacngagccagatctaggaaaggcttaaaccctattgcagccaagagtatttaaataactgagg

SEQ ID NO: 12517 - DNA, 121 bp, Artificial Sequence
  Synthesized
  misc_feature (61): n=t or c
cttgttctaatttgctgacatttctggatgcagaattaatatctacttgcgtggttcacangagtatcccaagaacaattttcccaagtttattccatgtacatgtacaatacaagttaaa

SEQ ID NO: 12518 - DNA, 121 bp, Artificial Sequence
  Synthesized
  misc_feature (61): n=a or t
tctttgtttggatttaatttaatgttctctgcatatgaggcacttctatcaaacggaggantcttcacacatagatagaaacgcctcacattggcctattagtactaaattgattcatgat

SEQ ID NO: 12519 - DNA, 121 bp, Artificial Sequence
  Synthesized
  misc_feature (61): n=a or g
gagtccttctatcttggaaagctactgtggtggtactccataagcaacttcttaaaacaanacattacctgttgagtacttcatttccttacattatttagaaaagatttgcagaaaataa

SEQ ID NO: 12520 - DNA, 121 bp, Artificial Sequence
  Synthesized
  misc_feature (61): n=a or g
aacagagaatgcaaaccctacacaagagactacagtatacatctcctgtgtaatggatgtntacagactgtataaaatgtcttctgtcaccaaaatttttcagatctctgagaaatttaat

SEQ ID NO: 12521 - DNA, 121 bp, Artificial Sequence
  Synthesized
  misc_feature (61): n=a or c
tattctgtactgatgtcttcaaaaggatcctaaaaacgcgacgagagaacaaattagaganccaaaacccatgcacattaagcatcttcattttagaggtgagaggacatcccaacagtca

SEQ ID NO: 12522 - DNA, 121 bp, Artificial Sequence
  Synthesized
  misc_feature (61): n=a or g
tgtgtccctcctcccagtgttgggtctttgcacaaattggaattacctaaaaatctgattncagcttcaggcaacgagctcttttgcaatgtgctaacagagcccctcactctcagtcctg

SEQ ID NO: 12523 - DNA, 121 bp, Artificial Sequence
  Synthesized
  misc_feature (61): n=a or g
caggagggaggacaagtgtatgaattccatgcagatgctatcatttattgttgatgccacnacccactgctaacacagagggttgttatcattcatgcactgtgccggataggtacagatg

SEQ ID NO: 12524 - DNA, 121 bp, Artificial Sequence
  Synthesized
  misc_feature (61): n=t or c
catgctgcatgctctcttgtgttctgtgtacagcctggggcaagcctctgaagacctgttntgactgctctttagtccttccacaggaagtattcaaccagtttgtgctactggggtgagg

SEQ ID NO: 12525 - DNA, 121 bp, Artificial Sequence
  Synthesized
  misc_feature (61): n=t or c
aaacctgatgtgaatactttaaatacaaggatattttctaagaataattatcacatgctcntaccagtgctacagtcaagaaaatcaactttaaaaatctgatggtctctcttgtgataaa

SEQ ID NO: 12526 - DNA, 121 bp, Artificial Sequence
  Synthesized
  misc_feature (61): n=t or c
agacatgatatgtctatgagataataaagtccagtatgagcccatacaaaatcagaagaanggaagcttattgtcgcaaagtcattgggaatgttaccgtgagtatttattgccttcgaga

SEQ ID NO: 12527 - DNA, 121 bp, Artificial Sequence
  Synthesized
  misc_feature (61): n=a or g
gagggggagtgatgctcttcagaggcattgttagggaggaggcgtaattgtgctcactggnaaagccaggatgcaattacagagcattgcagagccttgccacaacattccagcatcaggg

SEQ ID NO: 12528 - DNA, 121 bp, Artificial Sequence
  Synthesized
  misc_feature (61): n=a or g
ggcatcttcgaggcagtggccagcacagggcccagttcagggccataaaagacaaagtagncattagagatccatatacagtatgaaaatggaggaagagaggaggcttgcacttgggttt

SEQ ID NO: 12529 - DNA, 121 bp, Artificial Sequence
  Synthesized
  misc_feature (61): n=t or g
tggtgcttcacacaatagaattgctaattggtttcaatggggatacaaaagcatagtgcantggggcggtatggaaatacataagctgtctagaacaaccaacttcctcaaagccaaagag

SEQ ID NO: 12530 - DNA, 121 bp, Artificial Sequence
  Synthesized
  misc_feature (61): n=c or g
taaatacaaattgatagtaaaaaaggggcaaatactagctggaacagagttctcacagcancagaaaaaactaatcttcatatgctatataataagcagccacatggagaagagaccatta

SEQ ID NO: 12531 - DNA, 121 bp, Artificial Sequence
  Synthesized
  misc_feature (61): n=c or g
tttctttatagtggtttacatgacctccagatatatggagataaactatatattgttattnatactatgattattgaaaaaacagaagatctgtgagttacagaatcacaggactgcaaaa

SEQ ID NO: 12532 - DNA, 121 bp, Artificial Sequence
  Synthesized
  misc_feature (61): n=t or c
gtatccacatatattagtagtttagtgtgtgggcagataatctattaccatggcaaaactntcctataagtctctcaaggctgctatccctgctactactttcaccattttgcaatgccat

SEQ ID NO: 12533 - DNA, 121 bp, Artificial Sequence
  Synthesized
  misc_feature (61): n=a or g
tctgtgcctctttgattcttcaaagatgtagaaataagtctttagaaaaaaactggtaagnctgagagggaacaaatgaaggtacaatgacggtaatttttttctccttgatttgacagat

SEQ ID NO: 12534 - DNA, 121 bp, Artificial Sequence
  Synthesized
  misc_feature (61): n=a or g
agtcacatcctcaagtctagcatagtcttcctgttaatcccatcctggtgtgcagaagagntctgtctttgctttgtggtatagagaaagaggaaacatctgagattacctgaaggtagtt

SEQ ID NO: 12535 - DNA, 121 bp, Artificial Sequence
  Synthesized
  misc_feature (61): n=a or t
aggataagaagaaatctactctgacttcctgcatcacagcaataagattgttaaatttccnctgagtagtgagtcatccagtttctggctgaaatcaaatctagtgaatgtaagctttttg

SEQ ID NO: 12536 - DNA, 121 bp, Artificial Sequence
  Synthesized
  misc_feature (61): n=a or c
tcagtcactaatgcataaagactcttacggcatggctatctcagctctgtctgctaagtcnattggactatctctgagagactacagaacctttcatgtgatggttggaaaagttgcctgt

SEQ ID NO: 12537 - DNA, 121 bp, Artificial Sequence
  Synthesized
  misc_feature (61): n=a or g
ttcaaacagtgtctgtaaacagtgttataatacagccaccaactcaaccatagcgtatcanttgagaagtcagggaacaaaatcttctgccattagctgcctccagtttgtatctggaatg

SEQ ID NO: 12538 - DNA, 121 bp, Artificial Sequence
  Synthesized
  misc_feature (61): n=a or g
ctgcacattttgaaacttaagggtgccttgtaacttaggtgtggtgttagaagtttttctntgttgccttgctgggaagcgaggagaaatttaagtattagcatttcctttgatacaggcc

SEQ ID NO: 12539 - DNA, 121 bp, Artificial Sequence
  Synthesized
  misc_feature (61): n=t or g
aacctgaaaaaaatcaagatactgggatactttcaaaacaagcacaatataagcaacatgntgcctctgaggaaacttcacagaatgcttaagagattttgttacccgtattcaagttctg

SEQ ID NO: 12540 - DNA, 121 bp, Artificial Sequence
  Synthesized
  misc_feature (61): n=t or c
agattgtcttcttcctgggttaccttactgagtaaatgcctctctaaaacacatacagtcncttaaaagagcaaatccttttatttaaatccatcagcatatgtaatattgtttgttgttt

SEQ ID NO: 12541 - DNA, 121 bp, Artificial Sequence
  Synthesized
  misc_feature (61): n=t or c
catctcccagaagctccttgtctccaaggacaccagcaaattcctgttgcatttggtgganggttaggcctcacaacagcctgtgaacatttccctgttttgcagaaacaggaaacagaag

SEQ ID NO: 12542 - DNA, 121 bp, Artificial Sequence
  Synthesized
  misc_feature (61): n=a or g
gcatgtgctcagaaataagatggtggcatgatgctatgtaatagctgtatttcaatatgtntaagcaacagcagtgaagtttctccaaataatcagtccacatattcttagtcaagcagaa

SEQ ID NO: 12543 - DNA, 121 bp, Artificial Sequence
  Synthesized
  misc_feature (61): n=a or g
aaagattgcacagatgatttatattgctcctgaataatttgctgtggacataaaatgtaanatgataaatgccttttgatttattatttagagaaatagaagtattggagaaggtgtaaaa

SEQ ID NO: 12544 - DNA, 121 bp, Artificial Sequence
  Synthesized
  misc_feature (61): n=c or g
gcattgttctcctgtgcacaacaatttgtcccagcatctaattggtccatctagctggctnccatagaaagtcctttttactacagataagggtttatgcttctgatcaaagtttgtttgt

SEQ ID NO: 12545 - DNA, 121 bp, Artificial Sequence
  Synthesized
  misc_feature (61): n=t or c
gcagctctattgtggcacagctgtcagcagcctgcctttctgaaggacgtgagaaacgtgngaagcagagttaccctgaaaacactgagggaacttcccccagtatttctccctattgtga

SEQ ID NO: 12546 - DNA, 121 bp, Artificial Sequence
  Synthesized
  misc_feature (61): n=t or c
gcattttccaaatctctttgtgacaacttttcttgccaagggatatgagtttggattcaancagctaaactcagggaagataagaacaggctcagtatcttgacagtttttgatccttact

SEQ ID NO: 12547 - DNA, 121 bp, Artificial Sequence
  Synthesized
  misc_feature (61): n=t or c
cctaaattaataatcttggctctctatggaaagaaaaggcttctatcagaagagtttatcncgtcagctcattgtctttattgagcctttgtattataggcagcagaagctcataataaac

SEQ ID NO: 12548 - DNA, 121 bp, Artificial Sequence
  Synthesized
  misc_feature (61): n=a or g
aggctgaggagaaatgggatcgggggaatcttctgtgagaatcttctggcttcaaagtcanggagcagagcagtacaactagtccacggtgtgggagccctgcagcagcacagagagacag

SEQ ID NO: 12549 - DNA, 121 bp, Artificial Sequence
  Synthesized
  misc_feature (61): n=t or c
cttactgtgccttttcctcagaatgtataggcactacagaaacagcacccagtgcttcagnagccaaaaagaaattagaggaaaataaatctcctcctccctgctgtttgcttgatatgtg

SEQ ID NO: 12550 - DNA, 121 bp, Artificial Sequence
  Synthesized
  misc_feature (61): n=t or c
tgtggaaggaggttaatggggggttggccaggttctgtagcagctagggttctctaaacancctaatgagctagaagagcaggggaacagctgaagtcccaacattatttaggttagcaag

SEQ ID NO: 12551 - DNA, 121 bp, Artificial Sequence
  Synthesized
  misc_feature (61): n=t or c
cctgattgttttcctgttttgagtgctaggaagagaaaggagaggacttatcttcttcctncttgcagtcctcaatacctggtgtttctactggaattattatccttgtattgatacaata

SEQ ID NO: 12552 - DNA, 121 bp, Artificial Sequence
  Synthesized
  misc_feature (61): n=a or g
gaggctggatgaatcaccctgttggatcctttgaggctaaaatagtactattggaaagagncagtttttgttagctatgagtgaggctcagtgattgcttctagacttgaaacattctgca

SEQ ID NO: 12553 - DNA, 121 bp, Artificial Sequence
  Synthesized
  misc_feature (61): n=a or g
aggaagaaagttagaccagaactggatctgggatcattgaaagatctggcaaaagcagganagaatgagaactgggcttagctttgtcctgatctgactaaccagaagggctgcatgtggt

SEQ ID NO: 12554 - DNA, 121 bp, Artificial Sequence
  Synthesized
  misc_feature (61): n=a or t
gaagcttcagtccttgtaagtgttgttaaaaaaggagacgcaaagctgtataatgagaaantttgttaaatatatcatgtgttaaactctgctttcctgcaacagattgacagccagaaac

SEQ ID NO: 12555 - DNA, 121 bp, Artificial Sequence
  Synthesized
  misc_feature (61): n=a or g
accccacttgacctaacagtaacaaggttttgtttgagtgaaccatatggaataatatgangttggagtaatcttttaagtttcaaattccttcagatttcagaatgaccctcagtgtttt

SEQ ID NO: 12556 - DNA, 121 bp, Artificial Sequence
  Synthesized
  misc_feature (61): n=a or g
aatattttggtatgtattcatggtgccacctcagttattacaacttcatgcttgtcaaaanctaggagctttggaaagtcacatctaaaaaagtatttacatctttcactaatttaatcct

SEQ ID NO: 12557 - DNA, 121 bp, Artificial Sequence
  Synthesized
  misc_feature (61): n=t or c
acacaagcgaaataatgcaatgaactggaatccagagcttcaaatttttttcggaaagtanttcattctctcttcggcttgaaaacagtttgaacaaccagcctttactaagtgtaattta

SEQ ID NO: 12558 - DNA, 121 bp, Artificial Sequence
  Synthesized
  misc_feature (61): n=a or g
tttatgtgacagaaatggtcagatgaaattgccgatcagatatagtggtctattctgactntaaaatggtgaagtgaatgccagaccttaaaatgcttaaaggacatgcaaggaaaaagaa

SEQ ID NO: 12559 - DNA, 121 bp, Artificial Sequence
  Synthesized
  misc_feature (61): n=a or g
agagatgtgccaaatgcatcattttgtcacagagcatcgaagccaagtgatgggtgattcncagcccagtttgacctttttgtagggagctggtgggacaacacctctcccacactgagat

SEQ ID NO: 12560 - DNA, 121 bp, Artificial Sequence
  Synthesized
  misc_feature (61): n=t or c
tatgattcttctgagcacaggagatccttcataagatttctgagtcactcttcagtaccantgagcacttctaaaggaaatgctcctcagtttgcaaactccatatgagactgataggaag

SEQ ID NO: 12561 - DNA, 121 bp, Artificial Sequence
  Synthesized
  misc_feature (61): n=a or g
ggatgcacattcctcaattttaacataagcaacttttatacatcatatacatcagtgaagncttctttcaagttaacacatgctgtgtgttctgtactttctaacgaagaaggataaatct

SEQ ID NO: 12562 - DNA, 121 bp, Artificial Sequence
  Synthesized
  misc_feature (61): n=t or c
agatgtctgcacagattgtaatgctatctgaactgtgtgggatgtgggattccacttttcngggggcacagtggtgctttcagcatctgtccctcttctctaaacagagtaaagattccca

SEQ ID NO: 12563 - DNA, 121 bp, Artificial Sequence
  Synthesized
  misc_feature (61): n=t or c
cttcagcttttggttactttttgctttttgtcatctgctttacttccataggttttgcagngtgtttatttgtgaggcttgagctgaaggtaaaataaggtgattcagctctctgaggtta

SEQ ID NO: 12564 - DNA, 121 bp, Artificial Sequence
  Synthesized
  misc_feature (61): n=t or c
ctgggtctctggcaggtagaagcagctgtgaaaatacctaatacccagaacaagcgttacnagacattcttttttaaacagcagtcagctatcaagtgttattatacaataactaaatcag

SEQ ID NO: 12565 - DNA, 121 bp, Artificial Sequence
  Synthesized
  misc_feature (61): n=t or c
agatggtaaacactttgaaactaattaatctgaggaaattgaatacctgatttgtattgantgtgcaaatgtcattgctttgctcttcaagagcactttccagaatgtcatgtaaagctac

SEQ ID NO: 12566 - DNA, 121 bp, Artificial Sequence
  Synthesized
  misc_feature (61): n=t or c
tacggtcattaaactaaagccgaaaacctaccccaaagagtgactgttagcctccttagtntccttgtagtcccagaagagatgatttcgggttcacatctctgaatacgatgcagaaagt

SEQ ID NO: 12567 - DNA, 121 bp, Artificial Sequence
  Synthesized
  misc_feature (61): n=a or g
ccagcagcaaaatgtaggaacagccaattctccttaaaggacggagggctgaattgaggcnctgtcatagctacatatgaacttcatctcattaatgggtactggctatagcatgcctaaa

SEQ ID NO: 12568 - DNA, 121 bp, Artificial Sequence
  Synthesized
  misc_feature (61): n=a or g
cctttatttgtcaaaacattttttcaactttagctcctgtcatgagaagatcagtttccangtaaatcttaaataccctccgctacatggagaagaaaaacaacaacaacaaaaaagggtc

SEQ ID NO: 12569 - DNA, 121 bp, Artificial Sequence
  Synthesized
  misc_feature (61): n=t or c
taagcactgtaaaatcagaatgcatcggttctgtgttgagtgttgctgtgatggaaatgangaaacaaggaatagctacttatctgaatacagatatctcaacactagctaagcacagaca

SEQ ID NO: 12570 - DNA, 121 bp, Artificial Sequence
  Synthesized
  misc_feature (61): n=t or g
tcaattataagtgtcatcttttaggattaaaatgaaaaatcactaatactcctacttaatntgtagctcacagatttccttcagcataagtaacaagttcaaactggaaaaagcagaagca

SEQ ID NO: 12571 - DNA, 121 bp, Artificial Sequence
  Synthesized
  misc_feature (61): n=a or g
ggggtctgtctgctgtacgtttaatctcacagcccttctgttgatgcctgaagttcagaangcactgctgtgtccagatggcgtctgaaggttggacattcagagggggtattcagcctct

SEQ ID NO: 12572 - DNA, 121 bp, Artificial Sequence
  Synthesized
  misc_feature (61): n=c or g
ttaccataagcaggagcaataatacataggctatgacacaggaaagcgcttcaagctcatngttagcagagatttaaacatgaattaaactaacttgataacacctgtaagcactatctaa

SEQ ID NO: 12573 - DNA, 121 bp, Artificial Sequence
  Synthesized
  misc_feature (61): n=a or g
ctaattggatcccagacaacactgtctcatgaagtccttgcagaaatacaagtgtacatgnagtcaggtggaaagagggacatgtaggctgaaaagcagagagcaaccaatcagtttaagc

SEQ ID NO: 12574 - DNA, 121 bp, Artificial Sequence
  Synthesized
  misc_feature (61): n=a or g
gccttcccctgcctctcatatctcaaaacctcaggactatgcaggcaactactgctgacanaggagaaagatcccaaaatatttggctgcccgtgagggattcagtggttccctgtgcttg

SEQ ID NO: 12575 - DNA, 121 bp, Artificial Sequence
  Synthesized
  misc_feature (61): n=t or c
attcagtgcagatgctctccagcccctgttacgctgggtgtaaatccagttcagctccacngacaggagaggagttatgatttacatcagtgaaaatgagaccaaaattcattgaaattag

SEQ ID NO: 12576 - DNA, 121 bp, Artificial Sequence
  Synthesized
  misc_feature (61): n=a or g
ctaagtgaggaaaagtgtaagacgttacagtaatataatgtgttatttctttacaagttancttcaactctacataccacaccacagatgaaataacaccaattttcatttattaatgtta

SEQ ID NO: 12577 - DNA, 121 bp, Artificial Sequence
  Synthesized
  misc_feature (61): n=a or g
ggaacgaagcctgggtgatttgccttgtgttgaaggcagtcagtccttaaggatgccctcnctgctcttgtgggcgaccacacgttgctctggcacagccccacggggtcggcatcgtccg

SEQ ID NO: 12578 - DNA, 121 bp, Artificial Sequence
  Synthesized
  misc_feature (61): n=a or g
ccctagaaatactcttcatgattttataatggcatagctagacttctaacacaaaaatctnagtgtgtataccttattagacacacaactaatttcattaaccttcacctgtagtactgta

SEQ ID NO: 12579 - DNA, 121 bp, Artificial Sequence
  Synthesized
  misc_feature (61): n=t or c
tcatcatctttgtatgactacaagtgatcatgttaatatgtcttaacaaggtctcatctgncagccaagttttgttgcaaagtatagggtgtactgcagagatccacactgcaaatacagc

SEQ ID NO: 12580 - DNA, 121 bp, Artificial Sequence
  Synthesized
  misc_feature (61): n=a or g
caggaaagaatgtaaggtttatttaaagaactgcttccaaggagatacctttggctgggantctctttgctttttgggctgggcttcttcccaccttgctggaagccaactctttcctcag

SEQ ID NO: 12581 - DNA, 121 bp, Artificial Sequence
  Synthesized
  misc_feature (61): n=a or t
tgatactgcgttgactttggcaacaaagggaaattagatacaactctaatgagaaatcttnacagaactgctgcttccattctgagtctatataaagtactttgagattaatccaagaagg

SEQ ID NO: 12582 - DNA, 121 bp, Artificial Sequence
  Synthesized
  misc_feature (61): n=a or g
gcttcttccatagaactgcaacagcagtcatattacaggaaaggtcataaaagtgcacacntgaaaatatcccaagaattctttccttgacatctctaatgtaactcctgtgactccaagg

SEQ ID NO: 12583 - DNA, 121 bp, Artificial Sequence
  Synthesized
  misc_feature (61): n=a or g
aatggtaacagaatctgtgagtagccaaatgcttctgacttctagcttacaaatgtcctcnttgatttacatttcaaacttttctctagagttgtggaagctgtaactgaaagctgagatt

SEQ ID NO: 12584 - DNA, 121 bp, Artificial Sequence
  Synthesized
  misc_feature (61): n=t or c
aaggcagaagacctccacaaagtgacgcaaggaaacatcccctcacttacagatgggactnctgccatttattttgccccagatgacagaagctgctttaagctcaggtcggcagatcaca

SEQ ID NO: 12585 - DNA, 121 bp, Artificial Sequence
  Synthesized
  misc_feature (61): n=a or g
ttttgtgtcattattaagattgctaaatgtaatgctatgctgacttgagaaaactgtaacnatgacgattattatttaagaatataaccctaattacattaaaataaaataataataatat

SEQ ID NO: 12586 - DNA, 121 bp, Artificial Sequence
  Synthesized
  misc_feature (61): n=a or t
ccctccgtccactcgcaccggtgcagaggacccacaacctcaggacatgtaagattggtgngaagtcgttcatagaagggcagcgagctccctctgctgccagacttctgcaagaggcagg

SEQ ID NO: 12587 - DNA, 121 bp, Artificial Sequence
  Synthesized
  misc_feature (61): n=a or g
attcagttctatgtgcatgaataaatacacagtgaattcttcgtatatcatgtaaagccangtgattttggatgtattgtaaataaaattcagatttaaagttgtgctgaatcttacaagc

SEQ ID NO: 12588 - DNA, 121 bp, Artificial Sequence
  Synthesized
  misc_feature (61): n=t or c
agtaatcactgtattcgatccaatttttatgtcactagtggcttcccacatacttttttcngcaagtctccactgaattcaaacaagcctattctgattcataagaataggcgacttagcc

SEQ ID NO: 12589 - DNA, 121 bp, Artificial Sequence
  Synthesized
  misc_feature (61): n=a or c
tggcagttcaaggagctggttgtgttgcacatccaggacctccacttgcgttcgttcaagncgatctggtagccttcctaacaagttatgtcctgccagcagtttacgcaagctgctgttg

SEQ ID NO: 12590 - DNA, 121 bp, Artificial Sequence
  Synthesized
  misc_feature (61): n=a or g
tttcacagagatgctgctcaaagagcaattgggctgatgctatgacctgctctcatttccnggaagagcatttgagataaactgttcctgcagtgggcagagagtgtttagtagttgcaga

SEQ ID NO: 12591 - DNA, 121 bp, Artificial Sequence
  Synthesized
  misc_feature (61): n=c or g
gatatttttctctttgtccattgatctgagcactgccctacatggatctgaagggtttcantgtgtctcacaaatcccagtgaaattgactctcatttatcctgttatttggctatttatt

SEQ ID NO: 12592 - DNA, 121 bp, Artificial Sequence
  Synthesized
  misc_feature (61): n=a or g
cacctcatacagaaatgtagtgctctaacaacttttgacttgtatattgtgaaagtagctnctgctgaaggatgcaaatacatttgacatgcagagacagaaaactggaaattaatatatt

SEQ ID NO: 12593 - DNA, 121 bp, Artificial Sequence
  Synthesized
  misc_feature (61): n=a or g
aaaaacacctctttgtgtggctgtgaggtgtaatccacccaacctgtcctatctatctgcntattactggctgtagcaattaaatttgctttaaatgtttggaatcattagggccatattt

SEQ ID NO: 12594 - DNA, 121 bp, Artificial Sequence
  Synthesized
  misc_feature (61): n=t or g
ccacttaggagttaagtatttaacacaataaatgcttatataacaggaagaagagcagganagacactgccaggcttaagttaggatttataaagccagtatgttcttccaacggtaactg

SEQ ID NO: 12595 - DNA, 121 bp, Artificial Sequence
  Synthesized
  misc_feature (61): n=t or c
tgaaatacttttgccttaagctttgctgtctcaattattaaagaagggactcagagttccnactgttcatcagtatccattaaagtacaatctctttgagcgtggtggtgttgtctgtcct

SEQ ID NO: 12596 - DNA, 121 bp, Artificial Sequence
  Synthesized
  misc_feature (61): n=t or c
gcgttctcattcaaaaggcaggaagcagttccgttaccgaaacggagacgagtcacgtggngcccaaatgcatctcagctccagcgtgtggcgttcaccttcattgctgccccccgccaaa

SEQ ID NO: 12597 - DNA, 121 bp, Artificial Sequence
  Synthesized
  misc_feature (61): n=t or c
gctgtaatcgatgattcttaggcgagctctgagcctcgtgaagacgtagagagtcgtgccngagaagggttttgtcccctctctctggagtttgcgagctgtcccttccagggaagggtgc

SEQ ID NO: 12598 - DNA, 121 bp, Artificial Sequence
  Synthesized
  misc_feature (61): n=a or g
tctcaccacccacacttctgagctaatattctgtaagcttcacactgtggaggtaagtacntgataggcgagggaggttcctgagcagatagaagttgctggaagagacaatgtgtagatg

SEQ ID NO: 12599 - DNA, 121 bp, Artificial Sequence
  Synthesized
  misc_feature (61): n=c or g
caaaaacaccggaattactcacagctcaacagagtgggggccctcattgcagggaatgcancccccacaattagcagtgagtgcactgcgggcagcaatcaggcgcagccaggaggtgaga

SEQ ID NO: 12600 - DNA, 121 bp, Artificial Sequence
  Synthesized
  misc_feature (61): n=a or g
acagcccctggagtgaagacccggaccccaaacgggaccacccaaagcagaagaaaccccntggagaagggtcctgggaggatgctggtgtgagaaccaggcataaagcaggaactcatca

SEQ ID NO: 12601 - DNA, 121 bp, Artificial Sequence
  Synthesized
  misc_feature (61): n=t or g
cagcaggctgctgctcagccactgaagagacagggaaaggaggagtgaaccttcgtcctcncccagttatgcagtgggatcaatctatttatcggaagagttcaacaagacagaaatgcac

SEQ ID NO: 12602 - DNA, 121 bp, Artificial Sequence
  Synthesized
  misc_feature (61): n=a or g
atgtgtcaatatatgtgcagacagcatgcaaaggagtagtaggatggaaagcatgaaaggngtaaagtcagtgtgaaatagcaaaatttatcccaacaagctcattgctcttactttccct

SEQ ID NO: 12603 - DNA, 121 bp, Artificial Sequence
  Synthesized
  misc_feature (61): n=a or g
gaaatgttgctgaagaccctcctggtcttcagcaccaggaactgaccaacctcagtgcctnctgtgacctactccacagccacatagtctgagagcagataccaacctgcagagctgccct

SEQ ID NO: 12604 - DNA, 121 bp, Artificial Sequence
  Synthesized
  misc_feature (61): n=t or c
aaagattggcaagccaaaggcttcctagtggaccgattaaagtttctttgtcaaatagaangatttgctttgccacagcttttaatgataaaacgctgaactctagaagtatttggctgat

SEQ ID NO: 12605 - DNA, 121 bp, Artificial Sequence
  Synthesized
  misc_feature (61): n=c or g
aacttatatactgatccctaaacaaaccaacctgtatcattgtcttttatttgaaagtganatgaagaatgttaatgtggcaggacttgagcttaagttatttttcaaagcaccattgtgt

SEQ ID NO: 12606 - DNA, 121 bp, Artificial Sequence
  Synthesized
  misc_feature (61): n=a or t
gcaatacttaggaaaaagttataacaccattttgcaaaataaaatgtcactgtaattaacntagctgctgtgtggtacatgttacatttatgcagaagatgtaatgcacccactgtgttgt

SEQ ID NO: 12607 - DNA, 121 bp, Artificial Sequence
  Synthesized
  misc_feature (61): n=a or g
ctatactggaagcaatggtcaaatcgctaagcaaaagacagacactgtaaaagctgaccantggctactcattggctgaaagtgctaaaaagggcacgtgatatcaacaaacctcaactgg

SEQ ID NO: 12608 - DNA, 121 bp, Artificial Sequence
  Synthesized
  misc_feature (61): n=t or c
accctgttccctttgcctgttccccaccttactcctttaaacaagtccattttgtcctgcnaaaaccactgttgcttacctcactgagtaacaacaaaacctccaggaattgggcagagag

SEQ ID NO: 12609 - DNA, 121 bp, Artificial Sequence
  Synthesized
  misc_feature (61): n=t or c
accgttggtaatgattggttataaccagctccagcacacgtgagctctcattcagcgactnctgttgggcccatctcactcctgaaggtgttcccaaaaagcctgcgtttcccatgaactc

SEQ ID NO: 12610 - DNA, 121 bp, Artificial Sequence
  Synthesized
  misc_feature (61): n=a or g
ataacgttaaggtgctgtggaacactaacgactacctcagagccgaagagtaatttcctcngtgttttattatccaggtacaaaaataagaagacaagattaacactcactttaaaattac

SEQ ID NO: 12611 - DNA, 121 bp, Artificial Sequence
  Synthesized
  misc_feature (61): n=t or c
caagctgcactatcagcgatgcatttttaggtgcttaaaacgaggagctgaagaggacgangtataagcaagaaaaatatgaagtttgtggctaatcatgcaacacgtactcgattcttga

SEQ ID NO: 12612 - DNA, 121 bp, Artificial Sequence
  Synthesized
  misc_feature (61): n=a or g
ctttttcagatcctaacttaacaataagcccttaaatatgtaaatatgaaaaaacaaaggngtattatctgttgcacacattcattctttaaactcatttgtgtcatttacattcgtatcc

SEQ ID NO: 12613 - DNA, 121 bp, Artificial Sequence
  Synthesized
  misc_feature (61): n=a or c
tccctgcattgcacttgagagtgaaaagagaacatttacttcttcatttcttaagaagtgncagccaatctttcatagactcacaaactgagattagttagtaatcaagctcaatggatcc

SEQ ID NO: 12614 - DNA, 121 bp, Artificial Sequence
  Synthesized
  misc_feature (61): n=t or c
tcacatgaataaaacccacagcctatgttgcagatatcaatctgaatgtgatgaagaccantgtatttcattttactcactgtctatctcaccgcaaaatctttactgaaatacgatgatt

SEQ ID NO: 12615 - DNA, 121 bp, Artificial Sequence
  Synthesized
  misc_feature (61): n=t or c
tttccattgtatttttggatctgggaatcaaagttacaactgacacagaaaagtctagttngttggcagagaagtcactactgtcactagggaaaacaaggtcttatgagtacctagatca

SEQ ID NO: 12616 - DNA, 121 bp, Artificial Sequence
  Synthesized
  misc_feature (61): n=a or g
ctggtctgctggggatgtgctgtccccagtggatgcaggtgaagtaggagagctggccttncacctgggaggaagcaagataaccagaaccaaaatggagtctgcaggaaaccaggtgttc

SEQ ID NO: 12617 - DNA, 121 bp, Artificial Sequence
  Synthesized
  misc_feature (61): n=a or g
ttcacagcatttctgtcttactgttcactgttttgcaaggatttttaatacaaatttctgnccatttgctatggttaacgtgtaaacaagactgtatcacaagcgtggaaagacagaagtg

SEQ ID NO: 12618 - DNA, 121 bp, Artificial Sequence
  Synthesized
  misc_feature (61): n=a or t
ggaatatgatgatgcagatgatggctttcaggctttgcctgaagtcagttctgcaccactntccatataaagcattctggcttccctctatcatacagtaaaagagcaaggaaaatgattt

SEQ ID NO: 12619 - DNA, 121 bp, Artificial Sequence
  Synthesized
  misc_feature (61): n=a or g
aacttaaaatcagaagggaaaaaaaagggtggatcagaagaagaccctaattaaccagggngaactgttctaggaagtgttagtatgtttgctcatttcagtgctctgatttgctcaatgc

SEQ ID NO: 12620 - DNA, 121 bp, Artificial Sequence
  Synthesized
  misc_feature (61): n=t or c
cgtgcagatggccagcaccagtaagactctttttgatgtgctatcctcacatttgcactcntggcaccagacaaaccatgaaatacaggagcaagttcagtgaaaggtcccggtgatggct

SEQ ID NO: 12621 - DNA, 121 bp, Artificial Sequence
  Synthesized
  misc_feature (61): n=a or t
tgtcttctgcaagcttagctctgtacctgcacttctgccgtggtaataaaaccagcgtgcnatcctgaatgtctgtatttaactgtgtcaattcagagggcagaaaaaatgcacacacgca

SEQ ID NO: 12622 - DNA, 121 bp, Artificial Sequence
  Synthesized
  misc_feature (61): n=t or c
ttccccaaaggccagaaagaaatgtgtgaaatagttaaatattgcaagaccaatgcgtttnaagctagtggaacagaaatagctctacttttaggctgcagctcaactcagctcatctccc

SEQ ID NO: 12623 - DNA, 121 bp, Artificial Sequence
  Synthesized
  misc_feature (61): n=t or g
tttattattgatacagtaataagttattcaaagaagttcaaacagagagactcatggctgnctgtgtacaatactgttcattttcaagatgtgttttcattactggaaaaataaaacatac

SEQ ID NO: 12624 - DNA, 121 bp, Artificial Sequence
  Synthesized
  misc_feature (61): n=t or c
aactcttttctgcttcacaggtactttactttctgaaacagcttgtatgctgtatgtctcngctcaatttcggctcttttgtgttacatttgcctttaaattgattgcatgtaattaaaga

SEQ ID NO: 12625 - DNA, 121 bp, Artificial Sequence
  Synthesized
  misc_feature (61): n=t or g
caggtatgaaatactgactgtgcacatcagtgtctgtatgcctgccatggtctttccaggnctttgcagggccttctcataaagaggagaaacacaaagctgaattacgaggtcaaaagtg

SEQ ID NO: 12626 - DNA, 121 bp, Artificial Sequence
  Synthesized
  misc_feature (61): n=t or c
atctcttggtatatatctgtgcatatgtttggattgggcagctgacttaacataatacccnatttttggtgtatgccagatgccttaactcttgatgtggatagccttgccaatacactgg

SEQ ID NO: 12627 - DNA, 121 bp, Artificial Sequence
  Synthesized
  misc_feature (61): n=a or t
taaactcgtgacaaaccattttgtctctaagattttttaaaggctactaaggatgtttagnaatctgtagtgaaacttcctccagtaatctttttgtcatctacatagtatataacggtat

SEQ ID NO: 12628 - DNA, 121 bp, Artificial Sequence
  Synthesized
  misc_feature (61): n=a or g
gggttctgctgagaccaccagccccgaaaataacacagcaattgaaaacgccaagacaacnttacagcactcggcctcagatcgcggtcagaagtgagcagcaccagcaacccgaacaaga

SEQ ID NO: 12629 - DNA, 121 bp, Artificial Sequence
  Synthesized
  misc_feature (61): n=a or g
atattgaaaacaactagagatagagcttcataaaaattgaattgattgtcactcatttagntcacttctgatttaccatctgaacaggagttgtggattggggcccttctgctcacaagaa

SEQ ID NO: 12630 - DNA, 121 bp, Artificial Sequence
  Synthesized
  misc_feature (61): n=t or c
accataggacttactgagatgcaaatctggatactcactttatgatatctggtcaggtaantcagtacagtttggatactgagcatatggatggactggagcaccaggctgaaccactagg

SEQ ID NO: 12631 - DNA, 121 bp, Artificial Sequence
  Synthesized
  misc_feature (61): n=t or c
gaaatccctcaaaggctattaaacacaaaaatacggcctctggctcagaaattcaatgagncacagattgctggaagctaagtgtgaatatgctagtgttttgttgccatacgcttgctct

SEQ ID NO: 12632 - DNA, 121 bp, Artificial Sequence
  Synthesized
  misc_feature (61): n=t or c
ggcactaaatttaaaaattttttaagaagattgtataaggagaattgtacattcatacagngtttaagacagtctccatgcttcatgtcttgaacatgtcatgacagttctctgcttcgtg

SEQ ID NO: 12633 - DNA, 121 bp, Artificial Sequence
  Synthesized
  misc_feature (61): n=t or c
cctgatttaatgtatattcacatacaaagtcaggaggatatgaatgacttcctagtaaaanaatctttgtatttatgagagtaaaatcttcatatcaaagaaactagataatagtttcatt

SEQ ID NO: 12634 - DNA, 121 bp, Artificial Sequence
  Synthesized
  misc_feature (61): n=t or g
tgggcattttttaaaatatttgaaaatacagatgaaagacagataagaatttgtctgatanttgggaaaccttccttctaagacatttcagttttacatatccatgaggagttaaaattgc

SEQ ID NO: 12635 - DNA, 121 bp, Artificial Sequence
  Synthesized
  misc_feature (61): n=a or g
acactgtggtggttgaatatcgtatttgcttccttgtgggtcacaccataaatagctatcntatttctgttccctttgtactagcaatttaagtagaatgtgttgaattgcagagagaagc

SEQ ID NO: 12636 - DNA, 121 bp, Artificial Sequence
  Synthesized
  misc_feature (61): n=t or g
aatcagcatcaactcctcggccataatcacttcctccttggcttctgctcagcactgcacngtgtctcactgcagaacagagcctccatgggctgcacgtgtcagtgcagtgctatagata

SEQ ID NO: 12637 - DNA, 121 bp, Artificial Sequence
  Synthesized
  misc_feature (61): n=a or g
actacgaagcaacaaaacgacttcagtgggagcttcacaggactttttaacatggatgganatagaaagcaatcacagaaaacacaacaaaatgagtcacggtgttcggaggagactttcc

SEQ ID NO: 12638 - DNA, 121 bp, Artificial Sequence
  Synthesized
  misc_feature (61): n=t or c
cctccttcagcaagcccaccaccaccttctcctgtttatgacgtgagtatcagaatcaccntccatctcaacagaagtgatacctatatggctggcaaccccatttctgcgctctgccctg

SEQ ID NO: 12639 - DNA, 121 bp, Artificial Sequence
  Synthesized
  misc_feature (61): n=a or g
ttttcatgctttatagcaaatcctatcaaaacaagacagatctgtaatgatgttgctgtanactacttttcatttccagtagtgtgcatttttttcttcagacttactaatgcagattcct

SEQ ID NO: 12640 - DNA, 121 bp, Artificial Sequence
  Synthesized
  misc_feature (61): n=a or c
attatgtaaaataatgtttcctgtgtgcataaactggaacataatattgtaagtaaatccnagcagttaaagaaaccgtagtagttttttctatattctttaatgaaatgtttcttatctg

SEQ ID NO: 12641 - DNA, 121 bp, Artificial Sequence
  Synthesized
  misc_feature (61): n=t or g
ttttgctcagttggaactgagcttgacaaaatctaaatctagcatttctcaagttggctanatttcatttaccttgttatatcttaagcataagcatagctacatgcacacatgcatattg

SEQ ID NO: 12642 - DNA, 121 bp, Artificial Sequence
  Synthesized
  misc_feature (61): n=t or c
tggactgagaagcagtgctccctgaatgctagcgttctcaatatctgacgttagaattttncatccattcaccactgtctgcacccatccacctgttagtgaagtgacacagcacagatct

SEQ ID NO: 12643 - DNA, 121 bp, Artificial Sequence
  Synthesized
  misc_feature (61): n=c or g
ttctcttgtgtagcaggattgtttgtgcgatgtcaatacagctgtcaaatctttaactcanaaaaactattctgctgaagattgacaaatagacccatgattaaatgaatctaaagcaagc

SEQ ID NO: 12644 - DNA, 121 bp, Artificial Sequence
  Synthesized
  misc_feature (61): n=c or g
ctataatatttccatattatggactacaatagcctcatctgttaaatagagaagatgcagngtgcatgaaattgtacagtgctctgagttctctacagagataagtgaagaaataagaaca

SEQ ID NO: 12645 - DNA, 121 bp, Artificial Sequence
  Synthesized
  misc_feature (61): n=t or g
agggccggcagagctgtggacggggcagtttggagagctgtgctttgttttagtgccctcngtgcagagtttgcacatctcagcctctcttgggagagctgcaggtgccggctctgctttc

SEQ ID NO: 12646 - DNA, 121 bp, Artificial Sequence
  Synthesized
  misc_feature (61): n=t or c
gtgtggccctttccagcttccataaggatcctgcggttccagcactgcactgtaaaaatgntttttggatgggccaaagcacagcaccttggatttgtttagaatcatagaatcattaagg

SEQ ID NO: 12647 - DNA, 121 bp, Artificial Sequence
  Synthesized
  misc_feature (61): n=a or g
cctttaagaattcttactggtgcctagctgcttttaactgaatttgttgaaaacatcggtntcagcagaacacaaagttccacatgagcatagtcagaaggaaggtatgggtaaagaccca

SEQ ID NO: 12648 - DNA, 121 bp, Artificial Sequence
  Synthesized
  misc_feature (61): n=a or g
tctctacagaaaagcttattttctgagtaaagcacagccttagaaagctaagacttcttcngtggttttgagtgttcactctggatccaacacctatttttttgtgataaaccagctgtca

SEQ ID NO: 12649 - DNA, 121 bp, Artificial Sequence
  Synthesized
  misc_feature (61): n=t or c
ccccatttttctcccaatctttctctcctgactttatttctcctcttaaatactgaatgcnttttaaacttgaaacctcgagttacctgtagattttggcatctcttgttgttaattgtct

SEQ ID NO: 12650 - DNA, 121 bp, Artificial Sequence
  Synthesized
  misc_feature (61): n=a or g
aataatactttattaatgtgtattttaaaaactgatacaatagaaataagctgtgatcccnttgtttcctaacaaatctcattaagaaattgggcccatagtcctattatccaagtaagca

SEQ ID NO: 12651 - DNA, 121 bp, Artificial Sequence
  Synthesized
  misc_feature (61): n=t or c
gaagtggactgaaaaaacccacaactttcacctaagtgaataatgtaatttactcaagacnacaatagagctcgcatcagtttggctgggaattctggtgccatcctggtgttctaaggat

SEQ ID NO: 12652 - DNA, 121 bp, Artificial Sequence
  Synthesized
  misc_feature (61): n=t or c
ctttgaaaaagcgtgagtcagcccattaatatatgctgaaaatttctatcgctaccactgngctgttaaaagcctctcaaatttaatctctgcattaaaaaaaaaaataataaagaaaaag

SEQ ID NO: 12653 - DNA, 121 bp, Artificial Sequence
  Synthesized
  misc_feature (61): n=a or g
accaagaaaaaatgagtatatcattgttgtgtcatgacttgaggtcatgaagagctttaancatgcaagtggtgctggttgagaccctcaacctgtaaagtccacacctgtcaaatgaagg

SEQ ID NO: 12654 - DNA, 121 bp, Artificial Sequence
  Synthesized
  misc_feature (61): n=a or g
agtcataatttactcatgaagtgtgtttgattgttacatctgctgaatgagtaagtcatgnatgctgaatatttaaattttcccagacttaagtcatgtttatactatcagaacaaagctt

SEQ ID NO: 12655 - DNA, 121 bp, Artificial Sequence
  Synthesized
  misc_feature (61): n=a or g
tcttgtgccaccaagaagatgtatgacagtggcattaaagattatctcacattagccagtngacttaccatttgccagcttttactccttggcttggaacctgtggtccacccatatcacc

SEQ ID NO: 12656 - DNA, 121 bp, Artificial Sequence
  Synthesized
  misc_feature (61): n=a or c
acgaaaagctagaagttataactttgatgcacctataaatgaaacggccttaaagctgtgngctgcgtttggatggtgcgagctgtgtgttctcaatacctgctttatgctgctcctctcc

SEQ ID NO: 12657 - DNA, 121 bp, Artificial Sequence
  Synthesized
  misc_feature (61): n=t or c
ttgttccttgcagatttcctcagaaatacctttcaacaattgttttctctttcaggaaccnatgtctaagtattataacccactatgcatttttgttggatatttactccattcccttcct

SEQ ID NO: 12658 - DNA, 121 bp, Artificial Sequence
  Synthesized
  misc_feature (61): n=t or c
tggtatttgatctcttcatccttctttgtcagagtctgctgaacatactggagatcttcangaagacctcttatttcctcatcttctgactttttttgctcaccttgagccttcgtctccc

SEQ ID NO: 12659 - DNA, 121 bp, Artificial Sequence
  Synthesized
  misc_feature (61): n=t or g
cattttgaaagaataatgtctcctgtaagccatttccagaacaaaagactggttctgtctnctgatgttagttattaacatctgcataaaggtttgctatactgatttcatctaaaagctg

SEQ ID NO: 12660 - DNA, 121 bp, Artificial Sequence
  Synthesized
  misc_feature (61): n=a or t
tccttctgtcttaggatgtgtttttcatcttaagcaaataaattcttgtcccttactttcnattcatcgtgtagcattattccgacagccgtaaagaccctcaacaaaggtgggctcttca

SEQ ID NO: 12661 - DNA, 121 bp, Artificial Sequence
  Synthesized
  misc_feature (61): n=t or c
cacatacaagatgatctagctataattcaccatattttctcccttctgttaaggtacgcantgccatgctggataactattcaagtttttgttcagttatctacagtaaatgggaagcaac

SEQ ID NO: 12662 - DNA, 121 bp, Artificial Sequence
  Synthesized
  misc_feature (61): n=a or t
ctcactttgctgtcccagtgtttttaaaacccttaaaagtctaagtacaactaccccgagnacattgtctctgtaaattaaaagaacaaagtgaggtaaaaagcagtattgacattagtaa

SEQ ID NO: 12663 - DNA, 121 bp, Artificial Sequence
  Synthesized
  misc_feature (61): n=t or c
gagccctcacagcagcccccggcagaacgcgctcgggaagtttttgtccagcctttgaaangagcgcagaggtttcgcgagggcacatcgcgaaagggtatacaaacgaaggggctcgcac

SEQ ID NO: 12664 - DNA, 121 bp, Artificial Sequence
  Synthesized
  misc_feature (61): n=a or g
tgtggtagttaaagttctcatagttaagcagattagttcaagttgttccttaactctgtcntttgttcatcgtgagaattaattaactttatcttttaatatataggtaaacatgtatatc

SEQ ID NO: 12665 - DNA, 121 bp, Artificial Sequence
  Synthesized
  misc_feature (61): n=a or t
tgaaaatggttcttactgtgaaatttagagaaaaaaacacattgctgattccagcaggaantacacagatacttcagtacagctcatttacattggtgttggtttatgcccactttaaaga

SEQ ID NO: 12666 - DNA, 121 bp, Artificial Sequence
  Synthesized
  misc_feature (61): n=a or g
ttttgtccatactttagtgccttgtgagatacgtatgtacctgtctttctggcaagaaccntgggttaattgaaacctttctagtattttggtgcacagtagacttctcactcatcctggt

SEQ ID NO: 12667 - DNA, 121 bp, Artificial Sequence
  Synthesized
  misc_feature (61): n=a or g
gagaggcctgttatgagtaacagacaatttcaagggttatgcagcttagaggtgcaatttntgaaccagttgctgaatcactgtgagatttcttctacgatctctgaagaattctgttgtc

SEQ ID NO: 12668 - DNA, 121 bp, Artificial Sequence
  Synthesized
  misc_feature (61): n=t or g
cttcactaatctctgagaaatgtagatatggacagggctaacttaaaacacatgctcttgnaagattaatgcatgtttgccttattcaatccaggtatatcaaattggtccatctttttat

SEQ ID NO: 12669 - DNA, 121 bp, Artificial Sequence
  Synthesized
  misc_feature (61): n=a or g
gaagggcatccctggtcctcactgctcagccagtgagaagaagatggaaaacagacaggtnccagtttgtaaagaccctgagacacccaaccaactaccaaagaccctgagacatccaacc

SEQ ID NO: 12670 - DNA, 121 bp, Artificial Sequence
  Synthesized
  misc_feature (61): n=a or t
atgagagatgtgtagaatgagacaagctgtctgctttgcctcagggttctttgagcctacncttaatgccagccaaggtattgctgaccaggggagccatgcagtgaatgtcctgtgtcag

SEQ ID NO: 12671 - DNA, 121 bp, Artificial Sequence
  Synthesized
  misc_feature (61): n=a or g
cttttgggtaaatacctgtcattttaggcagaattcccttgattatctcctccacagtganatcagattgccccatagtacactgctttctctcctctggaacatagccaatgccaccaac

SEQ ID NO: 12672 - DNA, 121 bp, Artificial Sequence
  Synthesized
  misc_feature (61): n=a or g
atcaaggcagagcgaggtctgttgctggccagcttttgcaaccccagatctccacagaacncagcagttgaccccagcccacatgcaggacggggcaggaggaacccactctgcccctcat

SEQ ID NO: 12673 - DNA, 121 bp, Artificial Sequence
  Synthesized
  misc_feature (61): n=t or c
ttcatctcactgaatggcaaaaatatagcttgtcctttacataccagataaagtggtcacncaacttaagagtacagttccaaaaatgtgttcctcaagcaccagacaggaatgctcaagc

SEQ ID NO: 12674 - DNA, 121 bp, Artificial Sequence
  Synthesized
  misc_feature (61): n=a or g
ataatgtcaattcaataccaggaaactagaagccccacagcagaggctgtctaatggccangaactgttgctgtctcctctctggttaccttcactgccaggattctctctccccctctct

SEQ ID NO: 12675 - DNA, 121 bp, Artificial Sequence
  Synthesized
  misc_feature (61): n=t or c
gggaaagagaaaattattattaaaaagaaaggactccaaacattagatgcatatcagcttntctattttcactgtctatgtcacagctgtgtgtgtacaaagagtatatgagaatttaact

SEQ ID NO: 12676 - DNA, 121 bp, Artificial Sequence
  Synthesized
  misc_feature (61): n=a or g
cagttatcagaagcctatctccagtcctgaccaactctgtatcacccataaaaccagggcntactgtgttgccactactgcttccttcttttaatgttcttccccctgcaaatagctgagt

SEQ ID NO: 12677 - DNA, 121 bp, Artificial Sequence
  Synthesized
  misc_feature (61): n=a or g
acaaaacgacaaaacattgcagttcaacaggatattctccgtttttctcacatataatacntatcgcatgagttcagaatacagatgaaacaggaattatcccataggttttcaccttgtt

SEQ ID NO: 12678 - DNA, 121 bp, Artificial Sequence
  Synthesized
  misc_feature (61): n=a or g
ttccctgcttccaattctataggaaacccacccaccgagacagagacataaagatctgcanaacatttttagtcctggtgcaagtcccctcagctgttccatatgtccagcagcatctgtt

SEQ ID NO: 12679 - DNA, 121 bp, Artificial Sequence
  Synthesized
  misc_feature (61): n=t or g
agtatcttcttgttttacccgaatcaaagtaactgttaaactgagagagttgctgtaccancctcccatcgaatcttccagggtcgtaaaaatctcattttctcagccaggctgctgtagc

SEQ ID NO: 12680 - DNA, 121 bp, Artificial Sequence
  Synthesized
  misc_feature (61): n=t or c
caaatatatcgaagtttgcataataacatccccagtgaacggtactaaaatggttgctcantaacctttgcacagttcagtttaaaagtgtttttatattgatacactgtatgttattttt

SEQ ID NO: 12681 - DNA, 121 bp, Artificial Sequence
  Synthesized
  misc_feature (61): n=c or g
tgtaggaattatttctcatccaagaattaggaaattgagaaattgagaaagattacccagnaagaatcagagaaaggaggtgtgaaaacaaacaaacaaaacccttctacaaactagccta

SEQ ID NO: 12682 - DNA, 121 bp, Artificial Sequence
  Synthesized
  misc_feature (61): n=t or c
cggtttgcagtttctgtatcctcttggaactgcgcgcaggaaccgtcaatgtgagtattanactgcaaagagttgagaatggttcattttttcatattaccttagttgtatgcatgactgt

SEQ ID NO: 12683 - DNA, 121 bp, Artificial Sequence
  Synthesized
  misc_feature (61): n=t or c
aacgagaagcctacctgggtgtgagtcattccccaaacgtttcaactaatcctcttttccncacttttaccgttcctgattttttaagtaaggtcgcacacgtacaccaaaagggtcagaa

SEQ ID NO: 12684 - DNA, 121 bp, Artificial Sequence
  Synthesized
  misc_feature (61): n=t or c
ggattggatacaggccattaatttattaacattccataaactgaactgcatggaaaaacanactgacaactattagaacttaaacgcctatttgttactcctagttttaaattaagactga

SEQ ID NO: 12685 - DNA, 121 bp, Artificial Sequence
  Synthesized
  misc_feature (61): n=a or g
ctgttagaatcagtgtttctgaaatactttgcagccttaccaacctcaagttctgggtcantgaagtctgaggtctgcttagaaatactctgaacccagaacagcgtttccttcccacaag

SEQ ID NO: 12686 - DNA, 121 bp, Artificial Sequence
  Synthesized
  misc_feature (61): n=t or c
ggaaggcaagtgtaaaccaggtgcataaatcaaaatcaaaggactcagttcactgatttangtaccatacttactgtctgactgtcagttggactcttttgcttccccatatttatccttg

SEQ ID NO: 12687 - DNA, 121 bp, Artificial Sequence
  Synthesized
  misc_feature (61): n=a or g
caataaaggaataggaaaagaaaatttctggtatctcagcttcctgatctttgaagcactncagtagatagaattgccttctctagcacaccccctcgaagacttaactgtttcttttttt

SEQ ID NO: 12688 - DNA, 121 bp, Artificial Sequence
  Synthesized
  misc_feature (61): n=c or g
caaacgctgcaaacccctcattaataccggcataacgaggtgtttgcgtggcactcgcagncactgcagctttgcagctcactggaaaatccactcatcccattaaggactccccaaggct

SEQ ID NO: 12689 - DNA, 121 bp, Artificial Sequence
  Synthesized
  misc_feature (61): n=a or g
attacacatcacagagcagagaaaaaaaataaatcacagtgttgctgccagcgcccaaacngagagagacattaagcacagaacagaggaatggtgattcagaacatgtgatggcttgcat

SEQ ID NO: 12690 - DNA, 121 bp, Artificial Sequence
  Synthesized
  misc_feature (61): n=a or g
agaaaacgaatttcatcttaacaaggcaacttacggcttggagccatgcaaaacaaccagngaagctgtgactttcaaaatcatacgggaggagaaaggataaaacccaactcaatgaaac

SEQ ID NO: 12691 - DNA, 121 bp, Artificial Sequence
  Synthesized
  misc_feature (61): n=a or c
tgtttgtcataagctcagaataggtgggttgacagagctagcaagacccgtgcaagtgctncttttctgcttctctgtgaaattagctagtaccagcagatctccctggaaagcaggttac

SEQ ID NO: 12692 - DNA, 121 bp, Artificial Sequence
  Synthesized
  misc_feature (61): n=t or c
gtcagcatctgattgagtagctacttagttctgaaatccccttaagtctggctgtagcagnaggttagaagaaaatgacatgaaaaagagttatctgattgttcagaagataaaaacaagt

SEQ ID NO: 12693 - DNA, 121 bp, Artificial Sequence
  Synthesized
  misc_feature (61): n=t or c
gcatatgacaacctctgaagctcttcttggtccctgcaaatgctgatcattgatggtttcngttggctgaggtggagaacgtaggatgtttccagtgtgtgcagttatttcaccctacgca

SEQ ID NO: 12694 - DNA, 121 bp, Artificial Sequence
  Synthesized
  misc_feature (61): n=a or c
aaatgtgacatctccaaggaatagcttattgaaattacaaagaacagttctttccaatttntttcttcaaagcaagtctatgtaatttttacatacctgtgcaattgttcatctttatagt

SEQ ID NO: 12695 - DNA, 121 bp, Artificial Sequence
  Synthesized
  misc_feature (61): n=a or g
aataccagaatggctctggatccaggtgcataacttggagggtgatcacgctgatttcatncccagatgaatgagcatatttgtgaacctcctactgagatcaggcactctgcctgtgcac

SEQ ID NO: 12696 - DNA, 121 bp, Artificial Sequence
  Synthesized
  misc_feature (61): n=a or g
ttctccaatgaatgcaaatcactgtattagcataagaatttctggtttgataactcatganttgtttttgaccaagcaaggaacattaccgcatctggaagagtttttcaagtgtaacttc

SEQ ID NO: 12697 - DNA, 121 bp, Artificial Sequence
  Synthesized
  misc_feature (61): n=t or c
tctccaaccacctcaaaatcccagtgttaaagaaacaaaagaatatggaatctcaactgangtattagaggaaacgttctgtaagctactggatctcttcgttactcagataactaaaggc

SEQ ID NO: 12698 - DNA, 121 bp, Artificial Sequence
  Synthesized
  misc_feature (61): n=t or c
aatgtgaatttttcctggtgggaacacagaaggtttcaacagaggctattgttggccctgnaaatgccaagtgtctgctcttgggagatggagaacaaagttggcaccaataattagcagc

SEQ ID NO: 12699 - DNA, 121 bp, Artificial Sequence
  Synthesized
  misc_feature (61): n=a or g
tgaaaactgacaaggatgttaggaaagatgttaaccacatctttttaacaccgagatctgnaaagcactgcctatgatcgttagtaattcatactgcccaagcaccaggaccttctctgtt

SEQ ID NO: 12700 - DNA, 121 bp, Artificial Sequence
  Synthesized
  misc_feature (61): n=a or g
ctgcagtgtctgagtaggtgaatctgagattgcttataaaaacacagctataaatttcaantgattggaattcttgtagctcacagagcttttaaaatactttgcaaagaatgcaaactga

SEQ ID NO: 12701 - DNA, 121 bp, Artificial Sequence
  Synthesized
  misc_feature (61): n=a or g
gaatgcttgtgtacgtgcttatgtgtaaacatatttcagtgtgtttatatttggttttacnaatatacgtgtatgcttattgtatttatagatgtaatatggcagtgctcttggtgtgggt

SEQ ID NO: 12702 - DNA, 121 bp, Artificial Sequence
  Synthesized
  misc_feature (61): n=a or t
ttgacagcactttaatccctggtggaagtgtcaaaggaaggcgttgccagccacggaaaancagtctggatcatgctaagtgaagggtgctagaggagctcatgctgcaggactaatcctg

SEQ ID NO: 12703 - DNA, 121 bp, Artificial Sequence
  Synthesized
  misc_feature (61): n=a or g
tgtctcacttggtcctgtctttacatttagggattacttgaataatgaagaagttatagcntcagatatctagttaaattcttataaacatcttataaacataagttgctttaaatattta

SEQ ID NO: 12704 - DNA, 121 bp, Artificial Sequence
  Synthesized
  misc_feature (61): n=a or g
tgctgcagctgatgacagaggtttttcactttgaaattttgattgattctgaacactttgntactatagaaggctgtagacagtggtgacttacatcctggtgcttgctattttggacgac

SEQ ID NO: 12705 - DNA, 121 bp, Artificial Sequence
  Synthesized
  misc_feature (61): n=t or c
actcaggattaaaattcattgatcttcattcactcctttttatatatttacaaagcagaanctaaaatctggggtaaaatgcttgactctctttacagcaagttaaaggaaacagatgagg

SEQ ID NO: 12706 - DNA, 121 bp, Artificial Sequence
  Synthesized
  misc_feature (61): n=a or g
aacactactgtacagatagggatgcattcacatgtcaggggattaaactataggaaatcanttacaaaactgaaaacccgagtatcagtttttgttcatttagattcacatcaatccaaaa

SEQ ID NO: 12707 - DNA, 121 bp, Artificial Sequence
  Synthesized
  misc_feature (61): n=a or g
ctttaggcccaaggcaaacacaaatatttctagaaacaagtatgatattttattactaggngactacacgtgtttaaaaacaacatcctcaacatgactgctgtttctgtaattttttata

SEQ ID NO: 12708 - DNA, 121 bp, Artificial Sequence
  Synthesized
  misc_feature (61): n=a or g
cccgctaagtggtgagaacaggtgaaatcagatgatagattgagtgcattagaccctctgnagtgagagctggaaagagcttattaaagaccaccacagtcaggctagggagctctagtgt

SEQ ID NO: 12709 - DNA, 121 bp, Artificial Sequence
  Synthesized
  misc_feature (61): n=a or g
tataatgattggcagtggtgataatgtcaccatgttttttaactcagatgcacacataagntcatgagaagcacacgcactgcagaagaatctcatacacctctgcacttttatgctaccg

SEQ ID NO: 12710 - DNA, 121 bp, Artificial Sequence
  Synthesized
  misc_feature (61): n=a or g
tgactttcaatcaattccttattcactgaaattatatacaatttcaaactgctaagccatncacactatttaagtactccacagctatttctacttcagtactgctatctgtatggtagtt

SEQ ID NO: 12711 - DNA, 121 bp, Artificial Sequence
  Synthesized
  misc_feature (61): n=t or c
gaacagattttctgcctgaaagaagcagcaaaatggctctagatctgtttgtttcttctanttaagaaaacctcaccactgaacaaattaagcgttttgacttttcacgcattttctgcat

SEQ ID NO: 12712 - DNA, 121 bp, Artificial Sequence
  Synthesized
  misc_feature (61): n=a or t
tccagcagataaagggctgagggggtatgactgctgtcttgaaaaaagttcagggatgaanactagctcttcatgttaagtgtcaactttgacaaaagaatatgttaacattagttaacag

SEQ ID NO: 12713 - DNA, 121 bp, Artificial Sequence
  Synthesized
  misc_feature (61): n=a or g
ctttgtagaactttcaaggcattaggaatggagaacatcttagatccttgaagacggtagnaatagagaacttcctggatctttcaaagcagtaggaatgaagaacttcctaggtccttga

SEQ ID NO: 12714 - DNA, 121 bp, Artificial Sequence
  Synthesized
  misc_feature (61): n=t or c
atgtgccaatctgtagccatctcttaggaaactcaaaacgtctctaatggcactggataantaattttaagagagtgaactgagccttcgattactgttgaggataatgggagcttaaaca

SEQ ID NO: 12715 - DNA, 121 bp, Artificial Sequence
  Synthesized
  misc_feature (61): n=t or g
agctgttcagtgtcttttgggcagattagattttgtaatgaaaagatataaccctcatttnataaaagctgttgctgtcttgggaaaagcatcagtgaataagattagaaaactcttttac

SEQ ID NO: 12716 - DNA, 121 bp, Artificial Sequence
  Synthesized
  misc_feature (61): n=a or g
tctggccaaggtacctgcaccactctcttattttagtgctacctagttttgttaagttatnggatcttgctgagttcctgagtattgcaggttacaagagtaaggttaagatttcccacac

SEQ ID NO: 12717 - DNA, 121 bp, Artificial Sequence
  Synthesized
  misc_feature (61): n=c or g
ggggccctgcaggctttcttcaactactctccaacactgtggattatttcttcttctgaantgtaaaaattccaaactagaggaaaggagaaggcagaagtcgctcatgatggaaaagaca

SEQ ID NO: 12718 - DNA, 121 bp, Artificial Sequence
  Synthesized
  misc_feature (61): n=t or c
cagctccacctacagatctccccattatctcttgtctgccaccatgggcaacaccagggtncctcagtgaggccaaaatctgtgtgtgtcctcctcagagttcccctcaacttcagtcaga

SEQ ID NO: 12719 - DNA, 121 bp, Artificial Sequence
  Synthesized
  misc_feature (61): n=a or g
ataaagcagctccatgtgtgggcattctgtgagctttgtgctcccgttctcctacactgcnataccacggccttagtgaggatcagctctgcagcttcatggagctgcccgcagtcactca

SEQ ID NO: 12720 - DNA, 121 bp, Artificial Sequence
  Synthesized
  misc_feature (61): n=t or c
ggtgtttgctgaaacaacacattataggaataataattgttcacatcagtagcttagcttngggtaagggtgtcattagtttaggagagctgaaggagaactgttaggttctttagatgta

SEQ ID NO: 12721 - DNA, 121 bp, Artificial Sequence
  Synthesized
  misc_feature (61): n=a or t
ccccaaagctcttcagcttggtgaccaggccagaaaataggagagaatacttctttaaatnaacaccaattgtgatctccagggttcagaatattttgtttcaatctgaaacaaaacttct

SEQ ID NO: 12722 - DNA, 121 bp, Artificial Sequence
  Synthesized
  misc_feature (61): n=a or g
taggacacgtccacttctcagtcatgtgtgtaaatagccatgtgtgggctcagcattaccnccctctctaattctgccatttctcaggctggatcagcttggatcttgccatgaccaaggc

SEQ ID NO: 12723 - DNA, 121 bp, Artificial Sequence
  Synthesized
  misc_feature (61): n=a or g
gaagctgctgtcaaagtgcatcacgctgtgctgaaagctgatttcccttctgaacatcccntttctcttctgcaggtaatgatgaaagcagctgcttgctttctcctccctgtccttccca

SEQ ID NO: 12724 - DNA, 121 bp, Artificial Sequence
  Synthesized
  misc_feature (61): n=t or g
aaaatccttgcatcgatattcagttgattgttcccacgttacacgaactttgagagtccanacattcaaggatcatttgatctccttttgactccatttgttttgtgaaggtttcatgcga

SEQ ID NO: 12725 - DNA, 121 bp, Artificial Sequence
  Synthesized
  misc_feature (61): n=t or c
gcagaacattcccagaacaactgtagaactgagcaatgcacattctagagcatcgttttcncagggccagggactaacctccacttgcaaaatgtctatctagggccactatgcaatgggc

SEQ ID NO: 12726 - DNA, 121 bp, Artificial Sequence
  Synthesized
  misc_feature (61): n=a or g
tctagcaactatttatgtgaacactcaagacagcaagggtgcattaccttcctgtgttcanaagtgccaaagctaattgatatttcctttgccaaaggtataccatattgctcactggaac

SEQ ID NO: 12727 - DNA, 121 bp, Artificial Sequence
  Synthesized
  misc_feature (61): n=c or g
gcctgtgtggtgtgtgggaagaatggccccattagtaagggcacttccatctaatgcatgntcatctcataggtgagttactgctgttgatgtaaggtggaaatagtcagttcccctatct

SEQ ID NO: 12728 - DNA, 121 bp, Artificial Sequence
  Synthesized
  misc_feature (61): n=t or c
acccaaagactcaacacagtcatcctgcagaagtctcttggcaccccatggtagatcttantgctacaggttcatttgtggctaactcaggcagcaaaaaacattagctagagctaatggt

SEQ ID NO: 12729 - DNA, 121 bp, Artificial Sequence
  Synthesized
  misc_feature (61): n=t or c
tgccaataacaaatgctgtattctgtatgcccagggcaggaagaagcacagacacaacagnaaactacatgctcacatcactgtacaggggtatgatcctgctatcagacctttccaggta

SEQ ID NO: 12730 - DNA, 121 bp, Artificial Sequence
  Synthesized
  misc_feature (61): n=a or c
tgaagtagttgggggccagctgttactgagctgctatctagagtaacctggctgtaatgtnattctgctgcagtttccttctatgcgaaaagtgtcatttcctttttctcacataggatta

SEQ ID NO: 12731 - DNA, 121 bp, Artificial Sequence
  Synthesized
  misc_feature (61): n=a or g
gagactttgcagccttctggatttactgtactttttagaccataactacccattgaatatnaattgaatttctgtcataaagacatcaatgggtggccatgggactagcatcccatttatg

SEQ ID NO: 12732 - DNA, 121 bp, Artificial Sequence
  Synthesized
  misc_feature (61): n=a or g
ccaagtgtggcactttctctcagattttagacccaagtgtgggtctgtccccaagcatctntgtctggtggagacccctgagctttcatctgattaaacattaaagcctcatctcatttca

SEQ ID NO: 12733 - DNA, 121 bp, Artificial Sequence
  Synthesized
  misc_feature (61): n=t or c
gtagtgcagaatggaagggcagcatgagggagccagtaagctctaattttattccctcctnatttatttcctttaagtatttaggatgccattgatagtgacagagttccaagcctagtga

SEQ ID NO: 12734 - DNA, 121 bp, Artificial Sequence
  Synthesized
  misc_feature (61): n=a or g
aaagacagagcagcctcgcggaaatgtgtatgtgttatcaatgtgcatctatgcttcgtcngctgctttaagttgtatgaggttttttagacttcggaggcttgttcagtgggtctttgtg

SEQ ID NO: 12735 - DNA, 121 bp, Artificial Sequence
  Synthesized
  misc_feature (61): n=t or g
atcaagagcagcttcagtgagattgtttcgatgtaaaatgtgctcagcataaggtgtgtgntgggcattcagatatggttcagaagatgaaaacattcacctccctcgttgctggcagacc

SEQ ID NO: 12736 - DNA, 121 bp, Artificial Sequence
  Synthesized
  misc_feature (61): n=t or c
gaacatgtgaaaaatgttgatattttgttatcctttggtatgtggatatgcatttctatanatgcacagtagtccataatgcttacgcaggctcccaatctcgcagatttttttagactta

SEQ ID NO: 12737 - DNA, 121 bp, Artificial Sequence
  Synthesized
  misc_feature (61): n=t or g
attgcatgagacaggcattcttccctgacagcacgctgaggtcattccctgtggtcggtanaacctgggctatggaaatattaagcctcactttctaagcaaaaccctcccgcaattaact

SEQ ID NO: 12738 - DNA, 121 bp, Artificial Sequence
  Synthesized
  misc_feature (61): n=t or c
acccatcctacctctgtctccttgtcccattttgcagttcactggcatttatgagaggagntgaactgattgaggaagacccctgcaaaaagacttaactctatacccgttcagctccttg

SEQ ID NO: 12739 - DNA, 121 bp, Artificial Sequence
  Synthesized
  misc_feature (61): n=c or g
catgcactgaagttcactcatgctgtcagtgattcaaaaggggagaaaacacacacatttnatttggttttgctggatgcaatcatcaaatcattaacataaaaaggataaagcagcagtg

SEQ ID NO: 12740 - DNA, 121 bp, Artificial Sequence
  Synthesized
  misc_feature (61): n=a or g
tgcacgccgtgccctctgcctgctgtgggaggcagggcagagcactttgtagtaccctgtngaaagtaccaagttaaggccttccaccacatctatgcaggaaatatttctcactccaaat

SEQ ID NO: 12741 - DNA, 121 bp, Artificial Sequence
  Synthesized
  misc_feature (61): n=t or g
attagcctgcaggcccaggctctgatcccaagctttgcgtctctctagttgtcatgagtanacagaggccaggcaggagcatctgagtgtcatttcagatttaccaagggacagctgtgca

SEQ ID NO: 12742 - DNA, 121 bp, Artificial Sequence
  Synthesized
  misc_feature (61): n=a or g
caagtgctgtatggaattacatcatttaaaacctttttacacagagcaaagtgggtagccntaatatcaaatataagctataaataaaggaaagctcatcactgttcacagatttaatgag

SEQ ID NO: 12743 - DNA, 121 bp, Artificial Sequence
  Synthesized
  misc_feature (61): n=t or c
cgcagaggaacaacaggcccatgctttataaaagctgcagataaacttcctaagctgctgngatggtgttggtgctaaaccagcctcctggggagcgctggcactcaaacctcctgccttt

SEQ ID NO: 12744 - DNA, 121 bp, Artificial Sequence
  Synthesized
  misc_feature (61): n=t or c
agagaggagtataaaatgatgtaacagcatacttcataaggaaagaacatacaaaatcacngcagactaccatatacataaatgtatgctgcaacacatttatgatttctttgtgtgcaat

SEQ ID NO: 12745 - DNA, 121 bp, Artificial Sequence
  Synthesized
  misc_feature (61): n=a or g
aatgtttctgattctgccagctgatgtgctcacctctcaagctaatagacaataagcaaancagtgtcactcttgttaaggagaaagagaaggctccattgaaatgcagtgcgcagggcga

SEQ ID NO: 12746 - DNA, 121 bp, Artificial Sequence
  Synthesized
  misc_feature (61): n=a or g
gcattgtttgtgcacttatgcagcagagcggggactgcaaacccaaactaagacaggaggnctcccagtagagacagggtaagggaagtacaccagcaccagccccactcttggggtgcag

SEQ ID NO: 12747 - DNA, 121 bp, Artificial Sequence
  Synthesized
  misc_feature (61): n=a or g
tatactcttggtttccagtgttatttttagtaaaatacatttacacagagggagatgaacntaagaagcaggttgattttcatctgaacagagttgcagaaactttaatatcaatatatgg

SEQ ID NO: 12748 - DNA, 121 bp, Artificial Sequence
  Synthesized
  misc_feature (61): n=t or c
taggaaaggcatgtagctttgtatttgcagaactatcctgtactcagttctcaagcctacntaatctggaaatcagaagagtactctggttgtagcaatgacacacaaatatatacacaca

SEQ ID NO: 12749 - DNA, 121 bp, Artificial Sequence
  Synthesized
  misc_feature (61): n=a or g
gtttggcccaagaaaactaatggttcctaatgttttgtgttgtccatcaacagcaaagttnttctttccctctgatggtgtttgaaaaatattttagctcagccttgtacaattaggaaat

SEQ ID NO: 12750 - DNA, 121 bp, Artificial Sequence
  Synthesized
  misc_feature (61): n=t or g
gtcaccttccatgtaaaaaatacagttgtaaagtatgattgatcttcatagcaggccttcnaaacttgcattttaccactttgcacgtatatataaaagtggaaaaaataggagcggtatt

SEQ ID NO: 12751 - DNA, 121 bp, Artificial Sequence
  Synthesized
  misc_feature (61): n=a or c
gtaatgcctttttcgcagtcttttccctttattgtgaaaaaaagattactgttaggttttntacctttggcttggaaaggcttcaaacctctagatccttagcttatggtaactgtattca

SEQ ID NO: 12752 - DNA, 121 bp, Artificial Sequence
  Synthesized
  misc_feature (61): n=a or g
ttataaaaaaatatgaaaagatctattatctcattttacacctacaaacctaagtgataantgtttttaaaaataactccttcgatcagtgttatatgtccagatggaattgttttctttt

SEQ ID NO: 12753 - DNA, 121 bp, Artificial Sequence
  Synthesized
  misc_feature (61): n=t or c
tcctatagaagtatgacaatgtcttacttgattgagtgtcagtgctcaggttcttggtaanactgtgcattccaatgtaattctgttgtagaaacactgtctagttccttagcttggaaat

SEQ ID NO: 12754 - DNA, 121 bp, Artificial Sequence
  Synthesized
  misc_feature (61): n=a or g
aataatgaataggtgataagttgaaatacttctctcacataatctcacttttctcatttcncactcctttagtaacaaccaccttttagataatgtcagaatccacattaaaaaaaatgaa

SEQ ID NO: 12755 - DNA, 121 bp, Artificial Sequence
  Synthesized
  misc_feature (61): n=a or g
tagctgtcttatgcatcaatgccagacgtccttctccatctggtggcacgttgtcatcacngaagacaggctaacgacaaacgggactctgagggaagcacctctgttcaggctctcttgc

SEQ ID NO: 12756 - DNA, 121 bp, Artificial Sequence
  Synthesized
  misc_feature (61): n=c or g
atctggctggtgaattgccgcctcagtaatagctgggttatatttcttgcacgttcatgtnctaaggttcaagaactgatgtccatggtccctgtgctaaacagctggctagctttcctca

SEQ ID NO: 12757 - DNA, 121 bp, Artificial Sequence
  Synthesized
  misc_feature (61): n=t or c
cctgggtgacccgtctcaattatgggttctttttttgaaacaagttcttcctgtacattangctctaacaaaagcacctcattgggatggaaaactggcagaactctgtcccaggccatag

SEQ ID NO: 12758 - DNA, 121 bp, Artificial Sequence
  Synthesized
  misc_feature (61): n=a or g
acatcaattaacagtattgagcccatttcaaattagttcttctaccagaatagtagaaacngaatagtttcctccagactgctcagcatcctgctgtaaccttcttgttgacacaacagtc

SEQ ID NO: 12759 - DNA, 121 bp, Artificial Sequence
  Synthesized
  misc_feature (61): n=a or g
tccccatgtgtgagtttgccctgcagatgattttatctcatctgcttggagtcacaccacntcacattactaggtcattgtatacttactcccctgtggcagaataaataaacatagttgc

SEQ ID NO: 12760 - DNA, 121 bp, Artificial Sequence
  Synthesized
  misc_feature (61): n=t or c
ctaacagtatccaagatcctatgacttctaagagtgaaataatgaccctattaaaacatcntcagtgaaactgtttaactggacatatgtcacttagtaacagagatgatccaactaaaac

SEQ ID NO: 12761 - DNA, 121 bp, Artificial Sequence
  Synthesized
  misc_feature (61): n=a or g
tgactactgcagttattctttaattttaagatgattaccaacgtttttgcttttacctgtnggttccctcacctccacccctactccaaatgatattaactctgcttctgatagaagtcac

SEQ ID NO: 12762 - DNA, 121 bp, Artificial Sequence
  Synthesized
  misc_feature (61): n=a or g
cagtgcaatactcttacaaagcacacagcagcaacactttgaaattcaaagaggaacgacntaatgacacagtaggtttttgccatgctagtgtgaatgctctaagtatcttattaaaatg

SEQ ID NO: 12763 - DNA, 121 bp, Artificial Sequence
  Synthesized
  misc_feature (61): n=a or g
cagagggacctggacacacttgaaaagcaggcacacaatttaatgaggtttaatgaggccnagtgcaaggttgaggcgatctcaggcatgagaatatactgggagaactcatagagagcaa

SEQ ID NO: 12764 - DNA, 121 bp, Artificial Sequence
  Synthesized
  misc_feature (61): n=t or c
catctgaagtaaagcagacctcctttaacaaaagatgcacacacatgcaagtgcccagttntgtacagaagttcctaaactatggcaaggagtcagatgcataaaacaactttatgtaaat

SEQ ID NO: 12765 - DNA, 121 bp, Artificial Sequence
  Synthesized
  misc_feature (61): n=t or g
tcacctcaggtattaactctgcatcatttagtacagaactcataaagagcaaaggtgtttnctgtgtttcagtagatgtgcttaaaatgcaggacagtgcccagggtccaagtttgagaag

SEQ ID NO: 12766 - DNA, 121 bp, Artificial Sequence
  Synthesized
  misc_feature (61): n=t or c
ggagagaacataaataaagccatagaaagacactatttaaaggcaggatatcatatcccgntttcattctctacttcacttggtttcatttttcaagttactttttatttgtgcttttatt

SEQ ID NO: 12767 - DNA, 121 bp, Artificial Sequence
  Synthesized
  misc_feature (61): n=t or c
ttagaatttaacaaatagaaatgccaggtgtgaaatccatcagcctctggactcttacccngcttccactcaaaccagtgagacctctgccattgttttacttgggagaaaagctggatca

SEQ ID NO: 12768 - DNA, 121 bp, Artificial Sequence
  Synthesized
  misc_feature (61): n=t or c
gaatcacatctgccacacacatggtcttttgggccttttccacctttcctttttgctcctnaccctgcagatttcctaggagctgctatttgcagctattgcctggtgggtctccccatgg

SEQ ID NO: 12769 - DNA, 121 bp, Artificial Sequence
  Synthesized
  misc_feature (61): n=a or g
tccaaaggagaggaaaaggaagcaaatgtggaggaagacatactctgaatcaacacctacnaagaaagctcttcctctccagcagcacacatggagcatcctccatttcttctggactcca

SEQ ID NO: 12770 - DNA, 121 bp, Artificial Sequence
  Synthesized
  misc_feature (61): n=c or g
catcacgttatttcaagttttgtttgtcatcagagaaactgaggtgtttaagcagccactncaaactaagcactatggaatcagttattttaagaaggcagaaagagaaaacaattagatc

SEQ ID NO: 12771 - DNA, 121 bp, Artificial Sequence
  Synthesized
  misc_feature (61): n=t or c
gtacccaaacgctggagtctttgtcagtaagtccttaacccttagcagcattctccaaagntggagatgcagactgtggcagaaggaatctctaaatttttcagacagggtattagcactc

SEQ ID NO: 12772 - DNA, 121 bp, Artificial Sequence
  Synthesized
  misc_feature (61): n=t or g
ggcaaaactcctaaaatgttgtcaacaactgcgtgcatgcagattctgagaggttaacagntaattggcatcacacaaacgagattcatttcctggtcccaccaccactcagcatcctgtg

SEQ ID NO: 12773 - DNA, 121 bp, Artificial Sequence
  Synthesized
  misc_feature (61): n=t or c
catttaactagtcttgctgcatgtcgcgtgatggcttagttgataccaagatgctaaattntgggatattcaacagtaaacctggaagtgaccaaatcttgtgcaaaagggcaaacctaca

SEQ ID NO: 12774 - DNA, 121 bp, Artificial Sequence
  Synthesized
  misc_feature (61): n=a or g
ttctgattgaaggtcagaaataaacacatttgagaagaaactttccttttaaactattaanttatttgttacaagagcattactcagaaaacattttccttactaaaaggcatttgaagac

SEQ ID NO: 12775 - DNA, 121 bp, Artificial Sequence
  Synthesized
  misc_feature (61): n=a or g
gtcaaaacgttaggagtaacttgcaacagaggtcttccaaacacaaaaatatttcaggatnatataattaagtaaaacacgaggagagctgcagaaagcgacagccctttaggcttgagga

SEQ ID NO: 12776 - DNA, 121 bp, Artificial Sequence
  Synthesized
  misc_feature (61): n=t or c
gattcagataatccagcactctgaagtataagagtttctcatcttttcctctccaacaganattacacttctgcttactcaagtaggacttcatttgtcattatgctgtctatccccaaaa

SEQ ID NO: 12777 - DNA, 121 bp, Artificial Sequence
  Synthesized
  misc_feature (61): n=t or c
tcagtcaccatttcatggattttattgttttccagagttgctagctttcagtactttaaangtaatttttgacatgtggggaagatggacgtgacagcacagtgtttggaaagagaactgc

SEQ ID NO: 12778 - DNA, 121 bp, Artificial Sequence
  Synthesized
  misc_feature (61): n=a or g
tttgtatttagcatttatttactcagtgccccttgtgaactgcagatgttatgggcagcanatgtggaactgtagcccgttttccagaaggcaaacactaacgcggaaatatggcattggc

SEQ ID NO: 12779 - DNA, 121 bp, Artificial Sequence
  Synthesized
  misc_feature (61): n=a or g
gcagggtgcacgtctggctctttccacagttacagggaaaagcaaaggaagagagctcacncggtggaagccattcatgcttcctaggaagccggctccctttgggtgaggacgtgttcca

SEQ ID NO: 12780 - DNA, 121 bp, Artificial Sequence
  Synthesized
  misc_feature (61): n=a or g
gttcatccattctactctgaaaacaaatgatagaatgaagttcaaaatcagagtaatgcanagtcccaagtgaaggctaaagctgcagatgatgtttcaatggttatgaattagatagttg

SEQ ID NO: 12781 - DNA, 121 bp, Artificial Sequence
  Synthesized
  misc_feature (61): n=a or t
tagatgtcttttgtgcactgaaactatcataaaagaaagcaagatctggaactcatcttcnaaaatttaactttctgaaatctatggaatcagtcaaattcatttagtaattccagtgctt

SEQ ID NO: 12782 - DNA, 121 bp, Artificial Sequence
  Synthesized
  misc_feature (61): n=a or g
gttggcttgtggaaaagaccaggtagaaaatgtcaaatagatcacagtatcagcaataacntctgaattacagatgtatacagtgcataaacacagcacagcatagggccacactggtaca

SEQ ID NO: 12783 - DNA, 121 bp, Artificial Sequence
  Synthesized
  misc_feature (61): n=t or c
agcttgtgccttcataatacgtgccctggggagagctctggagtgtgttcctcagctaacngttgcggaagttctctagaaagccagggcgggttatagctctgctcagtggccgaaggta

SEQ ID NO: 12784 - DNA, 121 bp, Artificial Sequence
  Synthesized
  misc_feature (61): n=a or g
ccttcactatcaagcactcaagcagccttacattttctgcatgctaaactttcagaagcantacttggcacaaacatatgcaatcgtattaagggactaaaatactgccttttattattat

SEQ ID NO: 12785 - DNA, 121 bp, Artificial Sequence
  Synthesized
  misc_feature (61): n=a or g
ccatgtgccaggtgtgccacgggtttgcgcgcagtattgtggtcatagctgcacacgtgangatatctctgtgccagtggagggtctcagagacctggcttcacattgattcatttactgt

SEQ ID NO: 12786 - DNA, 121 bp, Artificial Sequence
  Synthesized
  misc_feature (61): n=t or g
cactggaaaaggtaaaatagtaccgagcagcctgaaatgcagcaacaccgagcttaaaagntggtgttgaaaacccagtcagagtgtgaagtctgagatatccacctccctttgtcctggg

SEQ ID NO: 12787 - DNA, 121 bp, Artificial Sequence
  Synthesized
  misc_feature (61): n=a or t
atgccaagacaactcctgcagctcccctcctgccttctgacccacatcctatggacacagncagtgcttcggtgcagaggagctagcaaagccaattcattatcccaaaggggccaggagt

SEQ ID NO: 12788 - DNA, 121 bp, Artificial Sequence
  Synthesized
  misc_feature (61): n=a or t
acagaaaatctcctgctaacacatgtgccattgagaagtgagatcctattactagaaacgngtttgaggcactgtgttttacctaaacttaacatcagaatgctttgcttttaaatttcaa

SEQ ID NO: 12789 - DNA, 121 bp, Artificial Sequence
  Synthesized
  misc_feature (61): n=a or g
ggtgacaaattgaagatgtggcatgcttatgaggtccaaacaaactgcaattaagagaagnctgaaaatgaagaaaaccttagagagactatgagactgatcagatctttttgatggtgga

SEQ ID NO: 12790 - DNA, 121 bp, Artificial Sequence
  Synthesized
  misc_feature (61): n=a or g
tcatgttcattcttgttgaacacacatgagcagaactgtgcacaatgaaaagtggtctcantctcttcttgacaggtgctgacagtgtgctgcctctcctagaaacagttcttcagtatat

SEQ ID NO: 12791 - DNA, 121 bp, Artificial Sequence
  Synthesized
  misc_feature (61): n=a or g
aaatttgtagcaaatattagcagaaatatagtaagtcaaaaacacttagacatttctactnctggttgtttaaaatcagcatttcaagtgtttccagtagagactggaaatgaaaaaacat

SEQ ID NO: 12792 - DNA, 121 bp, Artificial Sequence
  Synthesized
  misc_feature (61): n=t or c
acatggcaaaacctgtctacctccttcccccaggctctggtactactgcagtttcttggcngccactggctacatcttcctctcctgcataattagaactggggtatgtaactttcacttc

SEQ ID NO: 12793 - DNA, 121 bp, Artificial Sequence
  Synthesized
  misc_feature (61): n=a or g
atatatctacaacacccttaactctgtataagaataggaagtatggaaaaattgaacatantacagtgcagaacatagcagttcaacaagcattccccaggtagtcctttctcggaagcca

SEQ ID NO: 12794 - DNA, 121 bp, Artificial Sequence
  Synthesized
  misc_feature (61): n=a or g
actgttgtcctggcaatattcaaaaatatatctgaaaaatgtcctattgtccagattttcnaggacatcctccaggcttttccttaagtgtgatttgaaaaacttggaagaattttttttt

SEQ ID NO: 12795 - DNA, 121 bp, Artificial Sequence
  Synthesized
  misc_feature (61): n=t or c
taagaaatacatttaaaaaaagacttttaaggagacctttgactttacagactgaggcacngattttatgccctgtctgctgactagacccctgaggcagtagaaagcactggttgtcagt

SEQ ID NO: 12796 - DNA, 121 bp, Artificial Sequence
  Synthesized
  misc_feature (61): n=c or g
ggggcactgttagttgggagccagccgggtgtgcacagctggaatgggcgtgggaacacantgcatgtgaagggactgctgaaagtcacagagcagtgttagcacaccttttccaagccaa

SEQ ID NO: 12797 - DNA, 121 bp, Artificial Sequence
  Synthesized
  misc_feature (61): n=a or t
ctgtaactttttggaaggctgtacaacaaacctgggcagtcatcagtatccattttcctanatgtacactcagcaagcctcagtattcaaccctctacttttcagctgcagaagtgatttg

SEQ ID NO: 12798 - DNA, 121 bp, Artificial Sequence
  Synthesized
  misc_feature (61): n=t or g
gtttataacattgtttttgaaatgaatgatgtttctgatttatataaaagtcacacaaatngattgaatgggaacatttgcttgaatggtaggaggcacaacgtgtcacagaagaaatggc

SEQ ID NO: 12799 - DNA, 121 bp, Artificial Sequence
  Synthesized
  misc_feature (61): n=t or c
cactggcagtccttggggagcaatgacttaaaaagggaaggaattcaaaaatcgcctttgnggagtgtggtgaggactggccctgtttccatcccctgtgcaggacatgcagcccttcgtg

SEQ ID NO: 12800 - DNA, 121 bp, Artificial Sequence
  Synthesized
  misc_feature (61): n=a or g
taccctaaatgatctcaaaagaggatgcagagggcctcatttcttcatctgtaaaaggacnaaagactcttctctcacctctctgtctatctttttggtactgtagcagaaacacagttac

SEQ ID NO: 12801 - DNA, 121 bp, Artificial Sequence
  Synthesized
  misc_feature (61): n=t or c
atttgcttcctttatctgttactgcatacatttggttctgctttgattgtctacggggatntctttttctattcttttctacgttatactacatatgattcactgccttatttcagctctt

SEQ ID NO: 12802 - DNA, 121 bp, Artificial Sequence
  Synthesized
  misc_feature (61): n=c or g
gtgctgtgcgccttatataccagctcccaaaatatccgagtcctgataggatgagaaaacnctgtcatgttcttgcaccaggccaattacaaagctgtagttcctgtgctggtaaagatgt

SEQ ID NO: 12803 - DNA, 121 bp, Artificial Sequence
  Synthesized
  misc_feature (61): n=c or g
gctgggttttccatggctatgtgctaagctgtgagggtttgtgttgccaggaggcagtgtntgcccgctcttcccattgcttggtgctgcaatcggaggcaaaaggaggaaaataaacttg

SEQ ID NO: 12804 - DNA, 121 bp, Artificial Sequence
  Synthesized
  misc_feature (61): n=a or t
ttgaactcacctaattcttgataaaatatcttgtttcattatgggccaaatacatcccgcngtatgggagaacaaaggaggagagtagagccagggactgaacaaaatacaaagcagacct

SEQ ID NO: 12805 - DNA, 121 bp, Artificial Sequence
  Synthesized
  misc_feature (61): n=t or g
ctctcccagtatcaaagccttgccaggtttactcaatacaattatgcttatataaatgcgncagaacaaggcctgcatgaaacagcaatatacaaatgaatgcagcacttggatagaaaca

SEQ ID NO: 12806 - DNA, 121 bp, Artificial Sequence
  Synthesized
  misc_feature (61): n=a or g
ctcctacagccttatatcgaatgtggtgcaaagtgagtggaaatgagggagggaaaaggtnggacttctggtactctgaggtttaactgggattcaagtattatctgaaattgaacctgaa

SEQ ID NO: 12807 - DNA, 121 bp, Artificial Sequence
  Synthesized
  misc_feature (61): n=t or g
taaataaagagctaaatggtcacagccagaaagttaataatcaacagatctaaatccaggnggaggcaggtgtccatgttgggaccggtgctcttcaacatctttatcaatgacacagaca

SEQ ID NO: 12808 - DNA, 121 bp, Artificial Sequence
  Synthesized
  misc_feature (61): n=a or g
tttgcaaaatcaaagaatgaagtttgatagcaacttaaatcctctgcatcctgcctactcntgccactgtatgtcgcagcaagacagtggttacacaaagaaaaccactgcttgtttttct

SEQ ID NO: 12809 - DNA, 121 bp, Artificial Sequence
  Synthesized
  misc_feature (61): n=t or c
gtttccaagtgttcagagtctgacggggaaaaagtgagctacactgcagctagcaaatacngagaatataaaaattaatgccaagaaatacactgctccctactggagcatctaggtaaga

SEQ ID NO: 12810 - DNA, 121 bp, Artificial Sequence
  Synthesized
  misc_feature (61): n=t or c
gttctgtggccatctgaacacaggtcttttgctggcaaataccctgtgctggggccatgtntctaccccaaggtaagtgctttgactgttgtcagtcatgtctttggttatcagtagagat

SEQ ID NO: 12811 - DNA, 121 bp, Artificial Sequence
  Synthesized
  misc_feature (61): n=t or c
tatatagaaccatggaatagttgaaatatatcaaaatgacatctaaggatgtgtcacaaantgattgttgtgtattcagagatttttctttttcttttttccttttccaaacagaaaaata

SEQ ID NO: 12812 - DNA, 121 bp, Artificial Sequence
  Synthesized
  misc_feature (61): n=c or g
aaaaaaaaataggcacagttcaatttccaaaggagatttagcttttcccttccacttcaantaaaatcaccaggagactttaaatatcacgagcattactttaatgatccctcttcaaaag

SEQ ID NO: 12813 - DNA, 121 bp, Artificial Sequence
  Synthesized
  misc_feature (61): n=a or c
atgagaaaggaatttgtaactgtaaactcttaactttttagacagctgcctttgccagacncctgttttttatgtaggaaactgatgtgtaccctagtgtaaggcaggaaaactttgaaga

SEQ ID NO: 12814 - DNA, 121 bp, Artificial Sequence
  Synthesized
  misc_feature (61): n=t or g
tcccttaaaagttagccgtaaattttaaataagtacctactatttaaatgagtcagaaggncctatactacttcccctatcaaacaagtgattgaaaattgtttagtaatctctttaattg

SEQ ID NO: 12815 - DNA, 121 bp, Artificial Sequence
  Synthesized
  misc_feature (61): n=t or c
ctttggcaaaatggaagaaaggctggacttgttaaaaaacggaatgagcaaccagggacangtatctggaaagttaactttttcctccagtcaattcacttgtagccatccagattttctt

SEQ ID NO: 12816 - DNA, 121 bp, Artificial Sequence
  Synthesized
  misc_feature (61): n=t or c
aaccaatagtgccaagtctcacagtggtctacaagcccagacctaaagcaaactttactcnatgcagactgttgcagcttctgtaattttacttgcctttttcttgtcttcttcttcttcc

SEQ ID NO: 12817 - DNA, 121 bp, Artificial Sequence
  Synthesized
  misc_feature (61): n=t or c
aattaaatgagatcttttgggcagataaaaatcaagacctgtaatttttaacttgttccantctaattttcttgcttcagtgaattctcaagactatcacctcaccaatgctaatagaaaa

SEQ ID NO: 12818 - DNA, 121 bp, Artificial Sequence
  Synthesized
  misc_feature (61): n=a or g
gccttagcaagtgctatccactctctccattgaatccaaagctggcaattcccttctgacntgttatagtgctctcccgaggtctctaatttgtggttatttattatgtacacattttcag

SEQ ID NO: 12819 - DNA, 121 bp, Artificial Sequence
  Synthesized
  misc_feature (61): n=t or c
tgggggggccaaatagaatttcatcagttgttcccattacacagatgcctaatgcataccngccacttctcatgatgaaaatttaagagagaatatgaataaaataccaagagtgagttcc

SEQ ID NO: 12820 - DNA, 121 bp, Artificial Sequence
  Synthesized
  misc_feature (61): n=a or g
tgtaaattgaaagctgtttgaatctatccaacatcaaatgattcagatgctcttaacagantgtaagctattcttaatccatacttaatctaacggtagctattttagcgatttattgctg

SEQ ID NO: 12821 - DNA, 121 bp, Artificial Sequence
  Synthesized
  misc_feature (61): n=a or g
ctatagtattttcaagtgaagcttcttaaaaggcttatttgacaaaaatctaatccaagancagatttcaactaaatcaactaaccaacagatttcaatttaaatgtttatcattttatgc

SEQ ID NO: 12822 - DNA, 121 bp, Artificial Sequence
  Synthesized
  misc_feature (61): n=a or g
ggagatgaggaaagcctgttagagagctggccagaggggttcccacattttacacataacnaaactactgtcatattaattgagaatgtactttgtcttcttacagtaacacttaaaaaat

SEQ ID NO: 12823 - DNA, 121 bp, Artificial Sequence
  Synthesized
  misc_feature (61): n=a or g
ctcttagatgtgaagtacaggaaaagaaacataaccaaggagatgtgatattctaagacangaggtttataactagctatgccagtgtgagcatatccatgtatcactatgcaacagagca

SEQ ID NO: 12824 - DNA, 121 bp, Artificial Sequence
  Synthesized
  misc_feature (61): n=t or c
aaatcctgctctgtgtcacattaaattttatctgtaccatcagtctctagtagaaagacanacagaagctctgcttaggagactgtacaaatcttttttattattattaatgccaagcatg

SEQ ID NO: 12825 - DNA, 121 bp, Artificial Sequence
  Synthesized
  misc_feature (61): n=a or c
aattgattcttggccataagtaaagctgctctaccctggcatattctctctctcatgccanccttgatgttggtattttgcattcaagttattgctgtttcacaaaggaaatatggaagaa

SEQ ID NO: 12826 - DNA, 121 bp, Artificial Sequence
  Synthesized
  misc_feature (61): n=a or c
tggctttcagaatctgtgttctttcaagattgttttccttgcacctcaggacacaactgcncatttagaggtttaaatgcggtcttctgattcactccagttctgtcaaaataagcttttt

SEQ ID NO: 12827 - DNA, 121 bp, Artificial Sequence
  Synthesized
  misc_feature (61): n=a or g
atttgtggttcctaaacttcagctataggagagtacaactaggatgaaaatgattttctgnggccatttttttattagcagcaagttgtatacctatatctataggctagggctcttcttg

SEQ ID NO: 12828 - DNA, 121 bp, Artificial Sequence
  Synthesized
  misc_feature (61): n=a or c
ggaaaggaatccccttggctcgcagagagcaaagattaatgcctgagttgcaggctgctcnactcttcccttctccagaaccaatgattccatacagcatggagaaacgccccaaccgtct

SEQ ID NO: 12829 - DNA, 121 bp, Artificial Sequence
  Synthesized
  misc_feature (61): n=t or g
tatgacgttgaggatgggggaatgaaaggaagattgaggaggtagaagcagcaatgtaatncctgctctgaattttcttcctgatagatattctccaaagttactttgctaatatatgcac

SEQ ID NO: 12830 - DNA, 121 bp, Artificial Sequence
  Synthesized
  misc_feature (61): n=a or g
ctcactttacagcaacccactgggatgaagtgcctctcttcacatccctccagacaagggnatacccatgcacatagaaaccaactgcggcctaccacgaccccacaagcacagatcacag

SEQ ID NO: 12831 - DNA, 121 bp, Artificial Sequence
  Synthesized
  misc_feature (61): n=t or c
aattttcccatttgggtatggtgaaaagaccaaagtaatgtttctgaagacacactcatanacttcctttgtaagatcagtatttaagagatgactttaagagataaaggaacacatgcac

SEQ ID NO: 12832 - DNA, 121 bp, Artificial Sequence
  Synthesized
  misc_feature (61): n=a or c
caaattctctccccacttgggttatatgccatgaaggtgtttgaagcaaggtatatttacnaccacaaaattaactcatgtttcttgcttgcataacagcaagcacatctataaggtggta

SEQ ID NO: 12833 - DNA, 121 bp, Artificial Sequence
  Synthesized
  misc_feature (61): n=a or g
tacgagcttgtcaaatgaccactaacttgtgaagagctaatgttgcaattggttttctttntatttccacaattccataaaacctctgagaaatatgctattacacatgtgcgttaatatt

SEQ ID NO: 12834 - DNA, 121 bp, Artificial Sequence
  Synthesized
  misc_feature (61): n=t or c
aaagcactactgtcttttgcctctcagttatagttgtctgtagtatacaggtggtaggcangggcagtttgtttgtttatactagagaaaaacatccctagatttagaaactgtcaatatg

SEQ ID NO: 12835 - DNA, 121 bp, Artificial Sequence
  Synthesized
  misc_feature (61): n=a or g
tcactggtgaacgggaggctgcagccaaacacctgcctggaacactgtgagcctggcagcnacaggggctgatggcaaactctggcactataagcaggaaataacaagaaaaagggaagtt

SEQ ID NO: 12836 - DNA, 121 bp, Artificial Sequence
  Synthesized
  misc_feature (61): n=a or g
tccaggggccgcatctcacagcaaactcacctctgtgtccccacgttaggaaattctgcantgcgacacaaatgatcaccttcagggggacttttaatgtggctctgtgggctgaggaccc

SEQ ID NO: 12837 - DNA, 121 bp, Artificial Sequence
  Synthesized
  misc_feature (61): n=a or g
ctcaggcatattatttatattcattaaaaaaagactcacatttactacttcatactgaagntgtgctttgtttgtcctctctgacccctaaaataggctatttctacattatctaagtatt

SEQ ID NO: 12838 - DNA, 121 bp, Artificial Sequence
  Synthesized
  misc_feature (61): n=a or c
agaaaggcacctgtgggccatccaagttcatgaggcagaaagaacttagagccctgccagngggagaaattcagtttggagaatacaaagtcctggttataccacagatcagtgtcttgac

SEQ ID NO: 12839 - DNA, 121 bp, Artificial Sequence
  Synthesized
  misc_feature (61): n=c or g
caatctgtggatctggaatttgaaaataatggcattttttttatctgagcaatgtaacatncaactgctgtgtccacttatattcatttaactctcccatcattggaatggacatagatgg

SEQ ID NO: 12840 - DNA, 121 bp, Artificial Sequence
  Synthesized
  misc_feature (61): n=t or c
cgtagctgctaatgtcatctgggatcttttcttctagattgtctagctggttttgtaactncataatggcatctttggattggttggctgggaggtctggagatgtatagctcaattagag

SEQ ID NO: 12841 - DNA, 121 bp, Artificial Sequence
  Synthesized
  misc_feature (61): n=c or g
taggatgtgggtgagtgggagtggagtcaccccgctgaggctttgcattttaggctgcacnaccagcatgggcttgcctcaaaatattgcaaagcccactgatgctggaagcgtttgctct

SEQ ID NO: 12842 - DNA, 121 bp, Artificial Sequence
  Synthesized
  misc_feature (61): n=t or c
tgctcaggtgccattcaagtttcagaggtaccgtttccttcactgaagtggagcagcaagntaattttgtaacttactttttaagtaagcagcaaagaaggttatcatcatttttgttctc

SEQ ID NO: 12843 - DNA, 121 bp, Artificial Sequence
  Synthesized
  misc_feature (61): n=a or g
caccaaagttaacattgcacatgcatcttcaaccaggtatgaaacagagctgcttggttantatggatctgtgggccttcagtttagctttcactccccactccctcagggacatcagtga

SEQ ID NO: 12844 - DNA, 121 bp, Artificial Sequence
  Synthesized
  misc_feature (61): n=t or c
ccagccactccactgaagttaggaaggatcacatctctcaggtctcagattctaattaacngcgccgtgtttgtgaacatcacttgtgcaaacaattacggtacaggcagcggcggcgtaa

SEQ ID NO: 12845 - DNA, 121 bp, Artificial Sequence
  Synthesized
  misc_feature (61): n=t or c
aatatgtaagttgaagaaaatagctaaatttaatggcagtcagcacctgatttgtgtgtgnttttaattagtattaatagctgcaggttttactgctattactagtgtctctagttgcaca

SEQ ID NO: 12846 - DNA, 121 bp, Artificial Sequence
  Synthesized
  misc_feature (61): n=t or c
agtgcattgatagcctggattgcatttgttgtgtgcttagatgaggtgaatgagtttgagngctgacataggaatgaagtgaattgacttggaatgatactcaatgttttgagtgtggatg

SEQ ID NO: 12847 - DNA, 121 bp, Artificial Sequence
  Synthesized
  misc_feature (61): n=a or g
cactcaggccctactaacaaccaggcacttgtcacataggaggcattgaattaatgtcccnctgtcatctttacatcaaatcataaggattctttgggtaggtagaaaaggcataaagata

SEQ ID NO: 12848 - DNA, 121 bp, Artificial Sequence
  Synthesized
  misc_feature (61): n=t or c
tgttctgttaaaagtgtctaaaaacttaaatcaacaggcacagagtctcactttgttactntaaactcaaccacagtaggaaaggaaagttcaaagttataactttgcatgactgccaaaa

SEQ ID NO: 12849 - DNA, 121 bp, Artificial Sequence
  Synthesized
  misc_feature (61): n=a or g
gggctgggctggggggggctccgtccctgcagaacaaatgtgttgatgctgaagtcgggcnagctgctgccgtatgaggcactgtagctgaaaatttaactttgatttcaattttcatatt

SEQ ID NO: 12850 - DNA, 121 bp, Artificial Sequence
  Synthesized
  misc_feature (61): n=a or g
acaagtcttgctgatcatattgtgaccatatgggcaaactgaataactgctgtttcaccancaacaaggttctgagcaaattccaggtactataacaaatcatactgcttacaacccccag

SEQ ID NO: 12851 - DNA, 121 bp, Artificial Sequence
  Synthesized
  misc_feature (61): n=a or g
gaagcctggcagtgaaggaaaaggtgaaaagggtactccaagtagatagtgcctaaaggtntgagtgctgcttcaccatttgtgataatcccatatagaacattctccaacacaatgtcca

SEQ ID NO: 12852 - DNA, 121 bp, Artificial Sequence
  Synthesized
  misc_feature (61): n=t or c
aggatgacatctttacactcactttctggaacatcagaaatcactttgctatgactgaaantgatgtttcaattgatgataatagcctactcaaaagtcaaatgaagagcaggaataaaca

SEQ ID NO: 12853 - DNA, 121 bp, Artificial Sequence
  Synthesized
  misc_feature (61): n=t or c
tcaggacgaaaaggaatgagaactgcagctctcagtcaaattaagtggaggacaaaatcanggccacagtagttgcataaaagccttcctgctgcagatttcaaagcacaagcaataggaa

SEQ ID NO: 12854 - DNA, 121 bp, Artificial Sequence
  Synthesized
  misc_feature (61): n=a or g
acagaagagaagcgtgctgtttcctacagtatgcaagaaaacactgcacgtggacttaatnctgtgtgtcagctgatgtgaccagaccagtttttgattacttgtattattgctgcatgta

SEQ ID NO: 12855 - DNA, 121 bp, Artificial Sequence
  Synthesized
  misc_feature (61): n=t or g
atgaaagaaatggttcatcacaagcgttaggaccctctggaggttgatgtgggggggaaangttgtcctcattaaagatactccctactcaggaacaaggaagacagactgatggctacca

SEQ ID NO: 12856 - DNA, 121 bp, Artificial Sequence
  Synthesized
  misc_feature (61): n=t or g
aaaagcagaggctgcaaccattgaaattgtctctgtactaattggcaaggaaaagggcacngataggcatggattgtcaagatggctcctctgacccttctgcttaatccaaatgagtaat

SEQ ID NO: 12857 - DNA, 121 bp, Artificial Sequence
  Synthesized
  misc_feature (61): n=a or g
ctggaattgagaagtgctctctgctcaatggagctcaggggggtactgtaaattttccacngcatttggtttccaactacattgtacggacacgtgattaggaggcaaaactccattaaaa

SEQ ID NO: 12858 - DNA, 121 bp, Artificial Sequence
  Synthesized
  misc_feature (61): n=t or g
tcaggaaagatgctcattacagggagcaaaggaaaacaggactgcagataataaagcagtngattttgtgtattgtggttagttgcatttgatgaaaggtttgtaagaagatatgtcctta

SEQ ID NO: 12859 - DNA, 121 bp, Artificial Sequence
  Synthesized
  misc_feature (61): n=a or g
gtgctaaaggactttacaaaatggaataggaatagacaataaaagatgaaaactatcattntaacaggtggactgtagctaactgaagtactgaaaaggaaaaatattttttttttttaaa

SEQ ID NO: 12860 - DNA, 121 bp, Artificial Sequence
  Synthesized
  misc_feature (61): n=a or g
ccttctcctaatgaggacgtgctatccacaccctttctggccatgctgctaatgaaaactngctccatgttttacataaacattggttgtgatgggagtattgctggagaaacaagctcag

SEQ ID NO: 12861 - DNA, 121 bp, Artificial Sequence
  Synthesized
  misc_feature (61): n=t or g
cctttctgtcccttttgtgaagctgaaatgcacagtaacttttacacctctgtgatttctnttgcatgattcacctcaagtagacttttagttggttttacttatggttgtaccctgtaag

SEQ ID NO: 12862 - DNA, 121 bp, Artificial Sequence
  Synthesized
  misc_feature (61): n=t or c
gagaagtgaaagcctgtggtgtacagagagcagcagggtgccacgttcaccacaactgatncccacagtgccttctcatcactactgccacaaaactctctagcttggatgagagaacgta

SEQ ID NO: 12863 - DNA, 121 bp, Artificial Sequence
  Synthesized
  misc_feature (61): n=a or g
ttaacattaggaaaagcagacacccaggcactctcacaacctttacttggcttcctgtgtnagtaaaagtatgtttgctatatttttgaaagggattcctgtccgattcatcacacagatt

SEQ ID NO: 12864 - DNA, 121 bp, Artificial Sequence
  Synthesized
  misc_feature (61): n=t or c
gaaggaatggcagtgtatgtgtgcatctgactacgagtaggtcctggggaaaggagttctncccaaagataaacagtaaaatctttttccgacatttccttggcttgaaggcatcttcttg

SEQ ID NO: 12865 - DNA, 121 bp, Artificial Sequence
  Synthesized
  misc_feature (61): n=a or t
accttgtgcttacagttctcacgtgaatatttgtatcaggtaaatccacagacatacggtnggcataaggctgcaattataccaaaagtttgttttgaaaaatttagctatggaaatgtat

SEQ ID NO: 12866 - DNA, 121 bp, Artificial Sequence
  Synthesized
  misc_feature (61): n=a or g
tcactgtgtgtgtagaatgagtaagactctacaggtgtagtgtagtagcgtgatgtggtcntggttattggtcttaaatagaactggaagtaaagcatggagtctgctctgacctgaaagg

SEQ ID NO: 12867 - DNA, 121 bp, Artificial Sequence
  Synthesized
  misc_feature (61): n=c or g
catgaactccattatacgtccctacgggaaaactacacaggctagatgacagaaaaggtantttaatgtagggagggaagaggtgaggaaaagcagaaatattaaccagctgtgactttaa

SEQ ID NO: 12868 - DNA, 121 bp, Artificial Sequence
  Synthesized
  misc_feature (61): n=a or g
tctggtgcatggtgtaaactcaacgaatttctacgggagcttgctctgtggtccactgganatgttaaggaaggactgcttggcatgacaagaaattgttggaaaagcctttttcttgtgc

SEQ ID NO: 12869 - DNA, 121 bp, Artificial Sequence
  Synthesized
  misc_feature (61): n=t or c
acagatgagaatagtataatcaaactgctttggaccagttgtatattcagaccacacatcncagagtatataaacaggaaacttgccatgataatattatctttccataggacctactcct

SEQ ID NO: 12870 - DNA, 121 bp, Artificial Sequence
  Synthesized
  misc_feature (61): n=a or g
cctccccccaccagaaggagtcagtcctctgcaaccagagggctgagatatcctgcaaaanaggtggtaagtgtagacgtactttaacagtactgagatccatggggtgtttgataatatc

SEQ ID NO: 12871 - DNA, 121 bp, Artificial Sequence
  Synthesized
  misc_feature (61): n=t or c
gctactgctatatgattctggctttgtgtgaacaacgttcatgctagcacagtgttttggnggcaccggatgtaatgtccaaagcaacttgtaaggtaatgaaaaaacaaggtggaagaag

SEQ ID NO: 12872 - DNA, 121 bp, Artificial Sequence
  Synthesized
  misc_feature (61): n=t or c
tggcctagaagaggtttaatattttcatggtagggtaatttaagggtctgctcagtgggangtagcttcatatactcaatgagaactgcaggcagggtaaggtgaagtacgggttgggtgc

SEQ ID NO: 12873 - DNA, 121 bp, Artificial Sequence
  Synthesized
  misc_feature (61): n=a or c
atctactgtgctatttctgctgttcacactaatctttcccatagagacagattctgttganagtattactccagagtctttactgaaaggatgcatctgacatcttgaagcaaagagtggg

SEQ ID NO: 12874 - DNA, 121 bp, Artificial Sequence
  Synthesized
  misc_feature (61): n=t or c
aacagtaaggacttgaaaaacaacaaacacgtccagaaagtgctcctagttttgtttcttncttcatctatttcctcttcacatgctctgcttcaacagaagcagtatcttcaacattttt

SEQ ID NO: 12875 - DNA, 121 bp, Artificial Sequence
  Synthesized
  misc_feature (61): n=a or g
tgactgcacagctcaggtgttagagggttagaagagaagagaatggtgccttgaaagggtnctttggggatgagaaaagaaaaacactgttatagttggagagaggaccttagagaactta

SEQ ID NO: 12876 - DNA, 121 bp, Artificial Sequence
  Synthesized
  misc_feature (61): n=a or g
gcaggagtgtgcagcagcactggtggctttcctatgcatcccatcagcagaggagatccangaaccgggcagtagaatttatccccctcccctttatagaaacaaaaccaaataagctgag

SEQ ID NO: 12877 - DNA, 121 bp, Artificial Sequence
  Synthesized
  misc_feature (61): n=t or g
gaggagaaaaaacttcttgtggttctgtacctccacctatacctctactgggttgctggcntcttctggtatatacgtggtgtgggaatggagaacttgggtcactttttggatgaacagc

SEQ ID NO: 12878 - DNA, 121 bp, Artificial Sequence
  Synthesized
  misc_feature (61): n=a or g
gcccaagttgtgcctgggctgtagctcgtctccagatgttcatcctcatgtccgaggtttnatactagatccctgaacctccctccaaattccccagtgagaaggagaatggtggtgaatg

SEQ ID NO: 12879 - DNA, 121 bp, Artificial Sequence
  Synthesized
  misc_feature (61): n=a or g
tttttttttttattattctttttttaatagctattcctactgtttttgcctgtcttccccntgctgcagagaaccaagcttggtagatctggttgtcccacgttatcagcaccttctccaa

SEQ ID NO: 12880 - DNA, 121 bp, Artificial Sequence
  Synthesized
  misc_feature (61): n=t or g
tgtgtgacacactgtgcaggaaaagctgcaacaccctttcagtgtgtgggagcaagagagntggcttttgcaaaggaagagtgagtcctgcccctctctaggctgtctgcaattaccgtgg

SEQ ID NO: 12881 - DNA, 121 bp, Artificial Sequence
  Synthesized
  misc_feature (61): n=t or g
atctgtggtgggcatggggagcagaaaggagcgcagagctgcagtgcaacaaagtacctgngccttggtgtgctttcctccccaggaatggagtttgggaagcagtcttcttcttgtcctc

SEQ ID NO: 12882 - DNA, 121 bp, Artificial Sequence
  Synthesized
  misc_feature (61): n=c or g
cacaagaatatatatataaccaccacctgtacttaagagagaccctaagtgggatgaaagntcttaatgcacacggaatcacaaagttctctccagtgcgtcatggactactgtaaaatta

SEQ ID NO: 12883 - DNA, 121 bp, Artificial Sequence
  Synthesized
  misc_feature (61): n=a or g
ggatcagagtttgcaaaaggtaatgcttttaatttgagaggtgtgtaagaatcagtgaggntggagcaggaaaattgtgagaacagatttggatatggccacgatgagttatgtatccctt

SEQ ID NO: 12884 - DNA, 121 bp, Artificial Sequence
  Synthesized
  misc_feature (61): n=a or g
cataattaaattgaaacagcggtgtatgttatcttctaccaagtcaagctaaaatacaccnaaaggtacacaacccttagaatcactactgaagtaatcactagccttgttttacaagaaa

SEQ ID NO: 12885 - DNA, 121 bp, Artificial Sequence
  Synthesized
  misc_feature (61): n=a or g
tctactgttatcacacacagctcttcaatacatgggagagtgagcccacatacagcctagnaggaaaatatggagcattaagggctgatgccttgtggaggtgtttgccacgtccagcaat

SEQ ID NO: 12886 - DNA, 121 bp, Artificial Sequence
  Synthesized
  misc_feature (61): n=a or g
tgggcagggactggccaccagacaaccacagacaaaatctcctgagggccaacgtcagccnagaaaatttatggtttcctttcctcctcacctcctctgagggttttgtttatcttttgga

SEQ ID NO: 12887 - DNA, 121 bp, Artificial Sequence
  Synthesized
  misc_feature (61): n=t or c
tactcactcattttcttaatcattttaacactctttctttacatttactccagtctgaagncatttttctcacaaatttgggactcacccacagcattccaaacaccttcccacaaccttg

SEQ ID NO: 12888 - DNA, 121 bp, Artificial Sequence
  Synthesized
  misc_feature (61): n=a or g
tcctttatgacaatgaataataaatatgataattaataataaatatgcataatgaatacanaatttgatcagagagcctgtaagcaaagattcttctctttgatctacagctataacatat

SEQ ID NO: 12889 - DNA, 121 bp, Artificial Sequence
  Synthesized
  misc_feature (61): n=t or c
cagcccctctaaactgggaagcattcccattgttggacaattgcctgtgttgtgcctgttnggtagatagagatccctgggcattgatgctatgaatggtgcttttcataggagccaagca

SEQ ID NO: 12890 - DNA, 121 bp, Artificial Sequence
  Synthesized
  misc_feature (61): n=a or g
ataataacaaggaattctgtttctatatagattatgggcttagataaggaaaggaacgacngcacaagactgtttcctctcatgtcgtgctactgttactaatgcatgtattattataaac

SEQ ID NO: 12891 - DNA, 121 bp, Artificial Sequence
  Synthesized
  misc_feature (61): n=c or g
aggatatatattggagttagaccttccttttaacaacaaacttactgtgctttccccaggntgcaggattccaatgggtatggcaagtggagttatacttgattcacaaatcaatgcttca

SEQ ID NO: 12892 - DNA, 121 bp, Artificial Sequence
  Synthesized
  misc_feature (61): n=t or c
tgggatttggctccgggttctgctggttgcactccagtaagtggacacagactggttttangcaagtggcaaaggggtaaaggcagtaaaagagcagtttgggatgagcatgggggcaaag

SEQ ID NO: 12893 - DNA, 121 bp, Artificial Sequence
  Synthesized
  misc_feature (61): n=t or c
tttaactgcgagcgtttttgagggttttaaccacccagtacgtggcgttggttagtcaccncgtacaggcattaaaatgttagaaaaagcagtgaagcacagatgcagcccgtttgatact

SEQ ID NO: 12894 - DNA, 121 bp, Artificial Sequence
  Synthesized
  misc_feature (61): n=t or c
gatgcccaactatccattcatcaacattcggcctaatggtgagcacagaactggggctggnaacttccctgcgtgtcagcgggtgcaggagcagggccagggcagcagcctctgaacatcc

SEQ ID NO: 12895 - DNA, 121 bp, Artificial Sequence
  Synthesized
  misc_feature (61): n=a or t
ctatggaaaagatgaggcagtgtgaaaagaagcaaaattatttaggatcagaagattgatnaagaaaaacgtagaagtgaataagtgaatacttaaagctacaaaaggaataatattatgc

SEQ ID NO: 12896 - DNA, 121 bp, Artificial Sequence
  Synthesized
  misc_feature (61): n=a or g
cttttttatttcttttctttaaagatttgttcagttttcaattagtttcatgtttaattcnggcttttaacgcatgattccagaactgacctcctcacataactatttttgtctgtgttaa

SEQ ID NO: 12897 - DNA, 121 bp, Artificial Sequence
  Synthesized
  misc_feature (61): n=a or g
acatcaagactattccatgtcctgtctttgagccaatgaaagctacaaacaaaactgaacnttgtagtcaaaaggttcactgtaactttgcaaagcttgcaaaatctagaagaaaaaatgt

SEQ ID NO: 12898 - DNA, 121 bp, Artificial Sequence
  Synthesized
  misc_feature (61): n=a or g
tgatcaagccaaaagtcaatgctacctggtgccaggatgcaaattgtttcagttactgtgncatgcagcagctttttagttctgcagacctctgaggtccacacagtgtatggctgcacac

SEQ ID NO: 12899 - DNA, 121 bp, Artificial Sequence
  Synthesized
  misc_feature (61): n=a or g
cagttattgattacactgaggaaggtatttagccctagttctgctgggtccctgagatacngcacctttaacttgtctgcaccacggtaagcaaagagcagttgcaggagagaagatacac

SEQ ID NO: 12900 - DNA, 121 bp, Artificial Sequence
  Synthesized
  misc_feature (61): n=a or g
agaagcacgtgcatcaaacatgcagttttctgaagcatccaggtatctaaatggcttcctnagagagtgggaaatacacaaaacaggtttggtaatcctcttgtgagagaaggagttgtca

SEQ ID NO: 12901 - DNA, 121 bp, Artificial Sequence
  Synthesized
  misc_feature (61): n=t or g
tgcttctagagcagcctctgaaggccaagagataaattcaattatccattttacttctgtngagtagtactatttttaaaacttgcaagccgtcctgtccatggtaattttagaaaatact

SEQ ID NO: 12902 - DNA, 121 bp, Artificial Sequence
  Synthesized
  misc_feature (61): n=a or g
caggttctagaccatgtggagctttaggctaaacagaggtttcatacaagggcaggaaggnaggtgcagataagaataatctacttgtgatgtgctaacacataaaggagaagaaaatcat

SEQ ID NO: 12903 - DNA, 121 bp, Artificial Sequence
  Synthesized
  misc_feature (61): n=a or g
catcccacaagctgctgtaatgattttgtgtcgagatgatccaataaactttcaaaacaangttgaacccttcggcgccgttcagtggtgtgggtgcagggatggtgcggctctgtaatgc

SEQ ID NO: 12904 - DNA, 121 bp, Artificial Sequence
  Synthesized
  misc_feature (61): n=a or t
ttttctcttatctgacaaataatgcaatcaaaacaatcagaacatccagtgaaaatgctgnttttgacaagtggtttgatctgaaagctacttttagagcttcaagatgtggtattatatc

SEQ ID NO: 12905 - DNA, 121 bp, Artificial Sequence
  Synthesized
  misc_feature (61): n=t or c
tttgtttcaactggaaaagaaaaacaaaaaacaaaaagaaacaggagggacagggaacctnttctgctctttgcctttctaagacaggaaggaacaacaagagatgtctcttccaatcgaa

SEQ ID NO: 12906 - DNA, 121 bp, Artificial Sequence
  Synthesized
  misc_feature (61): n=a or g
tttaaacagcctagaccagacacaaagtcccctagaagtatattcaagaaaacagctttcnattagcacctgttacagttaaggatcctatatatcttttaagactcaaccaagttctact

SEQ ID NO: 12907 - DNA, 121 bp, Artificial Sequence
  Synthesized
  misc_feature (61): n=a or g
gtattggcctcagactcagagtacatatgtcatcttccagtcctttttaaggagggactcngtgtgccagtatgctttctatttccagttcagttttggatccttgaaaaattaatttacc

SEQ ID NO: 12908 - DNA, 121 bp, Artificial Sequence
  Synthesized
  misc_feature (61): n=t or c
aagaggctgcagagcacctggtggtgggagcctggcagtgctggtactgaagggaatgggncttgtggaagatcaagcagggacagcatgaaattgccctcccaggaggacttcagtgcct

SEQ ID NO: 12909 - DNA, 121 bp, Artificial Sequence
  Synthesized
  misc_feature (61): n=a or g
tgcactcctgcagtctttgtcattaacatgacagctttattgaaacaagagacatagggancccattttactgctgctcttctagatggctcttttgtgctgttcctgctctctgaaataa

SEQ ID NO: 12910 - DNA, 121 bp, Artificial Sequence
  Synthesized
  misc_feature (61): n=c or g
tccctttctataatcttccattcattgcacagttctgcagccaatcaggctccccaaattntctatttcattctgcaaaactgatgtggaacgtatttctttagaattgtttcagaacagc

SEQ ID NO: 12911 - DNA, 121 bp, Artificial Sequence
  Synthesized
  misc_feature (61): n=t or c
tgaaatggaaggccctgaacagctatctgaatctttttgatataaaggagctgcagtcaantgttttatgtttgcagtcttgccaggaacctgtggactatttattgaagggaaccacaaa

SEQ ID NO: 12912 - DNA, 121 bp, Artificial Sequence
  Synthesized
  misc_feature (61): n=a or g
tttagaaagcattaagggtgcttaactcctaacagtgtgcgaggaaactcccaagcccttncttcttcagcctgaggctttgagaaggctgcgctgccttgggatcccatgtgcagatcaa

SEQ ID NO: 12913 - DNA, 121 bp, Artificial Sequence
  Synthesized
  misc_feature (61): n=a or g
ctgagtagaagagaacattttaaaaagtcccttttgtagtgctttgtgtgctttgtgtganattagtttggattgcagtttaatggttgcatggcctgagcctttcacttactggtctcag

SEQ ID NO: 12914 - DNA, 121 bp, Artificial Sequence
  Synthesized
  misc_feature (61): n=a or c
atttcatggctgcagcctgcaggattggctcttttgaacctttgaaccagctgctctcacncacctgccacctttcaagcttgcagtatctctttagtaggaattgtccacttctggcctt

SEQ ID NO: 12915 - DNA, 121 bp, Artificial Sequence
  Synthesized
  misc_feature (61): n=a or g
tcaaaacttgagaagtattgactttatgcaaaatcctccagtaaatacgttgatcatgtanggaattttcacctgtatggcagaatttatattgtagactatcaaatcaatgttttttgcc

SEQ ID NO: 12916 - DNA, 121 bp, Artificial Sequence
  Synthesized
  misc_feature (61): n=a or g
ttgcccaacttttgagaactcatacattatttaagtcatttgttgttagttacagtgtacntgaacaggaaatccgggcagtgctatggatatagtgacacacatgtttatggtgtctcat

SEQ ID NO: 12917 - DNA, 121 bp, Artificial Sequence
  Synthesized
  misc_feature (61): n=a or g
caagagcagacagagtacaatacatgggaaaacagacagagcacaccagtagaatcccatntaaagacctgcagtgctctctctgcccactgtgtccctgagagagagcaagcctcccccc

SEQ ID NO: 12918 - DNA, 121 bp, Artificial Sequence
  Synthesized
  misc_feature (61): n=a or g
catgattattttaataatcccagcaacacatgagtgtgcctctgctcaaaggaaaaagggnactagaagtattgatgtgtttatgaaaccaccagtgccagaacaatgtacagtaatccca

SEQ ID NO: 12919 - DNA, 121 bp, Artificial Sequence
  Synthesized
  misc_feature (61): n=a or c
atgtttcccttcatgttgtcttcccttcccaaggctgctcaaagatcacacttatgttctnctcttctctcctatttgtatttaaggcacagcctttgattggaggaattgcgttactgtt

SEQ ID NO: 12920 - DNA, 121 bp, Artificial Sequence
  Synthesized
  misc_feature (61): n=a or g
gggaaggacccacgtgttgttgcctttttggaaggagacctgctgtctgaatctgggtggnggggcagcagccaagtggtgtgaaggcacctcccatggctctgtcatcaccccagagatg

SEQ ID NO: 12921 - DNA, 121 bp, Artificial Sequence
  Synthesized
  misc_feature (61): n=a or g
tgcaacatatctgtggagtgctcccttctgcactgatgctttcctactttctcaagacaancagcctgtcctagggggaatggatagaagccacggggagggcttagaaatacagctacct

SEQ ID NO: 12922 - DNA, 121 bp, Artificial Sequence
  Synthesized
  misc_feature (61): n=c or g
gacttcaacaggaaaaaaaaaggagcctcaatgttaaaaaatggttgaccctgataatagncaattttggaattcatctatttgatacatactatgtggttcctgttgatttaaggaagta

SEQ ID NO: 12923 - DNA, 121 bp, Artificial Sequence
  Synthesized
  misc_feature (61): n=a or g
cttctaaatatgttcaagataaaaaaaaaaaccatgagtgcatcagtgggagagcttcgtngtgactgtctgtgtcccagagtgcaaggatggaggctcgccctgccctcgtggtgctcag

SEQ ID NO: 12924 - DNA, 121 bp, Artificial Sequence
  Synthesized
  misc_feature (61): n=t or c
tgctgacacactgccttgctgtctttcccttcctgaaccagcattgctccctttctacacngcctgccagtcatttgcttttaccctccctttcagaaggggtaaatgcactgattcggtc

SEQ ID NO: 12925 - DNA, 121 bp, Artificial Sequence
  Synthesized
  misc_feature (61): n=a or g
accacagctcctgcacaaccacgctcattagtaaggacatcagttctgctctccggggtgnctgacctcagtttatgttggtcaatttccccatccaaataatgccttgagccccagctga

SEQ ID NO: 12926 - DNA, 121 bp, Artificial Sequence
  Synthesized
  misc_feature (61): n=t or c
aaacgtactcactatctttttgcttttctttccgtccacgtgattaatctctttgcttctnctcaccaaatcaaaattaggcagcttttctgagggctgaggcctcttagcacttacttcc

SEQ ID NO: 12927 - DNA, 121 bp, Artificial Sequence
  Synthesized
  misc_feature (61): n=t or c
taaggtgccttttttcactgtccacactcctctaggctgaaagcaactgtggtgtactttncacttcagttatactcaggaaaacagtctacatactgagagctatctagcttaactaaca

SEQ ID NO: 12928 - DNA, 121 bp, Artificial Sequence
  Synthesized
  misc_feature (61): n=t or c
ggtctgtatttcactatttgctcaagaaaggtgatctcacctttcttgggttgtagcatcnaagtaaaataccatatcttcttgtaaagtttgtttccactttcattatgccaagcactta

SEQ ID NO: 12929 - DNA, 121 bp, Artificial Sequence
  Synthesized
  misc_feature (61): n=a or g
ggcttctgctgaagacgtggtgacaagaacatttcagggacaagaaggtaagccagcaggntaggcggaacaaatggcttgtccttgcatttcagagatgctaaggagagtttagcactgt

SEQ ID NO: 12930 - DNA, 121 bp, Artificial Sequence
  Synthesized
  misc_feature (61): n=a or g
gggagacatggagctgaaccaccgggccatcgtcaccatgggagacaccttgggtgagcanggccacttgagaaagagaacggagtggttgggttggggtttgcctgtgagtctgaaggcc

SEQ ID NO: 12931 - DNA, 121 bp, Artificial Sequence
  Synthesized
  misc_feature (61): n=a or g
tccagaatactgaaaaaacatattctgcctgagctggcactgagttcccctaaaataatgnatctgacaaagagtgatctcccatgttggctatcctccttgccagtctgaatacataatc

SEQ ID NO: 12932 - DNA, 121 bp, Artificial Sequence
  Synthesized
  misc_feature (61): n=a or c
cattggaggatctcacatcatcccaaaacccgaagggcagccgggatgcccttacctgacngtgctgggatctgtccatccagagcaggttggacccggtgggagctgatgggtgcagcca

SEQ ID NO: 12933 - DNA, 121 bp, Artificial Sequence
  Synthesized
  misc_feature (61): n=t or c
ctggatgtcattaacagatgaagtttttatatctctgccttactgtgaccagtccactgcngtctgtaggtcgtaagcaaggtatcaccaaacaaaaccttttaagtcaacttttgttgcc

SEQ ID NO: 12934 - DNA, 121 bp, Artificial Sequence
  Synthesized
  misc_feature (61): n=a or g
acagaatctgacccgaattcttaagtcagtaaagagtacttttaagcgttttcacatttanaaaatgattactgttagaagtgggaactgaagagcagcgttcagttgaatcttaagctac

SEQ ID NO: 12935 - DNA, 121 bp, Artificial Sequence
  Synthesized
  misc_feature (61): n=a or t
taaaattcagtgaagttcatcatgaactttcctttagaagctctgtatgcacgcagagaanaaacacatggcacatagcttggctttgtgttttgacgcatggcagataagttgtgccatg

SEQ ID NO: 12936 - DNA, 121 bp, Artificial Sequence
  Synthesized
  misc_feature (61): n=t or c
acatgaaacctcaagtcaaccgagatttatattttccttcccagaaatagcataaatcatnccactgatatcattagaactgacttgctgaagccaggcggtacaaatttgctctgatttt

SEQ ID NO: 12937 - DNA, 121 bp, Artificial Sequence
  Synthesized
  misc_feature (61): n=a or g
gtaattgttgtctgaactacaacacatatgaggtggctgcacttggaagctctgtgctgancagacactgagtgccatagggccaacatgcctccccttgccttcttcctgtatctgtacc

SEQ ID NO: 12938 - DNA, 121 bp, Artificial Sequence
  Synthesized
  misc_feature (61): n=a or g
acacagacgctggagctttttattgtacacaattatctgcaacagaatggtgaatggagcntagctggtgtctgttgcatacatactcaacctcagctcttatgtaaacaaatgctcaatg

SEQ ID NO: 12939 - DNA, 121 bp, Artificial Sequence
  Synthesized
  misc_feature (61): n=t or g
ctcctctagaaatttgcataaataatctgtccagataggaaatacagtaaggacggacctnctctgtgcgttgatgtgtgcatttgtttgcaaacgccacggttatcttctcgaggggatg

SEQ ID NO: 12940 - DNA, 121 bp, Artificial Sequence
  Synthesized
  misc_feature (61): n=a or g
agaaaaaaaaaaaaaaaaagaaaaaagaaagactacattgtagtatgcagtgggttgggtnctttttaaagctttcacagcacctcatggatcacaagcctcaactgcctgcataaacaaa

SEQ ID NO: 12941 - DNA, 121 bp, Artificial Sequence
  Synthesized
  misc_feature (61): n=a or g
gagggaaagcaagggcaggatttgtactggtaaagagaaggcgccagaaatggagggggangtattggaagggcagtgggcagagtcatgggaggcagatctactcttagatggcagctgt

SEQ ID NO: 12942 - DNA, 121 bp, Artificial Sequence
  Synthesized
  misc_feature (61): n=a or g
gatgttggctgctgtgagaacagtctaacaactttttaacctcatttgaggagaactgagngactagataatatggaatgaaaagcaagattcagacaatgtggtatattgttaaaccatt

SEQ ID NO: 12943 - DNA, 121 bp, Artificial Sequence
  Synthesized
  misc_feature (61): n=a or g
atgaatagcccagagtccattatacactaaattcacaatatgctccatactttctctagantagatagttacaatttgccaaaaaaagtgaaaagcagattcagcatggttttgaaagcta

SEQ ID NO: 12944 - DNA, 121 bp, Artificial Sequence
  Synthesized
  misc_feature (61): n=a or g
aggggagacgtgctgagagttgaacaacagccggagcttacctaaaattaatttctttatntcacccttgtgttttttggaagggagttctctctagacttgaagtactctgtgccttatg

SEQ ID NO: 12945 - DNA, 121 bp, Artificial Sequence
  Synthesized
  misc_feature (61): n=a or t
gaaagggagtacacagctgaattaatctcccagaggaagtacaggtatttccagagctttnaaaatgatgttccaagcatggctaccactcctgaaaaaataaaacaatatattcaagtag

SEQ ID NO: 12946 - DNA, 121 bp, Artificial Sequence
  Synthesized
  misc_feature (61): n=a or g
gcggagaggctttgcattgccaccttcctccttccagatctattttgcccagggaaaaacnctgttatagcatcccggtcttcagatttcaggatcttcacccctactgtttattttatta

SEQ ID NO: 12947 - DNA, 121 bp, Artificial Sequence
  Synthesized
  misc_feature (61): n=t or c
agctgcagtttctacagtttcagaaggttgatggttggccacatggcccctgcaactctangcagcttctgagagcccaaagggattgcagaagtgagctgaaggaagggcagtgttccac

SEQ ID NO: 12948 - DNA, 121 bp, Artificial Sequence
  Synthesized
  misc_feature (61): n=a or t
tagttttccagcaggttgctacaagaagaaaataaagttcctcggatacatcaaatgagtnagagtatcattcttaccacactcaattatttaatctttgagatcaatctaatgctgagcc

SEQ ID NO: 12949 - DNA, 121 bp, Artificial Sequence
  Synthesized
  misc_feature (61): n=t or c
cgtaggctcggttgcccccagcgttcagcatacagtcgctgtaacttcataatggggttgntggtttccttttgtgttagaggtaccttggaaaaatgtgctatacagagctgtgatgaga

SEQ ID NO: 12950 - DNA, 121 bp, Artificial Sequence
  Synthesized
  misc_feature (61): n=t or c
ttaagacaaattaattgaactaattagtaatctatagaaaaaaggaaagcaagtctttaanagagcatgacagctgcaaatgagtatgtgctgagattccatatatgcaagttcatgtagc

SEQ ID NO: 12951 - DNA, 121 bp, Artificial Sequence
  Synthesized
  misc_feature (61): n=c or g
ctctgtgtactgcctattgctcatacctttggatgtttgggctgaaattgagcatttaganagctttagagaagtggttcaagtgtggcctagcaagtgtgagctacgaaggtgtggtgcc

SEQ ID NO: 12952 - DNA, 121 bp, Artificial Sequence
  Synthesized
  misc_feature (61): n=a or g
agttaggctccagcagtcctctcagtgatcagtctctaaccccaccgttaaggcagccctnctctgctcgcggttctgactgcaagtcccactccagggcctccacttccccctgctgtga

SEQ ID NO: 12953 - DNA, 121 bp, Artificial Sequence
  Synthesized
  misc_feature (61): n=a or g
catttggagagtaagtatctgcagaaaatgtgaatttttgaccctgtgattcaggccaacntgtggattctggatcaatcctgagcatacctatggctgtttaaaatatgaaaatctttct

SEQ ID NO: 12954 - DNA, 121 bp, Artificial Sequence
  Synthesized
  misc_feature (61): n=a or c
taaatcacggtactcatttttttcaattccatccagcatttatgtacaggttttttgctgnaattcagctaataattcccttcttccgcagtgtaaattggttgttcttgcctactaacca

SEQ ID NO: 12955 - DNA, 121 bp, Artificial Sequence
  Synthesized
  misc_feature (61): n=a or g
tacgggggcaagttccccttgagcaattagcaggaggcagtgggatgctgggaaaggagcnagcactgctttcccttacgaagcacgcagggagggcagtgcgtttggtgatgggtccctc

SEQ ID NO: 12956 - DNA, 121 bp, Artificial Sequence
  Synthesized
  misc_feature (61): n=t or c
gcatttattacctgttattcagaatcagtttttacaaggaatggcaacagttttcacaagngaaggagcaaatggataaaagactattaaaaataaagcattacaccccattcaattccca

SEQ ID NO: 12957 - DNA, 121 bp, Artificial Sequence
  Synthesized
  misc_feature (61): n=t or c
cactgaaaatgagattttggcagttatttcggcataagcagggtactcctgaagtctgctngcagggctgtcgggatggtgaaatgcagcaacctgcttttgtttgtctgagcatgtgatt

SEQ ID NO: 12958 - DNA, 121 bp, Artificial Sequence
  Synthesized
  misc_feature (61): n=t or g
ccaagccaggctcctcaaagtctcagacacggctatatacagaagcactgctctgttaagnctgggcaagacagaggtttacagtgtctcctctttagcacacagggaatgtcaatgcaca

SEQ ID NO: 12959 - DNA, 121 bp, Artificial Sequence
  Synthesized
  misc_feature (61): n=a or g
aatcatttaaggtatagaattcagtgctggtaattaattcctaaataggtattcattgtgnttcacagacgcagcactgtcaaattttaaatcctgaaaactcttctggcagtattttttc

SEQ ID NO: 12960 - DNA, 121 bp, Artificial Sequence
  Synthesized
  misc_feature (61): n=t or g
ggcttaatttttgtatcatactgagctgcaagctttgccatcgactgaaataaccatgaantatgtattctccttgtttctatgtacagaactgaagtggattgtaaatttatttcactag

SEQ ID NO: 12961 - DNA, 121 bp, Artificial Sequence
  Synthesized
  misc_feature (61): n=a or g
gtgctgctgggtctgtgtccctctgtccacctctctgtgggtctgcacctccctgggtgancagatcccatttcctgatggggatttccctaggtatgtctaccgtccaagtgagatgctc

SEQ ID NO: 12962 - DNA, 121 bp, Artificial Sequence
  Synthesized
  misc_feature (61): n=t or c
ggagccaaaatttcagaacatctgctgaagtactgcagtataagtttgtctagcaagaganctgcagtgacatttgtgacagatcccctgttctgagggtgtcacctaatgggacatcctc

SEQ ID NO: 12963 - DNA, 121 bp, Artificial Sequence
  Synthesized
  misc_feature (61): n=t or c
tctcaggaacacgtgtttccgaatggccttttttcatgtacagacctaatcctaacgtgcncttcatgtggggtaactgtttactcagaggaagcaagtggcatgacaggggtatgactag

SEQ ID NO: 12964 - DNA, 121 bp, Artificial Sequence
  Synthesized
  misc_feature (61): n=t or c
accgtaacgggttctctgcacaattatcacaacacttagtaagttattcatttccgagagngctaaggaccgctgtaaatgattttcattttgaaggaggaaggtatatccccctctggaa

SEQ ID NO: 12965 - DNA, 121 bp, Artificial Sequence
  Synthesized
  misc_feature (61): n=t or c
taaaaattgcaagcccggttcttcagtcttacatcagtcaaaacattcatcctcttttttncccctcatttttcagtaatctctccaaaaatgcaactctatataaatgtgttctttcatt

SEQ ID NO: 12966 - DNA, 121 bp, Artificial Sequence
  Synthesized
  misc_feature (61): n=t or c
ggcaaagggaagtttccttctcgctaattcccactgaatggtcagtgttaagaagaatggnagtgatgagctcatcaagaggagagagcagagaacaaaacagcactcggtaaagcaggtg

SEQ ID NO: 12967 - DNA, 121 bp, Artificial Sequence
  Synthesized
  misc_feature (61): n=a or t
ccagactttttaagggatattatgatcatataaaaacttcctcatatttctactgtgcacntacacaaacattatcttaatgcattactaggtactgctaatagcatgaaccagctttgac

SEQ ID NO: 12968 - DNA, 121 bp, Artificial Sequence
  Synthesized
  misc_feature (61): n=c or g
aactctttattcaggacagaaataccattggtcttcaacttccaaaaatatgcattatccnttacccagcagcaactttgcaaaaaactggaacaaagtatcattccacaccgtttatgaa

SEQ ID NO: 12969 - DNA, 121 bp, Artificial Sequence
  Synthesized
  misc_feature (61): n=a or g
ctaagagttcaatcaacttgaaccagatccatactgaaaccttcccaaaaatccacagagntcattaaggctaaaactggaagttctgggtctttaagaatatccaggtttgttcatattt

SEQ ID NO: 12970 - DNA, 121 bp, Artificial Sequence
  Synthesized
  misc_feature (61): n=a or g
cagcaccctggcagagttcttgacagaaaatggagaggcagaaacttgggatgacagaggntttgaatctgcaagcttctgatctggcatttaagcacgtgcttggctttgagcatcagtg

SEQ ID NO: 12971 - DNA, 121 bp, Artificial Sequence
  Synthesized
  misc_feature (61): n=t or c
tgatcttggttaaaactctgactcaaatatacagagcaaaaattgacagctgttgcaaaancatagaactctaagaagctatttatatattgtttaattcatttgcatcatagatattatg

SEQ ID NO: 12972 - DNA, 121 bp, Artificial Sequence
  Synthesized
  misc_feature (61): n=a or g
ggcagccttgattcagggaacatatacacttccagattaatcaagttaatttttctacacngacagatctgcaaggaagtgctttgcaaggaatgtaaaatcaaaattaaaacggacgaca

SEQ ID NO: 12973 - DNA, 121 bp, Artificial Sequence
  Synthesized
  misc_feature (61): n=t or c
cccatgattacttggtgggagtgaatgtgcagctcgcttttagagctcatagatgaaaccncagccttgagctctacccatataaatccagagtaacgtactcttagcttatccggagtaa

SEQ ID NO: 12974 - DNA, 121 bp, Artificial Sequence
  Synthesized
  misc_feature (61): n=a or g
ccagagagccaaaaagcccggggaaggctcagggatcctctctcctcgtcgggttttcagncggtgctgtagctgtgctccctgcaaagagctgggcaggcaggacggggcacagctgaaa

SEQ ID NO: 12975 - DNA, 121 bp, Artificial Sequence
  Synthesized
  misc_feature (61): n=a or g
gattaggaagaaaacgtaggagaagcgttagtgtaattgcacaagatttggcttgattgcntgcagtcatgttcctgatttcttctatcagtgttctgaagatggggtaaaaccctccagg

SEQ ID NO: 12976 - DNA, 121 bp, Artificial Sequence
  Synthesized
  misc_feature (61): n=a or g
gtacacttttatagcacagacaaatttatatgtatacagcatcatcattttaatgttcttnctgaacacggaacctctgcaacaacaggagagaaaagtagtatctactattcaattatgt

SEQ ID NO: 12977 - DNA, 121 bp, Artificial Sequence
  Synthesized
  misc_feature (61): n=a or g
tctgtctgaggaaagggattagagttttctcaaagctacgccttcagcctttacctgtaancccattagttctccagcctgctattaaattgagccatgttactgcgttgtggttgggtgt

SEQ ID NO: 12978 - DNA, 121 bp, Artificial Sequence
  Synthesized
  misc_feature (61): n=t or c
aagacccctttcttttagttatagtagcaaactattttcatataaatgaaagatggctgtngatcagaatgtactacctttcaggcaaagtagtacttcttataaaatgttgggtggtatt

SEQ ID NO: 12979 - DNA, 121 bp, Artificial Sequence
  Synthesized
  misc_feature (61): n=c or g
ttctgtgtgagatggagtcagactcacaagacagtctaagaccagggcagtcatggggagntctcactttggctgactaggtacttctccatgtcctggctcagaatgatcagttgagttt

SEQ ID NO: 12980 - DNA, 121 bp, Artificial Sequence
  Synthesized
  misc_feature (61): n=a or g
ataagaaagtcctatatatgttaatgaggtgaaccttaattaaatggagctctactgtcgnaaatctctgtagctgctgacctgagcttatttatgggtctatcaatgtagtatcttgcag

SEQ ID NO: 12981 - DNA, 121 bp, Artificial Sequence
  Synthesized
  misc_feature (61): n=t or c
ggataattatttggagtactcataagtacagtatgatgattctttttagctattgctcagngcactgtaacaaagtaaaactgaacttccctttttctgacgcagtgcaagttgacactag

SEQ ID NO: 12982 - DNA, 121 bp, Artificial Sequence
  Synthesized
  misc_feature (61): n=t or c
tgcactgtgcatgttctttcccatgctgcagaaattgtcagaactgcaaacaactccgctntacttttaactctaccccaaatacctcccccagaaatatcagttctctatctcttagtat

SEQ ID NO: 12983 - DNA, 121 bp, Artificial Sequence
  Synthesized
  misc_feature (61): n=a or g
atcaacagctacactgactcacaggggtaaggtgaggctgtgtaagggaatcttcacctcnagttgtctgaattccctgtgctggggctcgagaagagtagattcaagctaagcaattcat

SEQ ID NO: 12984 - DNA, 121 bp, Artificial Sequence
  Synthesized
  misc_feature (61): n=a or t
cttggccaaatcctactgtcctgagcagaagcagaaaccagtaagaatgggccagccttanaccccatcaggtttaactttgagaactacgacgaggggtagagggcagacaatgcaaacc

SEQ ID NO: 12985 - DNA, 121 bp, Artificial Sequence
  Synthesized
  misc_feature (61): n=t or c
aagtacacacacattttttcacttgtgtgacatggtcagattttagagctgttctcttttnggtttccgaagtacggaacgtagtgctttgaatattattgttaacgttttttccttcctt

SEQ ID NO: 12986 - DNA, 121 bp, Artificial Sequence
  Synthesized
  misc_feature (61): n=t or c
gggtaaggaataaataatcggcaaataaaggagggagagtccagtcctaaatgattaatgngagaaagaaactcgaaaatttagcattggaccttcaaaccctccatgggactatggtaaa

SEQ ID NO: 12987 - DNA, 121 bp, Artificial Sequence
  Synthesized
  misc_feature (61): n=a or g
acctcagcaaaatagatcccaactacttggtttttgagaaaaaccctggggaatgcctganccctcaacaagagctcccaggcaaggtaaaaatatcaaaactgggggacttaggtgccta

SEQ ID NO: 12988 - DNA, 121 bp, Artificial Sequence
  Synthesized
  misc_feature (61): n=a or g
ctatctgaatttagtctacatgatgtgctgtatttaccaattggctatgagaacattggangtaaagaaagagatgtctagcccttagctgttccatgtgattcattagactttgcacact

SEQ ID NO: 12989 - DNA, 121 bp, Artificial Sequence
  Synthesized
  misc_feature (61): n=a or g
atacaggcgtagtgatttccagtcattaagaaagaaaagcaagagacagctccttgaactntgaaatccctcagtcaaggtggtcagcaaggatctcgtcacatataatttcatatcccat

SEQ ID NO: 12990 - DNA, 121 bp, Artificial Sequence
  Synthesized
  misc_feature (61): n=a or g
gattgaatagatgatattacagaagcctatcaaactagaaattgcatattgctgtaagcancctatggcaaaagttgtatacaactctacatgcattatgctctggctttgtagtcacagc

SEQ ID NO: 12991 - DNA, 121 bp, Artificial Sequence
  Synthesized
  misc_feature (61): n=t or c
caggtgatctcctgaagcttttattatgtacctttttcattctgggggagaatgaaatacngttcaaaagcttcccttttccaagatccagctctggaagaaaaatactgtgcaatgcaat

SEQ ID NO: 12992 - DNA, 121 bp, Artificial Sequence
  Synthesized
  misc_feature (61): n=a or c
aaatatagaagaattagatgtgctttccatacgcaaaagaggaacagtttactttgttttntgggaagttttaccagttcagggctaagtcctgaattagaacataaagctccaagtatct

SEQ ID NO: 12993 - DNA, 121 bp, Artificial Sequence
  Synthesized
  misc_feature (61): n=a or g
ttacttggacatgatgcatatgctgtatttaagaaaagctttataaatactggtaacttcncataagaactctcatttacaagcatggggctttttgccctacttccagctttaagggcca

SEQ ID NO: 12994 - DNA, 121 bp, Artificial Sequence
  Synthesized
  misc_feature (61): n=c or g
tcaagacttgctggcatgttgggaaagaagtgacactgtggctgttcttcttgtttcagtnagtgatatattacaaaaaagtacaaagttagcatcccgtcagtttttagctgatataata

SEQ ID NO: 12995 - DNA, 121 bp, Artificial Sequence
  Synthesized
  misc_feature (61): n=a or g
ctaattttgtgacacgagaaaaaacaataattactgattactattagcaggagttaaagtnaaacttctcatggtaagtctgagctcatgagtcagtggggcaagagatttggtattagcc

SEQ ID NO: 12996 - DNA, 121 bp, Artificial Sequence
  Synthesized
  misc_feature (61): n=t or c
aaaccaaagatagaattaaatcaaatatttgcataaaggcctttggagaagtctgggccantattaagcaatatagatctcagctgaggtgagatatacaactccactggagttgaatagt

SEQ ID NO: 12997 - DNA, 121 bp, Artificial Sequence
  Synthesized
  misc_feature (61): n=a or g
gactcacatttgcatttgctatgaaagagagttttcttcacaaatacatcctttaaggccntaacagaaccaaatacaagacaacagccagttcaggtaccattcttgtatagaactcaaa

SEQ ID NO: 12998 - DNA, 121 bp, Artificial Sequence
  Synthesized
  misc_feature (61): n=t or c
ttgcaagtccagtagttctaaaagttaatgaacttttgcataggaagatgaaaatagtttnaaactttgtgcactagggcacaggttataagcactagtctaactgcaaatagagcagctt

SEQ ID NO: 12999 - DNA, 121 bp, Artificial Sequence
  Synthesized
  misc_feature (61): n=t or c
gagcagcttactcaagatgaaccaatctacttatgcactaagaacactgtcctaactgaangtgggagagacacaggaacacatggcagtgacctccatgaggctggaagctgctcatgga

SEQ ID NO: 13000 - DNA, 121 bp, Artificial Sequence
  Synthesized
  misc_feature (61): n=a or g
tactaaactttttttcaatcctctctgcactgtggaatcacatctgacttgagactccacnctggtcagtgctgcattaacatgcgcgctgatctacacctggaaataagctgcagatcag

SEQ ID NO: 13001 - DNA, 121 bp, Artificial Sequence
  Synthesized
  misc_feature (61): n=a or g
ctgctcttttagcttggaagaaacaaagatgaacagaggagtcatttacgtgtgacgtgtnttgttctgaagccaaacgaatcaacagaaagtggtccctaaaaacatcatcctagtgcaa

SEQ ID NO: 13002 - DNA, 121 bp, Artificial Sequence
  Synthesized
  misc_feature (61): n=a or g
gtcggctttcacagttaggactgtcaggcagagctcccacttgtgtcacagaactcctatnggatgctcagcagctccctccagccaagtttccaaaagggtcactatgatggcactgctg

SEQ ID NO: 13003 - DNA, 121 bp, Artificial Sequence
  Synthesized
  misc_feature (61): n=a or g
gagcgtgtggtgacagctgaatctatttttttctccaatgtgtgaatgctgaagggttgancataggcccaaaagaaactttcacaagcagctaagctaggaggcatccatcctctgacat

SEQ ID NO: 13004 - DNA, 121 bp, Artificial Sequence
  Synthesized
  misc_feature (61): n=t or c
tgtctctgtggccatgcacatccttgtgcatggaaggatggtacagagcccaccttccagngcattctgacacggcatgccttctccaaattcatcacctagaaatccctgtgtacttgtt

SEQ ID NO: 13005 - DNA, 121 bp, Artificial Sequence
  Synthesized
  misc_feature (61): n=a or g
ataaatggtctgtttatatggtgtccacctccttggcagattttgtctttcccttgaaccnttttgatgctactgatgtgtttatagaagaaagcgagtttgctaatggtggagaagcgtc

SEQ ID NO: 13006 - DNA, 121 bp, Artificial Sequence
  Synthesized
  misc_feature (61): n=a or g
gaacatctagaagtcagtagtgagaaataattatgaagctcatcaaacaaaaaagggaccnaaagcatgacctttgacaggcaaaacgggtggagggaaagcagtgaaacttgtttctgtg

SEQ ID NO: 13007 - DNA, 121 bp, Artificial Sequence
  Synthesized
  misc_feature (61): n=a or c
agaaaataagtacagttagaaagggaaatgagcaaatctaagtacactgatcagacatccnagcagacagccaatctcataataccacctgaaacgatcatagaatggtttgagctggaag

SEQ ID NO: 13008 - DNA, 121 bp, Artificial Sequence
  Synthesized
  misc_feature (61): n=t or c
ggggctgggaaggagaggagagctaaggcaattttctccagtgtttcccagtggacaggangccgatgggctgtatgtgccctgtctgaagccaggcatcacacattcctcctttaattac

SEQ ID NO: 13009 - DNA, 121 bp, Artificial Sequence
  Synthesized
  misc_feature (61): n=t or c
gcaatgacctcccagaactgtaataatgtcaaggaaaccagtagaacaaagaccctcagcntgtccctcaccacgtactgcaggatgcagcgtcagaaatcatattcacactgtctgtcct

SEQ ID NO: 13010 - DNA, 121 bp, Artificial Sequence
  Synthesized
  misc_feature (61): n=a or g
gcagcaaagatttttcgtgttgaatttcatctttaagtgaaattgtatgaattcttctccnttagttgcattgttagtgtgaattgatctgcagcaatgacatccttatttctgtttgcag

SEQ ID NO: 13011 - DNA, 121 bp, Artificial Sequence
  Synthesized
  misc_feature (61): n=a or g
ggaaaacagaaacaccgtgtggaaaacagcaagcagcaagctgggcattttgtttgactcnactgttaatcacaaagtttttagctttgtctgcaggagcagcaaggtatgtttgtgtggt

SEQ ID NO: 13012 - DNA, 121 bp, Artificial Sequence
  Synthesized
  misc_feature (61): n=t or c
agggtggagttagggtgaaattccaccaaccttaaagtcagtgcagttcttttcattgtcntgaatgtctttgactcattctccctggcagaagcttgagtagcacacaagtgtaagtatg

SEQ ID NO: 13013 - DNA, 121 bp, Artificial Sequence
  Synthesized
  misc_feature (61): n=a or g
cccaaatactcctactttcgttccactaaagctagtacctatggagctcttttgtggatgnaatttatttttctagtaatttgtactttcttttgcaggtttaaccattacaaaaccactc

SEQ ID NO: 13014 - DNA, 121 bp, Artificial Sequence
  Synthesized
  misc_feature (61): n=a or g
taacagttcagaaatatcaatatgtgaattgttgagcaaaatgcactgaagatagaaatanccctagtacaagctacagtttgcatgcagtttgaagtaatttttaaattgcaaaggatga

SEQ ID NO: 13015 - DNA, 121 bp, Artificial Sequence
  Synthesized
  misc_feature (61): n=a or g
agctaaatgcttctcacattgaaatccaaaaagcataaggtctgcatcagcatcgcctaancctaacagcaagcctctccagtgcagaggaaaagaattctcctggaatgagggaaagggg

SEQ ID NO: 13016 - DNA, 121 bp, Artificial Sequence
  Synthesized
  misc_feature (61): n=a or g
tcagtaagaaattagcacgtcagagacacttacggttggtgtgttgtcatcctttgagatnctttcctcaatggactttctagcaagacaggaaaacctggaaaaatggcaatcaccatta

SEQ ID NO: 13017 - DNA, 121 bp, Artificial Sequence
  Synthesized
  misc_feature (61): n=a or g
catcattctccaaaagtctccgaaggtttctggcaatgccccttgtgttgctatatatgcnttctgctttctgtatccatctatgtagttggcattgatgtagtcactgcctggtatgcct

SEQ ID NO: 13018 - DNA, 121 bp, Artificial Sequence
  Synthesized
  misc_feature (61): n=c or g
gaggagattaccattcctatcatacaaatctgtcctttcagaaatattaaattacttttancagcaaagaaaggtaaccttcatcaacagcagtagcaaaattaatattttcctgtagcat

SEQ ID NO: 13019 - DNA, 121 bp, Artificial Sequence
  Synthesized
  misc_feature (61): n=a or g
aggagtgtcaccacactcatggctcagaaacttctggaaattttgctcctacctctgtcanaaaagtcttctgtgtttcctcatcacagcgaatcagctctttcatcaccatcacctttcc

SEQ ID NO: 13020 - DNA, 121 bp, Artificial Sequence
  Synthesized
  misc_feature (61): n=a or g
tttgaagtcagaataactttgtactgtcatcctgggaagaattaaatcattatatgcaccncaatagttatggcgatgtttattcctgaatataatatgagaaaaaagacaagtagtgtgg

SEQ ID NO: 13021 - DNA, 121 bp, Artificial Sequence
  Synthesized
  misc_feature (61): n=t or c
gacgtgcaggaagaaagctctacagtgagctggggctcagacgttaaccggtgtgctatanatacaataacactagatggcagcacagactctgaaaagctgctcttgccttcgggctcaa

SEQ ID NO: 13022 - DNA, 121 bp, Artificial Sequence
  Synthesized
  misc_feature (61): n=a or c
atgaattctgtagtctgattcactttacctcatctgtgacaaatgttccttgatgtacaantcttccaagttaaatgtaactatacttacggaaagtttccactgtgatccaaagtgttat

SEQ ID NO: 13023 - DNA, 121 bp, Artificial Sequence
  Synthesized
  misc_feature (61): n=t or g
ttagataaactgttttctaaaactaattttggaatacttatacatttgtgaaataaggggnaatgcagaaaaaaagctactggattctgctctgactgtagactgggaggggaaggctttg

SEQ ID NO: 13024 - DNA, 121 bp, Artificial Sequence
  Synthesized
  misc_feature (61): n=a or t
ttgatgcatattcccactggactgtctgcctgcaggctttcttcaccttcagctctctgantttttccatatgttgcaatgtttcagctgggaaccatgattataaatctccagcctttat

SEQ ID NO: 13025 - DNA, 121 bp, Artificial Sequence
  Synthesized
  misc_feature (61): n=a or g
ctgattaactcctggtgagctagggaagcaaatcaaacctttctattcacaaacatgtacntatctgctgaagagagaagcagtcacagatatggatatcaatttcatggtagtgcccttt

SEQ ID NO: 13026 - DNA, 121 bp, Artificial Sequence
  Synthesized
  misc_feature (61): n=t or c
gcaccctttaagtaattatgggacaccaatcctaagtgataaacagcaaatagctcatgtnccaaaaatcaaagtcatgggagttccaaaactgcagatatacgttctttttctatgctct

SEQ ID NO: 13027 - DNA, 121 bp, Artificial Sequence
  Synthesized
  misc_feature (61): n=a or g
tgcaggctctgtgcttccccatcctcaggtctgaaaggctaccggtctggctttgatgttntacatagacaacagtagtgtacaggataaggtgcattagacacacgcctaataactgaag

SEQ ID NO: 13028 - DNA, 121 bp, Artificial Sequence
  Synthesized
  misc_feature (61): n=t or c
tatgtgtcatgccctcagattctcaaaatttgtcatgcattgacgctttctaatccttaantcttctctagtcgattacatcaagtgtactaaataccagatgctttacaatcaaatatga

SEQ ID NO: 13029 - DNA, 121 bp, Artificial Sequence
  Synthesized
  misc_feature (61): n=a or c
gctgaatagtaagggattcagaggttaatcaggaggaggaaaagcagagaaggtggcttgntgtttggcatgaattttcttggaactactttgctctactccagtgaggggtattacagta

SEQ ID NO: 13030 - DNA, 121 bp, Artificial Sequence
  Synthesized
  misc_feature (61): n=t or g
ctgctaagcgaggtgaaggcatgagaagtgtctaaagggataaaaagtaatgcatgaaaanatcaagcctgttctgttagcacactctgtgctttgtggctgcattgggacttcttggagg

SEQ ID NO: 13031 - DNA, 121 bp, Artificial Sequence
  Synthesized
  misc_feature (61): n=c or g
atgcgaagatctatcccagttttctccacccttgtttcagcacttgttaggacatcagaanactgtatatatggtctccccttcagctctatccatgaggtactcacctggtttgtctcat

SEQ ID NO: 13032 - DNA, 121 bp, Artificial Sequence
  Synthesized
  misc_feature (61): n=a or g
cagtatgattattgctatgaagtttcaagtaatccaagctggtgtctcagaaatgcatgantttcctgtagcaaccttcagtaaatcattacatttacctgcaaatacaaaataaatgaag

SEQ ID NO: 13033 - DNA, 121 bp, Artificial Sequence
  Synthesized
  misc_feature (61): n=t or g
gccctgttgatagtcaattaaaacatatatatttttaaataaccactatttttgccctcanttctgctttggcatagggaggaatggtattctgagccgctcctttagcttctatatccta

SEQ ID NO: 13034 - DNA, 121 bp, Artificial Sequence
  Synthesized
  misc_feature (61): n=t or c
atgcttctccctcagaagaaaagacttttcaagtacatggagtttttatgcctaacatttnctctttccaggtatattttggcttttgttgttgttgttcataaattctaatatttttgaa

SEQ ID NO: 13035 - DNA, 121 bp, Artificial Sequence
  Synthesized
  misc_feature (61): n=t or c
ctttcacaaagatggtgctcctttcatgcacaggtctgaacagaatatcaatcacttctanagctcctttacaaaactggtggactaccttgtgcaaaacagttaattcaccttctctact

SEQ ID NO: 13036 - DNA, 121 bp, Artificial Sequence
  Synthesized
  misc_feature (61): n=a or g
atatagtgctgagtagtttcctctctgtcatggctggatgcccccatttctggctaacagnttgtctttcgagctctcatgatctttattcagggtttcctttaaactcagctttacatcc

SEQ ID NO: 13037 - DNA, 121 bp, Artificial Sequence
  Synthesized
  misc_feature (61): n=t or c
ctcatgcacatccacccttttcttgagcccctccggggatggtggcacactgtgacaaggnttagcaggacttttcaatacaccctgtccttggcagtgccctggagctggtctattggca

SEQ ID NO: 13038 - DNA, 121 bp, Artificial Sequence
  Synthesized
  misc_feature (61): n=t or g
aaacattaagaaacatactgattgcttatgtgataattcatgtaccaataggtgttttttnggctaatagtagtcctgataatacaattccaatagtctcctgctgcacagttttctttgc

SEQ ID NO: 13039 - DNA, 121 bp, Artificial Sequence
  Synthesized
  misc_feature (61): n=t or c
ttttttttttcagaaaagcataacatttctaaaataattatccaatttctattgtgaaaangttttcagacctaggagtgttttaagctagatatacaggtgtttgtcccaggtggactaa

SEQ ID NO: 13040 - DNA, 121 bp, Artificial Sequence
  Synthesized
  misc_feature (61): n=a or g
ccaaaatgctgtctgaccttctttgtcttgaagactgaagctatctccttaagtaataacnaagtattgatattgatttcagaattggttttattttttcatcacttgtcataagtacatc

SEQ ID NO: 13041 - DNA, 121 bp, Artificial Sequence
  Synthesized
  misc_feature (61): n=t or g
gtcaattatgcagtttggttttcactcatatcaccttggcattaggcctataacaaacatngtgaagttaaaagctctcttatcttagaatgcagtcactggagaaagagaaatatatagt

SEQ ID NO: 13042 - DNA, 121 bp, Artificial Sequence
  Synthesized
  misc_feature (61): n=t or c
tatattctagttcaggactgaataaactgatgaattaatgcattaaagtagttggcaaaanttagcacgtatctgcaagataatttgaaaacatgagcttcacactccatgttgactagat

SEQ ID NO: 13043 - DNA, 121 bp, Artificial Sequence
  Synthesized
  misc_feature (61): n=a or t
atccacctgcaggattaagtagcttattagcagaaagatagaaaatgtccagactacagcnatactgttagtaatcagcatctgtcagaatacaaagcaagtaggagaacaagaacaaaaa

SEQ ID NO: 13044 - DNA, 121 bp, Artificial Sequence
  Synthesized
  misc_feature (61): n=a or g
tgaagagactatgtcagtaacagcagcaagcagtaacattaggccctgatagtaggctggnaatttcacttgggagttttcttccagatgctgcagaagatgtaggaaccaagccccagaa

SEQ ID NO: 13045 - DNA, 121 bp, Artificial Sequence
  Synthesized
  misc_feature (61): n=a or g
tgtctttcttcctcttccctttatgtttctcttgctttctgactgaactcaccctgcaggnagctttgcggcctgtactgcacagtgctctgaagaagcttcatctgcttctgcagtatca

SEQ ID NO: 13046 - DNA, 121 bp, Artificial Sequence
  Synthesized
  misc_feature (61): n=t or c
aagggcatgaatttgagtgaactgtgtgaaacagggaaaactttaattgtgggggcagccnagatataaactgcctcatgacaatttcaagtatgcactataggagcagtaacgcttaatg

SEQ ID NO: 13047 - DNA, 121 bp, Artificial Sequence
  Synthesized
  misc_feature (61): n=a or t
gatcccttgttgctctgaattcccatctcacctcagtcatatcagattcccagagaaacangatacagccaaacagcaaccatgtgctcagatggagcactgcggtagaacgtggcttctt

SEQ ID NO: 13048 - DNA, 121 bp, Artificial Sequence
  Synthesized
  misc_feature (61): n=a or g
ttctttcatgaatgtgagcaatgcagatctgatccttcaccaccacagctgccatcttctngatcctaggaatgccatcatttgtgaaatgctttttcttttcataaatatttttggtttt

SEQ ID NO: 13049 - DNA, 121 bp, Artificial Sequence
  Synthesized
  misc_feature (61): n=t or c
cctgtcttcccattatcactgaaacacaagcactcttcattaggctgaagagccattacantgaccacattgaacgctttcattctgagattctcacagcctattacactgcagcagaact

SEQ ID NO: 13050 - DNA, 121 bp, Artificial Sequence
  Synthesized
  misc_feature (61): n=t or c
ccacaaaccacatattaatgtttgacgtggcgcaggttttttatggcagaggggatggctntaacaaggcatcatttcctacttctgagctgctgctgctggggcttggctgcaggagtag

SEQ ID NO: 13051 - DNA, 121 bp, Artificial Sequence
  Synthesized
  misc_feature (61): n=a or g
tctaacaacatacaagatgtacagacagacaaacttacaagtactgcacgaattgcttatntttttcactgatatgactccctaagattatcatgagtttgttccagttttcatcaaaatc

SEQ ID NO: 13052 - DNA, 121 bp, Artificial Sequence
  Synthesized
  misc_feature (61): n=a or g
agtgcattctgtcagtataaaggtgcaaaacaaactcccagtctctcaaagattaagggcngtcataacacctatgtccgtaaaaagctatttcatgtttggtcaatataattatccatat

SEQ ID NO: 13053 - DNA, 121 bp, Artificial Sequence
  Synthesized
  misc_feature (61): n=a or g
gtggtggggtgggcttgggatgtggtggggtgagtgtgaaatgaggtgaccctgttctgancagccaggaggtgtgcctgcaggatgtgcacacacctggggggagaggcaggcaccagtg

SEQ ID NO: 13054 - DNA, 121 bp, Artificial Sequence
  Synthesized
  misc_feature (61): n=a or c
tgtttattatttacagcctccttgggcaaggggaataagccaaagaggggaaatactcctnttaacacccgctatcactcatctgccatgaatagcaagcagtggaagtaaatattgtatt

SEQ ID NO: 13055 - DNA, 121 bp, Artificial Sequence
  Synthesized
  misc_feature (61): n=a or g
tactgaccacatacctgttggcagccttagcattctatttgtaacagcattgggatcattnctgaatctgcctaactcttacaaggccaaacatgtgcaaaccaaagtccccacccaagaa

SEQ ID NO: 13056 - DNA, 121 bp, Artificial Sequence
  Synthesized
  misc_feature (61): n=t or c
agaattgcactgaccacacttagaaaacactccaccagagctactgctgcagcctatcctnatgttcagccagaaagaaccttgaagatcttaggagacaaatgttatgtataccatctgc

SEQ ID NO: 13057 - DNA, 121 bp, Artificial Sequence
  Synthesized
  misc_feature (61): n=a or g
aattaaagaaaaaaaaaacacatctggcagaggatgcaaaaaccttctagataggtgtatnatactttcaggaacaatgttagatatcaaccaatcacatgctccaatcagttagtttaaa

SEQ ID NO: 13058 - DNA, 121 bp, Artificial Sequence
  Synthesized
  misc_feature (61): n=a or g
cgtaagaggcattagctactgttctttcaaattaaaaatattaaggtggctccaagcaagnagaaaagaacctgctttctcatactatgtgtacagtacccatgctaagtgaattcaaaat

SEQ ID NO: 13059 - DNA, 121 bp, Artificial Sequence
  Synthesized
  misc_feature (61): n=t or c
aatgccacggaaagagtcgggtgatgggcaggatgatatcatgatggattagcccgtgcanttgtctggcagtgctggaggtcagcagaaggttataatcctctccagcatgtgttacctc

SEQ ID NO: 13060 - DNA, 121 bp, Artificial Sequence
  Synthesized
  misc_feature (61): n=t or c
gtggaggtttctgtctgttagtgccatgataattgtgctttttaaccaattttgctcattnctctctctgtgcagtaatttttacctcatgtgaagtcacagcctaataggtgctcaaagg

SEQ ID NO: 13061 - DNA, 121 bp, Artificial Sequence
  Synthesized
  misc_feature (61): n=t or g
taatggggaaaagagaataaggaagatgggggtgggtaggctgcagctagctttgagcttntgtcgcttgtgtcatgagtgtaaatggaaagtatttgtgtatcagaacctgtaattctct

SEQ ID NO: 13062 - DNA, 121 bp, Artificial Sequence
  Synthesized
  misc_feature (61): n=t or c
gagacagactatgtggtactctgttctgctagactgtgtgtgaccacagacataatttatnttgggttctttgctagaaaaagagaatgacactcttctgctaagccacgggaatgccgca

SEQ ID NO: 13063 - DNA, 121 bp, Artificial Sequence
  Synthesized
  misc_feature (61): n=c or g
actgcaaccagctgccccaagcaatatttctacctattttgttaccctcataaaccttcanagtcgcagttacatttagtctccaacttcctatcgtgctttgaacacaggacacagaaga

SEQ ID NO: 13064 - DNA, 121 bp, Artificial Sequence
  Synthesized
  misc_feature (61): n=t or c
cagccattggtaaaaaatgctcttgtatgtcttgttaatactgaaggtatttattcctgantgtgacaaagctgactcctattctgtatatttccatgcgcaaatagaaggcctgatcttt

SEQ ID NO: 13065 - DNA, 121 bp, Artificial Sequence
  Synthesized
  misc_feature (61): n=a or g
ttctgagaagaggttgaactgatgctaagaattataagcagatgtaacccctgacttggtnccaggcagctgacatctttcccagcaatgtgcaatgctcatctcagacgcagcagaggtg

SEQ ID NO: 13066 - DNA, 121 bp, Artificial Sequence
  Synthesized
  misc_feature (61): n=t or c
cactagtggagggttttctaactccgggtaagcagcctgaatggcagctccaaagatctcntgaagacggctgttgatattaatcatgcttttcactgttttactttgttcctcttgaagg

SEQ ID NO: 13067 - DNA, 121 bp, Artificial Sequence
  Synthesized
  misc_feature (61): n=t or c
agttatcccaacagaaggaagtcaagccctgctcagctaaactgctctgccagcagatgantgggagcatggtgagcagctggagcattttaaagctatcctactccagttagttctgtat

SEQ ID NO: 13068 - DNA, 121 bp, Artificial Sequence
  Synthesized
  misc_feature (61): n=a or g
gctttgggtgctgctttgggctgaaaacatcgcggtgttggaaccgggttccttctcatcntcccaaagactgcttccttattaagggctgggaacggctcccaccagcaacacgaggccg

SEQ ID NO: 13069 - DNA, 121 bp, Artificial Sequence
  Synthesized
  misc_feature (61): n=t or g
acttatttattctaatatttaaaattgtttgcttcaccagtattgagagtgagtgacttgnaagaaagagtacatcagtctttgtacataactcagaattgctcttacaaacacagctgat

SEQ ID NO: 13070 - DNA, 121 bp, Artificial Sequence
  Synthesized
  misc_feature (61): n=t or c
gacatctgggctgaaggcatgggatggaaagggcaggaggtaaagagatcgaacaaccttntcaggcagggcagagctgtcaagttcctttttggaaggaaggagcttgctgggtaggcac

SEQ ID NO: 13071 - DNA, 121 bp, Artificial Sequence
  Synthesized
  misc_feature (61): n=a or g
gcctattactgacgtagtacttaaatacacacagtgaaaaattagcaaacatacattgaantgtaactggcgtttggcctgaatgatgtgcgtgaggcagttcctgctcttggtgccttac

SEQ ID NO: 13072 - DNA, 121 bp, Artificial Sequence
  Synthesized
  misc_feature (61): n=a or g
gatgccaagaggaaaaagagacattgtctatacagtatacattaatgtgagccataccaanctgtacttctaaacaaatctgcagtgatggggactatccagaagcctcaagttctatgaa

SEQ ID NO: 13073 - DNA, 121 bp, Artificial Sequence
  Synthesized
  misc_feature (61): n=t or c
gaaacaggtggatttttggaggagaaatcaatttatagcttgttatttacataaaaatcantaaccacattcagcctgtccacataaccaaaacatgcttcattttgatcatcgtctgaca

SEQ ID NO: 13074 - DNA, 121 bp, Artificial Sequence
  Synthesized
  misc_feature (61): n=a or g
gcaatcctccaaatgggcggaaagcctgcagcctccaggaccactaatcaccttttgtgcncagccagaccagatgtttaatcccatttgccaattgggaaaggcagaacgatctctattt

SEQ ID NO: 13075 - DNA, 121 bp, Artificial Sequence
  Synthesized
  misc_feature (61): n=a or g
gacagctcaggctgcagaatgggctgatggttggaccggatcctcttagtcaacctcaatnagtctttgattcctgcttgggggaaaaccaagaggcacgccaacgttgtgatgctcttta

SEQ ID NO: 13076 - DNA, 121 bp, Artificial Sequence
  Synthesized
  misc_feature (61): n=a or g
tagttacgtccctcccatgcaaatgaattgaaatttaaacactgaatagttacctcattcncacccaaagcttcacaggttaaaatagagcagaacgttacaaaaccaagacgagcctaat

SEQ ID NO: 13077 - DNA, 121 bp, Artificial Sequence
  Synthesized
  misc_feature (61): n=a or g
tttttttccctatacgaatgttttggaagcagagcacattattccaaatgcgattaagccntttggaagaggattatggtgttttgggaataacaccctcttattcccgaatgagatcagt

SEQ ID NO: 13078 - DNA, 121 bp, Artificial Sequence
  Synthesized
  misc_feature (61): n=t or g
gggagcagatgactttgttctccactcagcattattacgcagtgcctcacaggggagggcnggagatgaatcagacccaagtatgaacctgttgttcttgcacagaaccaagtgcagtgct

SEQ ID NO: 13079 - DNA, 121 bp, Artificial Sequence
  Synthesized
  misc_feature (61): n=a or g
aagtggtgtctcattcagcagcaaggaaacactgctcccagatcaaccatttactagaacngaacccagaaccagcagatctacagaatgttaattaaaagtccagcaatgtctgggaaag

SEQ ID NO: 13080 - DNA, 121 bp, Artificial Sequence
  Synthesized
  misc_feature (61): n=a or t
gattttttcagcaatcctatatttacctccagaatttcttcttactcatttgaagaagganacacatctgaagtagataaggataacccgtttgttttcaaagttattgtcaataccatca

SEQ ID NO: 13081 - DNA, 121 bp, Artificial Sequence
  Synthesized
  misc_feature (61): n=a or t
gctaagctattgtgcttgtttgacacttgctactgaaaattgaaagtgcaacatttttgtntatatatgggtccaaaaaataacaggaaagttggttgacaaggacatctaggggttatta

SEQ ID NO: 13082 - DNA, 121 bp, Artificial Sequence
  Synthesized
  misc_feature (61): n=t or c
aaagcttttccacatcctctttgcttgtttttagtcttccttatcatctttcctccagatntgtttgcattattcacacagattctttcccttaaataccttcaacatgcttattcaggag

SEQ ID NO: 13083 - DNA, 121 bp, Artificial Sequence
  Synthesized
  misc_feature (61): n=a or t
atgctcttcagtcccttgatcacttcagtagctctgctctgcatttcttgcagattgaatngctcttatttgaacaaggattaatcagatttgtattcaggattctatttggagtctgagc

SEQ ID NO: 13084 - DNA, 121 bp, Artificial Sequence
  Synthesized
  misc_feature (61): n=a or g
cttccagagcacaaaccaacagaaacagttatttatgtgtctacactatgccagtttaacnttccctcaggacatttcaaaaacgtcatccagatgattttactaccacatgttacgtctt

SEQ ID NO: 13085 - DNA, 121 bp, Artificial Sequence
  Synthesized
  misc_feature (61): n=t or c
aaagacaaacagttcccatgtccaaagatggactttggggtgaataaaagcagtaaaaaanggcatccagtattttgtctgaataaaaatagtgccccagaagtgaatagatggggcatca

SEQ ID NO: 13086 - DNA, 121 bp, Artificial Sequence
  Synthesized
  misc_feature (61): n=a or c
gggcttgggaacagcctcccttgcctgatgtggaaacagctctgcctcctgttaatttatncacagtgtggagcaattggagtcagttattcagttttttatttacgctctgtactgttgt

SEQ ID NO: 13087 - DNA, 121 bp, Artificial Sequence
  Synthesized
  misc_feature (61): n=a or g
tcacttctgtgttcagcagagttagagacagatctaatctttgacatcattaaaatgcccntagagctaaattttaataccctacaggacattactgcatgtttattttataagacgatat

SEQ ID NO: 13088 - DNA, 121 bp, Artificial Sequence
  Synthesized
  misc_feature (61): n=t or c
ctggcactgggacaccagaaccaaggaagagatgtagcatactgttcagaagcctgttttnctggctggaagtttatcaaaggtgcctgtaagcctgtccttcacgtccttttacaagggt

SEQ ID NO: 13089 - DNA, 121 bp, Artificial Sequence
  Synthesized
  misc_feature (61): n=t or c
aattcagtataaaatgcattttaaaggaagcagatcttactttcttgatcctcttacagtngtacagctcctaacataaactagcttaaaacctttttccaaattgagtagatggatctca

SEQ ID NO: 13090 - DNA, 121 bp, Artificial Sequence
  Synthesized
  misc_feature (61): n=t or c
tgccactcatttcagtgacagtcacaaagaaaggatttcggggaactgagaattttcaacngtatctttctaaaccgtgcaaaaaagaataaaaataaggaaaggagaaataatcaccctt

SEQ ID NO: 13091 - DNA, 121 bp, Artificial Sequence
  Synthesized
  misc_feature (61): n=a or g
atgtttttggctgtaactgaaatactctttccattgcgataataatttattctggttttgnctcaattcaaagttctaggtagaaaagggagcaagtttgtcaggagagactggaagaacc

SEQ ID NO: 13092 - DNA, 121 bp, Artificial Sequence
  Synthesized
  misc_feature (61): n=t or g
tttttaatgtcacaaaggtaattaccgcagcagtctcagagcagtggtatgtagcaagatnatatataaaaacgttgattttgtagcagcatactgcttttgtttttcataaaaaaaatta

SEQ ID NO: 13093 - DNA, 121 bp, Artificial Sequence
  Synthesized
  misc_feature (61): n=t or c
aaattttaatatttctaagaaagagtgcagctttagaaagacagctccattacaactgaantctgtgctacagttaatgtgacttcagcacctgagtaagttattgagattatcctgggga

SEQ ID NO: 13094 - DNA, 121 bp, Artificial Sequence
  Synthesized
  misc_feature (61): n=a or g
gagctattgccagcagacagtgggagcaaagctgttcctcggtgcagtttccagcagtgantacatggcacatcccacacacagttaagggaacgagaacttctagatggtgaatccgtct

SEQ ID NO: 13095 - DNA, 121 bp, Artificial Sequence
  Synthesized
  misc_feature (61): n=a or g
cactgctgttgtcgttcatttagtcttcatttatctttacagtttctaagtagctcacacntactaatgattttatcttgcataacctgtaacacatgaaggggatgatcagcaatgtgtg

SEQ ID NO: 13096 - DNA, 121 bp, Artificial Sequence
  Synthesized
  misc_feature (61): n=t or c
gcaaaagtggaagtaaacatataaacagacctcctttccatggcttatcaacttttgatangaatgtggcagtgacactgcctggcagcacatgttcagatgactgttaaacttcaaagtt

SEQ ID NO: 13097 - DNA, 121 bp, Artificial Sequence
  Synthesized
  misc_feature (61): n=t or g
acctccaggagaattgtacttctcagagccaatgcatcagagttaggcagacgtttctgcntcagttctgtggttttgcactcatgttttcgttcctgctgttacacttggagatttagga

SEQ ID NO: 13098 - DNA, 121 bp, Artificial Sequence
  Synthesized
  misc_feature (61): n=a or g
ctgtgccctggtatgacatccagctccctgaggctgtaagcacgggagctttcctgtcccnctccgactcatgtaatttctcattgccaacctcgtcccaaatgctaagaatatctgaaag

SEQ ID NO: 13099 - DNA, 121 bp, Artificial Sequence
  Synthesized
  misc_feature (61): n=a or g
ctgaccagccccttcatgtttttcccatacacctgcacatcaccaaaatcctatttcagcntagctcagggccaacagcctgtagatgtgcttatctgtgttctgttcttcctagctggat

SEQ ID NO: 13100 - DNA, 121 bp, Artificial Sequence
  Synthesized
  misc_feature (61): n=c or g
atggggaaactgagtctcatgcagctctgtgaatttgactgtaccatgtagcataactgtnattctcatatctgtcatttgagagatgcatccttattgtttccaggggagttttgttaat

SEQ ID NO: 13101 - DNA, 121 bp, Artificial Sequence
  Synthesized
  misc_feature (61): n=c or g
aaaaggagcgaatgtgctgtcagctctgtcctagaggagctgagaaatggagggaatgatntggggagtcctgttttattaacagggagggcttggtgctgcactgcattggcttccatgt

SEQ ID NO: 13102 - DNA, 121 bp, Artificial Sequence
  Synthesized
  misc_feature (61): n=a or g
aggcagcagcaagtcacagtgtgaaatttcagtgaggaatcagttccacctcagtgtaccnttcagtcctgtgataagcaacactgcctgaatttaccatgctactacacaaactactcaa

SEQ ID NO: 13103 - DNA, 121 bp, Artificial Sequence
  Synthesized
  misc_feature (61): n=t or c
ctgggcaagtgctttgccagttgactgtacctaggagacaggagaattagctttcctctgnggttacacttgtgggtacccaaacacaaagatgcaatgccagcaagtatgtattcgctac

SEQ ID NO: 13104 - DNA, 121 bp, Artificial Sequence
  Synthesized
  misc_feature (61): n=a or g
ccgtgtctgcaaaccagggtgttccttcccctttgcctggcagggctgtgtgatggatgcnctcattgcatcctgctggtgctgcctcatcctagcaatgagcggtgcccgtgggaagggt

SEQ ID NO: 13105 - DNA, 121 bp, Artificial Sequence
  Synthesized
  misc_feature (61): n=a or g
gagagaaagagatgatataccagtgcccaccagaagcaaaaggtatttattcggcagcagnatgcaacagttaagatcaaactaattgtacagaagtaaagttgtgcaaccttaaaatata

SEQ ID NO: 13106 - DNA, 121 bp, Artificial Sequence
  Synthesized
  misc_feature (61): n=a or g
aattcatttctcaggtggtgcctaggaaaagtcctccttggtgctggaaagagggaccacngtaggcaaaggaaacatctgcagacagagggtttttgttgctgtgttactgccaacatcc

SEQ ID NO: 13107 - DNA, 121 bp, Artificial Sequence
  Synthesized
  misc_feature (61): n=t or c
ctgttttaggattttagtgcataattatgctatattataattctaggtggtaccctatgtnaagggtagtttgaaatgtgatagtgttatgtccacagtcattgctttgtcccttctgatt

SEQ ID NO: 13108 - DNA, 121 bp, Artificial Sequence
  Synthesized
  misc_feature (61): n=c or g
gggaagagtatgtgggatgtgccaccctgatcacaaccagaccaggaatgatggatgcttnatgtgcacacacggacagcctggctaaatgctgggggagtaaatagaggtggtttcagtg

SEQ ID NO: 13109 - DNA, 121 bp, Artificial Sequence
  Synthesized
  misc_feature (61): n=t or c
gcgtaatccccacaggtttactgcagaaaaaaaatgcatttttccctctaagaaaggcacngcatccaattcctctgctctgtcagccactccatggccagtgaggatacaagaatcgatg

SEQ ID NO: 13110 - DNA, 121 bp, Artificial Sequence
  Synthesized
  misc_feature (61): n=t or c
aacgccttaatcccacaggtgctttcggtgcctcagatctgccatctcaaagctgtcatgnggggctctccctgcagcagaaggagaagtgcacgggcctcatctcctggaagggacccat

SEQ ID NO: 13111 - DNA, 121 bp, Artificial Sequence
  Synthesized
  misc_feature (61): n=t or c
agttggtggggtaccctgggatcctggccataaaacccacacctctccaccttgggcctantgtgggagaaaccaggaagacccagacctgcaaggtaccctattctcagactgtttttca

SEQ ID NO: 13112 - DNA, 121 bp, Artificial Sequence
  Synthesized
  misc_feature (61): n=t or c
tttcataaagagtttcattttctgtcatagcctaaataaatcagtccagacccatacagtncagggtctattctttagtctggatagctgacccatgtgtgagtctccaggttgtaactga

SEQ ID NO: 13113 - DNA, 121 bp, Artificial Sequence
  Synthesized
  misc_feature (61): n=t or c
attaacgtaaccgtcatctttttgcatcttttcgtcttgctgagatcaggatttcgcttcnctgctctggagcttttcttggctgctcaaactcaaaactcagatcttctcagttctgctg

SEQ ID NO: 13114 - DNA, 121 bp, Artificial Sequence
  Synthesized
  misc_feature (61): n=t or c
attagcacccgattgattcaacctgtgctctcagcacatgtaaggcttactggctattcangatcattttgcaataaaggatgagctatggctatttttagatggtaaggaaatccatgtc

SEQ ID NO: 13115 - DNA, 121 bp, Artificial Sequence
  Synthesized
  misc_feature (61): n=a or g
cacagcctcctcctgaaacacacaacgcagcacaaaacagttctgcttccttttaagcagnggagatctcttcattttctagctacttttgcaacttgctctgtgcctgcagggatgctct

SEQ ID NO: 13116 - DNA, 121 bp, Artificial Sequence
  Synthesized
  misc_feature (61): n=a or g
caagccctttattttcagccttctctacattctatcagatctcacagtcgtcattacgccngttgtatttaataccgcccaaatgaacagagctttctttaatcaccaccacctttctgcc

SEQ ID NO: 13117 - DNA, 121 bp, Artificial Sequence
  Synthesized
  misc_feature (61): n=t or c
ccccttcgaacaggaaataggatcgtgcagcatacaaaccaagctgcaaggcttcactttnactgttccacacgtagacaagcatttgataccatacaagcaatactatacgctaatgttt

SEQ ID NO: 13118 - DNA, 121 bp, Artificial Sequence
  Synthesized
  misc_feature (61): n=t or c
ttaatcaagcaggttaacggtgctttctgctcacagtaagaaggctctctgacagaaaggnagcaacggctgtctctgaaaactcttggtgtgagctgagaaacattctgcagttctaagc

SEQ ID NO: 13119 - DNA, 121 bp, Artificial Sequence
  Synthesized
  misc_feature (61): n=a or g
tgcaaaatcaacatgcaacagtatactcatgttttatgttcagaggatttataagggttcnttaaaggccacagactagcaggatgagcttgcatgtctacaggtcattgacttgcaatgt

SEQ ID NO: 13120 - DNA, 121 bp, Artificial Sequence
  Synthesized
  misc_feature (61): n=t or g
acacttaattctgcagcatagccttcagttcacttgatttggggtggctctcagtctagtnacagaagtttggtgcagtctttcaggcagatggaatctaccagtcatgaaggggagtggt

SEQ ID NO: 13121 - DNA, 121 bp, Artificial Sequence
  Synthesized
  misc_feature (61): n=a or t
gtctattagaaaaattcttgggaaaaatctctacaaccactgccatatttttccatgggcntttttcttcactgcttggaatcataacaatacacaccgtatttggagctttttaatatag

SEQ ID NO: 13122 - DNA, 121 bp, Artificial Sequence
  Synthesized
  misc_feature (61): n=c or g
ctttgggtatttcttttttccaggctttgcagagttcagtggaattctgctgtgtgtgctnctgtgtgtgtgcagcgactgcacgcagccacaaaaataaaccagtgggatctctccctca

SEQ ID NO: 13123 - DNA, 121 bp, Artificial Sequence
  Synthesized
  misc_feature (61): n=t or c
aattaagcatttcagtggagtagaaaatgaaatgcatgatattttgtttctcttcagttantgtccctttatggattactgcagacagttcattataaattattttactgattttctgaac

SEQ ID NO: 13124 - DNA, 121 bp, Artificial Sequence
  Synthesized
  misc_feature (61): n=t or c
ttcacatttaggaaaaactgaggttaaatttgtattttgttctttaagggggggggacagnatggaagttagtcatgcattaagatttgtttcaggtgctagcctatgccctgaatcctca

SEQ ID NO: 13125 - DNA, 121 bp, Artificial Sequence
  Synthesized
  misc_feature (61): n=a or g
ggagccatgagaaactaagtgatacatccaaatcagaagtcactgaaaacaaaactcaaantgagtacagatgcacaaaatgaaaaatttgttttgcttttaattcttaaaagactgttca

SEQ ID NO: 13126 - DNA, 121 bp, Artificial Sequence
  Synthesized
  misc_feature (61): n=t or g
ctgctttgtttctgctcttatttctctctgccacagctcctcatcacacaagcctttctgnaggctttagtggtatggtaagttgatacctagtctgcagctaagcaccacacactcaccc

SEQ ID NO: 13127 - DNA, 121 bp, Artificial Sequence
  Synthesized
  misc_feature (61): n=a or t
acgaccccacatcaagtgggatggaaattgccttccaatgtattgtccttatgccagtatnttaattacaaggccaacgcttttatttgcttattctttgtattcaaattcattcagaatg

SEQ ID NO: 13128 - DNA, 121 bp, Artificial Sequence
  Synthesized
  misc_feature (61): n=t or c
agtctgcaagcactcaaactgatggcccacagccctgctagaaacccaagagattaacagnccaagagtcagctactggggacagcacagttctgatgaactactggaaggttctccatgt

SEQ ID NO: 13129 - DNA, 121 bp, Artificial Sequence
  Synthesized
  misc_feature (61): n=t or g
tattttggataaaattctttctctggtttcttacaagctgcatccagctgactgaaactgncaaatctgaatctcgttttcattgctccatccttacttagaaggttaggaactgcttaag

SEQ ID NO: 13130 - DNA, 121 bp, Artificial Sequence
  Synthesized
  misc_feature (61): n=t or c
gatattgtattttgctttgttttctatgttgttaagtaaatagccagacttttgtagatcntgtctttctataacctttaaagaaacattttaacagcaaaagttagaaactaaagatcta

SEQ ID NO: 13131 - DNA, 121 bp, Artificial Sequence
  Synthesized
  misc_feature (61): n=a or g
gcacaaggacaaaaacatcttcccctctttccttggcctgatgtcctccctttgctatcantcctattcccctaagcagtgcaggggatcagatgagagttgtgttaattgcagcccctct

SEQ ID NO: 13132 - DNA, 121 bp, Artificial Sequence
  Synthesized
  misc_feature (61): n=a or g
tagtagtggatgatgtacaggtgatctgattgaaatcaggtctggtttaaggctattgtcntcttaaggtcagtgattctcctgtatgctaagctgacttggcttaagaacgctaaaacgc

SEQ ID NO: 13133 - DNA, 121 bp, Artificial Sequence
  Synthesized
  misc_feature (61): n=a or g
atttcactgcttatggaattactcattgtagtaacttttgctacattggttcagcataccnaagcatccataagtgggcactgttatggcccttcaagccataacaaataccaaattgatg

SEQ ID NO: 13134 - DNA, 121 bp, Artificial Sequence
  Synthesized
  misc_feature (61): n=a or g
gtgttggatggttattctccaccagctgtgctgctgttcagctttctgtgttggatagttnttctgatgattgtgagaacaatgggctggctggctgattgctgaggtgctcctcctggct

SEQ ID NO: 13135 - DNA, 121 bp, Artificial Sequence
  Synthesized
  misc_feature (61): n=a or g
atttttgagtatgtttctgtaactagttaacacttgaatagttcagctgtgttgttgctcntatttttacatattgctacatacgtaagacttgaaatgaaatgatagcattatttttgtg

SEQ ID NO: 13136 - DNA, 121 bp, Artificial Sequence
  Synthesized
  misc_feature (61): n=a or g
ttagtttcatgcattctaactaatgtacctgctgaggggaggccaaatgcggcagggtgtnatgcagttcactggagagcaaagggttagcagggggaaggatgagaaatcagtgagcaag

SEQ ID NO: 13137 - DNA, 121 bp, Artificial Sequence
  Synthesized
  misc_feature (61): n=a or t
caccttgaagacagtgtctgatgttgctgcctagacagaccattttgttcattaggagaantttatcagctagattctatgaggcagcatcacaacattattaaatgattagatagctaga

SEQ ID NO: 13138 - DNA, 121 bp, Artificial Sequence
  Synthesized
  misc_feature (61): n=t or c
tatgcaaatggggaaaaaaggtgagtaggaaaaagggaaactggagcagggataaccaggnaggtaacatgcagcgtccccagtggataaggtcttctggatgaggacaaagagccaacat

SEQ ID NO: 13139 - DNA, 121 bp, Artificial Sequence
  Synthesized
  misc_feature (61): n=t or c
ttaatcagtcaggtgataatcttctcatccctaaactaatccagttcttctctgtgaatgnttccatttgctttccttcataatatgcttcatcccaatactcacgagaatagcacaaaat

SEQ ID NO: 13140 - DNA, 121 bp, Artificial Sequence
  Synthesized
  misc_feature (61): n=a or g
taaagttgcatcgctccaaacacagcgttctcacacagtgttctctcaggctgcctgcagnaagcactgtgcagaccagccagcacagctgtttctgtccttgcaggcctgcccaaagcag

SEQ ID NO: 13141 - DNA, 121 bp, Artificial Sequence
  Synthesized
  misc_feature (61): n=t or c
aggcaaagttttatcaagtgggggaagtgacacgagttctgccttcgtgctccagcaaagncctaccaggctgcctcccaggatctgcctgcactgtcagtgcaaggagagatgagcgctt

SEQ ID NO: 13142 - DNA, 121 bp, Artificial Sequence
  Synthesized
  misc_feature (61): n=t or c
ctccaaaatgtatgctcagcagccaaatgatttgtctttatttcttttaagcagcagcctnggaaatgatgggaagtatttttagggaaggaaaacatttcagcagaatgagctggagagg

SEQ ID NO: 13143 - DNA, 121 bp, Artificial Sequence
  Synthesized
  misc_feature (61): n=t or c
acacacgcaatgaatggttcatttgtaaaatatactgggcaagttagaagagttagaattntctgatgcaagttgttagctgtaatagctgaagttgtatctcatttatacaaaaaaaaga

SEQ ID NO: 13144 - DNA, 121 bp, Artificial Sequence
  Synthesized
  misc_feature (61): n=t or c
ttttcttaatttaataactctccaacttctgtctccaagcagaagcaatagttgtgtgctnaaagatgagcggtgtgtaaattgctttgctgaggtgaaactgcagatcacagtcaggcaa

SEQ ID NO: 13145 - DNA, 121 bp, Artificial Sequence
  Synthesized
  misc_feature (61): n=a or g
tatcatgagccgttcttactagagttcaggacaagaatgtacccaattgcgttactgagtntagaaggtatctgatactaattctgtacttcgagaatatctaaaaagggctttagtaggt

SEQ ID NO: 13146 - DNA, 121 bp, Artificial Sequence
  Synthesized
  misc_feature (61): n=a or g
agaggtggagctgaacctgctgagttcaaacccttctctgagggctctgttgccaccctgntgcaggcttgcctgaaagggaactttagatggattctcttcatttgctctggtcaaagag

SEQ ID NO: 13147 - DNA, 121 bp, Artificial Sequence
  Synthesized
  misc_feature (61): n=t or c
tgataaatacagtttgcaaaaccagcatgtatgactaaatgcataggcttgcaaagagatngtgctttcttacttccccattgtttcacatctcatcgctgaccttttggaacatacataa

SEQ ID NO: 13148 - DNA, 121 bp, Artificial Sequence
  Synthesized
  misc_feature (61): n=t or c
attcagccttaaagcagctgatgcttcattggaagggctagggaaaacaatagtgtgcaangatttacaatgcagttctgccctggggcacataccacgcgtttctgtgctttttccttca

SEQ ID NO: 13149 - DNA, 121 bp, Artificial Sequence
  Synthesized
  misc_feature (61): n=a or c
cccttactgctccagctcttttttaaagacaagcattcaggtttctccagtatctggcagntactagctggtaacagctttacaggcgcagatccattgcagtgcatttacagaacactct

SEQ ID NO: 13150 - DNA, 121 bp, Artificial Sequence
  Synthesized
  misc_feature (61): n=t or c
gaggaaaggctgaaaggcggtaaagcttctgtggcatcacagaaagttaagagcaacatanaagtcattacataacagttaccttaaatctatgctgctaagtttatatgcaaaatcagac

SEQ ID NO: 13151 - DNA, 121 bp, Artificial Sequence
  Synthesized
  misc_feature (61): n=t or c
ggtgagaggtgaatgtgatctttccactgcctctcaaaacctcttttgctctggataaggngtttatgcagcagcccatcgtgatgcctgcgaacagcttcatttcacactgccaagctgt

SEQ ID NO: 13152 - DNA, 121 bp, Artificial Sequence
  Synthesized
  misc_feature (61): n=c or g
gaagctctcactttagctgagttacctctgcactttggtcaagcctgtatctcttctcgangttcccttgctcagtgtctgcacaggcagactagttgaaaagaatcagtaaggtgaaacg

SEQ ID NO: 13153 - DNA, 121 bp, Artificial Sequence
  Synthesized
  misc_feature (61): n=a or g
gggcagtagctgctttcagtcagcttgtgctgttgggggatttcagccattcctgctctcntaatgctttttcccatgtggaaattttgtctcggagtgattttcaaaagtttgtatccat

SEQ ID NO: 13154 - DNA, 121 bp, Artificial Sequence
  Synthesized
  misc_feature (61): n=a or t
ctaaaggttgaaattatactaattggtaattaatttataacctaaagctctgagccctgancagatgtgaaattctacagttagaaaacatcagctcttctgcaaatattaaaatctaaaa

SEQ ID NO: 13155 - DNA, 121 bp, Artificial Sequence
  Synthesized
  misc_feature (61): n=c or g
tttgccttttaagcttaaaagattattagacttttcagtcttaactctattaatttcatanatagtccagaagttctcccatcccacaagaacctacctcacaattttctgtccaagatac

SEQ ID NO: 13156 - DNA, 121 bp, Artificial Sequence
  Synthesized
  misc_feature (61): n=t or c
aataatccaattgctgaaataatttttgacaaggagagaaagactgcttaaccaaagttantgaacctttctttatgcattgtaaacacagcaaaagcttctaaaaacctgttgcataaaa

SEQ ID NO: 13157 - DNA, 121 bp, Artificial Sequence
  Synthesized
  misc_feature (61): n=a or g
gagggaagagcagtgtggttacagtgagcaacctgctgagcaaagcatgctttcaagaggnaaaagccaatgaaggacagtatgacagcaatgcaaatagagatgtgggagcaagaatcat

SEQ ID NO: 13158 - DNA, 121 bp, Artificial Sequence
  Synthesized
  misc_feature (61): n=a or g
caaagaaacgctgccttcacagctgcttgtttgatcagcaatttgccttgtcggctgaacnctgtatttttagaggagcttcccctaggcattcctataatttatgttttacatttatggt

SEQ ID NO: 13159 - DNA, 121 bp, Artificial Sequence
  Synthesized
  misc_feature (61): n=t or c
ttagtgctaatgttgaaacaatttctgagtaaaaatagctacccatatatccattcaatcnagagactaacttcatgatcagatttctcttttttctggagtagatgtgagtctgctttcg

SEQ ID NO: 13160 - DNA, 121 bp, Artificial Sequence
  Synthesized
  misc_feature (61): n=t or c
cactgaaaactacactgcatcaagaaagtactactttaggtaaagaaattagtgctgtatnctgcactgaatccctctaaagatatctcacgtgaatgtttcagcgtatttgatttgaaga

SEQ ID NO: 13161 - DNA, 121 bp, Artificial Sequence
  Synthesized
  misc_feature (61): n=a or t
tgtttggaaacctctcgatcctcattaatcagtttggtgtttttatctacaatatgtgcanccgtaacatgctcctaatgctacttgtctttcattaacccttcataaacccatgattaaa

SEQ ID NO: 13162 - DNA, 121 bp, Artificial Sequence
  Synthesized
  misc_feature (61): n=t or g
atttcacatcctaatactcatcagaaaaacctaattacttagaagctgaaatatttccatnagatgggccatcagactttcaatcagcctgccaatcaattaatactgcagctgaaatcgc

SEQ ID NO: 13163 - DNA, 121 bp, Artificial Sequence
  Synthesized
  misc_feature (61): n=a or g
tactttcttcctgaggaagtcccacttctttaagcaatgagaaaggatatgctgtacatgntagtctgcaaatcactgaaatgaattctttctgcgcaagtagaactgggaagatatcaca

SEQ ID NO: 13164 - DNA, 121 bp, Artificial Sequence
  Synthesized
  misc_feature (61): n=c or g
tagtaagcagggatattcattattgataccattcctttaaaatgcatgaattcttcagagnctcctaggatacaactgcttaccttagttctgttctgttctccttacactgctccatctc

SEQ ID NO: 13165 - DNA, 121 bp, Artificial Sequence
  Synthesized
  misc_feature (61): n=a or c
cacattcctaatgagaaatatctgctcggtttcagcaggggcaaggtggggaaataacacntcaaataacacctctctcaccaacctcactagagcctcacacactgtcagtgagcctaaa

SEQ ID NO: 13166 - DNA, 121 bp, Artificial Sequence
  Synthesized
  misc_feature (61): n=a or c
ccgctctagggtcagcaattcttacagttaaggctggaaaagctgcaaaggaagaaaaaantaaccaggaatatctcatcatagggtctgactacacatattaaatcttatgcctgctaga

SEQ ID NO: 13167 - DNA, 121 bp, Artificial Sequence
  Synthesized
  misc_feature (61): n=c or g
ttattaattctttccaacaacgtaataatgtctaatcgtctgactgacaaattccgcatgnagaaatagcccttcccaccagaggagattcattggcacgtgaactgcttgtagggggcaa

SEQ ID NO: 13168 - DNA, 121 bp, Artificial Sequence
  Synthesized
  misc_feature (61): n=t or c
cttgccacaaactgctcgtggggagcagaagaaaatacaagctggaaagattccgtgtctnacatgcagtgtgtagccagaaaacaggccagcacacattgttattctctttcttagtctc

SEQ ID NO: 13169 - DNA, 121 bp, Artificial Sequence
  Synthesized
  misc_feature (61): n=c or g
tcagaaacatttcaggcaaagtttagtattgcatagacaaatgaagcaagcagacaaatcnctgtgcaggctgtggcatggagcagatccattgtgaagctaatggctttatactcttctg

SEQ ID NO: 13170 - DNA, 121 bp, Artificial Sequence
  Synthesized
  misc_feature (61): n=a or g
gctctaaaacatcctgagaggaccctccatactgatatatacacttatcctatcttgcttnctgttgaatttccacccaaatcgggaaggaagaccaaatgataccactaacctgatagca

SEQ ID NO: 13171 - DNA, 121 bp, Artificial Sequence
  Synthesized
  misc_feature (61): n=t or c
ttcgcagctgtaacactccacataaacgtcacctgtggtaagttagctcttaaacatttcncagtactcagatcccttggtttttccctcagttctatcctcccattaaactgaaaaaata

SEQ ID NO: 13172 - DNA, 121 bp, Artificial Sequence
  Synthesized
  misc_feature (61): n=a or g
cttcctctccctgctcactaggcagtgtccaggcaatgctgctctcagaccttgtttcttntgcatttctatcatcttggattgcagggattgtatgtgtgtgagtgcttgtgagtgttcc

SEQ ID NO: 13173 - DNA, 121 bp, Artificial Sequence
  Synthesized
  misc_feature (61): n=t or c
ttcttcatacggaaggaaaagaaaacatgtattcactggtttggcaaatcttccaggtcantggccaactgaaatcatgggtttctaaaatacatttcctggaaagatataccctgtagtg

SEQ ID NO: 13174 - DNA, 121 bp, Artificial Sequence
  Synthesized
  misc_feature (61): n=t or c
acatacagaaaacagtgttactacagcagcacttattccaatgaagcttctaaatctttcngtcctaattcatcagttgtttctgagcagattaaatagaaatatcattcttgcccttcca

SEQ ID NO: 13175 - DNA, 121 bp, Artificial Sequence
  Synthesized
  misc_feature (61): n=a or g
agctaggatatataccttgaattaaattcctttgctgctgggctctgtttgtgggaaactntttaccttttaaatgatgcactttctcagatctgtcactgtaaagcagacccacacctga

SEQ ID NO: 13176 - DNA, 121 bp, Artificial Sequence
  Synthesized
  misc_feature (61): n=t or c
atatttctctagaaaatatctacttatattgcaccaagtgctgctataatccagacaatcngatgtttattatattggctgcttgggatatttccaatactttcagtagaccccaaaagtt

SEQ ID NO: 13177 - DNA, 121 bp, Artificial Sequence
  Synthesized
  misc_feature (61): n=a or g
aattaggaaaaaaaattagcagccacctgctattctctaaactttgcctgatctgagtcanctaagctttccttttaaataaagctagaatgtatgccttgatatgctcagattcattggc

SEQ ID NO: 13178 - DNA, 121 bp, Artificial Sequence
  Synthesized
  misc_feature (61): n=a or g
ggtcattccagagtgttttatacgtaaagaaacacacattgctcaatggagggtaaaaatngcattcacattattagaatagtagaattagaatagtaaaaatgatttcatatgcgttata

SEQ ID NO: 13179 - DNA, 121 bp, Artificial Sequence
  Synthesized
  misc_feature (61): n=a or g
tggtctctgtgctgccacagtttcagacataagcctatttatttctgtaaccaaactgtgnaatggaaaactgagagactgcccacagtcatgtgtgaagtctgcagcagggctggaaata

SEQ ID NO: 13180 - DNA, 121 bp, Artificial Sequence
  Synthesized
  misc_feature (61): n=t or g
aagtattacatcaactggcttcctttggtcagttagttgagtaaccttgtaaaaggagatnaaatttgtgaagcaggactttcccctcaggagcccatgttggctataatcagtcactgca

SEQ ID NO: 13181 - DNA, 121 bp, Artificial Sequence
  Synthesized
  misc_feature (61): n=a or c
agcacaaaccagttcttaagagggataatgaagattatttttagaatgtatttagttaaanaatacccggatcctatagcagtccattaactcagtgcacaagttctgcactctcaattta

SEQ ID NO: 13182 - DNA, 121 bp, Artificial Sequence
  Synthesized
  misc_feature (61): n=a or c
ggtctccaaaacatgccgataaatcaatcaggaacagtaattggatttgttgttccaatangtttgatcaatggagtggaaaaattcactaagtttctgtttagaataaatcatcctctca

SEQ ID NO: 13183 - DNA, 121 bp, Artificial Sequence
  Synthesized
  misc_feature (61): n=a or g
ccaaaggctgcacagcaataaagtccaaaataaaacaatccataaagcaactgagggcccngtaacttccttcccaaacagatcgtcctgttcccagtagttcctttccatttcttctagg

SEQ ID NO: 13184 - DNA, 121 bp, Artificial Sequence
  Synthesized
  misc_feature (61): n=t or c
aataaaaatctgccaagacagaagaaatgtgacctattcaaaccactgcagtgaatggatncgtgcatatgagaatagaccaatcacaggaaaattgaatcttcttttcaccatccaacct

SEQ ID NO: 13185 - DNA, 121 bp, Artificial Sequence
  Synthesized
  misc_feature (61): n=a or g
caattgtctcattacaaaaatatagagatcagctcatttctagttaagggacagctatcantgttgtaactgatttaaaagctttcaaaaatcacttctaataatcaaggatagtattggc

SEQ ID NO: 13186 - DNA, 121 bp, Artificial Sequence
  Synthesized
  misc_feature (61): n=t or g
gctgtggggaagatggtcaagaacaaggggaccaggtgttttctcttgaatactgccagtnaggaaaaagaacttttggaggaacaaatggatttcatgtgtcagctactggttacatggc

SEQ ID NO: 13187 - DNA, 121 bp, Artificial Sequence
  Synthesized
  misc_feature (61): n=c or g
ttgaagcttataaccctgtgatctttaaatcatattaacagataggcctcaatccagaaantaacacaaacacaatttcctcaggaggcaaactgaaactactctcctcctcatacccaaa

SEQ ID NO: 13188 - DNA, 121 bp, Artificial Sequence
  Synthesized
  misc_feature (61): n=c or g
gcagcgaggaggtctgtgtcatttattcctttgatacaactcgcaaacatgctggacctanggtccttcctctcttacagcaagttcttgggatttgccttccttcataaatctacactga

SEQ ID NO: 13189 - DNA, 121 bp, Artificial Sequence
  Synthesized
  misc_feature (61): n=a or g
gatggcagcagaggggcagtctgacaaaatggcatttgacataaagtgcatatgtagcatngatgtgtcactggattctccaagtggaaaaataattgcatccattgacattcatcaatgc

SEQ ID NO: 13190 - DNA, 121 bp, Artificial Sequence
  Synthesized
  misc_feature (61): n=t or c
gcctgctcaccaagcctggtgtagagaaaccccccagcaggtgatgaccacaacttctttntcttaaggcagtttgtttttccatgagccataaattcgttcttgtgtaggaaagataaga

SEQ ID NO: 13191 - DNA, 121 bp, Artificial Sequence
  Synthesized
  misc_feature (61): n=a or g
gattctcccaaaggagacaaaagtgtaatacctcattaacccatttcagccgcacatgtantagtagtgcacaaccagtcaacttgtattcagtgtgatatgatctttccagctactcctt

SEQ ID NO: 13192 - DNA, 121 bp, Artificial Sequence
  Synthesized
  misc_feature (61): n=t or c
ttttttttggtatggatctgttgcagctattcccatttgaactgagaggaatttaaacatnttcttcttcttttcacaaaaagagcacaaagaagaacaatcatgatgtatgagtactcgt

SEQ ID NO: 13193 - DNA, 121 bp, Artificial Sequence
  Synthesized
  misc_feature (61): n=t or c
gctcagggactcaaagcctttctgttcagaaagtcgcccgtcttctgcattttaattcttngccaatccatctctttcacacagcactgatcctgagcatttcttttcttctggagtaagc

SEQ ID NO: 13194 - DNA, 121 bp, Artificial Sequence
  Synthesized
  misc_feature (61): n=a or g
ctttttctggtatcgctctgctctcagagctgtatttagcaatgctggattttgttggacntgtccaatgtgtagtgatttagagatatttaacagcctgatcaaagacgaatataaaata

SEQ ID NO: 13195 - DNA, 121 bp, Artificial Sequence
  Synthesized
  misc_feature (61): n=a or t
ctgaattagatcatgaaaggggtaaactttgtaacatatattccggagaagataagcaatnctaatgtctcctctttctgcacgaatctaattagcagctctgaggctggaaaaaaaatgg

SEQ ID NO: 13196 - DNA, 121 bp, Artificial Sequence
  Synthesized
  misc_feature (61): n=t or c
agtgctgtcaaaccagcttattcattttgtcaatgtttaagcttctttaagatctggaacnagaaaagccttattgtcagaagcatactgacaaacagacaggtccaaagaacctaaacaa

SEQ ID NO: 13197 - DNA, 121 bp, Artificial Sequence
  Synthesized
  misc_feature (61): n=a or g
gtccttagtgtgtctatgaaatggcatgtgtagccacgttgcagtgtacttctgttaattncattgcagttgctatgccatttgcaaactacctgagtgttatagaaaaaaggatgtcctt

SEQ ID NO: 13198 - DNA, 121 bp, Artificial Sequence
  Synthesized
  misc_feature (61): n=a or g
atgtgcattttttggtgtgtaggtaaaaattatatgcactgtggcgtagtaactctttaantggttggtcagatcttttcagcgtaccaacctgaatactttcctgggctcattttagcca

SEQ ID NO: 13199 - DNA, 121 bp, Artificial Sequence
  Synthesized
  misc_feature (61): n=a or g
tcagcctccatggagcaccaggaagaagcgcagcaaagctgtcagtcctcagggctcagcnatgtgcccttgcagcaccccgacacaaaccacacagtgctggtgataacgtgcttgaacg

SEQ ID NO: 13200 - DNA, 121 bp, Artificial Sequence
  Synthesized
  misc_feature (61): n=a or c
tataaggaaaggaagagcccgatacttcacattccaattttcagttttgtttttgtatganttttcaggtcagttcatatgttaccagtgaggttacatccatcttcagaatgatgagaaa

SEQ ID NO: 13201 - DNA, 121 bp, Artificial Sequence
  Synthesized
  misc_feature (61): n=a or g
ttaatttgccgaaataaagccttaatttcattatttagctgcctactgtgaggtggccccntgctttaaattaagctgtcagcagaagctgatctgtgccatttgttaactgcaaattatg

SEQ ID NO: 13202 - DNA, 121 bp, Artificial Sequence
  Synthesized
  misc_feature (61): n=a or t
tttctgaagcaccagatcattcatgccgagtgacttctcattcaaaattcctactttgggnagtggatgttgctgttttggtatctccattgctgggataacaaaagcactgttgcaacag

SEQ ID NO: 13203 - DNA, 121 bp, Artificial Sequence
  Synthesized
  misc_feature (61): n=t or c
ggaggcataacattcagacagtaaagacaatgatctgaaaatggatctctatccattcacntaatcttaacgaataatttgcactgaattaaacaggttcatcgacttcccttggcagaaa

SEQ ID NO: 13204 - DNA, 121 bp, Artificial Sequence
  Synthesized
  misc_feature (61): n=a or g
aaaacaatttctcattgtctcttccttgctctttaatttttaaaacaagtaacacaggacngctttccaagattcagctacatcagtttaatttgtaatgaacttcataacagggcgaaat

SEQ ID NO: 13205 - DNA, 121 bp, Artificial Sequence
  Synthesized
  misc_feature (61): n=t or c
actgaatgtatttctcttttctatatgagaaagctttttcagctcaaaacttaaacacaanctgagtgactaggaagtcacaatgaacctcttcccagtggtcttacttgggaatgacatc

SEQ ID NO: 13206 - DNA, 121 bp, Artificial Sequence
  Synthesized
  misc_feature (61): n=a or g
gttattgcaagtactaagtagtcctgatttttttatttgtaagagtactgtacaggactgnaagaaatgaactctttaaaacgatgaaacactgttttataggcactagtctagagttaaa

SEQ ID NO: 13207 - DNA, 121 bp, Artificial Sequence
  Synthesized
  misc_feature (61): n=t or c
tatttttccaaccacaacagagataattctatcttatcttaggtactttacttgaagaagngtgatatcttggaaaaactgcaagagtatgtgattcacaaggattatagcatgaaaatgt

SEQ ID NO: 13208 - DNA, 121 bp, Artificial Sequence
  Synthesized
  misc_feature (61): n=t or c
tttggtaagcccagctgttgatttttgaacatttaggataagtgatactgaaaaggagtangtgtggcttaacgccatacaattcaaacggtggtagcagtatttccattcttatactgtt

SEQ ID NO: 13209 - DNA, 121 bp, Artificial Sequence
  Synthesized
  misc_feature (61): n=t or c
gggccaagaccttcaggaaaaaaaacatttacaggagcttttgctgcccatacagtttgantgaaaagcacagcagttgtatgctcagccactggctgaccagccatgggaagcagccctt

SEQ ID NO: 13210 - DNA, 121 bp, Artificial Sequence
  Synthesized
  misc_feature (61): n=a or g
actcaagatggccttgatcagttttctagcaagctgaaaacaatgccataatactgttctngcagctgtaggagaattgattttctatacatcttggaggaacaggaatagttttaatatc

SEQ ID NO: 13211 - DNA, 121 bp, Artificial Sequence
  Synthesized
  misc_feature (61): n=t or c
atacagaatcatgtttaggaccatgagttcaagttacagctttactgattgtataatatcntcaaggaagagttacagtccacttgcatgagatacagtaatggcaaactgaaacataaac

SEQ ID NO: 13212 - DNA, 121 bp, Artificial Sequence
  Synthesized
  misc_feature (61): n=t or c
ttcaacatcctgtactgatgtgtctcccttggtaaattgctgctcttgctagcctgcaagngcttgtgttattctgaggcgtgacccaatctcaccagtggttgtagcctgatctagcatt

SEQ ID NO: 13213 - DNA, 121 bp, Artificial Sequence
  Synthesized
  misc_feature (61): n=a or g
agtactaaggctcagaatatccagagtactagtcaactttccagtgtatgtattattattnttattattcctgctatttacctaaaggttttacttcttttgagaaaataaattcagactg

SEQ ID NO: 13214 - DNA, 121 bp, Artificial Sequence
  Synthesized
  misc_feature (61): n=t or c
tgcaagccttgcacttacatacagtattcctgacagtgacacagagatccccagttaatangtaacatactactgcaaaaaatcagcagcttctcttgcttggaatccttcctgctctctt

SEQ ID NO: 13215 - DNA, 121 bp, Artificial Sequence
  Synthesized
  misc_feature (61): n=a or g
gggacctcaaaacagtatttttcaccttgttaagtgtattcatctatgctcatgctaattnttagtgtctgcaagagacatcagctgctggtaggcataggtcagagcagtgtttttcagt

SEQ ID NO: 13216 - DNA, 121 bp, Artificial Sequence
  Synthesized
  misc_feature (61): n=a or c
tgtgttccttttttaggtttataggcagtaggcattgtcaggaagtattttgtgaactggnagttttacatcaaagaagagttccagatgtgaaatctgaatatttgtcagaaaccttgtt

SEQ ID NO: 13217 - DNA, 121 bp, Artificial Sequence
  Synthesized
  misc_feature (61): n=t or g
cagatagcagcagaagccgttgtaatacacaattaaaaagtcttgtcttttggcactccancagtgttatccccatgctttctttaattctcttccctgccatccctcctagttccaaatc

SEQ ID NO: 13218 - DNA, 121 bp, Artificial Sequence
  Synthesized
  misc_feature (61): n=a or c
attaattatcactaatattatcaatgatcactaatattttatgttaacgtgttgctcaganaaaaacatacacctgctcagccctcccagctacaggcagtggcagaacttccagctggaa

SEQ ID NO: 13219 - DNA, 121 bp, Artificial Sequence
  Synthesized
  misc_feature (61): n=a or g
ctctaagcaggattggtcagtgctggtaaatgttaaaaacagcagcaagataaccatgacnaatacatcctctgatgaaggcaaatggagattcagtctcataataatgcatttgtcttca

SEQ ID NO: 13220 - DNA, 121 bp, Artificial Sequence
  Synthesized
  misc_feature (61): n=a or g
taaaaataaaaaataaaaatcctccctaggtgaaatcttacggatggcatttgtcacgcanttactgctgtactgcctgcagtgctttatggttcaaatgcttgatttctgtaccttcaag

SEQ ID NO: 13221 - DNA, 121 bp, Artificial Sequence
  Synthesized
  misc_feature (61): n=t or c
gctcagaaaacatctaggacaccctgtttgctgctggagatctggtcccagagagccaaanatttgacattttaaacgtggactaattcattacttttcctctgcttctgaaacaaactgg

SEQ ID NO: 13222 - DNA, 121 bp, Artificial Sequence
  Synthesized
  misc_feature (61): n=a or g
atggcacctgtctcctataaaaaccaagcctcatcttccatttgtgaaatttctatccacntttcttatatttcatagcagtgctccagaatatttggggtcaacaacagagtattggttc

SEQ ID NO: 13223 - DNA, 121 bp, Artificial Sequence
  Synthesized
  misc_feature (61): n=a or t
aaagaatttccatatgaatacagacacctccagaatatccctttgtttcaccagaggaaanacaacaattcagtgtgccctagtgctgcacatcctcagtactttctccaaaccatggcta

SEQ ID NO: 13224 - DNA, 121 bp, Artificial Sequence
  Synthesized
  misc_feature (61): n=t or c
tctatgattctatgattctttgtgtttttgtcttaatacaccccatgagaatacagacatncactgctatcgcaggaaaagcgtgacaatgctttgtgagctgttactgttggagtactgc

SEQ ID NO: 13225 - DNA, 121 bp, Artificial Sequence
  Synthesized
  misc_feature (61): n=a or g
ctcttcttccactgagcaggagacagctgagctgtccagcagacaactcggtgctttcccncacctttgctaccagtttttgaaggtaatgtgatgactgtgctgctccagcactacaaac

SEQ ID NO: 13226 - DNA, 121 bp, Artificial Sequence
  Synthesized
  misc_feature (61): n=t or c
aagagcacactgctggctcacgttaagtttttcatccatcacaactctcaggtccttctcngcagggcaaatccacacaactcaacttgaaacgtgtaggcattattacccaaggccagat

SEQ ID NO: 13227 - DNA, 121 bp, Artificial Sequence
  Synthesized
  misc_feature (61): n=a or t
agcttttcacaagaactggtagactaaaaggacatctagataatctctgcttgacctcttntcagatatcagcttcagtaaggtcccagaacatcaagcccagttacattagtcaggttga

SEQ ID NO: 13228 - DNA, 121 bp, Artificial Sequence
  Synthesized
  misc_feature (61): n=t or c
ctctctgcatgtctgaattactgcaaaaacttgtgactgttaagtaacatacacagaatcngatctagaagaaataatgggatctgaggctttgctcatgtttcaggatctgggagatgga

SEQ ID NO: 13229 - DNA, 121 bp, Artificial Sequence
  Synthesized
  misc_feature (61): n=t or g
gacttgggaatggccacaacgtgacagtaggcaaagtgctaatcttctgtatctaaggaantaattctgcttacgagtttttctgcagttttgacacacatcttactactgccccaggtat

SEQ ID NO: 13230 - DNA, 121 bp, Artificial Sequence
  Synthesized
  misc_feature (61): n=t or c
tgagagacaggcttaatatatattttcttttcttgtagttctgacctctgaacaggactcnataaaaccttatttatccagaatttactaaaatataaaagaaccctggaaaaaaatttca

SEQ ID NO: 13231 - DNA, 121 bp, Artificial Sequence
  Synthesized
  misc_feature (61): n=t or g
ttacaggcctggaagacattgctgctaacaagatttcttctacgatcggaacaactgcttncaatacaagtaaccgactgtgtcacgtacgttcacattcatcagcagtgtttttgcccac

SEQ ID NO: 13232 - DNA, 121 bp, Artificial Sequence
  Synthesized
  misc_feature (61): n=a or g
agctgtacagatacaaatattagtcaattgtacagcagtatcaaggcacaacaagtgtttnctgaaacacagtacatgtcaacatctttgttatagctggtgcagcactgctcccttcaaa

SEQ ID NO: 13233 - DNA, 121 bp, Artificial Sequence
  Synthesized
  misc_feature (61): n=t or c
cgttacatgcacgttacatacgtagctgttagtggttatgtacaagttacattgtcatttnatagttatatacccatagggctattatataagtgtacacctccctatttggctcccactt

SEQ ID NO: 13234 - DNA, 121 bp, Artificial Sequence
  Synthesized
  misc_feature (61): n=a or g
cccattgatgtgagcagcccatggcacgtgacaactcgaaccctggttttgcaccttcccntgacattccttacaatcccaccctctcctgttcctgtggactcacctctcacgtcttact

SEQ ID NO: 13235 - DNA, 121 bp, Artificial Sequence
  Synthesized
  misc_feature (61): n=a or g
agagctgcaagaggttctgcagagcctcggattcaaggtttccatgctacaaataacaacnttgagttaatccattcggaagggaaatgtctctactttatttatccaaatatatagctct

SEQ ID NO: 13236 - DNA, 121 bp, Artificial Sequence
  Synthesized
  misc_feature (61): n=t or c
acacacagagggagagatgtataaaaactatgccaatagccctgagcatttgcaaacaacngtacagaaggctcttcaggagaggcagacagaggggatctcagctggcgtgaggagctgg

SEQ ID NO: 13237 - DNA, 121 bp, Artificial Sequence
  Synthesized
  misc_feature (61): n=t or c
ttaagacattttaagagtacaacattccaaagcttgtaagacacaaatcattttggactanaacaacgcaataagtaaacatcagcttttgcacttaaatttttcgcctaattttaatctt

SEQ ID NO: 13238 - DNA, 121 bp, Artificial Sequence
  Synthesized
  misc_feature (61): n=t or c
tttattttgacattatttctcaacactgcaataaaccttgagtctaaaattgtttatattncgtatagcagttaataaatcagactgaatttacaaatgctctgctattctcgtgctccaa

SEQ ID NO: 13239 - DNA, 121 bp, Artificial Sequence
  Synthesized
  misc_feature (61): n=t or c
aactgctaaacggagagatgcggatatctttggtgtaaaatcatgttttcatgcaggcttnctgacagcagtgaaaaaggaggcaatcaggaagacaccagaattaattgtgtttgccttt

SEQ ID NO: 13240 - DNA, 121 bp, Artificial Sequence
  Synthesized
  misc_feature (61): n=t or g
tcggagtaaagtaacctgggggaggcaacacctgcaaatattttacaccacgctgatcaangcctatgtgaacttcttcctgcacggcattaactgttggcctcaggcctccttgctgcta

SEQ ID NO: 13241 - DNA, 121 bp, Artificial Sequence
  Synthesized
  misc_feature (61): n=t or c
agctgctttaagctgaagacagtgcagagtttctcatttttctttccagcagtgctggagngactgcatgaaaatttcaagcctccttctcatcacactgttaacatttaatagtggtttc

SEQ ID NO: 13242 - DNA, 121 bp, Artificial Sequence
  Synthesized
  misc_feature (61): n=t or c
tcagagaacaaaattcaagagcccatttcatcagctttgtcccttgggtcactgctgcaancttcagcttttgtcttcctcagttcctgatcaggaaggcccagtgcccaagaaaatgact

SEQ ID NO: 13243 - DNA, 121 bp, Artificial Sequence
  Synthesized
  misc_feature (61): n=c or g
caaaaacaccaactaatcaatttcctacagtgatatttcatgaggaaattacttgatacanaatctacatatagagcttctttggaaacagaagaaagaagcatataagtctgtcttactg

SEQ ID NO: 13244 - DNA, 121 bp, Artificial Sequence
  Synthesized
  misc_feature (61): n=t or c
ctacttcagtatctgatgtctttggaggattcatttgcagctttttaagctttggctaaanacagccaggaatcatctgcagatatactttcacatcttcaagtcttcctcctgtggtaaa

SEQ ID NO: 13245 - DNA, 121 bp, Artificial Sequence
  Synthesized
  misc_feature (61): n=t or c
tcaggaaacacttaatcttgtgctgaatctgaacgccagctttgagtcctccatgctctcncctatccttcctcatcatataggttaaccactgtaagcatttggatttgatttgtgcctc

SEQ ID NO: 13246 - DNA, 121 bp, Artificial Sequence
  Synthesized
  misc_feature (61): n=t or g
atgtttccagttcctaagcattttttttctgcttgtccacatggatggcttttttcctgtntgaacaaagatgtttctggcaggcctgagttgggcaataggcaatatgttgtacaggtct

SEQ ID NO: 13247 - DNA, 121 bp, Artificial Sequence
  Synthesized
  misc_feature (61): n=a or g
actctgtttctatcagagactcttatcagagaacatcaggtaagcgatgtttggctcaccntggctgaactataaagggaccttttcaaagaagagtttgtgctttgagggtgagattccc

SEQ ID NO: 13248 - DNA, 121 bp, Artificial Sequence
  Synthesized
  misc_feature (61): n=a or g
ctggctgcactacttcagtgttatcttgatcttcctattcgttgtcttctatggaattggnccatgtgagtaagagagaaaattttgcatcatattggttggcaacacaactagcatagaa

SEQ ID NO: 13249 - DNA, 121 bp, Artificial Sequence
  Synthesized
  misc_feature (61): n=a or t
atgaagtagtgtgtgctttgtgttccaaaatccttgcccttcttgagaaattaaaacattngatcttcatgaggacaactagataatctcagcctcagtcctgcttcttacttacagtatc

SEQ ID NO: 13250 - DNA, 121 bp, Artificial Sequence
  Synthesized
  misc_feature (61): n=t or c
tgaagccatttcttaaggaagtccagctgtgtagggatgttctgtgtgcatgtgttcctgncagtaattttggagtccactgatgattcagatataaaggtcaggagaacagtagaatgtc

SEQ ID NO: 13251 - DNA, 121 bp, Artificial Sequence
  Synthesized
  misc_feature (61): n=a or g
ccatcatcttgttttccacgtggcaaatatttgttttgcagctggcctggttattccgacnactctgaaccttcatatgatttttctgcgaggtttgctcaccgtaggtaggtgacttgtt

SEQ ID NO: 13252 - DNA, 121 bp, Artificial Sequence
  Synthesized
  misc_feature (61): n=a or c
acagcttgaaaataaatttaaagtttcagtttgcaccatcacagagatacagaaatacatnatctttctgctatttctcattttaccactgtcccaaccacagcagcaggtgtactcggca

SEQ ID NO: 13253 - DNA, 121 bp, Artificial Sequence
  Synthesized
  misc_feature (61): n=t or c
gtgatggatggagtggttggcaggccgtgcccatggcaggtgttggaactgggtgctcttngagatgccctccaccaacccaggctgttctgtgaggttagctttcatttgccctccaaca

SEQ ID NO: 13254 - DNA, 121 bp, Artificial Sequence
  Synthesized
  misc_feature (61): n=a or t
ctggctgtcctgccccatagtgatggggagcagcaaacctttggtgcctgcagagttttcnggtgactcaccttgcagcaaagacacaaagaggaggagaacctccatgtctgcccttctc

SEQ ID NO: 13255 - DNA, 121 bp, Artificial Sequence
  Synthesized
  misc_feature (61): n=a or g
gctcctagaagtcatcagctgttaactgctctggttaattatgcatcagcttcttaaaganccatttaagctcagagtgagatgtgggttttttttgtcagctatgacatccacctcggcc

SEQ ID NO: 13256 - DNA, 121 bp, Artificial Sequence
  Synthesized
  misc_feature (61): n=c or g
aaaaagaaggtcagagcagctgaatctggcaaagaagtcatagctttcagaccatgagctnctccttagagatgtttcacttaagagaagcccacagcctaattagcaaattagctgaggg

SEQ ID NO: 13257 - DNA, 121 bp, Artificial Sequence
  Synthesized
  misc_feature (61): n=c or g
attgctctgaaattgggttttattttagttaggcaccagtgctaaagtttaaccatccagnaatcagattggcagtttcaatatttcattttttatatgtaatgcatctaaggagataatt

SEQ ID NO: 13258 - DNA, 121 bp, Artificial Sequence
  Synthesized
  misc_feature (61): n=a or g
ttaaaattaatcattgtggtccaaatatactccatgaattgatacagttagttttctaatnaaacttctattgtttataaataacaaaaatcttaccaatgctttctcaaaagtacatttt

SEQ ID NO: 13259 - DNA, 121 bp, Artificial Sequence
  Synthesized
  misc_feature (61): n=a or g
tacacaacgcagagaatcactggctggacttcaccttaatcagctggaagaaatcctccantgctgactgtcgtacaaagaatagttgggaaatgaaaattattttcttcatatgatttga

SEQ ID NO: 13260 - DNA, 121 bp, Artificial Sequence
  Synthesized
  misc_feature (61): n=a or g
gtgatgataacatgtagtgctagaagggatttctttatttccattgctctgaactcactgnttttgattattataggacctggaagaagaactagacatgaaagacagaatcataaagaaa

SEQ ID NO: 13261 - DNA, 121 bp, Artificial Sequence
  Synthesized
  misc_feature (61): n=t or c
tcaaaggcatcaggataaaacagtgtctgctcaggtccacagcaatgctcttgtcactgtngaatgacctcaaacaggagaaagtactctgcatctacttgaagacgtgctttccaaagag

SEQ ID NO: 13262 - DNA, 121 bp, Artificial Sequence
  Synthesized
  misc_feature (61): n=a or g
aatatgtaacttactattccctattgctatcttctttaaatccagttcttactgcttcctnggcctttccttcctattgctttaggttgctgtcaacagaaatgagctgctcttctgaaac

SEQ ID NO: 13263 - DNA, 121 bp, Artificial Sequence
  Synthesized
  misc_feature (61): n=a or c
gcagacctaaactggataaagaaagattccattactgtaagacattatgtgaaaaaaaaanaaacatgaaaaacatttgggagttgcctgggggaacagccactgcttgcagactggcagg

SEQ ID NO: 13264 - DNA, 121 bp, Artificial Sequence
  Synthesized
  misc_feature (61): n=a or c
ggactagaaaataagaagtctgcaaacaaaaaaggatgcaaaaatcctctggttatggganttgatagaatattttacccacacaggctgcttatttctccaatagcatcattagcatgct

SEQ ID NO: 13265 - DNA, 121 bp, Artificial Sequence
  Synthesized
  misc_feature (61): n=a or c
tatgtatagactctatttggaacagtgatattataattaggaaaagattaagattttgtcnctaataattaaagcccatgtcagaatacctgggacaacgacaaatacgttataactaatt

SEQ ID NO: 13266 - DNA, 121 bp, Artificial Sequence
  Synthesized
  misc_feature (61): n=t or c
gaaccattaactcaataagactgaaacatatgtgacaatgcatatgtcagccactcatctnctcgccgtaaataatatacagacacgtttcgacacacagttcattatctttgaccaacgt

SEQ ID NO: 13267 - DNA, 121 bp, Artificial Sequence
  Synthesized
  misc_feature (61): n=t or c
agttaccctcctatttgtgcagcgtcagtgtaattgtgaaggcctttacacagcactgacnttgcagagatggtattactgcatgcagcagcggggtgctgcttctgccctgcagtgctgg

SEQ ID NO: 13268 - DNA, 121 bp, Artificial Sequence
  Synthesized
  misc_feature (61): n=a or c
tattgcaattaacctttccttccaagtccctaaaagtctctgacttttcctttattatccnttaattttctttctagagactgtactgatttcttttttaaaacatccagagatggaacat

SEQ ID NO: 13269 - DNA, 121 bp, Artificial Sequence
  Synthesized
  misc_feature (61): n=t or c
ggcaaaagtctacagaagtcagtggggtctatgtagttcaactcaagagccaaatgctttnttacagatatcagattgttctgattctactgaatatatttctatagacatgctagaactt

SEQ ID NO: 13270 - DNA, 121 bp, Artificial Sequence
  Synthesized
  misc_feature (61): n=c or g
attatacaactgcctccaaatttaaattgaaatcaacatgcttttaaaaattgttttgganaaaacactgaagaatatattatgatgcagggaattatcaggtataagcagtgtagatgcc

SEQ ID NO: 13271 - DNA, 121 bp, Artificial Sequence
  Synthesized
  misc_feature (61): n=a or g
atattcagactggaagatgtcagaagaacccaaagtaacgagtagcttgagatttatacanggaatgtgcttgactataatggcaagtaactgttttcagtggtagagtccttcagccatg

SEQ ID NO: 13272 - DNA, 121 bp, Artificial Sequence
  Synthesized
  misc_feature (61): n=a or c
tgaaattccaccacttatcagacaaacttgcattattaatgtttattaatttctatagggnaagggttagacatgcattaatgaactggtataatcctttctgtttggcactgtttgtgag

SEQ ID NO: 13273 - DNA, 121 bp, Artificial Sequence
  Synthesized
  misc_feature (61): n=t or c
aaaatgaatcttctatcagcaattacacatttatctattcttacaaacatcatcagcctantattctaccttcctgagtttcaacttctgtttgaggagttcgaatattttattttatttc

SEQ ID NO: 13274 - DNA, 121 bp, Artificial Sequence
  Synthesized
  misc_feature (61): n=a or g
gcaatgcagtgcattcgcaggatgccagacctctctcagaccaacggaccagccaggctgnaggaacttttcctcttttgtttaaatctgaaaggactctggcttctctttgaactggacc

SEQ ID NO: 13275 - DNA, 121 bp, Artificial Sequence
  Synthesized
  misc_feature (61): n=t or c
tcagcatgcccacgagatcccacagaataaatgggaaaatcatttatgtagggaaatgacngagtgtgagtccaatcctaatggtttctgtaagtgaagtgactcctaggacagtgtgtag

SEQ ID NO: 13276 - DNA, 121 bp, Artificial Sequence
  Synthesized
  misc_feature (61): n=t or c
tcaactccaacagaaggcctgcagtagttggctgagctgcagctgtataacttcagatggngaggaggtttcaggcacagtttgcagtggattcataaacagaaactccctttcaaagctg

SEQ ID NO: 13277 - DNA, 121 bp, Artificial Sequence
  Synthesized
  misc_feature (61): n=a or g
tgtggatagatgtggcaaacttttcacagctacaccagtaagttaaggagccttataaatnaaagcaagcttgtaaccaccgattacacctcagaatggctgctgtcagtttaaccttgtg

SEQ ID NO: 13278 - DNA, 121 bp, Artificial Sequence
  Synthesized
  misc_feature (61): n=a or c
tacagacacaaatggttagctgtaagagtggttaaccatggcaacacctaaaaataattgntcttacttcatcaagcataaggaatgcctaatttaaagggggataagtatctgggatgta

SEQ ID NO: 13279 - DNA, 121 bp, Artificial Sequence
  Synthesized
  misc_feature (61): n=a or g
ggcagtgctgtgagccacgcgtgtagtgcagctgtgcaaaaattaactctggctttagacntagctgagaacgtttctgctaaagcctggggaaagctaatgccaccataggcaggcacca

SEQ ID NO: 13280 - DNA, 121 bp, Artificial Sequence
  Synthesized
  misc_feature (61): n=a or g
cccccaaatacatatggttttcaagagatgtcaagacgaatccaacagctttatccagacncgacgttacatgcagccctctgtgagcactgcagtgctgatgatgtactttctcagcagt

SEQ ID NO: 13281 - DNA, 121 bp, Artificial Sequence
  Synthesized
  misc_feature (61): n=t or c
tctttccctttggtaaaccatgggctgtgctggtgcaaactgacccgacattgactgggangtggatttaaaggcagaccaatggaaccagagatcacctccccagagacctccttccctt

SEQ ID NO: 13282 - DNA, 121 bp, Artificial Sequence
  Synthesized
  misc_feature (61): n=t or c
gcagttcctcatcagtgggacctgtttctttttcagactggtctttgggtgctttggcaangtagaaattcttgaaattattagtttcagaagaatgtgaaggaattttcatataggaagt

SEQ ID NO: 13283 - DNA, 121 bp, Artificial Sequence
  Synthesized
  misc_feature (61): n=a or t
aacatgcaaaccggtggattgctgcagagatctcataacttaggcattcatgctggccctnttctaggcctatctgaaggtatgaactacaggagataagtgcctcacatgtgggctttgt

SEQ ID NO: 13284 - DNA, 121 bp, Artificial Sequence
  Synthesized
  misc_feature (61): n=a or g
aaataaaggtgctcagttcaccctgggagaaattctcagggcagatgggctcagtgctggngcactcacctgcagctggcacaaggcgctgcaaggacacaatgctccagccagatgtgaa

SEQ ID NO: 13285 - DNA, 121 bp, Artificial Sequence
  Synthesized
  misc_feature (61): n=a or c
tttttccccctatcttttgcaaagcagcaccagacacacaccaacttacagcacaaacacnagcagaacccacatatccctggacatgccctctgaaatgcccacggtaggcacaaatgtc

SEQ ID NO: 13286 - DNA, 121 bp, Artificial Sequence
  Synthesized
  misc_feature (61): n=t or g
tttgttattagcaggcagcttcagacagcacttttataccttctacctgtggatgcatagnctaccagttggcatcgcaagatcccctggcctgttcggaaagcattatttctccatttcc

SEQ ID NO: 13287 - DNA, 121 bp, Artificial Sequence
  Synthesized
  misc_feature (61): n=a or g
gatttgaacccaaaaattcaaaacaacctcctcaaaatcacagagctctattgcgccaacnttgattttcttacattgagcacatggcattcactagacaaaggcaggttcatttttgcat

SEQ ID NO: 13288 - DNA, 121 bp, Artificial Sequence
  Synthesized
  misc_feature (61): n=a or g
tcacaactgtaagatacgatcacatggcaaagcagaaaaccaaatagttaaatgcttacanaagcagaaggaattgcttcatactcactaagggacctcacaaaaaagtgcatttcaggaa

SEQ ID NO: 13289 - DNA, 121 bp, Artificial Sequence
  Synthesized
  misc_feature (61): n=t or c
tgtcacagaatcacagagttgtaggagttgggtgggcttctggggatcacctagtgcaatnccccactaaagcaatttccctacagtaggctgcacaggaaagtccaggtgggttttgaat

SEQ ID NO: 13290 - DNA, 121 bp, Artificial Sequence
  Synthesized
  misc_feature (61): n=a or t
aatactgcctggtcttatgaatctcctcttgaaagattttctttttatgagttaaccaagnttcatccagctcttttatagatagttttctttcttctgctaattcttctcccaggttatt

SEQ ID NO: 13291 - DNA, 121 bp, Artificial Sequence
  Synthesized
  misc_feature (61): n=t or c
attcaagccatagtgcagaaagagaactgatacaaagcagatggaattcaagtgtctttcntcagctacgcataatactgcctcagatataaagacttaggtacctgtgctctgtgtaagg

SEQ ID NO: 13292 - DNA, 121 bp, Artificial Sequence
  Synthesized
  misc_feature (61): n=t or c
ctatcgcaggttcaacatagagcataagtcacagagatggatgcgtgatgggtgcacactnctgcaagcatgggcagagattcctcagtctatgaatagacgcctcactgactagctggta

SEQ ID NO: 13293 - DNA, 121 bp, Artificial Sequence
  Synthesized
  misc_feature (61): n=t or c
caggttgattaatataacacgcttcttctgctggtcaaaaccttcacaaaccacccttgangagtagtggtacaattctctttgaaaacagtgttatgcacagtggcaaaacaaacaagca

SEQ ID NO: 13294 - DNA, 121 bp, Artificial Sequence
  Synthesized
  misc_feature (61): n=a or g
tgagggttgagaatgcaagcacactttattgtgaagttattggtgtgctcagccaattccnctgttatgaatcaataccaataattttcagcttacctcctgtgactttcctttctctaac

SEQ ID NO: 13295 - DNA, 121 bp, Artificial Sequence
  Synthesized
  misc_feature (61): n=t or c
tgaagacatttgttactctcctctgccttcagtgctgtaaaggcagattaaacaggttccncaagaaatgcagcattccattttcttggaatatattgaagtgagctgtaacctaaactat

SEQ ID NO: 13296 - DNA, 121 bp, Artificial Sequence
  Synthesized
  misc_feature (61): n=t or c
tagctagactctataggagcagaaatacaccatcatttcacaggcactgacatgggtacantggcacaggtacagcagatattgcctgtttcagttttgtacttttatacaaacctattat

SEQ ID NO: 13297 - DNA, 121 bp, Artificial Sequence
  Synthesized
  misc_feature (61): n=t or g
tatttaaaggaacagagatattcacaattattttttaacggtgagctccagctcccatganctaagaagctggcattacctttcattaagagctagtcagaatatatgaatgttctcaatg

SEQ ID NO: 13298 - DNA, 121 bp, Artificial Sequence
  Synthesized
  misc_feature (61): n=a or t
acttgagagacttggtttcagtatacttctgatgtttcatttgatttccaatactaagtcnaggtgtttgaattaggagcttaaagtttttctcactttgttgccggtgatgagtgtcatc

SEQ ID NO: 13299 - DNA, 121 bp, Artificial Sequence
  Synthesized
  misc_feature (61): n=t or c
caatctttgagattcatgtggggtagtcacaacagtctatctggtaggactggtgatctantgctcctgccaagggcaaggcaaaaaaaggaaggaaagaaaacacccaaagctcagtcaa

SEQ ID NO: 13300 - DNA, 121 bp, Artificial Sequence
  Synthesized
  misc_feature (61): n=t or c
ttatcactcatggggtaggaaggcaatgggggcagaatcaactgtgacttgaagcctggcntcttaccaactgctcctgtagattttgtttccctcctcccagataattcatgttctgctg

SEQ ID NO: 13301 - DNA, 121 bp, Artificial Sequence
  Synthesized
  misc_feature (61): n=t or g
cgcatgaaaatatcacaggaattttttaacacaaaaaaaggaaatctgaaaggcgagcgcngtggcctaacagtatttagcaattccaaacacaacgtaaacatgctgtgtgcttgaagaa

SEQ ID NO: 13302 - DNA, 121 bp, Artificial Sequence
  Synthesized
  misc_feature (61): n=t or c
tagaaactgaagtttcagaagtgacaccttgcaggtcttcctccttactagtggatttatncaaatcatttccctttgtattgttctgccagtaagataataaggtttaagtaagcctgcc

SEQ ID NO: 13303 - DNA, 121 bp, Artificial Sequence
  Synthesized
  misc_feature (61): n=a or g
agattcaaggctgaacctgtctcattgtcatatatccactggagatttttaacagcacagnagtgtgggtaacaatggtttccatcctggcacctcagctctgccaaggagatcaccatag

SEQ ID NO: 13304 - DNA, 121 bp, Artificial Sequence
  Synthesized
  misc_feature (61): n=t or c
atttttgttatattaatttatgagccaatcgtgaagtatctaagcagcagaatcctaaacnagcctgccctagagcatcacagaggcactcattggaagggacatgcagtccaactttctg

SEQ ID NO: 13305 - DNA, 121 bp, Artificial Sequence
  Synthesized
  misc_feature (61): n=a or g
gcaggagcaaatgcttttggctagagcagaggtacttcccatggaaggtggactgccaacntttaatgctctttctgcactatctcagtgatagatttctgccagtgaaactaattgcagc

SEQ ID NO: 13306 - DNA, 121 bp, Artificial Sequence
  Synthesized
  misc_feature (61): n=t or c
tatatatatagcgactaggtaactggaatcatccaattagtcaagttcattgcaagaaagngccctttttactgacctgtactaatcccagaaagaatgcgtgcattattcatagctgtgg

SEQ ID NO: 13307 - DNA, 121 bp, Artificial Sequence
  Synthesized
  misc_feature (61): n=t or c
accctgcggtagcatctgggaagctagcaatattacaagcagctttcttgctcagaagagnacgtacctatgaatgattggctaatttaatggtgaagtgttgggtgttcaggtgagctag

SEQ ID NO: 13308 - DNA, 121 bp, Artificial Sequence
  Synthesized
  misc_feature (61): n=a or g
tatgcctcttcctcagatggagacattgagccaagagaagtatgagaattagaaaaacacnacttagcgagtcttgtgccctgcccgttaggaaacacttccatctgttctacagggaatc

SEQ ID NO: 13309 - DNA, 121 bp, Artificial Sequence
  Synthesized
  misc_feature (61): n=t or c
caaaaatgatagcatgaaaatgatagcacagaaatgatagcattctcttcacttgccaaanactcatttctactcctgtgtgctctttccttgcgatggagtcctcaacaaatttcatttc

SEQ ID NO: 13310 - DNA, 121 bp, Artificial Sequence
  Synthesized
  misc_feature (61): n=c or g
aaataagcagtctctaagaccctttcacatcatgtgaacaaagcagagcttgagtttgaantcctccaacttagagtttgaattgaacaagaacaagcattttaaaacaggatgcggacac

SEQ ID NO: 13311 - DNA, 121 bp, Artificial Sequence
  Synthesized
  misc_feature (61): n=t or c
ccagagctcagaagccagggaatcgggagcaacaactctgcaacagtccaagaggctgctncggtgttagtgagagatcacgtagcaataatccaactataactgaataggtacataatga

SEQ ID NO: 13312 - DNA, 121 bp, Artificial Sequence
  Synthesized
  misc_feature (61): n=a or g
ttttggtaaatagaaacccaggtgaccttacttacacttaccttgtttaccaaccttcacnttaatagcacatgagtccatccccctgcagagtccttgacatgctctaaaggcaagagaa

SEQ ID NO: 13313 - DNA, 121 bp, Artificial Sequence
  Synthesized
  misc_feature (61): n=c or g
gaggcttagcatggctaaaccctctggtatatcatgtagtacttaccaagatgtcagtctnggctgcaaaccacccagcacatcaccttttaattcaccatttgaggaattctttttttct

SEQ ID NO: 13314 - DNA, 121 bp, Artificial Sequence
  Synthesized
  misc_feature (61): n=t or c
tactttcagatgggagtggtgagaaacttgggaggtgaaagtcacaaagttgagatggcantgagcaagtatctctaagaggatagtcttttgaattacaactaagggtcttttgtcaacc

SEQ ID NO: 13315 - DNA, 121 bp, Artificial Sequence
  Synthesized
  misc_feature (61): n=t or c
agtgaattacaattttaatgtcagcagctatggcacttgagggtccttcttttgaaaaatntgagatccagtcactttagtcaatgaggctattgctcatgtactctccttcaatgtttat

SEQ ID NO: 13316 - DNA, 121 bp, Artificial Sequence
  Synthesized
  misc_feature (61): n=a or g
tgaagactgactctttggatgcttagaaataaaattgtttcctacttctttttatagagtngaaaatcagccaccctggaacaaatattttgtgaaggaattttttaagagataaatctaa

SEQ ID NO: 13317 - DNA, 121 bp, Artificial Sequence
  Synthesized
  misc_feature (61): n=t or c
ggacattttgaatatttcatttttcctacttgaatatctgtttaatgtgcaggttagaagnacctgtatgtttttaggcaagtaataattagacacagtaaaacaacaagcaagccaccta

SEQ ID NO: 13318 - DNA, 121 bp, Artificial Sequence
  Synthesized
  misc_feature (61): n=t or c
gtatttattatggactgtattcacaccacctgtagcagttaattctgtttccaaagacaangtatttagttaatgagaagtatgttataatcaccaccagtgtttgttttataaaaaacct

SEQ ID NO: 13319 - DNA, 121 bp, Artificial Sequence
  Synthesized
  misc_feature (61): n=t or c
agtccaatttatttactttttaattttagcagaagatataaccataattactgtgatgtanggattgtaaaacaatcacatggaactgaaggaagaaagaagactagcctataagagtgac

SEQ ID NO: 13320 - DNA, 121 bp, Artificial Sequence
  Synthesized
  misc_feature (61): n=a or g
atggacgtgatgagcttacctctatttttgattgttggggatgtcagttggtgggcaaggnctagacagagctgaggcagcatcatcagctgcacctcagtgtcgctggatctgtgggcat

SEQ ID NO: 13321 - DNA, 121 bp, Artificial Sequence
  Synthesized
  misc_feature (61): n=t or c
acagctatacgttaccaactctttcactgatatccctgatttgcaaatgtttgtttatttncccttaatctcaaaatgaaactcggcagaattttctcagaactaatattcaaatcaatag

SEQ ID NO: 13322 - DNA, 121 bp, Artificial Sequence
  Synthesized
  misc_feature (61): n=t or c
ttgataattgcatatctatttatattacttagaatgattttacttttgaggccattcctanagagatggtcattttatgtgcaaattcaggaagactttacacagtggttgttttgtaata

SEQ ID NO: 13323 - DNA, 121 bp, Artificial Sequence
  Synthesized
  misc_feature (61): n=t or c
taaattgttatcagatgggaacaattcccatgcacccctagcaccttgaggctggatacangataatgatctatacccgatcatttcttccttgctattcagctctctgctcatttgcaga

SEQ ID NO: 13324 - DNA, 121 bp, Artificial Sequence
  Synthesized
  misc_feature (61): n=a or g
acctatggatgggctgtgttcatcctgttgttctcccatctcttggtggggctgatcctgntagtgcagtgcagtttgactcttctgatggtgcttgttcttgaaatggtcgtccgaatgc

SEQ ID NO: 13325 - DNA, 121 bp, Artificial Sequence
  Synthesized
  misc_feature (61): n=c or g
tacctgtgtcagtagctgggactgttttagacagagaaggatctgtagcagtggctgtgtntgtggctttgtgtttattcctgacttagcatctgtaaggtgatagactctggaaagagca

SEQ ID NO: 13326 - DNA, 121 bp, Artificial Sequence
  Synthesized
  misc_feature (61): n=a or t
aactgtcatggctatagtaagatcaggaagtacaagaaaactgtagagaaaacaaatgatncaaagaacgtcagcatgtggccatagaaaaacagctatgctggtccactgataaagaaag

SEQ ID NO: 13327 - DNA, 121 bp, Artificial Sequence
  Synthesized
  misc_feature (61): n=t or c
accattgtcggagccatgcagacggttgatgtgcagcctgtaggagtggtaggaactcgtnccccggatgctgaacttctcctggctgatgtttgtgccatatgtcgcttttcccagcgga

SEQ ID NO: 13328 - DNA, 121 bp, Artificial Sequence
  Synthesized
  misc_feature (61): n=a or g
gaaagggaggaggagtttaagtagcatagaaaattctctctccagaataatttgaatgcantaggaagctaagctactctatgtatttccaactacaattagttatctttgttccaggttg

SEQ ID NO: 13329 - DNA, 121 bp, Artificial Sequence
  Synthesized
  misc_feature (61): n=t or c
gcaagccaaacactaaagcactgcaagacttgctgtggcctcgaatctgtgacaatcagangctcccctggagtttttaatctgaacttaggttgctaaccgagttcttatgcaggagcat

SEQ ID NO: 13330 - DNA, 121 bp, Artificial Sequence
  Synthesized
  misc_feature (61): n=a or g
gtcagcacaaaagcttacagatccacatttacaaaaatagtgctcgtgcaatttcatagcntagcttcctgcaaagttaggtacgtgagcagccagcgctgcgtgctcagttggtttttct

SEQ ID NO: 13331 - DNA, 121 bp, Artificial Sequence
  Synthesized
  misc_feature (61): n=a or g
aatagctgcgataaataataacaattattcaccacaaaaagaaatgtaataaacaatacantgtaacagggatagaccttcagagctcattcacttggaactaccaacacagtggctctgg

SEQ ID NO: 13332 - DNA, 121 bp, Artificial Sequence
  Synthesized
  misc_feature (61): n=a or g
aacagaggcagaccaagaggacacacagatgggatttaactgcaataaactcatagtgatngtatgcaaaaagcactgtgtattcttcctgtagacctcctaatgtgtgatttttcttaag

SEQ ID NO: 13333 - DNA, 121 bp, Artificial Sequence
  Synthesized
  misc_feature (61): n=t or g
tttttgggcttttcacaattttgcctgtgtgtcctctcccctcctggagggtgttgtctgntctccacaacactggtgattcctgatgataacaggggtttcttcaatttactgtaaatga

SEQ ID NO: 13334 - DNA, 121 bp, Artificial Sequence
  Synthesized
  misc_feature (61): n=a or g
gaggtgaaggtgcatctaatttggcttcagtgaggatttttaaactggtattaactgatgntttactgatacaggatttgctatggtgcagagcaatcctaccttggcacaatgcaatttg

SEQ ID NO: 13335 - DNA, 121 bp, Artificial Sequence
  Synthesized
  misc_feature (61): n=a or t
gttagggacattctttgtaggaaatacatgatgtgacagaaatgatgcgttaaccaatcangggagagacagtgcccttccttccacacaaactcctgagtcagtaaaactggcaatattg

SEQ ID NO: 13336 - DNA, 121 bp, Artificial Sequence
  Synthesized
  misc_feature (61): n=a or g
ggagggcaggagggtcaagagggaacaaagcttcccatataatctaaaaatgaaaaatacnttttcatagtttacatcccaggactttttttgttgtttttcttttcaagagcagtgaaat

SEQ ID NO: 13337 - DNA, 121 bp, Artificial Sequence
  Synthesized
  misc_feature (61): n=a or g
agacctctacatggcagtttacatgtgtatctctaactttttaggcttgttctcacataantttgtcctgttagctgctgctttttgttcttagtattcctccctcttcctgattgctttc

SEQ ID NO: 13338 - DNA, 121 bp, Artificial Sequence
  Synthesized
  misc_feature (61): n=a or g
gacacagaggctgtcaggctccaacaaacgaggcggtggatgcactgcaggatggagcacngtctgataatcacctcccactgccccagccacagtcctgaaggtcttattattagactgg

SEQ ID NO: 13339 - DNA, 121 bp, Artificial Sequence
  Synthesized
  misc_feature (61): n=t or c
agagtaaccttctctggaatacctctctgcttcctctgtggcaagagcaggaagcttgatngtgacaaagacatcaaggctgtctgtggcaactgatttgagaatgtcaaggcttcttcac

SEQ ID NO: 13340 - DNA, 121 bp, Artificial Sequence
  Synthesized
  misc_feature (61): n=t or c
tcttggcctttgtgttgtcaggcaggctagtgacatacaggaaaaagcatacgtgttgagnttcactgaagcaccactcaagttcttataaacaaacaaacaagaacatcacccattgtca

SEQ ID NO: 13341 - DNA, 121 bp, Artificial Sequence
  Synthesized
  misc_feature (61): n=t or c
tgattgagataaagtcacccacactgttctggattcaagtaacagcaactatatgtagaangaatgctgcagtggcagttaaagaatttgactggaaactcttcattgccccagtgggtcc

SEQ ID NO: 13342 - DNA, 121 bp, Artificial Sequence
  Synthesized
  misc_feature (61): n=t or g
tgccagtgagacgccctctcaattgggataccatgctatttggtacggagctgaagctcantttgttccttgctttaaaagttcagatgaattcctgataagagtaaagagttcaccgaga

SEQ ID NO: 13343 - DNA, 121 bp, Artificial Sequence
  Synthesized
  misc_feature (61): n=t or c
agtgccggcgggtgctcctgacagtgctggaaacgacccggatttggcacggttcttcccntgccatctgacttccaggctccaaaggctctgggtgactgatgaaactctgctatgcaac

SEQ ID NO: 13344 - DNA, 121 bp, Artificial Sequence
  Synthesized
  misc_feature (61): n=t or c
cagctgttctttcagtttgtttgtctgttaaatcccagttgaaaactgttatccaataagntaccatacttggttcttgatcactgatatagtagcagaaatgagatgagaaactgtaagt

SEQ ID NO: 13345 - DNA, 121 bp, Artificial Sequence
  Synthesized
  misc_feature (61): n=a or g
ccatgaacaactaaatggtccctggtcacaaccacagtggtgagatgctgatgtctgtggnatgagagactggaacgtggcaggagtgcagggcttgatctgacctctttccctcactggg

SEQ ID NO: 13346 - DNA, 121 bp, Artificial Sequence
  Synthesized
  misc_feature (61): n=a or g
gatctggttaaggaatttgggcttctgaggttattttggacatccatgctgtacgtggctntgtatgtttgtgggttgagctgatttacttctggtgcacttcctagttatttttactcat

SEQ ID NO: 13347 - DNA, 121 bp, Artificial Sequence
  Synthesized
  misc_feature (61): n=a or g
cacactgagacctctaccacacggtagcctccagtaggctcagaaacaccatttctgaganactttctattttgaactgggaaaagaacaaattccatcagcagatcaaactaaaggagca

SEQ ID NO: 13348 - DNA, 121 bp, Artificial Sequence
  Synthesized
  misc_feature (61): n=a or g
caacatatttgcacaaataagagaagacttccctaccatcattcatacaaaatgcttgganatctgaataaagggaaaaaacagaattactgacaaaggagagatatgtaatgaaagatgt

SEQ ID NO: 13349 - DNA, 121 bp, Artificial Sequence
  Synthesized
  misc_feature (61): n=t or c
ttgtgactaagagatttacaaatacactatagattccctaggattgttgaaaataacaagngaggaaagacaatttaaattatactaaaagcagtttgaaaattgcaaaatgttacagttt

SEQ ID NO: 13350 - DNA, 121 bp, Artificial Sequence
  Synthesized
  misc_feature (61): n=a or t
gtcccccagagaaggattgttttaaaatttcctcatgtctgcagtcagtatcactacagtntgtattttgtttggggccagcagaagaaagtaaacttgctaacagatgaggatgtggggt

SEQ ID NO: 13351 - DNA, 121 bp, Artificial Sequence
  Synthesized
  misc_feature (61): n=a or g
aatttagctttccagcatggtgagaaataggcaaacataattactgcacgcatggaaaagntgaacgtcaggtcaagacccaagtttaagaatttcagtcttagtctaacacattcatccc

SEQ ID NO: 13352 - DNA, 121 bp, Artificial Sequence
  Synthesized
  misc_feature (61): n=a or g
ggcattactgtaacaaagttagttacacttacttgaatagctcatgagtttgttgagccangaaccaaggcgcagggcaaacttctgatgagccatgacgtcagcgtgcagaacttccaca

SEQ ID NO: 13353 - DNA, 121 bp, Artificial Sequence
  Synthesized
  misc_feature (61): n=a or g
agagaggtattcagcagcactattccaaatctttcccacaagttaacttcaggcccgaaangtggtataatacagatgatgaagaacatttagtcacatgaaatgatttatcctatacttt

SEQ ID NO: 13354 - DNA, 121 bp, Artificial Sequence
  Synthesized
  misc_feature (61): n=t or c
tttaatgtcctactgagctgatagtgaaggcctattggcatagctaaatcagaattggatngggtgctttccatgtcacattgagcactggcaacaaagcatttggctccaacagtgcagt

SEQ ID NO: 13355 - DNA, 121 bp, Artificial Sequence
  Synthesized
  misc_feature (61): n=t or c
taccacttcttgttattgactgctgagggtcggaaactgttttggcaataaaatccttacngtgcaaactcttttctctttctgagagccattaactgcagctttcatatgagaaaatttt

SEQ ID NO: 13356 - DNA, 121 bp, Artificial Sequence
  Synthesized
  misc_feature (61): n=a or t
aacgcttgccagtttcttctctctgcaatctcagttctcccctggttgctcacattagctnattccccaaggtgtaaagccctgaccttatgactcaactttcaaccctctctttccctga

SEQ ID NO: 13357 - DNA, 121 bp, Artificial Sequence
  Synthesized
  misc_feature (61): n=t or c
ctacacggattagggaagagtcaggtctttgctgtcaaaaaatctgcaatcagcagtgtgnggcagtcagcacttttacttcacggatagggcactgagtcaagggaaaaaaaaaaatcag

SEQ ID NO: 13358 - DNA, 121 bp, Artificial Sequence
  Synthesized
  misc_feature (61): n=t or c
cacttggttgatgtatttggacctccatgcaagtgcctgtgatcagaaaaggcccacagcntgctcagcttccacaaggcaacatttgtctgttgaaatgctagcagttattcgtgatgaa

SEQ ID NO: 13359 - DNA, 121 bp, Artificial Sequence
  Synthesized
  misc_feature (61): n=a or t
cagtgcctaacactgtggtgatgacactgaacagcagtgtacctgtaccagagtacctgcnagtaaagactgcagaagtcacagaaccacaccagaggatttggccactgcatgaaaaagg

SEQ ID NO: 13360 - DNA, 121 bp, Artificial Sequence
  Synthesized
  misc_feature (61): n=t or c
gggaaacttgctgagagcatgtggatgccataaaaagtttgaaacaggcttgatgagacangtaactgcataaaggtgtaaagttgagtgttttatttaaaattgttcagttcttacacaa

SEQ ID NO: 13361 - DNA, 121 bp, Artificial Sequence
  Synthesized
  misc_feature (61): n=c or g
gaacatctccatctactcaaaaagcccacaggtcaaactccagtcccaccaaagtttcaantaagtagctgaattccttccaaatttaaacgcatgacagatatcacttgcaggcagcaca

SEQ ID NO: 13362 - DNA, 121 bp, Artificial Sequence
  Synthesized
  misc_feature (61): n=t or c
ggcgttttgctcggaattaatgcatttctcagacctgggctgatattgctgatggaaatgntgtcctctatgaaattcctcattgttttacatcattttatgtgggaatcagaaactgcag

SEQ ID NO: 13363 - DNA, 121 bp, Artificial Sequence
  Synthesized
  misc_feature (61): n=t or c
tgtgtgctaacttcttctatgctttattatgtaaaaacaattggtttgcaggttcatttangcttggaaaacttttgaactcttggaatcttgtaggatgagaagatggtttcctacccat

SEQ ID NO: 13364 - DNA, 121 bp, Artificial Sequence
  Synthesized
  misc_feature (61): n=t or c
ccctatagatgcatgctgttaagcaccactacctacttgttggttttaaggcaattcttanctattttcaaatacaaatccgaaggatcacaattttgtcttttcagtataaaaagatttt

SEQ ID NO: 13365 - DNA, 121 bp, Artificial Sequence
  Synthesized
  misc_feature (61): n=a or c
aataataataataaaaactgaaaaaaaaaaagatagtaaagcctacaatgaaaaatttaanattgtcttgaaatgaactgggaatttctatacatcgaattcaacgtttttgcaggtagtt

SEQ ID NO: 13366 - DNA, 121 bp, Artificial Sequence
  Synthesized
  misc_feature (61): n=t or c
ttcaagactgttgttttgacgtgttagagccaacaacaataacattgtcctctctgagcangctgcattgtatcaggtttaaagtaggtcatgtaaaagaaggggtgctgaatagattgaa

SEQ ID NO: 13367 - DNA, 121 bp, Artificial Sequence
  Synthesized
  misc_feature (61): n=a or t
tcccccccacggtgaatgggggatgcccaaatgcagtcatggccctctgaccacttacatntgacaaagaatgagtttggcagtttacatcctcttaagcagcgttgggaaggtgggtaac

SEQ ID NO: 13368 - DNA, 121 bp, Artificial Sequence
  Synthesized
  misc_feature (61): n=a or t
accaccttcctttgcctttttgctttctgtgcagaatggctttgaaattattctaggtaanaaaggtgcactgacttgtgtgctacttgaggataaggaagctgttggtctaggctgtgtc

SEQ ID NO: 13369 - DNA, 121 bp, Artificial Sequence
  Synthesized
  misc_feature (61): n=t or g
aattcaaataggtaacttatgtagctattgcaggttggtctttttctgaagtgctgtacgngcctggacagggaaaatctgaagggaaatctcttacactctgtcagatttgatgaatgat

SEQ ID NO: 13370 - DNA, 121 bp, Artificial Sequence
  Synthesized
  misc_feature (61): n=a or g
tcaaactcactgtacttaacagagcttgcagtcatcaaactccatacaaggtctgagcacnaatacttgcagaagtggtaggcaatgcttatttacagaactgcatctctaagatatggag

SEQ ID NO: 13371 - DNA, 121 bp, Artificial Sequence
  Synthesized
  misc_feature (61): n=t or c
gtttgtatcctgatagaaggcaatatcaccaccttcccttgctccacatctgacttacagnttcaggacttcagcattctgtagccctactccacagctacatcaatttattgttagatct

SEQ ID NO: 13372 - DNA, 121 bp, Artificial Sequence
  Synthesized
  misc_feature (61): n=a or t
tttgacatttcaacatgcttcgagtattcagaaatgcacctttggcataatagacaatatngatagtcataacctcaagattctgcacgcctttctctaattggtagaacagaaaacatgc

SEQ ID NO: 13373 - DNA, 121 bp, Artificial Sequence
  Synthesized
  misc_feature (61): n=c or g
tagctcaggattccactccaatcacagcttaaactttcactccaatttgatgtgaaatcantgctggtatgtatacatacttaaataattgaattattagtttgacagtcctctagagtac

SEQ ID NO: 13374 - DNA, 121 bp, Artificial Sequence
  Synthesized
  misc_feature (61): n=t or c
tgcagatctgccgtctttcattcgtttgctacaatatctttctcttagtgatctctcaagnctccgtttctctcctgctatttttcgtttcgacttaaagtacaggtcctagcactctcat

SEQ ID NO: 13375 - DNA, 121 bp, Artificial Sequence
  Synthesized
  misc_feature (61): n=c or g
catggcaaagggaaaaaaagaatattggcaaaggacaccatattaaacctttctcttccanactgtgccatgggattttcaatatccacaaggagaagatgtctttaatatctggtcatta

SEQ ID NO: 13376 - DNA, 121 bp, Artificial Sequence
  Synthesized
  misc_feature (61): n=a or g
gcaccacagacagcagctcagagaaaatcacttggcctgtagcaattagatgtttttctgntctactttcagacagtctaagagcttgaagcttcttgacaacctttcttgaagaactccc

SEQ ID NO: 13377 - DNA, 121 bp, Artificial Sequence
  Synthesized
  misc_feature (61): n=a or g
gtctccttgcatttcaaggcagctcagaagctaaggctgtatctgcttagcaagacttatncttgctatttagggatgccattccacactcaggcttttctgctggagccaagcatttatc

SEQ ID NO: 13378 - DNA, 121 bp, Artificial Sequence
  Synthesized
  misc_feature (61): n=a or g
aagatttacaggaatatgagttagagctgtagtggttttacatgtttggcagcacagcaanatgtttcagctatagaactgtgtttataaaggtcactagaaatgttaaccctcgtgacct

SEQ ID NO: 13379 - DNA, 121 bp, Artificial Sequence
  Synthesized
  misc_feature (61): n=a or c
gttaaaaaaaaaaaaaaaaaagataaataaagaagctgtgtgcataaaaattttgaagcanttgagaatatttccaagacttcccattgatgcaccctttacctagatttgtgcactactg

SEQ ID NO: 13380 - DNA, 121 bp, Artificial Sequence
  Synthesized
  misc_feature (61): n=a or g
tgactatgcctaatagcatatgccatcagtacaatactgtccccatcctagctgttacttnaagctttgggacaggttatccacttatctgggacctcaacacgatgaatgtcataaggtg

SEQ ID NO: 13381 - DNA, 121 bp, Artificial Sequence
  Synthesized
  misc_feature (61): n=a or c
agctgggagacatggaagatgaagagttcatccttaatacctccaaactcccagctgcccnactaagcaccagcagcattacttggcatttacatttcttaggtagctattaaataattta

SEQ ID NO: 13382 - DNA, 121 bp, Artificial Sequence
  Synthesized
  misc_feature (61): n=a or g
agtgagaagatagaggaataatagaatgtgtaagaggtaaaagaataaggacatgaagacnttgtggggtaagcttgtttaaaaacatttctgaatgtgggccttatctgccttttccaat

SEQ ID NO: 13383 - DNA, 121 bp, Artificial Sequence
  Synthesized
  misc_feature (61): n=t or g
aatatacggttctaaattgttcttggtgcgtggccactcatcagtttccatttaagaaacnagcataccgttttgctcttcgcaggtaggggctggcacgggacttagagaaagccatatc

SEQ ID NO: 13384 - DNA, 121 bp, Artificial Sequence
  Synthesized
  misc_feature (61): n=t or c
gaagtgtttccaggcaggaagagacacaagatggcccacagagtgctaacacaccatcaangcaggggaaattcccagaggcaataaaatgacaaaagactttatctggggtgaaaaacac

SEQ ID NO: 13385 - DNA, 121 bp, Artificial Sequence
  Synthesized
  misc_feature (61): n=t or g
tcctctgtgcttagcaggtggtcagactgagacttgctcctgccttatcactagctagcantccataggacagaatctggtaagcctctcatctctttggtcccttccaggagctggcttt

SEQ ID NO: 13386 - DNA, 121 bp, Artificial Sequence
  Synthesized
  misc_feature (61): n=a or c
ataaaaaagaaaagcgatgaccttaaagataacacttaggaattcataactgtacagtcantaccttacaatcccactgcctacttgttgtactggttgttggaacagatttttcactctt

SEQ ID NO: 13387 - DNA, 121 bp, Artificial Sequence
  Synthesized
  misc_feature (61): n=a or g
tgtatcaagcaaaataaggttctcactgtaaaagaaatccataggacacacagtataaacnggtagctaaaattaataatcacttcacagctgtgtgcagaaatggagaagggtcaaacat

SEQ ID NO: 13388 - DNA, 121 bp, Artificial Sequence
  Synthesized
  misc_feature (61): n=a or g
tgttatcatattcagataacagatattcagtctcctcttgtttgccattttggtttcacanccccatgcactgcttgcctccaccagcaggaagagaggacttttcccatttcccttcctt

SEQ ID NO: 13389 - DNA, 121 bp, Artificial Sequence
  Synthesized
  misc_feature (61): n=a or g
ggttcattcccatctgcctagcagctctggagatgagttctgggaggacaggcaacacctnggttctggcaaagcaagaccttgaagttcgtgttgctgaaagcatatctgactgctggaa

SEQ ID NO: 13390 - DNA, 121 bp, Artificial Sequence
  Synthesized
  misc_feature (61): n=a or g
tcctagaactgctccaggccttaatgttgtttcttcaccaaggatatttatatttacagancaagctatgagcacatctatataagagtattattaccaaaaagcaattgatatcctactt

SEQ ID NO: 13391 - DNA, 121 bp, Artificial Sequence
  Synthesized
  misc_feature (61): n=a or g
tgcactcatcgatgggctgtacgggctggtggtggatgcgatctttgggttcagcttcaanggagcggtgcgggagccgtttgggagcatcctcagcaccctgcagcgcatcacagtgccc

SEQ ID NO: 13392 - DNA, 121 bp, Artificial Sequence
  Synthesized
  misc_feature (61): n=c or g
ggctttgttttgtgtttacagaccatctttttttaaatactccccgattttcaggagatgnacaaagggtcagaactgattcgcattacatgagaacgtgggaagttctccatttggaact

SEQ ID NO: 13393 - DNA, 121 bp, Artificial Sequence
  Synthesized
  misc_feature (61): n=a or g
cctgcccttgctgtgcaggtttaccacccccatgccttggttttggtgcttggtctctgtntactgatctaatttgttaatttgggggaaaaaaagaaaagcaggtggctttttccagttt

SEQ ID NO: 13394 - DNA, 121 bp, Artificial Sequence
  Synthesized
  misc_feature (61): n=a or g
agcagggagcaaacagatcagatttctggtgtgccatgatggtaacttcctaccacatgtnatgagggcaggttttctgtccagacctcttataaacaaatatgaactagttggattgtga

SEQ ID NO: 13395 - DNA, 121 bp, Artificial Sequence
  Synthesized
  misc_feature (61): n=a or g
agaacacagttgtgggatgctccacctccgctgctgttggcagcaccctcagctctgaggncgtgcccatcagcaacgttggcatctcagcgtcctatagctttctatgttatctcccacc

SEQ ID NO: 13396 - DNA, 121 bp, Artificial Sequence
  Synthesized
  misc_feature (61): n=a or g
ttctgggttcagtgatggtagattgtgaaaatcagttataaactgtgcctggaaaacttgnttctttgatccatgatatgattctactgttctatgattctgtggtagaaattatatgcaa

SEQ ID NO: 13397 - DNA, 121 bp, Artificial Sequence
  Synthesized
  misc_feature (61): n=t or g
tacaatcaaaagcaatgaactctcagagctgacccacaaatgttacttaagatcaaatcanctgtatgagaactgctgagggtgaaacaggatgccctgaataactccattcatctcccat

SEQ ID NO: 13398 - DNA, 121 bp, Artificial Sequence
  Synthesized
  misc_feature (61): n=t or c
gatttgtttaagctaccattcctcttcctctcaacactgagaagctgggaccttgtcaacntccacagcaggattccagcccaaagctctctttaggttctgtaaggagaacaggggtaat

SEQ ID NO: 13399 - DNA, 121 bp, Artificial Sequence
  Synthesized
  misc_feature (61): n=t or c
tgatacagttaacagctgcttgtggctcctttccagataacaataatattttttctgtggnaaacatataagccacaatggagctgttggaattagctggaggattctgatcacaggagca

SEQ ID NO: 13400 - DNA, 121 bp, Artificial Sequence
  Synthesized
  misc_feature (61): n=a or t
ttttaaaataaactggcctatgcaagttcagtgaatgcacagaatatcagtagggggctanttaggagatgtgtaaagtctttaaagtcagtgtctttctgttgtggcagcacggtcctgg

SEQ ID NO: 13401 - DNA, 121 bp, Artificial Sequence
  Synthesized
  misc_feature (61): n=t or c
ttaagacttttattattagcccttgctgaccttattgctgtacaagtcatccatcccgccntggaaataaacttttcattagagttgctcttttgcttatgttgcacaagagcccttttgt

SEQ ID NO: 13402 - DNA, 121 bp, Artificial Sequence
  Synthesized
  misc_feature (61): n=t or g
ccttacccgaatttagtgctttctttggtgccacgtgacactgttgttctgagggcaagcngggtggaaagttgcacagagctgcttgctttatccaagtcatgccaagaatcagaggtta

SEQ ID NO: 13403 - DNA, 121 bp, Artificial Sequence
  Synthesized
  misc_feature (61): n=a or t
aagtgagatttctgtctatagaccaagtacagagttcaggtcagtcaggtttggttgacantaaaccaaaaggagagaatgcattttctgtggctacacgcaaaactaatatactgaaaga

SEQ ID NO: 13404 - DNA, 121 bp, Artificial Sequence
  Synthesized
  misc_feature (61): n=a or g
aggcaaacatccccatgtgtccctacctatttgctaatgaccggtccagattacaaatcanttacaatttatttaattgttccgaggatctgatagtcaaataagaagggagaacgactgt

SEQ ID NO: 13405 - DNA, 121 bp, Artificial Sequence
  Synthesized
  misc_feature (61): n=a or g
ccgtggctggacatgtcctccgggtgtagctctgttatgtactctggcatttacctcacanaaataacatccattgtgtcgcattctgagaactacatatggaaacgctgcataggtgctg

SEQ ID NO: 13406 - DNA, 121 bp, Artificial Sequence
  Synthesized
  misc_feature (61): n=t or c
agaacaaagccacgggcagaagagaagcaagtgaagagctgagcccaatctgtgcagggcngtaatgaaatcgctgtggcagatggtcagagggttaagcaggccccagattaggaaaaac

SEQ ID NO: 13407 - DNA, 121 bp, Artificial Sequence
  Synthesized
  misc_feature (61): n=a or t
gaaagctgtttctgccagtcttacactagaactgttgtaaagaggtatgtctctgctcttnggctccagtgagtttagagatgttttgcagtgctcacatggcacagtatggtcttcagca

SEQ ID NO: 13408 - DNA, 121 bp, Artificial Sequence
  Synthesized
  misc_feature (61): n=a or g
ctatcggcagatggttactgaccactgctaaatggagaggggaattcttctgctgtggagngcaaacaagaagtagttatactcaggtgcattggtttaaggttcattcaaagaagaaaga

SEQ ID NO: 13409 - DNA, 121 bp, Artificial Sequence
  Synthesized
  misc_feature (61): n=a or g
ggcagttgggaagatgccccagatagcccagctcttccagagttacaagcaagctgcttcntttcttggttatttacacttctctctgtaatgctgctcagtctgtatgccctcagtagag

SEQ ID NO: 13410 - DNA, 121 bp, Artificial Sequence
  Synthesized
  misc_feature (61): n=t or g
catttttctctgcactcaacaaagtagattcacagtgtttcttgtatttcctttctttatncttctaagttacttacaggttgcactggatttttaacaacgctgtcagtatattgttggt

SEQ ID NO: 13411 - DNA, 121 bp, Artificial Sequence
  Synthesized
  misc_feature (61): n=t or c
tgattacagatctacgttggattctaggctgctttagaaatgtcttgatgaggtgaaaaangtcaaaagtcccttcctgttgcaacagggctaaaactgctgtttgcgtatactgatctca

SEQ ID NO: 13412 - DNA, 121 bp, Artificial Sequence
  Synthesized
  misc_feature (61): n=a or g
aattgaggtatggtttgttgtgttgctcatcctggaccaatgatgaaaacagatgttctcnaagcattcattaaactaaagtttctgcaaagcagcccagagatagggagaatgaaaagaa

SEQ ID NO: 13413 - DNA, 121 bp, Artificial Sequence
  Synthesized
  misc_feature (61): n=t or g
gaaaaagaagattgacttatcatatttacaggaatattctggatgacaaagatatccagantgactatatggaagtagggagtgtgccagcattttaactgagatttttgaactagccaaa

SEQ ID NO: 13414 - DNA, 121 bp, Artificial Sequence
  Synthesized
  misc_feature (61): n=a or g
ctgtatctgcagcagcccacacacagcactcgtggcctggagtctaaactggaggggaacngggaattcacatggcagatacgtatgcagagctgatttgaagtcataaatttgcaggatc

SEQ ID NO: 13415 - DNA, 121 bp, Artificial Sequence
  Synthesized
  misc_feature (61): n=a or g
cttctgtacaatagaaaggagggatttttataggctatctgttttgactatattccctaanacaagcaccaattctgcagagaatttgtgtttataaactttaatctagagaaaaatgctt

SEQ ID NO: 13416 - DNA, 121 bp, Artificial Sequence
  Synthesized
  misc_feature (61): n=a or g
gagtttccagccaatcaaataaaatacggaggtgtctgctgggaagagcttttccatccantgttctctatttaataccccagtgcctcttcatgcggtgttaactccaacacggaaaaaa

SEQ ID NO: 13417 - DNA, 121 bp, Artificial Sequence
  Synthesized
  misc_feature (61): n=a or c
taatgccttacactcattttttctgacccttcaggctgtcacctaactaagtattaaaaantgccaggggattctttgtgatttagctctaaaagctggttcatgaatcttgtgatctgac

SEQ ID NO: 13418 - DNA, 121 bp, Artificial Sequence
  Synthesized
  misc_feature (61): n=a or g
aaaaaaaaaaaagatatgtattattttatagctcaagtatgtattactcttctggctgtgnagaagtctgtgcagcagtaaagctccagtggagtgtggatctgcatatttattgatagta

SEQ ID NO: 13419 - DNA, 121 bp, Artificial Sequence
  Synthesized
  misc_feature (61): n=c or g
taggcactcaagcatcataaatatgagtgttcatgcttgatcttagtgttatttgaaacanatcatacatgcagctaggatgagtttggtgtgttactgataatgggttagaacagcatgg

SEQ ID NO: 13420 - DNA, 121 bp, Artificial Sequence
  Synthesized
  misc_feature (61): n=t or c
attctataactgggtgccatgacttgagtgaaacactgccaggaattgattatgtaggcanagcatgcctaaaacaaacatgagcacagtcctgctgaaagtaacaatggaggaagtgtca

SEQ ID NO: 13421 - DNA, 121 bp, Artificial Sequence
  Synthesized
  misc_feature (61): n=t or g
tttctgaagtaaatgtcctgcaaatgaaatggtgtagatttaaaagcatcctttaaaaacnttcgatctgagtattagatatgctcaccatgcatcaccattataaaaacagaccttccac

SEQ ID NO: 13422 - DNA, 121 bp, Artificial Sequence
  Synthesized
  misc_feature (61): n=a or g
aacagcaaggataaacagagttggaccaaacagctttgctggatagaagtgagtgtttgcnaatgctgccttgcagtatttgacctgcactaatgagctctcggtattcaataacctggtc

SEQ ID NO: 13423 - DNA, 121 bp, Artificial Sequence
  Synthesized
  misc_feature (61): n=a or g
accaccaagcgcatatccacccctccatcccaagccttctcagtacacaaggaagcaaaanccacaaagtccagtgaagacggctggcagctgcatggcagcaggtaacctcgggcaggcc

SEQ ID NO: 13424 - DNA, 121 bp, Artificial Sequence
  Synthesized
  misc_feature (61): n=t or c
tcagttaaatacttatctgagcttcaaaggatttagtggcagattggtgccaggaggctgnggctcttagggtcacctcaaacacatctttgctgttgtgaggtgtcagcgctgggagctc

SEQ ID NO: 13425 - DNA, 121 bp, Artificial Sequence
  Synthesized
  misc_feature (61): n=t or c
ggattttgagcttgagttgatgtgagcagatgactttgattcacctgaaaagcaagaagcntaggcctgactcatgaaagatcttgacagttattagcaagaaggaaacatcagcttctct

SEQ ID NO: 13426 - DNA, 121 bp, Artificial Sequence
  Synthesized
  misc_feature (61): n=t or c
tggtttgggaagattttgtcaatcaggtttctgtttgtgtcccaccctactgttaaacttngaactctttgcccaattccgtattattggacaaaagattactcctataaacctgaaatga

SEQ ID NO: 13427 - DNA, 121 bp, Artificial Sequence
  Synthesized
  misc_feature (61): n=c or g
ctaccttgtatcagacactctttcttctgtagatctcaatgtgattgcttttttagagaanagcatgaagttgttgatgaataagcttgtgattcactataaacagatccttctcccacaa

SEQ ID NO: 13428 - DNA, 121 bp, Artificial Sequence
  Synthesized
  misc_feature (61): n=t or c
tggaggaatctcattctgttttctttatattctcccattagagagcagaagaaagcagaanattttcccttagctttcccttcttaaggctaaaggaaaaccgctttcttgacttcttctc

SEQ ID NO: 13429 - DNA, 121 bp, Artificial Sequence
  Synthesized
  misc_feature (61): n=a or g
ctttgtgaggtgaggcccattgagagggagctgtgtgttagtgaaaatggctactaaatgnccaagtacaatatagtatatactcaaagaatgatctcttgtaaatttctatggacaattc

SEQ ID NO: 13430 - DNA, 121 bp, Artificial Sequence
  Synthesized
  misc_feature (61): n=a or g
cgtttgggtgctcttcactttggccagattctaatcaacaccagaacagaaacacagcccnctctaaccatgttctgaagggcttggtttaagccctcggatcaaatttctctccagttct

SEQ ID NO: 13431 - DNA, 121 bp, Artificial Sequence
  Synthesized
  misc_feature (61): n=a or g
ttctaggagcgcaggcgtttggctgtgctcttcttgtgccttgttttaaataagaggtacntgtaggtggcttcattatcaacaatggatacaatgatctcctaatgcatcacactggtat

SEQ ID NO: 13432 - DNA, 121 bp, Artificial Sequence
  Synthesized
  misc_feature (61): n=a or g
aaatggtaacaactttgttctgctatgcaagtcatatatactgttgggagctatgcataanactgagaaatgcttcaggagtgtgccaactgagatgttagcttttataggttttttaata

SEQ ID NO: 13433 - DNA, 121 bp, Artificial Sequence
  Synthesized
  misc_feature (61): n=a or g
taagtctgaagaggaaaaatatatacattttttcaagcattattatagtgaataactacancttcacttaggtagaagaaatagtgctagataccagtaagaaggctcatgagtgtttgca

SEQ ID NO: 13434 - DNA, 121 bp, Artificial Sequence
  Synthesized
  misc_feature (61): n=a or g
acaggtcattaatcaatctttcttctgttgacacataatagggagaattttgatttactcnttttccatatcttatctgaaaagcttggatttccttctgttcagtttcagttattttcct

SEQ ID NO: 13435 - DNA, 121 bp, Artificial Sequence
  Synthesized
  misc_feature (61): n=t or c
aggcttggtgtgccactgagaagttttgccatcttagttatccgtcttcagatgcaactcnattgctctcccctctgctgcggctgtgtcagcagaaggcccctggtagaggaaatgacca

SEQ ID NO: 13436 - DNA, 121 bp, Artificial Sequence
  Synthesized
  misc_feature (61): n=a or g
aacaactgggaagaggggaattcatttagagagccagaaacgtgtgcaatgaagctttggnttttggggcaaaacctggcacgtgagcgacttcagcaccagacttcacaaggaaacatct

SEQ ID NO: 13437 - DNA, 121 bp, Artificial Sequence
  Synthesized
  misc_feature (61): n=a or c
ccaccgacaccatattcttgtaccacccctccccagtaggctggagcactgtaattacacngcttctggtcaagttgggcaacttttcaaggaaagagtatacgtggaagtacttcactta

SEQ ID NO: 13438 - DNA, 121 bp, Artificial Sequence
  Synthesized
  misc_feature (61): n=a or g
caaggaaggctgccagtttctcttatcagctaccccaagtataatcttagtgcagttttgnaggctttcctccacatgtgcccctatttctctctgccagttagctttctgaatgtttcac

SEQ ID NO: 13439 - DNA, 121 bp, Artificial Sequence
  Synthesized
  misc_feature (61): n=a or c
ggggacacagagaagaccatcatggagttaatgggaagagacagggttacgtcttctggcntctcactgccttttgacattgtagccgtcaactcttttcccctctacacagaaggaaaaa

SEQ ID NO: 13440 - DNA, 121 bp, Artificial Sequence
  Synthesized
  misc_feature (61): n=c or g
cactaaacacacaggtggagttcacaatggccaagacaaagcttcaaatgaatgccatttntattctattagtttagcacaacggaaccataagatcacactgtcagcgtacgcttcattc

SEQ ID NO: 13441 - DNA, 121 bp, Artificial Sequence
  Synthesized
  misc_feature (61): n=t or c
gatttgttgctactgtataattaaaactagaattctttatgttctggatgaagatgagccngagcacggttctgagcagcaaaagatatatcacccaaacggcaaaggactgcaaattgat

SEQ ID NO: 13442 - DNA, 121 bp, Artificial Sequence
  Synthesized
  misc_feature (61): n=a or g
cattatttgaagaatgcttatcatttcagattagtatttgatcatactcatttgctcatgntgtaaggggaagtgcatgctgttcattaaaaattgatatttttagaccaaaagcttttgc

SEQ ID NO: 13443 - DNA, 121 bp, Artificial Sequence
  Synthesized
  misc_feature (61): n=t or c
ggcactcatctctgcttcctccaggtggcagaggtgaaatcaaattggtgtttctgtatgntcagagcaataaaacttttgtgagtgttccagtatttctttaatatcttaccctctttct

SEQ ID NO: 13444 - DNA, 121 bp, Artificial Sequence
  Synthesized
  misc_feature (61): n=a or g
aggagggtcaaaaatgtgaaaaaccctcagtgatgactctgatagatatcatctgtaagancaattattttaagggaaacaatttgaagaattggcctaattatgaatagtgctggaagat

SEQ ID NO: 13445 - DNA, 121 bp, Artificial Sequence
  Synthesized
  misc_feature (61): n=a or g
tgtataaccgtagtaatgggaaagacgttacaacagcagtatactttgagtttgctttgtntcagttgcccccttctgccccctgtgaaacaaatgccccagcccagtaggtaaaatagtt

SEQ ID NO: 13446 - DNA, 121 bp, Artificial Sequence
  Synthesized
  misc_feature (61): n=a or g
cagtgcaattaggactggacaggtgcaacagcaaaaataaaggctacagcacatctagcantgactgagtttatgttttgattcaataagttattaatatgactcatccgtatgttaccaa

SEQ ID NO: 13447 - DNA, 121 bp, Artificial Sequence
  Synthesized
  misc_feature (61): n=a or c
cttgatagttcccctctggcactgtggtgagagctctgccagccttcttattcatccttantctccttcacacaatctatggtgcaataagtgacacaatcccttttgccctctctcattt

SEQ ID NO: 13448 - DNA, 121 bp, Artificial Sequence
  Synthesized
  misc_feature (61): n=t or c
cccaaacccgctgcgccagcgcctggaggagtatttccagcatgcctggtcctacaccaanggcatcgacatgaacgcggtgagtgccatgcagggaggcctcacatttatgcagagcctt

SEQ ID NO: 13449 - DNA, 121 bp, Artificial Sequence
  Synthesized
  misc_feature (61): n=t or c
ttattactgttactcaataatcagttggcctggacattaggttgcgaaaatttgaacaaantgtgaactgttgaactttaccctgcacatacggcttatttccctgccctcttcttattgc

SEQ ID NO: 13450 - DNA, 121 bp, Artificial Sequence
  Synthesized
  misc_feature (61): n=t or c
atgtacccaagtaaaaacattagaagcaacaataacaggattaagtatgggagaagagtanagtttcagagtgattgctaccaatgagaaagggaaaagtgatccaagagaacttggcgtc

SEQ ID NO: 13451 - DNA, 121 bp, Artificial Sequence
  Synthesized
  misc_feature (61): n=t or g
tgaggatggagcgatgccattgggatgtggggcagtgcagggcagctgggctcacatacanccatgtccccaaaatgatctgcagagcccaggacgtgtgagcccagattgccacgtgcag

SEQ ID NO: 13452 - DNA, 121 bp, Artificial Sequence
  Synthesized
  misc_feature (61): n=t or c
tgtattattttctgtcttttccagcagggtgcagacttataggtcagattcaagtttgttngcataaaatatttttgtgcccaagaagaaaatacagcccacaaaatatacattaggaaat

SEQ ID NO: 13453 - DNA, 121 bp, Artificial Sequence
  Synthesized
  misc_feature (61): n=a or g
tgctttagaactaaatgctaattcactctgtgcagagttccctctttaaatcccaaatgcncagtgcaaggggaacgtctcttgtacagacagtagtggccttgatgcatccatccatgca

SEQ ID NO: 13454 - DNA, 121 bp, Artificial Sequence
  Synthesized
  misc_feature (61): n=a or g
attgagcacttgagggaccccatccactctattgcaaactaacttaatcagactcatttcnctgctaactgctgtagctttttacacctctagaagaaggaaaaaaaaccctactttaatt

SEQ ID NO: 13455 - DNA, 121 bp, Artificial Sequence
  Synthesized
  misc_feature (61): n=t or c
agcactggaacgtgggagatgggcagggttctgctcgtgtccctgggagacaaacagcaangatctggcaaatgcactcaacctctttgctcacatatttttccctcgaattgctcgaagt

SEQ ID NO: 13456 - DNA, 121 bp, Artificial Sequence
  Synthesized
  misc_feature (61): n=t or g
tacatttaattctctacgacaactctattcttaaaaatagttctaccatggaacaaagttnttatacagcacataattttatgaacatcagtggtgcatttcctatggactaacaggagag

SEQ ID NO: 13457 - DNA, 121 bp, Artificial Sequence
  Synthesized
  misc_feature (61): n=t or c
tcattgggagtcaatttcagctgggaaataatcaaatagtatgaactgtgagctaccaccnatgcctctcagcactggtgatagtctaggttttttcaaagttaacagtacatatcacgtg

SEQ ID NO: 13458 - DNA, 121 bp, Artificial Sequence
  Synthesized
  misc_feature (61): n=t or c
attcttaacagcccgagtcttcctttaccaaatataaacatttaccacatatatttaagcngtataggcttaaatacaaattttccagaggtgttttttccccattgttaagtattttaca

SEQ ID NO: 13459 - DNA, 121 bp, Artificial Sequence
  Synthesized
  misc_feature (61): n=t or c
cccggctgcacaccagtcggatctgaacctttgggtaggagagtaggcagcagccaagtgncattatcaggttagaggagcattttttccttactcgtgtaattccagctgataaagtgac

SEQ ID NO: 13460 - DNA, 121 bp, Artificial Sequence
  Synthesized
  misc_feature (61): n=t or c
aagaagatggaaaaaaggaggaagttttctaagtctcctactcaataaatagcataactgnctgagaagagccttcacatttttctcagtgtcagattcaggaaagtgcctgtcgcccaaa

SEQ ID NO: 13461 - DNA, 121 bp, Artificial Sequence
  Synthesized
  misc_feature (61): n=a or g
tgagtgaaggattctggttctgcactggcatgaactcgcctggggtggggaagggttgcantaggtggctgttgtctttgctgcagagctgaagggaggagcccgtctgctgatacagagc

SEQ ID NO: 13462 - DNA, 121 bp, Artificial Sequence
  Synthesized
  misc_feature (61): n=a or g
ttgttttgcaactgttgacgctgatgtggttcctttgaggttcacggcaagtcaggcctgngacttgaagcagagagagaacgatgacaagaacccaggaagccttgattttctgagaaac

SEQ ID NO: 13463 - DNA, 121 bp, Artificial Sequence
  Synthesized
  misc_feature (61): n=a or c
tcagaggaagttaaaggaagtgattcttgcttaccctggtttgatatctcccatcaaaacnccgtgttttagttccagtgtgagagagggccttcagatgatatctcggcagtggcagctc

SEQ ID NO: 13464 - DNA, 121 bp, Artificial Sequence
  Synthesized
  misc_feature (61): n=a or g
caccgtacagactgctgtaaagaaaataaaacccataaccaccagacctggtgcatttggncatataattagcaaggcagtaaaaggcctccccctttgtgcttactgaaaccttcagagg

SEQ ID NO: 13465 - DNA, 121 bp, Artificial Sequence
  Synthesized
  misc_feature (61): n=a or g
gttcttctcctgcgtggcctgagctcctaccacacatcagaggaggagaaatatcctgggnctattttgtgtttcaccacatcccccatcctcacaatatcacccttccctcaccccctcc

SEQ ID NO: 13466 - DNA, 121 bp, Artificial Sequence
  Synthesized
  misc_feature (61): n=t or c
cacatatttctgttaataccacaatatagtagcaagcaaagaaaagctgtattaaaaacgntgactgttctgtagctgtagcaaagccagaggcaaaatatttccagtggcattcttgcag

SEQ ID NO: 13467 - DNA, 121 bp, Artificial Sequence
  Synthesized
  misc_feature (61): n=t or c
actccctgctcctccacagctgggccaggagctgggggaaatagccatgtcagaacggaanggtcagcagcacttgccaagaggagcatttggtccatggccagtatacctggtctagctt

SEQ ID NO: 13468 - DNA, 121 bp, Artificial Sequence
  Synthesized
  misc_feature (61): n=t or g
cagcaaatatgaagtcatagtatttctttcacattcactgcactgcaaagataccaacagngttgcagctgagaacagatttcagaagcacgtctcttgaattactggtattggtcactgt

SEQ ID NO: 13469 - DNA, 121 bp, Artificial Sequence
  Synthesized
  misc_feature (61): n=t or g
accattacagctcaactcacatctcagcatgccgtgatggattctttaagtacagattagntagtaatgacatgaaattgccttgatgctataaacctcatctgtatgcatttatttaccc

SEQ ID NO: 13470 - DNA, 121 bp, Artificial Sequence
  Synthesized
  misc_feature (61): n=a or g
gctgttttcttagttctgagtttagaacaatagagcctggaacagctttggctgtaaaacnggttcttattttccacactctatagagtttgccagttcattttgttggagcagtgctgca

SEQ ID NO: 13471 - DNA, 121 bp, Artificial Sequence
  Synthesized
  misc_feature (61): n=a or g
ttatcaactctatgtcttcggcagagctcttcaggagtagactattcatcttacttttccncatcacttttcatactctgttgaaaaaataacatggaaacaggcagcaaaacctgttata

SEQ ID NO: 13472 - DNA, 121 bp, Artificial Sequence
  Synthesized
  misc_feature (61): n=a or g
ggcaactttggaaatagcgtgagttgaattgaggaaaagctaggcactgtgaaagggtatnaagattccaaataaacttgaagtttggaatttgcctggaggacgtagtttgtgcaagtac

SEQ ID NO: 13473 - DNA, 121 bp, Artificial Sequence
  Synthesized
  misc_feature (61): n=c or g
gtgcaacaatacgtgtgtatgacagtttcagatattagcacctcagctggcttattatagnttagagactttagatgaagaaaggaatgagctggcttgactgccttggggaagaatacgg

SEQ ID NO: 13474 - DNA, 121 bp, Artificial Sequence
  Synthesized
  misc_feature (61): n=a or g
tgccttgtgaatggaaagaggtggtctgctgtcctgtggaggcatgacacccactgtggtntaggggaagtttctgttggtgatgttttctattatgaaactgtcttgagacagacggttc

SEQ ID NO: 13475 - DNA, 121 bp, Artificial Sequence
  Synthesized
  misc_feature (61): n=a or g
ttgattgcttttcattttgctagactgaaattgttctcactgaagttctctctcccgcagngcatgtctcattctcatctctggtgaggagtttcagttgaaacagctcagccacttgaaa

SEQ ID NO: 13476 - DNA, 121 bp, Artificial Sequence
  Synthesized
  misc_feature (61): n=a or g
tgtgcataaacttccttttgaattacgctgatatcaaatgaaagagtccttgcgtgacagncagagtaggcactaacaaactagagaatcagccattccatagaaccctctcccccaaaga

SEQ ID NO: 13477 - DNA, 121 bp, Artificial Sequence
  Synthesized
  misc_feature (61): n=a or c
tgtttttttttaaatatatatacatatatttctgtagactatggcttatgcctatatggtnagcataaaatatctctacacaagtactccgtttgcctgagttgttcacttacaggactgc

SEQ ID NO: 13478 - DNA, 121 bp, Artificial Sequence
  Synthesized
  misc_feature (61): n=t or c
cagctacagtaaaatttagactaagcaacttttatttcactgcattattcctaattacaantgatggtaattacaaactgaagcaagagcagaggatattatcatgtaagaacctctctat

SEQ ID NO: 13479 - DNA, 121 bp, Artificial Sequence
  Synthesized
  misc_feature (61): n=a or c
atgtctgctatgttgccacaggtatgtgcaagcactttgatatgtttgtggctttttgatngctttttcaatgggcacagctgaggcggcactaaggggttctgagaaacactcttgtaat

SEQ ID NO: 13480 - DNA, 121 bp, Artificial Sequence
  Synthesized
  misc_feature (61): n=a or g
cctgtaggaggtagggtggcatgcagcagttgaacatcaaatatgttagatctatcatctncgttgggtaaccatgaacaagtcgtgacataatagggcccatatagcagcctctgtactt

SEQ ID NO: 13481 - DNA, 121 bp, Artificial Sequence
  Synthesized
  misc_feature (61): n=t or c
gccacaaggttatccacactcatagcccagcaggataaatgtcagaccttcaggttgttanacggtcagcatggtgctcacttcagttgtacgcttcttagagcaatatatcttacagggc

SEQ ID NO: 13482 - DNA, 121 bp, Artificial Sequence
  Synthesized
  misc_feature (61): n=t or c
tctaggtgtattgcatgaagtttagtgatatctgtccccttagcagtagagatacgttcanattgccttggcaaaagggttaaatcactatgatgtgaactttcaaggagaattctagctg

SEQ ID NO: 13483 - DNA, 121 bp, Artificial Sequence
  Synthesized
  misc_feature (61): n=a or g
agattttatgttgttgatgaggtttatgagatttctctcaggtgctttattacaagaactnttgatcctcaccattctgagattactgctgtaaaccaagagctgaccctttctgctgttg

SEQ ID NO: 13484 - DNA, 121 bp, Artificial Sequence
  Synthesized
  misc_feature (61): n=a or c
tatatccagagtagataagaaaggctgggcttgaaactgaagcagtgtgaatgtagcttanaccaccaaaaagtccttccctcgatgatttcccacctcacaacaatttccagaactaaat

SEQ ID NO: 13485 - DNA, 121 bp, Artificial Sequence
  Synthesized
  misc_feature (61): n=t or c
cccaacagcggggacagtgacctatcaaacatacattgcaggagcagagtccgatgggagncgggccatggctgtgtgcagggacaggacagggtgctccagcacagcagagccccaggca

SEQ ID NO: 13486 - DNA, 121 bp, Artificial Sequence
  Synthesized
  misc_feature (61): n=a or g
gcagggcatggggagatattaggaaagaatatgagtgagaaggcatgtgtgttaaagaaanaggagtgatagcacttaacataaatggctatgggcaaaacagactcagtttgggaaaatt

SEQ ID NO: 13487 - DNA, 121 bp, Artificial Sequence
  Synthesized
  misc_feature (61): n=t or c
ttagtcttttttccttccagctcctaaacaagtcttactcttaaattacctaaaaaagacngtttgagatgcagaaggaaaggggaaaagtctatccaaccagtttacagactaacgggaa

SEQ ID NO: 13488 - DNA, 121 bp, Artificial Sequence
  Synthesized
  misc_feature (61): n=t or c
tgttgcacagttcaaattcacagtgcttttaatgcctaatggtcctatgaggataaccagnggccccttcgaacctgagctctacaagtcggagtttgaggtgcaagatggagagctgaag

SEQ ID NO: 13489 - DNA, 121 bp, Artificial Sequence
  Synthesized
  misc_feature (61): n=a or g
gcaaagctgcattaagaagccttatcttcagaacagccaaccaagagcttctccacgtctncagaccttctgacagcaaacagcctgaggcccatttactaattcaagctctgctcttacc

SEQ ID NO: 13490 - DNA, 121 bp, Artificial Sequence
  Synthesized
  misc_feature (61): n=a or g
caggacattcgtaggctaccagaagcatcactactattaagagctaatgaggaacctgganaacttgcagaatcagaaaccattctttgtataagtattttagctcatttatgatgagccc

SEQ ID NO: 13491 - DNA, 121 bp, Artificial Sequence
  Synthesized
  misc_feature (61): n=a or c
ttaaagaaaccccaaatgacggtgagcagcatagatgagctaaatctgataaagcagatgnctttgtactctccaagttggtccgtgcacatctctagcctctaccgaatgtacttttatt

SEQ ID NO: 13492 - DNA, 121 bp, Artificial Sequence
  Synthesized
  misc_feature (61): n=t or g
gttttcatggagcttgaagttgtcctaaaaccaaatgccgtagtagcaaggtaatcgtggngtttatggacacgctgcgcaatcatccatgagtgttttctttattcgcctttgttctggt

SEQ ID NO: 13493 - DNA, 121 bp, Artificial Sequence
  Synthesized
  misc_feature (61): n=a or t
ctcatgaataaaacataaaagggggaaaaaaagaaaaaaaatagctttcaattcaataagngtgaactcagcatagaaatatttcttcaagtaggcaaatcttgttaaaattatgcccctt

SEQ ID NO: 13494 - DNA, 121 bp, Artificial Sequence
  Synthesized
  misc_feature (61): n=a or c
aggtttgtattcagcatagtgatatattgtgatttatcatcatgctgtgctgaatattccngtattatcaatatcatgacaactttgctacatgtctggctactgtgctccttatcacact

SEQ ID NO: 13495 - DNA, 121 bp, Artificial Sequence
  Synthesized
  misc_feature (61): n=c or g
accacagttatacagaaaattcatcactgatatattactagaggttcatgaggtttgtttntatgaggtgctgacctacttttcctttatctcttaagggattaatttatttttttaatca

SEQ ID NO: 13496 - DNA, 121 bp, Artificial Sequence
  Synthesized
  misc_feature (61): n=c or g
gatgtctatccacataaagttttaagatctacatgtcttactaccaaataaatgtgcccantttgacaggtccacatgcaccccaccaaataagtgttaggtatttactgacctattaaca

SEQ ID NO: 13497 - DNA, 121 bp, Artificial Sequence
  Synthesized
  misc_feature (61): n=a or g
gctgtttaaatgtttgttctaagttacgttgctttctgatgtttttacttcaaattaaatntaaaagtttgtcttactcagttcataaactattaatatcctctgtagtggctgacaaaat

SEQ ID NO: 13498 - DNA, 121 bp, Artificial Sequence
  Synthesized
  misc_feature (61): n=t or c
tgggctgaaaatgagaagcaagagctttaactgacaaagcagtaaggctatgaaacatccntccaccagacgcagtcatggcaaaaaaaaaaaaaaaaaacctatctaattttaggataaa

SEQ ID NO: 13499 - DNA, 121 bp, Artificial Sequence
  Synthesized
  misc_feature (61): n=a or g
gatgtgtgcttgtccctgctcccttggcacacgggtcactattgcagcgatggcattgaantccatgcccagagctgtccccttcccaccagcaccgaccagtttgaaaccttccgcagcc

SEQ ID NO: 13500 - DNA, 121 bp, Artificial Sequence
  Synthesized
  misc_feature (61): n=t or c
gatggctggcattgcttccagctcgatctataattaaccaccttgtggagacgcagctttnaaaaataggcacaagtaggaattgtttcccctcttagtgtgtgtgtttggctggtgttgc

SEQ ID NO: 13501 - DNA, 121 bp, Artificial Sequence
  Synthesized
  misc_feature (61): n=a or g
gaagcaagctggcatctggagaacttcctgggacttacacaaaatgccaccaaattgattnaaagaggaaacgatagcgttccatgttcattctcccaaccagtgtgcttaagctgaaccc

SEQ ID NO: 13502 - DNA, 121 bp, Artificial Sequence
  Synthesized
  misc_feature (61): n=a or g
agtcctacctcaggcacttgagtctgaagaactgcttattcctaagagtgaagaaaatctntagtggcagacctgtaagtgagagaaaggcagagttagtatgattcctggaaggatcatt

SEQ ID NO: 13503 - DNA, 121 bp, Artificial Sequence
  Synthesized
  misc_feature (61): n=t or c
aattggtaattcttacttaagtgctatctgcttgattaaagggagcaaatagaaaagggtngtgcgaatccctcccatgtgagattaaaatgagtattaaaagtagaatgatggtcgtgtt

SEQ ID NO: 13504 - DNA, 121 bp, Artificial Sequence
  Synthesized
  misc_feature (61): n=c or g
tgtgatctgccttggtcatacccagtcaccaatgatgaatgcatgttcataggtggatggnttaaagttattcttctctatgtcattcacctattgctgctctgatcaaaggaaacatcat

SEQ ID NO: 13505 - DNA, 121 bp, Artificial Sequence
  Synthesized
  misc_feature (61): n=a or g
ctcctcctctccaatatgcatccaattttgctccatcagtcatgaggaatgacaaaactgngctctcccaatcgctatggctgtggtccccccatgtccccaccctgctgggcgctgctgg

SEQ ID NO: 13506 - DNA, 121 bp, Artificial Sequence
  Synthesized
  misc_feature (61): n=a or c
ctgagctgtaatgcaaatagttcacaaccaaccagaatgtaaatcagagcaaattcttatncagccctttttttgaaatgattaactaaatacaatcactaaggttccgttcattaagtcg

SEQ ID NO: 13507 - DNA, 121 bp, Artificial Sequence
  Synthesized
  misc_feature (61): n=t or g
taagtctttccagctgcaaacgttagagttgtctaaagttatgattttggactgcaattanctgcagctctccagctctgtccctatggcacggggcatccccacacgcccctgctccagc

SEQ ID NO: 13508 - DNA, 121 bp, Artificial Sequence
  Synthesized
  misc_feature (61): n=t or c
acagtgcacctaatgcacactttgatagtcaaatatggcatttactttgagtgtagggaangtaatagatcttgtgaactaacgaggtcttctgaagtaatttccctgtctagtggaaaac

SEQ ID NO: 13509 - DNA, 121 bp, Artificial Sequence
  Synthesized
  misc_feature (61): n=a or g
caaagcacagcaagaatgatattattcagatattcacaaactgggggaaacagagctggancaacaaggcagctgctcccaatcaagtgttgtggtaaggacctgcctggccaggacacct

SEQ ID NO: 13510 - DNA, 121 bp, Artificial Sequence
  Synthesized
  misc_feature (61): n=t or g
cattgcgctccgtttgttcaaagtaaccactcctcttcccagggtggaatctctttttccnttttattgacttacaaaaaatgtctctgctatcagcaccggccgtgtgcgtgtcataaat

SEQ ID NO: 13511 - DNA, 121 bp, Artificial Sequence
  Synthesized
  misc_feature (61): n=t or c
ccctggggaaactctggaaagagttgcatacaatacacaatacacatggggacaaatcccnatccttggtcaactggtgaagctctatgatttcagaggctctggccagagctgtgctttg

SEQ ID NO: 13512 - DNA, 121 bp, Artificial Sequence
  Synthesized
  misc_feature (61): n=a or g
gccgaactcttcagagtctttaactccctctagttgctgaagcatgctaaagcaataacgncatgttctgtgttgagatgtgttgcactgtattaaaccgatcgctgttacaggctacaga

SEQ ID NO: 13513 - DNA, 121 bp, Artificial Sequence
  Synthesized
  misc_feature (61): n=a or c
aggaaaaaaaaaactgccagaattatcaaaatcacaggaaatatctgtgcaactctatggntgaacctggtattctctttaccactgacaatgcatttctgtttatgcaccagtggttaaa

SEQ ID NO: 13514 - DNA, 121 bp, Artificial Sequence
  Synthesized
  misc_feature (61): n=c or g
acttgagcagccatcatcgtctgtacggggcaatagaactaggtgtagctcaatagcttgnctatgcacaattcaaagagtaacccctcgttcaacaaccaaattaaattcagatgggtca

SEQ ID NO: 13515 - DNA, 121 bp, Artificial Sequence
  Synthesized
  misc_feature (61): n=t or c
cataactgcactgcaggctgacacacatcttctgaagtgcaagcaggctaggatgatgctncagctaatggcaatttacaaatgtgcctaatagctgaaagacagtgacctcagctctcat

SEQ ID NO: 13516 - DNA, 121 bp, Artificial Sequence
  Synthesized
  misc_feature (61): n=c or g
cagcagtgttttggtgagtctggggatgtcttcaaacattacctaatgtatttgcacaggncatttcctgagcataaccaatgtcctacccatcagcactctgccttttgaggcagtttca

SEQ ID NO: 13517 - DNA, 121 bp, Artificial Sequence
  Synthesized
  misc_feature (61): n=t or g
ttagcacccaggtttgcccttttagctacgcaaatataagctgcaaaattattcacttggnattcagacttaggcttgcataaaatggagtatgtgtatatagatgtatagatgttcgtaa

SEQ ID NO: 13518 - DNA, 121 bp, Artificial Sequence
  Synthesized
  misc_feature (61): n=a or c
cttcactgcagcaagggtaaatgcagctgctgagggtatgggccaggtgggagcaggaaancaggaaggtcaaggagagaaggagaaaagcaggacttgcaggtgggtagaaagtgggagc

SEQ ID NO: 13519 - DNA, 121 bp, Artificial Sequence
  Synthesized
  misc_feature (61): n=t or g
aactttcttcaaaccattaaagtgagaatctctaatgagaatagtgaagacttctgacaantgaattcagttgcaacacttacaagtaagctagatttgtacctttaaaggaaagatacgc

SEQ ID NO: 13520 - DNA, 121 bp, Artificial Sequence
  Synthesized
  misc_feature (61): n=t or c
aaaattctgtggatgaattaactttgaatactgccttgagtacttttgtgaaacaatttcntttcaggtattaatgaagtttcagttttaacatctccctttaggacaagcattttccatc

SEQ ID NO: 13521 - DNA, 121 bp, Artificial Sequence
  Synthesized
  misc_feature (61): n=a or g
gcaaactgtgagtgttttgtatttgtgtgagggtctcatgtttggcctgcaatttttcagntggcaagcagtcactctgagccccacatgcaatcctttcagttgagatgagtctttttaa

SEQ ID NO: 13522 - DNA, 121 bp, Artificial Sequence
  Synthesized
  misc_feature (61): n=a or c
gggctcactgacacggtgtggatgaacatgtgagataaacgcacatctcctatagtcattngtttgggatttgaggaggaggaaggtagaattgcagcctccttaagacaaggagttttgc

SEQ ID NO: 13523 - DNA, 121 bp, Artificial Sequence
  Synthesized
  misc_feature (61): n=t or c
gtcattttgtagtttggaggtctgaggtctattctgtttctacctttgatttcaggtgtgnttaacaaatcagtttcttcatttgtatgtcctccttctgtccactactgccttattcggc

SEQ ID NO: 13524 - DNA, 121 bp, Artificial Sequence
  Synthesized
  misc_feature (61): n=a or g
tgacagcaactgctaggatagacagtgggaagtaaaagacacatgtagatttgaatgggtnatttcccacaagagctgttaagcacattcagagctcagtgaagcagatactacttaattg

SEQ ID NO: 13525 - DNA, 121 bp, Artificial Sequence
  Synthesized
  misc_feature (61): n=a or g
tggctgcattcacaagctctcccaccctctcacctcctgaggctcactgattccacatccngcaaaacactgctatcgcagaaggtaccaaagtggcttctcaagtgatctggataagcca

SEQ ID NO: 13526 - DNA, 121 bp, Artificial Sequence
  Synthesized
  misc_feature (61): n=t or g
atttaaaagagaaattactgaaaaaggaacattgaagatttctgcaaagttccagaaacantaaatgtactcaagtttcactgacaaacttgtttttacataaattttatctgttatatct

SEQ ID NO: 13527 - DNA, 121 bp, Artificial Sequence
  Synthesized
  misc_feature (61): n=t or c
ggacacaacgggcagggccgggccaggggatgctgggggctgcagcattcggcgctgagangccaaaacgagctgcctgagtgcagagggagattggatcacatcgacgccctcagtcctg

SEQ ID NO: 13528 - DNA, 121 bp, Artificial Sequence
  Synthesized
  misc_feature (61): n=t or c
gaagcctccaatagcagcgtttatctcttcaagctttgctccttttctcttcacatgagcnttagcctttttaaaaggactagaaggttgtatttatgtatatgcattcatttgtgtgtgt

SEQ ID NO: 13529 - DNA, 121 bp, Artificial Sequence
  Synthesized
  misc_feature (61): n=t or c
ttatgaaagaaaaatgaaaaagcaccatttaaatgttccctgtgatatggaagatcaatangatgcagcctttggatagattttattcatcgttttgaagaatgctgaacattcctagaag

SEQ ID NO: 13530 - DNA, 121 bp, Artificial Sequence
  Synthesized
  misc_feature (61): n=a or g
tctggctgtgctttgcaaacacctccaggtcccaggaacacctgcaaagagcgagtgcacnttccagcacagtaagcagcaaagcaaactgacagcctcaacatgcaaaatagagacctca

SEQ ID NO: 13531 - DNA, 121 bp, Artificial Sequence
  Synthesized
  misc_feature (61): n=t or c
tactcttaagagggcttgattttgcaattataggtcctcaacactgtgtggtaagaatcanagctctatcccatcttacagtatgatggaagtggaaaaaactgtcatttctgaaaaatga

SEQ ID NO: 13532 - DNA, 121 bp, Artificial Sequence
  Synthesized
  misc_feature (61): n=t or c
ggctcacagtgcttctggagcagatggctggaggcagtttgcagccagcatcttgtctctntgctccttcacctttcaagagggttttattggaaatctcatctgctcccattggtttggg

SEQ ID NO: 13533 - DNA, 121 bp, Artificial Sequence
  Synthesized
  misc_feature (61): n=c or g
ttccacagaatgactttgaaataggcttatagtaattgctttcaaagttcttttggatcantgcacctccctgcatccttggcttttgtggcctatctgatttccttggcgtttctggtgt

SEQ ID NO: 13534 - DNA, 121 bp, Artificial Sequence
  Synthesized
  misc_feature (61): n=a or g
tgatcgtctctggctttattttacctctccatctttccacctgggggctttgatttgtttnaataacctaatgtctttctttagatgtaggtaaacaggtctaccactaatctatcctaaa

SEQ ID NO: 13535 - DNA, 121 bp, Artificial Sequence
  Synthesized
  misc_feature (61): n=a or t
ctatgcccccagctactggctgcacgtgtagcctttcattagggcactgctgcttgccttnaattgctggttggagctcagctctctgagggggacaggagttggctgtcagcaggaaaat

SEQ ID NO: 13536 - DNA, 121 bp, Artificial Sequence
  Synthesized
  misc_feature (61): n=a or g
cagcctccaaaattgaactggctgttgaattggctgtttccctgtaaacggaaaatctttngccagagatgtatctgtaagctttacgtttctgctggttattgtgcttgtcattgtgggt

SEQ ID NO: 13537 - DNA, 121 bp, Artificial Sequence
  Synthesized
  misc_feature (61): n=a or g
agctgtgctggagtggggagaaataggtcaggagcaccgtctgcatgtgctactttccctnttgcagcacaaagatctgtgtgagtgcagcggggagctgcttcattagtgccaagaagct

SEQ ID NO: 13538 - DNA, 121 bp, Artificial Sequence
  Synthesized
  misc_feature (61): n=a or g
gaggtgttgaagctctccctcaatacatccccctaaagtagtctcctggtcatagaaaatnaagatggatgaaatgagtcagagtttgactgcatgagcaaaactagcaaaggcacactga

SEQ ID NO: 13539 - DNA, 121 bp, Artificial Sequence
  Synthesized
  misc_feature (61): n=t or c
tgattggctgtgctttcacaattctacatttctgagtagctgatgggataggctgcacatngctccactacagttgtctaaggagcatggctggagaagcacaaagaggttttcttacagc

SEQ ID NO: 13540 - DNA, 121 bp, Artificial Sequence
  Synthesized
  misc_feature (61): n=a or g
aagtttaatagcttgaaaaagagcaaacttagcggcaaagcacggcgttctcttcccatcngggactaaaagctgaggtacagaccgaaagctgatgttcgttgtgcccatcaggcaggtg

SEQ ID NO: 13541 - DNA, 121 bp, Artificial Sequence
  Synthesized
  misc_feature (61): n=t or c
tagaatatggacgaggcaagtagggtggtactcctgcagttttttcagcctttggttcatntcaactcaggattatttgaagctatacctttatacttaatagctcttgatggctttttct

SEQ ID NO: 13542 - DNA, 121 bp, Artificial Sequence
  Synthesized
  misc_feature (61): n=t or c
cttacaaaaggacaatgttaaatcagtcaacaaaaacagccatttcttttcccatacactncataatttcagtcatgttaaggaagaggtttggactttccaacgtcttttaaattttctc

SEQ ID NO: 13543 - DNA, 121 bp, Artificial Sequence
  Synthesized
  misc_feature (61): n=a or c
tttatgctcttttgcaaaatgtagatcccaaactcattagccttaaattactacctgcagngatacggagggcccaaaatggctgcgtttgcgtgtaggttaatagcacgtgtggaagttg

SEQ ID NO: 13544 - DNA, 121 bp, Artificial Sequence
  Synthesized
  misc_feature (61): n=a or g
tggtacaatttgggcattgcttttgagcagaacttggagtatcattttcagagggtttctntgggttttgttccctgttccatgcactcctgcagcagcgccacccacctcactgtccttg

SEQ ID NO: 13545 - DNA, 121 bp, Artificial Sequence
  Synthesized
  misc_feature (61): n=t or c
gcattaatttgtcgagtatctttcaggtgatcagataggaccagtatatacacaataggcnttgcaaaatgagactacttccaaaaccctgctaggtaaaacctagaaaaatagctgctcg

SEQ ID NO: 13546 - DNA, 121 bp, Artificial Sequence
  Synthesized
  misc_feature (61): n=t or c
ctctctgcttcgcacaggtttggttgaaatagtttgctgatgtcccttggaagccattggngctgcaaagtggctgcctaagtgctttcttgaactggatcccaaatggaggaaaggctgt

SEQ ID NO: 13547 - DNA, 121 bp, Artificial Sequence
  Synthesized
  misc_feature (61): n=t or c
gttagggagcattcttctttacgatggtgtcactgcatcagtggaggagggaagagccacngatgccatccagattcaagtggggcctttggcacagaaccccaacatccttcttgtccaa

SEQ ID NO: 13548 - DNA, 121 bp, Artificial Sequence
  Synthesized
  misc_feature (61): n=t or g
gtccctgcgctgcagcagcagcaccaagggagtgagcggtgaaatattttgggagcgggcnctgctcttctgttacatgtttcctgtctcacatgaaaagtgcaattcagctgctccctaa

SEQ ID NO: 13549 - DNA, 121 bp, Artificial Sequence
  Synthesized
  misc_feature (61): n=t or g
ggcttttcattcacctcccagaaaagagaactaataatacttgttggccatagaggtgctnttaggcttaattcattactgttcataaaagctgataaatatctagtttcaaagatagaca

SEQ ID NO: 13550 - DNA, 121 bp, Artificial Sequence
  Synthesized
  misc_feature (61): n=a or g
cagatgtatgggtaaagagtaaagaagagagaccactacataaactagcaggctgagtagnaaccgcaatggaaagctttccaaggactagtgtaattcatccttggttcttatagacaag

SEQ ID NO: 13551 - DNA, 121 bp, Artificial Sequence
  Synthesized
  misc_feature (61): n=c or g
ttaactggaacaaccacagactccccctcaatctaagtcttatcaccgtgtttccaggaangggacagttttccctcttggctgtaggagaacatttagttgaatggccaaaagccacact

SEQ ID NO: 13552 - DNA, 121 bp, Artificial Sequence
  Synthesized
  misc_feature (61): n=t or c
tatattctttttctgtttttcatatttttggggggtctttaagcaaatgtgtcttggaaantaaacatttacattttagtgagctttttgtttatagattggttttaaggaaatcattttt

SEQ ID NO: 13553 - DNA, 121 bp, Artificial Sequence
  Synthesized
  misc_feature (61): n=t or c
attgttttggataatgctgttgccaatcctaatgctactgttcaaaaaacaaatccttccnaaagataagcagaatgctaaagtgaattatgtaacaaagctaccaatgtataaaaataga

SEQ ID NO: 13554 - DNA, 121 bp, Artificial Sequence
  Synthesized
  misc_feature (61): n=t or g
acttatgctttgaagcctataagcttatgcttttgtatatgttttaatttattctgcatgnccttaaagctttaccgcacaagaaaaggaacactgtgggtaggcagaacactgatataaa

SEQ ID NO: 13555 - DNA, 121 bp, Artificial Sequence
  Synthesized
  misc_feature (61): n=c or g
cacgttggttggcaattcccttccatactgggaaaccatgaaaaaatgagatgcttagatngtccaagaccaaggaagtaagcaggtaagggggtaaaatcataacaatataaacaatgga

SEQ ID NO: 13556 - DNA, 121 bp, Artificial Sequence
  Synthesized
  misc_feature (61): n=a or g
acatacgtacatgtgcctgtgtgtgcacatacatcatcaactctacccccacaaattaagncactgaaaacacctacacaaggaccatctctgatacccatgtgtcagtaatttcagttgt

SEQ ID NO: 13557 - DNA, 121 bp, Artificial Sequence
  Synthesized
  misc_feature (61): n=t or c
tgttaattgtgcagggattctcggtgctataggagggaagtgcaggagaaatgacagtggngcttggaaatgaaaacgatgctcagaatctgggccaaatggatgcagcagggataggcca

SEQ ID NO: 13558 - DNA, 121 bp, Artificial Sequence
  Synthesized
  misc_feature (61): n=a or c
gtgcttcaaaaactgcttttcgaatataaaaatgtttgcaaggtaacctctttaatcttanctgtattcagatgctcatttgcttaatacatgcatgacatatgtaatttactttaaaatg

SEQ ID NO: 13559 - DNA, 121 bp, Artificial Sequence
  Synthesized
  misc_feature (61): n=a or c
aacactgttaagtgagaacatagtaagatcttactggtcacgataagcctcagaaaaggtntgaaaacattgagttcttttagcttcagtgctgattgttccagtctccatactgtttgcc

SEQ ID NO: 13560 - DNA, 121 bp, Artificial Sequence
  Synthesized
  misc_feature (61): n=a or c
atctctgttctttgcacactggctagcataataggctcccagtttgtgacagggctcctanatcctaccttgttaccaatatcattaaatcctaggagaaatacactcccaatcccttgtt

SEQ ID NO: 13561 - DNA, 121 bp, Artificial Sequence
  Synthesized
  misc_feature (61): n=t or c
gagagaaaaggcccttcaattgagggactatttgtcctttagctgctagttagaggagaanaggaggcataaagatacatagcttccatgggataagcttttttggttccaaaacaagagg

SEQ ID NO: 13562 - DNA, 121 bp, Artificial Sequence
  Synthesized
  misc_feature (61): n=t or c
aggcaactcgttccctgggagagagatgtgtgagaggatgtaatctacgactctccaattnctccattttgagaataacaagtacttcaaatacagagttaaaataaatagcatttagaaa

SEQ ID NO: 13563 - DNA, 121 bp, Artificial Sequence
  Synthesized
  misc_feature (61): n=t or c
tttcttctttcaccctgcttttatattttgtccaatgtctggccaatgcaaagaatatatncctatgtatcacctagttagacattttcattgcataaatgcatttatctttcttgcagct

SEQ ID NO: 13564 - DNA, 121 bp, Artificial Sequence
  Synthesized
  misc_feature (61): n=a or g
gttcaaacacagttcataagtagaacagaaaagtttaaggcccctgggatggaagaaatcntcctgcagatatgaatatgggttatctttatgtatttcctgaagaaacaaacaaatgaaa

SEQ ID NO: 13565 - DNA, 121 bp, Artificial Sequence
  Synthesized
  misc_feature (61): n=a or g
caccagcatttctgtgttaagtccagatctgtcttgttttttcttgttctgtatgcttgangaactacagtgtatgtaacttacagattattcctgatttatgacagtttgccttaaaaaa

SEQ ID NO: 13566 - DNA, 121 bp, Artificial Sequence
  Synthesized
  misc_feature (61): n=a or g
gtgggtgggatgtccatgtgccccggccaggctgaccgaagggtagtgagccatgaaggcntagggcttatccaggtctggagagccatcctgcttcaaagagaagttcccactgatgctc

SEQ ID NO: 13567 - DNA, 121 bp, Artificial Sequence
  Synthesized
  misc_feature (61): n=t or c
acactgctgcgcacagcgttaggtgactgactctctgcaagccaactacttgtacctacangggacagttctgcacaggaaaacatcagtcttgtaactgtcattctcaaatgccaacata

SEQ ID NO: 13568 - DNA, 121 bp, Artificial Sequence
  Synthesized
  misc_feature (61): n=t or c
ggtgctggtctcagccacgctggcgtcagacagatccacctcgtcaaagatcagggactgngggaacaaagcagggctcagtagtgctgcaaacccaaacccagctcagcgggggctcaga

SEQ ID NO: 13569 - DNA, 121 bp, Artificial Sequence
  Synthesized
  misc_feature (61): n=a or g
taggcaggtggtggagatgtgtggaggtccagctccccttagacagcctcacacaggtatncaagtagaaaagacctcagccagtaataccatagaactacactgtctgtcatagaatcat

SEQ ID NO: 13570 - DNA, 121 bp, Artificial Sequence
  Synthesized
  misc_feature (61): n=t or c
cttaatcctgaaagcaatatagatgttcttaatctaactgtggcatgaaaaccattgcaangagctaaacacttcatctaggaactggagaactttcccatagtcttaacaggtacaggaa

SEQ ID NO: 13571 - DNA, 121 bp, Artificial Sequence
  Synthesized
  misc_feature (61): n=t or c
atgagtatgtgatttttttttttgcatagcacatgttaaatgttgctccatccacaactgntttgagactgtcaaatatattaaaaagactgatttgatgaacacgtataacttctaaaca

SEQ ID NO: 13572 - DNA, 121 bp, Artificial Sequence
  Synthesized
  misc_feature (61): n=t or c
tatacatagacacatacatatcagaaacataaatacaaaacatacaaagaggcaaatgctncattttggtacctaagcgatacagatgcccatctccttgttaattctactcactgctgtg

SEQ ID NO: 13573 - DNA, 121 bp, Artificial Sequence
  Synthesized
  misc_feature (61): n=c or g
tgcagaaacatccctgtaatgccaatttttccatctgtaatgctgattcctatcccaacangggtccaaaatgggaacaaaggcctcccagcctccatcctgcacatgaactactgtttgc

SEQ ID NO: 13574 - DNA, 121 bp, Artificial Sequence
  Synthesized
  misc_feature (61): n=a or g
gtttataacacctgttagggtgattcctaaagtgaaatcagcaaataccccacgagcacanaattgctttatttacagaccaatctcagtaccagaagacgggatggcattttccctatcg

SEQ ID NO: 13575 - DNA, 121 bp, Artificial Sequence
  Synthesized
  misc_feature (61): n=t or g
aataggctcaacatgccatggaagtgagagttcaagatgcaaacagagcactaaaaagtcntcttctgcactaagcagtgaggcagtcattctgaaaagaaactgagagctggagaccatc

SEQ ID NO: 13576 - DNA, 121 bp, Artificial Sequence
  Synthesized
  misc_feature (61): n=a or g
gagcggatacgttaggcacctgatataaatcattggtcaagcaaccagcaatgtatcaagngggagagttgcaggcctttttcttctgctctccgcaggcaggatgcttgccgttttgaca

SEQ ID NO: 13577 - DNA, 121 bp, Artificial Sequence
  Synthesized
  misc_feature (61): n=t or c
accttcaacaaagatttgactgtcaacgctgcatctgttaggtagggataatggcagaagnaataataaaatctaaaaacaaagtgcctgtaagctatgttgaaagggtaccctttgtgtt

SEQ ID NO: 13578 - DNA, 121 bp, Artificial Sequence
  Synthesized
  misc_feature (61): n=t or c
tatatatttttgtaacagtgcaactgaaagtttaaatttctcacaggaagcacccacaaanctgtttgcaatttagcttctatacatgcatggtctcagtcctgttacacagagctgaggt

SEQ ID NO: 13579 - DNA, 121 bp, Artificial Sequence
  Synthesized
  misc_feature (61): n=a or g
catttctttgaactaaacaggcaggttgcagacctacataataatgaaaaggaactgatcngttgtggcaagataggtggaagcttgcaaatgttaatacttccgtgggggaaatacacag

SEQ ID NO: 13580 - DNA, 121 bp, Artificial Sequence
  Synthesized
  misc_feature (61): n=a or t
atttctatcgttctctaattctatttctttatggaaattgagctacagttttatgcacaangattcttttaaattcctccacccacctctcccttctcttccttcttccatgctggagaaa

SEQ ID NO: 13581 - DNA, 121 bp, Artificial Sequence
  Synthesized
  misc_feature (61): n=a or g
tccaccacagagcagggggacagcctgttccaccatgggcctctccatgactgcagctgcngccccaaggtctgttggaagagagaattactttttctttaaatccatgtgttcttttctg

SEQ ID NO: 13582 - DNA, 121 bp, Artificial Sequence
  Synthesized
  misc_feature (61): n=a or g
gttgcccaccttagcatccttaatagcctttttatattgtggggccgagaactacacacanttttcaagatgagcccacagcaatattaaatacagcagtagaatcacctcttttgaccag

SEQ ID NO: 13583 - DNA, 121 bp, Artificial Sequence
  Synthesized
  misc_feature (61): n=c or g
ttcatcaaagtattagggaaaggcagctttggcaaggtaggtagatacttttttctttccntcttggtatgtagcttatttatgactgtactacttggaaaatactcatactgatattcag

SEQ ID NO: 13584 - DNA, 121 bp, Artificial Sequence
  Synthesized
  misc_feature (61): n=a or c
aaggtggaaaaaatataattaaatttcactattaaaaattaaaaagggcatatatatatanataactgtatggtttcccactatatttggactgctttttgttgttgttgttgtttgcttt

SEQ ID NO: 13585 - DNA, 121 bp, Artificial Sequence
  Synthesized
  misc_feature (61): n=t or c
taaaaaaggatgttaaggttagtatttcagtgattgtaaatgatgcattgaaacatagganttataagtaatgactgtcaaagagcaattaggcagcagaacatcaccacggtgttaatgt

SEQ ID NO: 13586 - DNA, 121 bp, Artificial Sequence
  Synthesized
  misc_feature (61): n=a or g
tttgtgtttgtgtttacctgcacgtacatgcgtgcttgtgggttcaaatgatccgctggtnctgctgggttcacactgcagcatcggcgcttattaacataagagaggcactgcgcacaga

SEQ ID NO: 13587 - DNA, 121 bp, Artificial Sequence
  Synthesized
  misc_feature (61): n=a or g
caggagaaagaagaaaacagaagatctagaggcacagctggacctaggagtagtgaaaatntccagcacccaatttaatttctgcacccactatccatgtcccacccttttataagtagtt

SEQ ID NO: 13588 - DNA, 121 bp, Artificial Sequence
  Synthesized
  misc_feature (61): n=a or t
aatggtgatttgctacagaaaaatcaatccatgacaccactcaggccatttgactgcgggntgggagagaaactccataatccaaatttgaggttggatttgatgatcttgaagatctttt

SEQ ID NO: 13589 - DNA, 121 bp, Artificial Sequence
  Synthesized
  misc_feature (61): n=t or c
aacccctgacaagaaaaatgtgtatcgacaccttggagatcatgttttgatgcagtacttngatgggaaaataaaaaggacggttgcacacacatttttcatgtgctatttcaaatacatg

SEQ ID NO: 13590 - DNA, 121 bp, Artificial Sequence
  Synthesized
  misc_feature (61): n=a or t
ggatagatgtaagattgagaaaaggtatcattctggattttgtgatgtgatgcacttatcntgggtagaaagatgaaataaacagtccacctcaaaatagttctcttttctaaaagtgaag

SEQ ID NO: 13591 - DNA, 121 bp, Artificial Sequence
  Synthesized
  misc_feature (61): n=t or c
aaaaaagatttctgccaggagttctcaatgtttctctccatgtagtaagtatgttcactgnaaatattctgctgtttttcaacccttaatttataaataaacttgtaaggttctgctataa

SEQ ID NO: 13592 - DNA, 121 bp, Artificial Sequence
  Synthesized
  misc_feature (61): n=a or g
gcaaggggttttgctctcgagctgcgtcactactcagggtggtggaaggagtacatgagangcagaaaagctgtataaaatgatggaggatgcgtgcacaggagtgagtgagaggcaagca

SEQ ID NO: 13593 - DNA, 121 bp, Artificial Sequence
  Synthesized
  misc_feature (61): n=a or g
ggatgtcctctatcaggttcccagcttctcttccagatacatacctggttcatttggtacnttctattaggtgagctgctttccttccacacagtagatagccaacttgaaactgctcata

SEQ ID NO: 13594 - DNA, 121 bp, Artificial Sequence
  Synthesized
  misc_feature (61): n=a or t
taaaggactacttacagccttctgttgttctttgaagtcagcccagagcttctctaaatcngcaggaattggattcccggataattccaaagccttaatgatatcaccagcataccgtgcc

SEQ ID NO: 13595 - DNA, 121 bp, Artificial Sequence
  Synthesized
  misc_feature (61): n=t or c
agtgccctgctggaacccggccctgcagcacccagcagcacaagcagtgatggggttcacngaggtttcccacctgcaatgactctcacggaggatttgggcacatggcagctggcagtca

SEQ ID NO: 13596 - DNA, 121 bp, Artificial Sequence
  Synthesized
  misc_feature (61): n=a or t
gcattctccagcacccaagaccccaggccactgatgttatgtagcagatacttttcatagntcagattaaggggcgatgaagtaacagagattcatgcaagcatcccactgtgctcttgaa

SEQ ID NO: 13597 - DNA, 121 bp, Artificial Sequence
  Synthesized
  misc_feature (61): n=c or g
taattgaagtcattcagaaagcttagagatttgaagtaagctttgtaacagcatgcaatgncatgccactttacgaagggataaatatactttctagatactaaaagcaagttaaaacaga

SEQ ID NO: 13598 - DNA, 121 bp, Artificial Sequence
  Synthesized
  misc_feature (61): n=a or g
ttcagcgtacgggacaaaaccccgtgccgtaaggcgctgcctccggctccttacaaccggngatgcccctttacattttaacgtccagaagttttggtggaggaaaaaaataaaatgagaa

SEQ ID NO: 13599 - DNA, 121 bp, Artificial Sequence
  Synthesized
  misc_feature (61): n=t or c
aaggactccagaggagtttcctgtagtatggaagtggatttggtataaatgggccatcacngatatgagttggtcctactttggaaaggaagtgacacgaatcttggtttgctgtgggcat

SEQ ID NO: 13600 - DNA, 121 bp, Artificial Sequence
  Synthesized
  misc_feature (61): n=a or g
tgcgtgggtcggctgttgtcgcggtgaggacggagcagcaaagctggaaggaccttttcantaataatttgcctcgtagctacctgtccagtttgcgtttcaagggcgattgctggagttt

SEQ ID NO: 13601 - DNA, 121 bp, Artificial Sequence
  Synthesized
  misc_feature (61): n=a or c
cttacatttattttgtcggttttcataagcaggtttttgggcgctgccttgagaagcgagnggctggactcattccacacccatggcatgagacagagtgctcccagcagatggatgagcg

SEQ ID NO: 13602 - DNA, 121 bp, Artificial Sequence
  Synthesized
  misc_feature (61): n=a or g
ggagccgggaggacagggaggtccccctgctgtcggcaggcaggtgactgcagactgcacncagtgttgctgtgcccccgtgaaacaaatatctccctggaaaaagttgtaacgggaaagg

SEQ ID NO: 13603 - DNA, 121 bp, Artificial Sequence
  Synthesized
  misc_feature (61): n=t or c
tgacacttcattactgataaccaaatagaatgcgttagtcaaaattacctttccaaaactntcatggatcacagtctgagcaaactgagttgaggtgatcttgagatctcttgttttaata

SEQ ID NO: 13604 - DNA, 121 bp, Artificial Sequence
  Synthesized
  misc_feature (61): n=a or t
actgtcttaagcaccttgtgatttacggagggagattttctgggcaaaatgaataatgttngcaggatcatgcagtaagtgttggagccatgagcaaaattgtgttcagtgctattcagac

SEQ ID NO: 13605 - DNA, 121 bp, Artificial Sequence
  Synthesized
  misc_feature (61): n=t or c
acagcttcaggggtgttcagaggcaaaagcgttgcgatgtttacttggctgggtgctgagncccctcttccccatgcagtccctcagtggatgtgtggggccacaggaccgtgctccctcc

SEQ ID NO: 13606 - DNA, 121 bp, Artificial Sequence
  Synthesized
  misc_feature (61): n=a or g
atcccaatctgaaacttactgtctagtaaaggttctactgtttacttcactgggtactcantttgtcctttcaaatacgaaattcctcataactaacagtaactgtatgcttcaccatgta

SEQ ID NO: 13607 - DNA, 121 bp, Artificial Sequence
  Synthesized
  misc_feature (61): n=a or g
tctgtgccactcgctatcggcccatcgtatctctgcctgctcgtctcattccaatcttcantgtatgaggtaactctctgccttcatgctctgcatcattgtcatataagaaagcacaata

SEQ ID NO: 13608 - DNA, 121 bp, Artificial Sequence
  Synthesized
  misc_feature (61): n=t or c
cttcctcccacttcctcatgagcccacaggccaacccatgctctgcttcccaggaaagtgntcaggtaacaagaatgggccaaactagggcacaggagcaggtgccttttatagcagcaca

SEQ ID NO: 13609 - DNA, 121 bp, Artificial Sequence
  Synthesized
  misc_feature (61): n=a or g
atatcagtgtggtatccagcacctcctggatgaggacagcaatgggcagccatggagaccncccctctgctcttatgtctgtgcccatgtagaatgcaaagaccggccttgtgagcacggg

SEQ ID NO: 13610 - DNA, 121 bp, Artificial Sequence
  Synthesized
  misc_feature (61): n=t or c
ccattggaggtgcctgatggagcttctcttcctgccaaccactgcgtcctacctcagcctnttcgggacccttgtcccatccaggccagccttaatctctcagaagccagtgaattcttgg

SEQ ID NO: 13611 - DNA, 121 bp, Artificial Sequence
  Synthesized
  misc_feature (61): n=t or c
tcatttaaatctaccctctactggtttgaagccattcttgattgtcctatcaatatcagantgtataaaatgtcattctgtatcctgttcataatctccctttaagtactggaaggcctca

SEQ ID NO: 13612 - DNA, 121 bp, Artificial Sequence
  Synthesized
  misc_feature (61): n=c or g
tgacagttgatgttagaaggaggtcagtatggaaataaccaccagaaaacctattgtgaangtgctcctctgtagaagaaaatgactgtttgttgtgctactgccagaagggaaatctctt

SEQ ID NO: 13613 - DNA, 121 bp, Artificial Sequence
  Synthesized
  misc_feature (61): n=a or g
tttgtccgaagggctgtgacatgtacaggatattgaagggaaagaggaaggtgggcaggcntgggccacaggttctgcttttggcttcatgcgctgaggactggggcaggtgggttacctc

SEQ ID NO: 13614 - DNA, 121 bp, Artificial Sequence
  Synthesized
  misc_feature (61): n=t or c
tttaaaactctacaagaaaaacatatgctatcatatttgggtgttaaaaatgctctgttanggaaacgagggaatgaattaagttctacatgctccttgctcagaacattcttctcgctac

SEQ ID NO: 13615 - DNA, 121 bp, Artificial Sequence
  Synthesized
  misc_feature (61): n=a or g
tgagttatattccactttttcattcctcttgctacatagatctttctcattaagctaaacnatattcctgggcacagggtgatgttgcaagatagactgaataggtctgatctctttcttc

SEQ ID NO: 13616 - DNA, 121 bp, Artificial Sequence
  Synthesized
  misc_feature (61): n=a or g
ccctgcttacttggcttcttctagcttactcttttctgcaaggtattggaagtttctatcntccagcggtacttcagtgcatgatttatactgctgcagtgtttgcagggtagattacagt

SEQ ID NO: 13617 - DNA, 121 bp, Artificial Sequence
  Synthesized
  misc_feature (61): n=t or c
cacataaatgctattacctccaataataagactctgaattagtagtaaaacacttaatccnctctcactgaacttaatgctctgaatatagtgcaaaagagtacctggacgaggctaacat

SEQ ID NO: 13618 - DNA, 121 bp, Artificial Sequence
  Synthesized
  misc_feature (61): n=a or g
ataaacaaaggacaaactcattaaccaattatttactgaaagattcaacggtaagaatgtntgaacaccaagggtcacttagatgtcatctacacttatcacttaaggagtagagcaagtt

SEQ ID NO: 13619 - DNA, 121 bp, Artificial Sequence
  Synthesized
  misc_feature (61): n=a or c
ataaagagaaagtagtctgggaaataaaaagtcatagatgcttctgaatagacatctaagncctgtattcactttgaccttgattatggaccttttgctgctgctcccacttacaatgtga

SEQ ID NO: 13620 - DNA, 121 bp, Artificial Sequence
  Synthesized
  misc_feature (61): n=a or g
tggcagtacggcaggagccttcaccagcacatggaacagcagaaagctacaagtgagacantgcaggcagaggaagcagagtgaatcaaaactgggcacttctctaccaaacaacttcgtc

SEQ ID NO: 13621 - DNA, 121 bp, Artificial Sequence
  Synthesized
  misc_feature (61): n=t or c
atggctttgccctacataggcagaaaatcccctggctggctccttggcactgctgcttccnctgggaggaatgggatccaccatcaatatcctcccagaggaaaatgatggacacacactg

SEQ ID NO: 13622 - DNA, 121 bp, Artificial Sequence
  Synthesized
  misc_feature (61): n=a or g
attagtccaaaacatgacagaatgaatacctctcttgtaggagattcactgtgggcagacngagcaaattctctttctatactgctttccaaacaccaccgtgttaccttcagagggcact

SEQ ID NO: 13623 - DNA, 121 bp, Artificial Sequence
  Synthesized
  misc_feature (61): n=t or c
ggtttgcattattgttgtcattttggtaatgccaatttcacctgcccagagaccggctcangctgaaaatgcactgtttataaggcaatttattgtttcagatagccttgtaggttaaaga

SEQ ID NO: 13624 - DNA, 121 bp, Artificial Sequence
  Synthesized
  misc_feature (61): n=a or t
aatggtgggagtctaaagacagctcaattcggtgccagagacttagtagctttacagtgcntgtgattatacgaagcatgggtcattacaaacgtttaaaaaatgccacctgtacactgac

SEQ ID NO: 13625 - DNA, 121 bp, Artificial Sequence
  Synthesized
  misc_feature (61): n=t or c
atttcccatttgtcttgtttgggtagtgcaagatgcctgttgcatgagaagcatgaaacgntacatctcaccagagtgtggcatctgcaactggatgtaaatgctgctaagtatccttctg

SEQ ID NO: 13626 - DNA, 121 bp, Artificial Sequence
  Synthesized
  misc_feature (61): n=a or g
ctgaccatgtcccttgccttgttttaccagcattatctttgctataattgaaattgctcangaaactgtcctacaagaatagagaaaatctgttttcaagataaaagcaaccttactgtag

SEQ ID NO: 13627 - DNA, 121 bp, Artificial Sequence
  Synthesized
  misc_feature (61): n=a or t
aacacaggtaagttgtggtaaggggtaaggcaagagtaggactttcctgcttggcaaaaanaggagcccttaggaagaactccatcattaggaatggcctcctctatgctttgacaatgca

SEQ ID NO: 13628 - DNA, 121 bp, Artificial Sequence
  Synthesized
  misc_feature (61): n=a or g
agagcttattgaaaaatcctctcagatctgaaggtatagaagccgtttacatcaaacaccnactcaggattgataaacaagcaaggcactttaatttttttacatattgaaactttgggcg

SEQ ID NO: 13629 - DNA, 121 bp, Artificial Sequence
  Synthesized
  misc_feature (61): n=t or c
tgcctctggctgctgtcataggggcattgccaagagagctgctgccccactgagtcgtaangtgtcatcttgaatggcagaaagtacaggggagggaagggaaaactctggcaaagcacca

SEQ ID NO: 13630 - DNA, 121 bp, Artificial Sequence
  Synthesized
  misc_feature (61): n=c or g
acagaacacgtatgtggtgtgcaaagagagcatgcaggaatgtatgcaggagaacactgantgtgctcagagtgtgcagggatatcacaaacagagcatgcagagtgactgtgcatgaaat

SEQ ID NO: 13631 - DNA, 121 bp, Artificial Sequence
  Synthesized
  misc_feature (61): n=t or c
ataagcaggaaacaaagctctggacagaaactgtattctgctgcaaatgttcttactttgnaaacagggatcaagggaaatctggaaggaaggagcaagacttccctcattaaaaaaacaa

SEQ ID NO: 13632 - DNA, 121 bp, Artificial Sequence
  Synthesized
  misc_feature (61): n=t or c
accgctgagtttgatattatgatctttagaggcagaaaatgtagctattaccctattcctngttttccccaaatatcaaggatttggagttgcaggcatgggtcctggattgcttaattct

SEQ ID NO: 13633 - DNA, 121 bp, Artificial Sequence
  Synthesized
  misc_feature (61): n=a or g
tctgtagacttcacacttctacaattctttaaagcaggaaatcccagtaagctgcagaagngtatattgggctggagagtggtaaggtgttggaacaggctgcccagaatggtttgtggat

SEQ ID NO: 13634 - DNA, 121 bp, Artificial Sequence
  Synthesized
  misc_feature (61): n=a or g
agtctagactctaaccgtacttccagtgtatatacaatatatgtgtttatagacactggcntagggtactatacatcaaattgaaataagcagtattagttcacatatttttatagtgatg

SEQ ID NO: 13635 - DNA, 121 bp, Artificial Sequence
  Synthesized
  misc_feature (61): n=t or g
aggatataattgactctctgggctgcaagaccattttcacagctcatattcaggttttttntctagcagtaccctccaaatctttctctgcaggagaagaagcagttctgaagatgacaga

SEQ ID NO: 13636 - DNA, 121 bp, Artificial Sequence
  Synthesized
  misc_feature (61): n=a or g
ctcagcagtaactccacggtgacagcctccactcgcagctccgtggccacgacatcaggtntgcttcccctgatgctgaacggagggaggctccaagaaacggtttctgctgttgggcttc

SEQ ID NO: 13637 - DNA, 121 bp, Artificial Sequence
  Synthesized
  misc_feature (61): n=a or t
aaaattgtttgtttcagaaactgaacatttttttaatgtcactggaaacagattttgcaangcaattttgtatgtaatgtgacagcactgttaggttagcatctggcttgctcacaaccac

SEQ ID NO: 13638 - DNA, 121 bp, Artificial Sequence
  Synthesized
  misc_feature (61): n=t or c
agaaagagagccagagtacagtgctccccatacaggcatgcaacttcagtttttatggaanggagtctgcttactgaagaaaagcattctgaaggtttaacagtcattttcatatgttttt

SEQ ID NO: 13639 - DNA, 121 bp, Artificial Sequence
  Synthesized
  misc_feature (61): n=t or c
gtctcactgtaatagcaacagttttctagtcatttaagttaaagtttacaggattggccanttgtaccacctaagttaatgctgtagtctcagttctagtcttttctgcatgctgagcacc

SEQ ID NO: 13640 - DNA, 121 bp, Artificial Sequence
  Synthesized
  misc_feature (61): n=t or g
tgtgcataatgctccaagctggtttcctcatccctgcaatcagggtgaagtacagtctttngctgcaaattaaggtttcaaaccacttatctgctcttcctctcagcttttcattttcaag

SEQ ID NO: 13641 - DNA, 121 bp, Artificial Sequence
  Synthesized
  misc_feature (61): n=a or g
aagaaaaatatgtgtctttatgaggaaaatgtcagccttgttttgcttgtctgacctagcngcctttacctacctgctgagctgaggaaaggaatggacacgtacaactctcactggggca

SEQ ID NO: 13642 - DNA, 121 bp, Artificial Sequence
  Synthesized
  misc_feature (61): n=t or c
aaaaggagagctaagccaggataactcagtcagtcgaagggagcgaggcccgcaaaatgangctctgaagctcgtttttgtcacagaggaacactatttaagcaacagtttctttcagaaa

SEQ ID NO: 13643 - DNA, 121 bp, Artificial Sequence
  Synthesized
  misc_feature (61): n=t or g
tcaggtacagcagtgtttattagctaggcatttgttaacaacctttgcaggcataaatcgncacagatacttagaattaatgaagttgctctaacctgtacctgcagtgctttcaatgagg

SEQ ID NO: 13644 - DNA, 121 bp, Artificial Sequence
  Synthesized
  misc_feature (61): n=a or g
gcctctattgcgtgcagcccttccttccctggggatgcccagtagtgctctcttctcttcncagccagtggatttaccaaaatgtaggaccagagtatcttttgacatctctaccactctt

SEQ ID NO: 13645 - DNA, 121 bp, Artificial Sequence
  Synthesized
  misc_feature (61): n=a or g
catcttcctgtggaaatatactcaaatgtttgcaaagatgatcaagaaataagtttacacntgtaacagactccaccagtgaaacgctagatgtgcagaaaccaacaccagtgcaaaggac

SEQ ID NO: 13646 - DNA, 121 bp, Artificial Sequence
  Synthesized
  misc_feature (61): n=c or g
tgtcatgagctaaactgcacttgttaaggcaagttaattttcctcgatggtggaatattanaatgttgatttattatgacctcgatttattagcatatactgtttttcagggtagtgaaag

SEQ ID NO: 13647 - DNA, 121 bp, Artificial Sequence
  Synthesized
  misc_feature (61): n=t or c
ctgtttgatttcagatacatgccttcaaggatcgaggcacctaccagtcaaatagaacttnagtgaaataactaagctgtgctgaacttaagaaaataggagagacatactgctttgggag

SEQ ID NO: 13648 - DNA, 121 bp, Artificial Sequence
  Synthesized
  misc_feature (61): n=t or g
gtaaagaaacagataaaaacctgtctctgcgatgccttctggacccaaatgttttctgatntataacttaagaaggaactaagcaggttggcctattgtttgaaaacaagagagaaaaaga

SEQ ID NO: 13649 - DNA, 121 bp, Artificial Sequence
  Synthesized
  misc_feature (61): n=a or g
atgtatatatgctacctaagggtgcactggggaagaaaagactgtagtaacctagaggctnttagagatctacctgctaactggagaaaaagcagggcggtggagagcattcccaaggagt

SEQ ID NO: 13650 - DNA, 121 bp, Artificial Sequence
  Synthesized
  misc_feature (61): n=a or g
actcaatggctgagggcaaacaatgtgcaacatccatagcaagagataaggaaagaccagncagatcattcttgacacttaagttgatgcatttcaactgagcgtaatatttcaaagtaac

SEQ ID NO: 13651 - DNA, 121 bp, Artificial Sequence
  Synthesized
  misc_feature (61): n=t or c
ggctacataccttcagaaggacattttccactctgtgatccacccaaagcagaccctcatngtggtttagtgagcatggcagtgatgggtttttagtgattctgtgaacacaggctcttac

SEQ ID NO: 13652 - DNA, 121 bp, Artificial Sequence
  Synthesized
  misc_feature (61): n=a or g
taaagctgggtaaataaatcaaccatggttaacgttacagattgctcaacagtttgggaanaagcagtcatatctgcataactgtctcaaaacatctaaacctaagtagatctaacaagcc

SEQ ID NO: 13653 - DNA, 121 bp, Artificial Sequence
  Synthesized
  misc_feature (61): n=t or g
caatctccttcatacttgtggctctcaatgcccattcaatcatttataaccacatttcatngagcagtggagtttctctgagacactagatttctgtaagatttctgaaaagagttggatt

SEQ ID NO: 13654 - DNA, 121 bp, Artificial Sequence
  Synthesized
  misc_feature (61): n=a or c
aacatgggaaaaggaaggcagaaacaggcttgacaccaggggctatgttagaattagtccnagtcccagtgtgctcccattgtggtgtgggagggagctgggatggctgtccccaggcaag

SEQ ID NO: 13655 - DNA, 121 bp, Artificial Sequence
  Synthesized
  misc_feature (61): n=a or c
ctgtcaattttgtcctgtcttcaagcaacaaaattgtttaaaagaatagtgtgcctgactnttcttgatttcatttctgggtatttatgtatatatacattcttttctgagtctgattgta

SEQ ID NO: 13656 - DNA, 121 bp, Artificial Sequence
  Synthesized
  misc_feature (61): n=t or g
ttaagagattaggtgagcactgaggaaatacatgaggttctgtcgataaaatgaaattaantgggaaggttgcaaaggaccttagttgcggtggttggttactgacctccgctgacatcag

SEQ ID NO: 13657 - DNA, 121 bp, Artificial Sequence
  Synthesized
  misc_feature (61): n=a or g
ttgtagtaggagcagtatgaggtatagaaagcttcctgcaagattacttcagaccacatgnggcctgtttcctattctgccgtgagtagaaatttgctgtttaaagaagttacatgaagtt

SEQ ID NO: 13658 - DNA, 121 bp, Artificial Sequence
  Synthesized
  misc_feature (61): n=t or c
gttcccctgcacagcctaccagttcttcaaagcttttgttaccaggactatttcttcttantccctgtaagcccaattccttgaatgccaacagttggaactggtggagagaaggctcaag

SEQ ID NO: 13659 - DNA, 121 bp, Artificial Sequence
  Synthesized
  misc_feature (61): n=a or g
cctgtatgagtatgcaaaggaaaggaattcagtttctagcatatggtttttttaagtctanctctacatggtagaaggatttgaaaatatttagcttctattacaccagctcaccagttgc

SEQ ID NO: 13660 - DNA, 121 bp, Artificial Sequence
  Synthesized
  misc_feature (61): n=a or c
agaaaataaaagaaaaaaatattggtttccttagttgcctacaacttgctctttcagtgcnttctgttaagatgtatgaatagtcaaagtcattgattattctccacgtaataatgtctgt

SEQ ID NO: 13661 - DNA, 121 bp, Artificial Sequence
  Synthesized
  misc_feature (61): n=a or g
cttgttttctgttgtttagtagtgacggtcatgtagttgttatcgacctgcacctgaaacntagcgacaactttgctttctctcagaaagtatatatccatgcctggaattatctccccta

SEQ ID NO: 13662 - DNA, 121 bp, Artificial Sequence
  Synthesized
  misc_feature (61): n=c or g
ctgcatgagtttaagagaagatctcatttaaagcaaacaaaaataatctttagaagagctntgcataatcagtggttacttggctgaagttttcatgagatttttttttccccctggttca

SEQ ID NO: 13663 - DNA, 121 bp, Artificial Sequence
  Synthesized
  misc_feature (61): n=t or g
gtgattaagcaatgttaagccaaatcatcagtggacgaaagcccaccttcattataattanactacgagatatgccagtttatagagctgagaactgggacctagctgttctgttctgtag

SEQ ID NO: 13664 - DNA, 121 bp, Artificial Sequence
  Synthesized
  misc_feature (61): n=t or c
attaaggattcttatgtcctatatgtcctagctgctttctaattgctccatcaagctaacntaagtaacagaaacaggcacagaaacagcataagtgctcaggacagcagcactcatcaat

SEQ ID NO: 13665 - DNA, 121 bp, Artificial Sequence
  Synthesized
  misc_feature (61): n=t or c
tagtagctgaaacagaagaatgaaaacagcagacctgaggccataatccagccacttgctngcaacatggaattgggagtgtttttgtggtctcagccggggacccaaccagggagctgcc

SEQ ID NO: 13666 - DNA, 121 bp, Artificial Sequence
  Synthesized
  misc_feature (61): n=t or c
tccagaaatcccatcagagaatgctctagtgcttttttttgtgattagattcaaatagganctgaaaagtctattcttgtaatttgccccatgtccaaaagttttttaaacacattcaggg

SEQ ID NO: 13667 - DNA, 121 bp, Artificial Sequence
  Synthesized
  misc_feature (61): n=t or g
ttagaggtgtgatagatttaaaataagaagtcttgttgaaatgtctactgaaataaaatgntttttctgtgatcaaaagtgctatctcttgcaactaaatacttgaactctaacataatgt

SEQ ID NO: 13668 - DNA, 121 bp, Artificial Sequence
  Synthesized
  misc_feature (61): n=t or g
taactaaaacatttcctaattcatcatgaacttgctgaggtgcagggcttgtctgttctangttaagttagaaagaaaaacaaccatgcaaaaattagttatgcaacaccagtattacaac

SEQ ID NO: 13669 - DNA, 121 bp, Artificial Sequence
  Synthesized
  misc_feature (61): n=a or c
gcacaagggagcttgtctggtaccagctcttcaaggcaatacagtgataatggggagctgnacaaagaaaatgaattgtgcttgaccatcatggctggataggtgacagcagagtgggcca

SEQ ID NO: 13670 - DNA, 121 bp, Artificial Sequence
  Synthesized
  misc_feature (61): n=a or g
cacagtgcccatagcttcagtcacagagcccatcactctctgcgtgagctgagcagtgtangggatgtaaccagagactttctgatcacttggacccattggcagaccccctttgcagaca

SEQ ID NO: 13671 - DNA, 121 bp, Artificial Sequence
  Synthesized
  misc_feature (61): n=t or c
gaaaacaaacagttattattttttcctgtgaatactgaagacgtgcagcacagcacagaantagatttacagagtcatttgttaccaatatcatcatacttttgtcacagttaaaatgggt

SEQ ID NO: 13672 - DNA, 121 bp, Artificial Sequence
  Synthesized
  misc_feature (61): n=a or g
atctagaagctctctgatggcatttctcaggctgcaggggagggcactgcgttgcactgtnccatgctcattcctcgctgcgctgagctgcagcccgtgctgggatatcaccgtgcaatcg

SEQ ID NO: 13673 - DNA, 121 bp, Artificial Sequence
  Synthesized
  misc_feature (61): n=t or g
gagacgttgagaactatttcctaggacaaaaaagttctctctccataaccatttacccctncaatgctctttcagtctgtctctgttgctagccaagccctctcacaacactgaaaagcca

SEQ ID NO: 13674 - DNA, 121 bp, Artificial Sequence
  Synthesized
  misc_feature (61): n=t or c
aacagtgacctgactataaggagaagatacagccataaaatggctgctatcaactgtcagntgaaaatctcgttagattgagaactctgccttggaaccaggcctggaaacttcatctttg

SEQ ID NO: 13675 - DNA, 121 bp, Artificial Sequence
  Synthesized
  misc_feature (61): n=t or c
gagtaaagagtacatttttctgaagcatcctggtgatgcagggaatcaaaacaaacagcangttacaatgctcaagggataagctgaatttctccaaaggccattttagatccagcccagt

SEQ ID NO: 13676 - DNA, 121 bp, Artificial Sequence
  Synthesized
  misc_feature (61): n=a or t
acagaaaaaatgaagagggtcagggttagatgcagttatcttttgttacccaccatgctantctttgttttctggataatgccaaggaaatgaatagactcacccatctgatgctgcaagg

SEQ ID NO: 13677 - DNA, 121 bp, Artificial Sequence
  Synthesized
  misc_feature (61): n=a or g
agtttacaagatcaaacatttaaataggaatgcagtcctcatgccagtgatgaacactttnagctctttcacacacctgaatgaagcttgctttcatcttctctactggcactccgagtta

SEQ ID NO: 13678 - DNA, 121 bp, Artificial Sequence
  Synthesized
  misc_feature (61): n=t or c
taccatagctcgggtatgcagctgcaagcagggcttgttctgttgctggtctctattggcncttcatggtgcatacggtgcaactcagcccacagccgaaaagctgcacagctgggacctg

SEQ ID NO: 13679 - DNA, 121 bp, Artificial Sequence
  Synthesized
  misc_feature (61): n=c or g
tcttgagatgaagttgtctttggtttgtagcttctttactccttgtagagcatctttgagntcccctgagcatcttggttccctctcagcccagaggcacctgggagggtgcaggccttga

SEQ ID NO: 13680 - DNA, 121 bp, Artificial Sequence
  Synthesized
  misc_feature (61): n=a or g
aggcaccttatttacagcaatttaaaaacacagccgtagcattgagcacagccttcagacngcttgcagttttaccccagggctctcctagtttccccacgtgggcctgttagcacagagg

SEQ ID NO: 13681 - DNA, 121 bp, Artificial Sequence
  Synthesized
  misc_feature (61): n=a or c
tgctgtgccagtgtctggtttaggctgctccattgaagtgcccagcgtgtgccctctgctncccaaagcatggcattgtttggatttcttgacgatgatgatttttttcactgtctaggtc

SEQ ID NO: 13682 - DNA, 121 bp, Artificial Sequence
  Synthesized
  misc_feature (61): n=a or g
gcacaggcaagccaaggtagaaggctgtcaactgctgaagttttaatgcagccaaaaaaancatacaataaatgtatgtagtacttggcttgtcagtgtttgtatggcaactcagacaaca

SEQ ID NO: 13683 - DNA, 121 bp, Artificial Sequence
  Synthesized
  misc_feature (61): n=t or c
ggatattgatagtgctatcccctgcttgcagttaacattttggtcaagattgatgtaggangttacgtacactcaccttctgaacataatctatcaggagcattctttgctgagtgcaata

SEQ ID NO: 13684 - DNA, 121 bp, Artificial Sequence
  Synthesized
  misc_feature (61): n=t or g
agctggcctgaagaactggtccaggttaaaactaaccattgcattttccccacctctggantagttttaactttgctcagttccctgctccagatcttggtttggcaacacaaaaattagg

SEQ ID NO: 13685 - DNA, 121 bp, Artificial Sequence
  Synthesized
  misc_feature (61): n=c or g
tctatatacagggccccaaaatggctatttagttcagctatactggaaaatacagccttancacagcgtatgttctaatgctaagcatatttctgtaggagagtatgacaaaacagctgtg

SEQ ID NO: 13686 - DNA, 121 bp, Artificial Sequence
  Synthesized
  misc_feature (61): n=a or g
gctgcagggattgatgtattgtgaatggtctcattcccatactgctgctgggtgcatgacntgaaacacgtgttggcaggatgggtcctcagtgctctacccagtctgtgaggtgtcactg

SEQ ID NO: 13687 - DNA, 121 bp, Artificial Sequence
  Synthesized
  misc_feature (61): n=a or g
gacctctgcgatcccagccggcgagaaagctgcgtttgcctctgttgaaacagccggcttnatgaaataggggtgcacggaggaaagcatccccgtgcccagcgcccatcccggcctgccc

SEQ ID NO: 13688 - DNA, 121 bp, Artificial Sequence
  Synthesized
  misc_feature (61): n=a or g
ccattcagagcagaaaataagacaccagatgtgactgcaccctggtgacaggttacctccntgctccttagcggtgtctttgcaaacacagccatgctgctaaggccaacccctctctagg

SEQ ID NO: 13689 - DNA, 121 bp, Artificial Sequence
  Synthesized
  misc_feature (61): n=a or g
tgtatgatgtgagagggtctgctctggtaaattagcgcaaacatgcagccaaagctcagcnatacctgcctcgccggaacgctacctctatttaccacaagcgcgatgcatctgcatgcag

SEQ ID NO: 13690 - DNA, 121 bp, Artificial Sequence
  Synthesized
  misc_feature (61): n=a or g
tgtgtttgtgttttgactgctgggtatcatcaatcctctgtttaaaccatggatggccagnagtcagtagtttgatgatatgagaagatgaattacttcttgggtgctccatgagcactag

SEQ ID NO: 13691 - DNA, 121 bp, Artificial Sequence
  Synthesized
  misc_feature (61): n=a or g
tggatttattccccctcatccatgccttaccttcgggtaagggcctgaacagagccctttncttcctgcttctttctcccatagctccctctcctttgggtctcctggactcagtgccacg

SEQ ID NO: 13692 - DNA, 121 bp, Artificial Sequence
  Synthesized
  misc_feature (61): n=t or g
gtctgctgaaggcaggagatgttttaattgtgtgcttaacacacccagctttgaagtattnctttccttctgaattgcctcctgcatgcaacgtctgccacctgctacatccttgttcatg

SEQ ID NO: 13693 - DNA, 121 bp, Artificial Sequence
  Synthesized
  misc_feature (61): n=a or g
cacccctgctctgtgcaccccatgccctgccagcacccgaggtgctgctttcaggcgtggngatgccacttcagacccaaacacgagcttttattctgtttcagaagtgattcatttaatt

SEQ ID NO: 13694 - DNA, 121 bp, Artificial Sequence
  Synthesized
  misc_feature (61): n=c or g
gctacgccaaggacatccccaggctgcaccccaggtcccccaaggaactgttggtgtgagnagatgacatggtatgagatggtcagtgccaccaactgaacccatcaccaacaccaaagct

SEQ ID NO: 13695 - DNA, 121 bp, Artificial Sequence
  Synthesized
  misc_feature (61): n=a or g
cctggctgacagcaaagggcagcctgatggagctggctcagtgctggagtactccactcantcacactgaccaagagctttcagaggggcacctgatgcatgaggccacatggagcagcac

SEQ ID NO: 13696 - DNA, 121 bp, Artificial Sequence
  Synthesized
  misc_feature (61): n=a or g
cacatcagtgcaacaagtaagaactgcatttcctacttttgttttactttgaagaaaatgnaggcactataacagagcacacttacctaaatctctaagggcaaaaggtttagatttttcg

SEQ ID NO: 13697 - DNA, 121 bp, Artificial Sequence
  Synthesized
  misc_feature (61): n=a or g
ggcaaacaaatgccatagtttttctccttttcactctatgttgagctataaagtatagctntggctttctgtaaagttcagggctattctcatctactaattagattcagacagtgtttta

SEQ ID NO: 13698 - DNA, 121 bp, Artificial Sequence
  Synthesized
  misc_feature (61): n=a or g
aaaccctgagctgtcactgagctgtgccgctcgagcaaacagagacttttgcaattgcccnttcgtgtgcgagtggcgcattggtgtgctgtatttttgcatgcagtggcggagagagcac

SEQ ID NO: 13699 - DNA, 121 bp, Artificial Sequence
  Synthesized
  misc_feature (61): n=t or c
gcaattctaaaaagtgaaaaaaatataaaagatgcttcgctttctgagggtttcaagcaangttttatgtctttgtcacaggattctaaagatgttacaaaacacacaatttaggaatcca

SEQ ID NO: 13700 - DNA, 121 bp, Artificial Sequence
  Synthesized
  misc_feature (61): n=a or g
aacaccaagattaaatataggtctctgattaagcatgtgaggccgttaaagcttaaatacnctgtcaatgaaatgtcttgttagaataacgggatggtcttccgaagtctgaatagtaata

SEQ ID NO: 13701 - DNA, 121 bp, Artificial Sequence
  Synthesized
  misc_feature (61): n=a or g
taaaaaaaaaaaaaaaagcttcctagcggtgaaaacctactgagtttcacctacccaaccngcaggtattgacttaatctaagagaggaactgaatatcagtatacatgcagcactttctg

SEQ ID NO: 13702 - DNA, 121 bp, Artificial Sequence
  Synthesized
  misc_feature (61): n=t or g
ctggagacttccagtggaaaagggttgggctgaagggggggctgctgagttagaagcgttnaaacacttcttcagaaaggtgaagaaagttgctcaagacgggagagcaggtcagcagagc

SEQ ID NO: 13703 - DNA, 121 bp, Artificial Sequence
  Synthesized
  misc_feature (61): n=t or c
accccaggccagcagcatgctagataaagagagtcactgtgctgctgtgctaccactctgngtgcagttggctgctgatgtaagcagaggcctgttgcatcacctttcccaaatttctttg

SEQ ID NO: 13704 - DNA, 121 bp, Artificial Sequence
  Synthesized
  misc_feature (61): n=t or g
aacatacagcagagcaaatcattattaagagctctcagaacagaggctggctattcggacngcagtaggtcaaatgaagtgtttccacaggaataaatggcgaaaagaaagctgttagcaa

SEQ ID NO: 13705 - DNA, 121 bp, Artificial Sequence
  Synthesized
  misc_feature (61): n=t or g
cgcgtttaaagatcttccaccgtgtactttaatacatgtttctaacaaaccagagaccaancatggtttttagagggagtctgctaaccagagtgcgtatgactgtgagagatgtatttac

SEQ ID NO: 13706 - DNA, 121 bp, Artificial Sequence
  Synthesized
  misc_feature (61): n=t or c
acactttgcatgcgtgcagggattgctggctcctgcacgaggctttatcagcatcaattangttttgtgcctgctttcaggaggcagaaactccagtttcccaagcagaaggcagggctga

SEQ ID NO: 13707 - DNA, 121 bp, Artificial Sequence
  Synthesized
  misc_feature (61): n=t or g
gtggcacctattgcaagaatatctccaaaaaagagatgttataactaagaatcagctgtgntgttttaaatatataccaagatccatgaaactacttccctattcaacagttgaatttagc

SEQ ID NO: 13708 - DNA, 121 bp, Artificial Sequence
  Synthesized
  misc_feature (61): n=a or g
caggagggaaggaaagtctcatccactgcattcagaagagctgataaaccagtacaatccnaccaggggcaaagagattctccccaagactaaacaaagaggaagaaatccagcgttactc

SEQ ID NO: 13709 - DNA, 121 bp, Artificial Sequence
  Synthesized
  misc_feature (61): n=t or c
aagacaagaaaaggccatggaacatcgaagtgtttcccatcttgacatcaacataaatctnctcagttgagattgccagaaacatggtaagcatgtttccatcaactcaaccttattgttg

SEQ ID NO: 13710 - DNA, 121 bp, Artificial Sequence
  Synthesized
  misc_feature (61): n=a or g
caagctttttagaatagcgctcctttatatttcagtgatagcagttatgggatttacaccnttatctggatggagtcctcaatgacacagaaccacttgtacacggccagaggatgcaggc

SEQ ID NO: 13711 - DNA, 121 bp, Artificial Sequence
  Synthesized
  misc_feature (61): n=a or g
ctgcatctttgtactattgcttagttgagttgtctactaacaggtttggcttttaccaganagggtgtgttcctttttctttctattactgtttactaatggcaaagacactgagggaaaa

SEQ ID NO: 13712 - DNA, 121 bp, Artificial Sequence
  Synthesized
  misc_feature (61): n=a or g
caacagcatctactctccatgaaagagcagtgtgcacgtttgtcattttgcagaaagcaanatgactgccagggctctgggctgccctgccaccacccctgctcacccagctgaaggcaca

SEQ ID NO: 13713 - DNA, 121 bp, Artificial Sequence
  Synthesized
  misc_feature (61): n=a or g
gataggggacagagatggccttcagagatggggttttgatcaggagcctttggttcaaagngaccactggggctgctcaggccttggcacacctggaggaatctggggacggggtccgggg

SEQ ID NO: 13714 - DNA, 121 bp, Artificial Sequence
  Synthesized
  misc_feature (61): n=a or g
gatacacacagagctctaagcacacaaacatgtctatgtggcacacatgcgtgtccacacntacacatgaatacacaaacttacaatattaacgcttcaggaactaaaagaggaaatttag

SEQ ID NO: 13715 - DNA, 121 bp, Artificial Sequence
  Synthesized
  misc_feature (61): n=t or c
attttattttgtgctgagtttgcatccccagttcaatccttttctgcttgaaagttcacanccgaaattggcttgctctgtccatcatcttgcactgtgcacttcttggcgatgctaagta

SEQ ID NO: 13716 - DNA, 121 bp, Artificial Sequence
  Synthesized
  misc_feature (61): n=a or t
catatacaccttttaatgcaaactttcaagaagttaatattataaactttttttgtcattnaacacagtgaagacatagtccttaccagcatgaaagagtcttttgccataaaataaacaa

SEQ ID NO: 13717 - DNA, 121 bp, Artificial Sequence
  Synthesized
  misc_feature (61): n=t or c
aagctgaaaagaacagaatatgagcgtcagctggattcactcaaaagtcaaatagatctcncaatgcaaggaagagtcttcatctttgtaaattccactgactgcgcgtatcctgtgaagc

SEQ ID NO: 13718 - DNA, 121 bp, Artificial Sequence
  Synthesized
  misc_feature (61): n=t or c
gctgcaatgcatttacagaatatttttgtccaattgctttggggacaattattttgcaaangagcctgcagttctgcattgcatcccatcccatgaaaggcacccttaaagagactgtctc

SEQ ID NO: 13719 - DNA, 121 bp, Artificial Sequence
  Synthesized
  misc_feature (61): n=a or g
tttgttcagatattttgcaaatgaagatatttcaaatggactttgttttgactgattctantgtcctcagtccaaacataaccagcaagtgtcatattattctcaccaatagaggcactta

SEQ ID NO: 13720 - DNA, 121 bp, Artificial Sequence
  Synthesized
  misc_feature (61): n=a or t
agactctgatcattgatctaaagtgcctgaactacacagttacctaccagagtgtcaaggnaaaatccttatgatctgctgagatgataccttcctagattcagttgatcttgaaggtacc

SEQ ID NO: 13721 - DNA, 121 bp, Artificial Sequence
  Synthesized
  misc_feature (61): n=t or c
gctatctattgccatgtgctcctggccaaacgctttgtgatgtgaaaatctagcatataanttagaaatcagaaccacactttacttatataaaatgacatgaagttctcagctagaaaca

SEQ ID NO: 13722 - DNA, 121 bp, Artificial Sequence
  Synthesized
  misc_feature (61): n=a or t
tgatatgatgaaatgaagagttttatccggtactggtcagcacaacttatggttgcaattnaactacttgggcctggtttcagcatgcaattccttgatggattaagataacaacgtgaca

SEQ ID NO: 13723 - DNA, 121 bp, Artificial Sequence
  Synthesized
  misc_feature (61): n=t or c
agtttatcctgtggaataggaaggaatggccccagacgtaattacaagtaagtagtgcacngagaggggaaaagctcaggaaatgtgatgtctaagacctttttttcccctctggtgttta

SEQ ID NO: 13724 - DNA, 121 bp, Artificial Sequence
  Synthesized
  misc_feature (61): n=a or g
atttacttgtgataacagtcttaggaagaagttacaatttgcaaactatttgaaatgccgncttgtattttgagattactgcttgaaacctgctttatgattttgccccaagatctcagtt

SEQ ID NO: 13725 - DNA, 121 bp, Artificial Sequence
  Synthesized
  misc_feature (61): n=a or g
ggtgcatcagagacaacaacagttcaaacttgcataaattttaaccagctctcatgtcttntaaagaatcaggttcctccatgtctgatgggcatttttctaagaagtgccttcccctcgc

SEQ ID NO: 13726 - DNA, 121 bp, Artificial Sequence
  Synthesized
  misc_feature (61): n=a or t
cccgaacctagtgaaccatcagaaaaagagaaaagggacatctgtgaaaggagggatgagnttgaaacccaagataaactgaaagaggaggagaaagaagacctatttgaatggggaaaaa

SEQ ID NO: 13727 - DNA, 121 bp, Artificial Sequence
  Synthesized
  misc_feature (61): n=t or c
atggagcagggatgctactggatttccttttttgccatgggcaagagatactcattgatantaatagcttccccccttgactaaaatcagtctcaaacccagtattcctgtctcacagcag

SEQ ID NO: 13728 - DNA, 121 bp, Artificial Sequence
  Synthesized
  misc_feature (61): n=a or c
tctaaaccttccctatgctctctctcttctagattaagactcattttcaagacagttcctntacaaatgccaaagatccccacatgtactttattagagtaaagtttaggagtgttcctga

SEQ ID NO: 13729 - DNA, 121 bp, Artificial Sequence
  Synthesized
  misc_feature (61): n=c or g
agcagttatgaaatctttacctctgttgtgttgaagaattacaaatacatattgatttttnttattcctgtttccctactgatttagatcacaaaagaggaaaaaaaaaaaaaaaagcaaa

SEQ ID NO: 13730 - DNA, 121 bp, Artificial Sequence
  Synthesized
  misc_feature (61): n=t or c
tcggccaaggcggtccccaccttctgtcctgtcattggatatgtactcgggcaaaaccatngagccacctcctgtccccgtggccttggtggaaagtgctatgagtaaagagctattgagt

SEQ ID NO: 13731 - DNA, 121 bp, Artificial Sequence
  Synthesized
  misc_feature (61): n=a or g
tgcaaggaacactattggagatttaaagagaacaacccttactttacaaatgagtaatganccactgctgaccatcaggagtatcttcaacaacattttcatactagtagactctttgttt

SEQ ID NO: 13732 - DNA, 121 bp, Artificial Sequence
  Synthesized
  misc_feature (61): n=a or g
catactgctcagttcccagtctgtccaatagtaacaatattatcagaatttcattacatcnggagattctttgtcaaaacaagtaaacaatcaatgttaaaaaagaaacaatcttcccccg

SEQ ID NO: 13733 - DNA, 121 bp, Artificial Sequence
  Synthesized
  misc_feature (61): n=t or c
catgtgcataattcctatagtctcacaaagccagtggttaattttattcttaaaatagcanccctttccaaaggaattggttgctttaagctgaccttgaaacaaagacagtcacagaatc

SEQ ID NO: 13734 - DNA, 121 bp, Artificial Sequence
  Synthesized
  misc_feature (61): n=a or c
tgttagtgctaacaggcttgaatgagtgaggagattctcttcacaattactatcagcatcntcaaggggaaaaatcttaacatctgagcactggtttctaaggctaggctggagatgactg

SEQ ID NO: 13735 - DNA, 121 bp, Artificial Sequence
  Synthesized
  misc_feature (61): n=t or g
tcagtttttcattcaccaagtccttacacagaaaaagttagtgttatcatacaaataaaangatagtcttagttctctctagggacaggtggtctaccaccatctaaaatctgcctgtgcc

SEQ ID NO: 13736 - DNA, 121 bp, Artificial Sequence
  Synthesized
  misc_feature (61): n=t or c
ctgctggtttctctgaaaacatgaggctctctgaatggagagggatgtgtcacaaagacangttgagaaggttacagctacagtaggaggaggaagctctactgactgtgctggagactta

SEQ ID NO: 13737 - DNA, 121 bp, Artificial Sequence
  Synthesized
  misc_feature (61): n=a or g
aaaatggatcattacttgacagagcagactgtgctccttagttacttaatgtgtgcgggtntaacctgcgagccatgacttgagagctttccccacagttaaaagttttctgcagtaaaat

SEQ ID NO: 13738 - DNA, 121 bp, Artificial Sequence
  Synthesized
  misc_feature (61): n=t or g
aacataaatgctagcagtcctagtcagaagtcttttttcatgctttcacatgcagcttttngcattttaaagctaaagagtgagaaaaactgccacgaggaagagatgaccaagagtgcct

SEQ ID NO: 13739 - DNA, 121 bp, Artificial Sequence
  Synthesized
  misc_feature (61): n=t or g
tttgaggaaggaatggaatcaatgttttcaaaaggcaatagcttactaattggctatggcntatgtagcagtattggatatagatacactggcactgcatctatccctctctcactgactc

SEQ ID NO: 13740 - DNA, 121 bp, Artificial Sequence
  Synthesized
  misc_feature (61): n=t or c
cattaactgcgggtgtgtgcacagagtgcgtggctgcagctcagtgtgtatgtgacacagntgtgcaagcagtgcacgcggtgtctccgtgacgtgtgcccattcgtgtggaagtgctgta

SEQ ID NO: 13741 - DNA, 121 bp, Artificial Sequence
  Synthesized
  misc_feature (61): n=c or g
acaccttgataagagattgagagaggcaaaaaagaaacaacacaaggtactgcctggtggngaggacttggtcaggcagcagcagaagtggctgggcaaggaaggaatgacagctagatgg

SEQ ID NO: 13742 - DNA, 121 bp, Artificial Sequence
  Synthesized
  misc_feature (61): n=a or c
ctgcagcagtgtgctgctccaaaacagccacatcaggcaccaggctgatctgccattgggnaggcagaaatatccttgagatgggtttcaggccttggagatgtgaggagcagctatttca

SEQ ID NO: 13743 - DNA, 121 bp, Artificial Sequence
  Synthesized
  misc_feature (61): n=a or g
atggagaaagaattttgaagcagggaacagtgaaaacccactcagccctgtgaatcctgcncaggccttatttgcccccttcccatttttgatgctatgttgacagctttttggaatctat

SEQ ID NO: 13744 - DNA, 121 bp, Artificial Sequence
  Synthesized
  misc_feature (61): n=a or g
ttgagctgcctgtatggaagctcaggagcccagcagcattttgtgcagctgtgggctgacngtggttggttctgctggctgcaggagggcagaagttgccctctgtttcaaggggtgccag

SEQ ID NO: 13745 - DNA, 121 bp, Artificial Sequence
  Synthesized
  misc_feature (61): n=a or g
attttggtaagttgctacagggttgaggaagaggaaggggaacagcgtctattgtagtgtntgcagttacattgagcccattggagaaacaactgagtttgatgaaccagatcttcataga

SEQ ID NO: 13746 - DNA, 121 bp, Artificial Sequence
  Synthesized
  misc_feature (61): n=a or g
agctaacatttaaatttatgtataagagaattttaagacttgagtagctaacctcagtgcnttgcagaatagccagtaaaatcagtgtgttgaatttaactgatatcacaacaaaaattaa

SEQ ID NO: 13747 - DNA, 121 bp, Artificial Sequence
  Synthesized
  misc_feature (61): n=a or g
gctatctctagacctcagaattctttagcacttctcacctgagcagataaaagccacaaangcatctatttctacatcacccctttctattgggtgttgcaacccctctacaaaatcattt

SEQ ID NO: 13748 - DNA, 121 bp, Artificial Sequence
  Synthesized
  misc_feature (61): n=a or g
gtatcttttgcaagggttttactgccctcatgcgtccatgaattgcttcgtgttgaccagngaaggttaggatgaatacagtcacatggcttgcaagcataagtagttctttgtcttcctg

SEQ ID NO: 13749 - DNA, 121 bp, Artificial Sequence
  Synthesized
  misc_feature (61): n=t or c
attaaatgcctcttaaatgtttccctcttctggcaaggacagaggcaacatctaaatctcnaggaaggttcagctacacagagtacaaataatttttcctctttcttaattttcatgccta

SEQ ID NO: 13750 - DNA, 121 bp, Artificial Sequence
  Synthesized
  misc_feature (61): n=t or g
ttcatacttaagctgttcagctacctgaataaaataacattgtctaaacttctgaaaattnttcttctctacttcttaacataattcagattttgttaaaacaaaagtttacttccattga

SEQ ID NO: 13751 - DNA, 121 bp, Artificial Sequence
  Synthesized
  misc_feature (61): n=a or c
tgtgttttttgttttggttttttttccccctcatttgcgacatgttgagtgcctatgaaantgatttactccagggatgaaggatactaacgttatttgttgctcttaaagaatctgccta

SEQ ID NO: 13752 - DNA, 121 bp, Artificial Sequence
  Synthesized
  misc_feature (61): n=a or g
agtcagtacaaataatgctgtgattccacctgctgacatcactgcacaaccacagccctcngtgcccatgactgacacctgctctgctggaccttcctgctgggacggcactgatgaaggc

SEQ ID NO: 13753 - DNA, 121 bp, Artificial Sequence
  Synthesized
  misc_feature (61): n=t or c
ccttgctgggaaaaggagcttttgcagcaggaaagaaaattcagctacagatacaaagatngcacacttttcttctcgtaactggtaaatgagagctcctggaaaagatgaataatattct

SEQ ID NO: 13754 - DNA, 121 bp, Artificial Sequence
  Synthesized
  misc_feature (61): n=a or t
atgtcttaccatagacttaggttcatgcagaagtcttaccccccataggaaatgtgagatntctccctgctaactttcagggagctcagagcagctgaggtttccactcagtttaattgga

SEQ ID NO: 13755 - DNA, 121 bp, Artificial Sequence
  Synthesized
  misc_feature (61): n=t or c
ttaaggaaaaactggataatactaatcactgaagagattctatatcaaaatctccagaaangctacaacagcatattgagaaaaacccaaatctatgttaccacacaaacatgaccagaaa

SEQ ID NO: 13756 - DNA, 121 bp, Artificial Sequence
  Synthesized
  misc_feature (61): n=a or t
ctgggtgctttgttcagtttcagtttttaacaacagtgcctcgtgctgctgtaactcaagnaccataaatgctttaattgtttcagcatccagtatcctgctaaggattttagtattaacc

SEQ ID NO: 13757 - DNA, 121 bp, Artificial Sequence
  Synthesized
  misc_feature (61): n=t or c
tactaatgtgtgcactacaacacagtcagcgtcttctgctgcagaggaattgcagtccaanaaagctcttgcagccgaaggatacatttacaccttttctattctttaacctcatgttctt

SEQ ID NO: 13758 - DNA, 121 bp, Artificial Sequence
  Synthesized
  misc_feature (61): n=t or c
agaggtttccctaaatgccactgacgtgaagtttcaggtttggatgtgttttgttggaccncagtatggtgcttacagcagtgggtgcaggatggagaacaactgtttatgagggtggatg

SEQ ID NO: 13759 - DNA, 121 bp, Artificial Sequence
  Synthesized
  misc_feature (61): n=t or g
gaatgaaaccagatctgtttattttgagttcactgttgcaaatcattgcaagaagaacccngtcctgcagagtggatccgacgtggatgtgaaccacatgaagttcaggtctgatcctgca

SEQ ID NO: 13760 - DNA, 121 bp, Artificial Sequence
  Synthesized
  misc_feature (61): n=t or c
tcattttcatttatataggtactctgcatcttgtgtgttttttccagctgaggaaaactgnctgcccgtagtcaaactgtagccctgagttcccatgttaagaacagaagtgtgggctttc

SEQ ID NO: 13761 - DNA, 121 bp, Artificial Sequence
  Synthesized
  misc_feature (61): n=c or g
gacattgtcatagccttaatttaaggatggctacaaattcctagcacattttctgcacaangatgtccccactcatcacctcaaagaagcagctcagctgctcctcagtaaccagaaatga

SEQ ID NO: 13762 - DNA, 121 bp, Artificial Sequence
  Synthesized
  misc_feature (61): n=t or c
tcagctgtagctcctgtttgctttcattgtgaaggaactccataagacagcagtctgtganctaaaagcaacccttcctgttatgtaaattcaagagatacagctgagtccatactccaga

SEQ ID NO: 13763 - DNA, 121 bp, Artificial Sequence
  Synthesized
  misc_feature (61): n=a or g
aatagaaatacactctgctgagtggcacatatgatgccgtgcacaaagtgctgtttgtccnccggttcttcagtgctcacatccctgctctggccatttctcgttccaggtggatttgtat

SEQ ID NO: 13764 - DNA, 121 bp, Artificial Sequence
  Synthesized
  misc_feature (61): n=a or g
cttccttccccaggtgcagccccggatttgtggcttctggcgaaggaaagggacgggaggncacggatgtgccgctaagcagggtcagacctccaggtgatttgttgtctttgtgttatga

SEQ ID NO: 13765 - DNA, 121 bp, Artificial Sequence
  Synthesized
  misc_feature (61): n=t or c
aatgtgaataggtttctttgtatgatctgatgcgaaaaaaatgaatttagaagtgattagntctcagcatgtttgtttttcagtatattcagaaaaacatatttgattcactgttacagag

SEQ ID NO: 13766 - DNA, 121 bp, Artificial Sequence
  Synthesized
  misc_feature (61): n=a or c
ctgccacagttcaccacaccaaagccaagagagcagctttcacctgggcaagggtgaacantgtatcctgagcaggatctcatcgatctcatgtacacgcaaagcaggtctgaactgcaga

SEQ ID NO: 13767 - DNA, 121 bp, Artificial Sequence
  Synthesized
  misc_feature (61): n=a or g
agatgtcataagtatttaaatgggaaaaaatctagtaatataatatgtttgagtcatatanctatatatatgtgatagttcccagaccaacttgcaagtattcctcacttctgctctgaaa

SEQ ID NO: 13768 - DNA, 121 bp, Artificial Sequence
  Synthesized
  misc_feature (61): n=a or g
ctgtcagcatcctgttccagatcttagtttccttcatagttttttaagcttttctgctagntgaaaccttccacgtaaccagagcaccagcttctctgagtactgtcaattgtaaaaccaa

SEQ ID NO: 13769 - DNA, 121 bp, Artificial Sequence
  Synthesized
  misc_feature (61): n=a or c
acatttttgcatgaattcctttttaaagatgcaggatgcaactttttttatacaacacctntctgtttgaaaacaatctgaaacagttatcttagttctaaataattctaaataatgcttc

SEQ ID NO: 13770 - DNA, 121 bp, Artificial Sequence
  Synthesized
  misc_feature (61): n=t or g
aataaattgtttaagcatttgagatgtattcagagaaaagcacttcatctcttaaaagcanaacttcatttttctttcagtaatgcaagccaattacattctaactcaaggccaggctgga

SEQ ID NO: 13771 - DNA, 121 bp, Artificial Sequence
  Synthesized
  misc_feature (61): n=c or g
ctgagagagttgtgcgagaggcagtggaaaaggtaacacttgtcaaacaccacctacaccncggtttgaggagaggaggagtgggattaggatttttttttttctacattcttttctactt

SEQ ID NO: 13772 - DNA, 121 bp, Artificial Sequence
  Synthesized
  misc_feature (61): n=a or g
cttctactccgaagtaatgccccgaaaaacaaggataccattgccaactcggactctgtantagttcacatacaatcataggacatatatgccttcactatttagtctttactacattata

SEQ ID NO: 13773 - DNA, 121 bp, Artificial Sequence
  Synthesized
  misc_feature (61): n=a or c
agaggggcaccatagcaagagacagccagtcaggatggcacagttccaccaggagcaatgnagcagggcagaaaagatcaactgagcagcaagcagcttctcaggtcaggctctgagtgct

SEQ ID NO: 13774 - DNA, 121 bp, Artificial Sequence
  Synthesized
  misc_feature (61): n=c or g
cattacatgttgtgtggtgcatggattcattcctgttgttagattttatcaagacagaatnctatctgatctaaggttaaacggttaaaatgaaaatctttcacacgctttcctttgcaac

SEQ ID NO: 13775 - DNA, 121 bp, Artificial Sequence
  Synthesized
  misc_feature (61): n=a or g
tttggattccaaatctgtgtcttatataattcttgctgaacagcttagaagtaataaaagnaaaagcataagggtggatacaaatcttactatttgggtctggaaaaaaaagaggtaagtt

SEQ ID NO: 13776 - DNA, 121 bp, Artificial Sequence
  Synthesized
  misc_feature (61): n=a or c
tgttgggcaaggcatcatcaccagaactccacatacaccaagctcttggcacgtgggacangggcagcagctgagaggttgaggaaagtgcagctgaagcaccgttctctgcacggctctg

SEQ ID NO: 13777 - DNA, 121 bp, Artificial Sequence
  Synthesized
  misc_feature (61): n=t or c
agactccctctggaaacccaacactcagggtaagaccaggatcagatccccaaaggagagnggcacaaccgcccaccatatgggcacagagggattaattacagctgcaccaggggacgga

SEQ ID NO: 13778 - DNA, 121 bp, Artificial Sequence
  Synthesized
  misc_feature (61): n=a or g
agtaaactcctctctgaatgaggaattctgtcttttaacagttcaattctgctaggagtcntatgtttgaagtgtttggactttaccttgctattcactatttacaattctataagtgggc

SEQ ID NO: 13779 - DNA, 121 bp, Artificial Sequence
  Synthesized
  misc_feature (61): n=t or c
aaagcacacatgcgcatagttaatcaactaagagaaatactttttaaaggagactagtagntgattagtcaactatgccaacaaaaatctagatatcaatagaatttctcagaaccatccc

SEQ ID NO: 13780 - DNA, 121 bp, Artificial Sequence
  Synthesized
  misc_feature (61): n=t or c
aaatacatggggaaacacatggtggctttttctgttgtcacagctttaaggagatagtganggcctttagctaagtaacctttgctaacccaggaagtcatctttcattaagagtcagatg

SEQ ID NO: 13781 - DNA, 121 bp, Artificial Sequence
  Synthesized
  misc_feature (61): n=a or g
tttacacagttccattaaatgtctatcagatgtcaagctgggtttaaggccactgcatttnaattactaaaacacatacaaattggaaacttacaaaaaaaaaaaaaaaaaaaaaaaagaa

SEQ ID NO: 13782 - DNA, 121 bp, Artificial Sequence
  Synthesized
  misc_feature (61): n=t or c
tttttcatcctgtaatttctactgaaactggctgttttatcaagtcagtctgtatttctgnacagaactgaaaatgtccccgttcatttaatagagttaaattttgccttggtggcttctt

SEQ ID NO: 13783 - DNA, 121 bp, Artificial Sequence
  Synthesized
  misc_feature (61): n=c or g
agtaagagcgcatcagctgtaggtcacacagtatttgctactgatacataacacccagagnaaatctgacacaagatctgcagataaaagatggttgttgaggaagtacctccagctcttt

SEQ ID NO: 13784 - DNA, 121 bp, Artificial Sequence
  Synthesized
  misc_feature (61): n=a or g
aacaaatttttgtttgtttatctcttaacatctgtaccatagccttcaggcaacttccaantaaaagccataatcctggctctctccttgttatatagtttacttttttttctgttaagcc

SEQ ID NO: 13785 - DNA, 121 bp, Artificial Sequence
  Synthesized
  misc_feature (61): n=a or c
aaccgtgagagtgatctgaaaacataaagtcttgcttttcctgctcagacaagggaggccntggtcataggtaagaaagaataaggccactcaacatcttaagaactagaaatagagatgt

SEQ ID NO: 13786 - DNA, 121 bp, Artificial Sequence
  Synthesized
  misc_feature (61): n=t or c
tgctctgtagaacaagaagttccaagaaatctaaggaaaggcgaagaaaattctttggagncatacttttcaagccagtgtttctgctagaagatggcttagttattttggctgaaatgag

SEQ ID NO: 13787 - DNA, 121 bp, Artificial Sequence
  Synthesized
  misc_feature (61): n=t or c
aaatatataggctcagaagggatctccagccattaacccagtagaacatcctggtttctgntgtcactctgtgagcgtttgtcacaataaagtttctgagtacagccacacagaggtaaag

SEQ ID NO: 13788 - DNA, 121 bp, Artificial Sequence
  Synthesized
  misc_feature (61): n=a or g
agagcctcctgtgaatttacaacaaatgccacctggcagagggcaccataatcacaagtgnatgtgccctttgtccttaactaaatttacatatttttcagagaaaggttcaatgtttatt

SEQ ID NO: 13789 - DNA, 121 bp, Artificial Sequence
  Synthesized
  misc_feature (61): n=a or t
gctgtttattccatcatctaacttagcagaaaattatcagtgtttagtaacacttctgtangccagaaaaacaccttgttgccacttcgtcttcacacaccttgaaaggagtactatctga

SEQ ID NO: 13790 - DNA, 121 bp, Artificial Sequence
  Synthesized
  misc_feature (61): n=t or c
acatgttctgtgagaatacccttacttttaaagctactgaaagttactagaattgttccangcatgaatgcctgtttcaggcaggtgtttctaattatgtttaaacttcatctggaacagt

SEQ ID NO: 13791 - DNA, 121 bp, Artificial Sequence
  Synthesized
  misc_feature (61): n=a or c
acaggctgatgtctttttccattagtaaatgtttgattacttatggtgtaatagatcctanctactagccccagaatgaaagtgttgttccatgatgaatttgatatcttttaatgaaaga

SEQ ID NO: 13792 - DNA, 121 bp, Artificial Sequence
  Synthesized
  misc_feature (61): n=a or g
acatggacagtacaatttttggctgttgttttctttcatgtgcagaactgaggaatgtaanagatgctagacaggttgggtgaagtcgaagaatttctggtttcctatttgaagtttaggt

SEQ ID NO: 13793 - DNA, 121 bp, Artificial Sequence
  Synthesized
  misc_feature (61): n=a or t
ttccttgaagccaaattacttcaagaattctgctgtaatatccagggagtggaatggagantacagggatatgatcacatatctccataatttttttttgtttttgtttttaaaagtaaca

SEQ ID NO: 13794 - DNA, 121 bp, Artificial Sequence
  Synthesized
  misc_feature (61): n=t or c
ttgaaatgtagcacgaatgcattttataagtaaatatatttttgagactgtcacgtgaagngggagaccactgtaatcagccctttttaagctttattggtggctttaaacaaaatgctct

SEQ ID NO: 13795 - DNA, 121 bp, Artificial Sequence
  Synthesized
  misc_feature (61): n=a or g
gaccatattgcctcaagattgctttctgtgatctggcttttcctgttaccaagaatttacntaaccaaaaagaccaaaaccacactatgatgagtaagcagtagatggtctaaaacatttc

SEQ ID NO: 13796 - DNA, 121 bp, Artificial Sequence
  Synthesized
  misc_feature (61): n=t or c
ggtagccactaactgcttctcaatcatactatgtctttcttctgttccatgccaaatgatnctggaatggaataaagtattctgaattttaagggttatagccacaaatatcttgttttgt

SEQ ID NO: 13797 - DNA, 121 bp, Artificial Sequence
  Synthesized
  misc_feature (61): n=a or g
agcactcagagcagaataggctggatatattccagctccagcccagtttgagttgtatctnttttctatattcggttattaatgagaaaatacaaaagctgtgatgtttgtgtcttatact

SEQ ID NO: 13798 - DNA, 121 bp, Artificial Sequence
  Synthesized
  misc_feature (61): n=a or g
tactaatgctagaaaagggagttctgggagttctaagttccataggtattacatgtgaacngatacactagaacagtaccaagggactagcagaccttgttacaagaggaagttgaaaggt

SEQ ID NO: 13799 - DNA, 121 bp, Artificial Sequence
  Synthesized
  misc_feature (61): n=t or g
aataagcaattgtcacaagactccccattaatactcgcctctgcacatataaacactgaanatttaggtgccttctgtgacaggccaaattgctgaagtataatacatactttttactatt

SEQ ID NO: 13800 - DNA, 121 bp, Artificial Sequence
  Synthesized
  misc_feature (61): n=a or g
atacgccttgagcacagcatcacctgctcatccaggagtgtggcaaaccactgtgtgtacnccatgaccatttcggggggggtgttgtaattacactgtagatctcatttgcatatatttt

SEQ ID NO: 13801 - DNA, 121 bp, Artificial Sequence
  Synthesized
  misc_feature (61): n=t or c
gaccagctgacttgaaagtcattcactcagaggctgggatttcactggctaccttcagctnttcagtttgggtccacaaaacctatctgaatctcctggttacactcgtgcagagaactgg

SEQ ID NO: 13802 - DNA, 121 bp, Artificial Sequence
  Synthesized
  misc_feature (61): n=c or g
aaaaaaatatagattgaaactcattacgaatgtgaagcattaaattatgttccatgatagntggattactggaaaggaatatgagagctgatcagaagttctaaacatagggttttgtgga

SEQ ID NO: 13803 - DNA, 121 bp, Artificial Sequence
  Synthesized
  misc_feature (61): n=t or c
taagatttctgaatgtggtatgatacaaatgtactttgatagatgttgactcaaatcaganggattaaaaagtgagagaacaatttaggacctaagaatgaatgaaggcagtaaggcatat

SEQ ID NO: 13804 - DNA, 121 bp, Artificial Sequence
  Synthesized
  misc_feature (61): n=a or g
taaggattacctctagggcctcaaacacaacattcttgttacagacagctttcttttacancagcatcatgtggctaactcagggccagattaattttctgtggagcagattgggatcaca

SEQ ID NO: 13805 - DNA, 121 bp, Artificial Sequence
  Synthesized
  misc_feature (61): n=t or c
aatttccctccacacatcaccctatgctatcttgtgatcaatactggtgtttctctgacanggaaaggacagaaatgcaagctcttaatgaccagaaacagcagaagttaaggtatacccc

SEQ ID NO: 13806 - DNA, 121 bp, Artificial Sequence
  Synthesized
  misc_feature (61): n=t or g
gtggcagagttggtgtgtgaatacctacaaaaaccgaacagggaaacagagcctgaaaatnatgcaaaaggtctggagtactgggcaggatgtgttctgacatttcatttttaactgtctt

SEQ ID NO: 13807 - DNA, 121 bp, Artificial Sequence
  Synthesized
  misc_feature (61): n=a or t
tgcattcattaatggcctgaggacagtttccagatcatacttagctcttctacagaacagnaacagatagctcacataactaagataaaggacaagaagataccatgtgaacttcaacaaa

SEQ ID NO: 13808 - DNA, 121 bp, Artificial Sequence
  Synthesized
  misc_feature (61): n=a or g
accggaatcagggagaaaaacattctccagaaattcaatttaacacaaagccaagaacacntcctgggatttgcaaccaaaaggagcaggcggaggcgccgtgccagggaccagattcctt

SEQ ID NO: 13809 - DNA, 121 bp, Artificial Sequence
  Synthesized
  misc_feature (61): n=a or t
attcatctcctatctcatgtgcaattaagatgaatggccatgcaaggacaaccaaagcagnaggaccacacaactttacacccaatccattaacagaaaattgctattagtgaagtggtct

SEQ ID NO: 13810 - DNA, 121 bp, Artificial Sequence
  Synthesized
  misc_feature (61): n=a or g
ttcccttgcacccagtctggggggctatatgagtgctggaggtaggcctgggctgctgaangaactaagggactgattttcaatggtctgtagtccacactgaccctctcaactatttctg

SEQ ID NO: 13811 - DNA, 121 bp, Artificial Sequence
  Synthesized
  misc_feature (61): n=t or c
aacatagcatgaggacccacagtgtaagcaaacacactgatacacagaggcagcaaaccanggccagcacggcagaagaacaggaatagcctggtcagcacaacccaagagaagcttcctt

SEQ ID NO: 13812 - DNA, 121 bp, Artificial Sequence
  Synthesized
  misc_feature (61): n=t or g
atcctattaaaaatgtgagaggctgctataagcttctgtgtgaaggcacactggtgttttntgcaggggtggaatgtgtccccagaggcctaaatctcaaactgaggcctcaagcataagg

SEQ ID NO: 13813 - DNA, 121 bp, Artificial Sequence
  Synthesized
  misc_feature (61): n=t or g
acagtggatgcatggcaagggtgacacccgacttttgctttgtaaatacagaaaatgcatntatctagccagggtgacaagtcttccttgctcagttcttcctgaccacacaggaaagtga

SEQ ID NO: 13814 - DNA, 121 bp, Artificial Sequence
  Synthesized
  misc_feature (61): n=c or g
tgcttctatcgtgaaagtttttatcatggagactgtgacagtggaatccctgaagattctntaagtggaaaacacagtttacatcattatttctgactctagaaagaagtcaacacagtaa

SEQ ID NO: 13815 - DNA, 121 bp, Artificial Sequence
  Synthesized
  misc_feature (61): n=t or c
aacctgactatgtgctactgcagtttagaaacatgctccaagcatcttggtcctgtatcanaggagtggataagcagcaacaaggtatgcacatgccttggcagactagtgcagctagagt

SEQ ID NO: 13816 - DNA, 121 bp, Artificial Sequence
  Synthesized
  misc_feature (61): n=a or g
atcacctgcccttgtcgtgagatttttcagcagattcatcaacaaggatgagtaatcagcnatatgaactaggtcctattcttgccccaaggaaagctcttctgtatcgaggttggtgctg

SEQ ID NO: 13817 - DNA, 121 bp, Artificial Sequence
  Synthesized
  misc_feature (61): n=a or t
ctctgagcaaagcgctgggttaaatgggatctcggggagagacagctgaagaaaaacgtancgtctatatgaatgcatgtatgtatgagcgattccatacatccagaagggtgttctgggg

SEQ ID NO: 13818 - DNA, 121 bp, Artificial Sequence
  Synthesized
  misc_feature (61): n=a or g
aaaaaaacactcttgagtccacatctgaagggctggattctcctctgggcacttcactgcnacaaagacatggactgagagacaggattgtccagcaaaaggccaggaatattgcatatgt

SEQ ID NO: 13819 - DNA, 121 bp, Artificial Sequence
  Synthesized
  misc_feature (61): n=t or c
tatgaccttcagaaatggttaagagccaggattcgattaatttgcatttaattgatattgngtgccgcacattttaaagtcttaaaggtctattacagcttcattagtaactttatcagtc

SEQ ID NO: 13820 - DNA, 121 bp, Artificial Sequence
  Synthesized
  misc_feature (61): n=t or c
ttagctggacctcttctgagcggctccgggtcaccccgtttgtttcaatgggagccagccntgtaacagcgggctgaattatttgcttgtgcagctctccaggcgctgaaatatatgggct

SEQ ID NO: 13821 - DNA, 121 bp, Artificial Sequence
  Synthesized
  misc_feature (61): n=t or c
acggtacaggcctgagaagcctgacaggctttgtaagaggttcataaagcttagagtgganattatacttccaggcttcagcagttctaataagtattcatcacaagcaatgttgactgtg

SEQ ID NO: 13822 - DNA, 121 bp, Artificial Sequence
  Synthesized
  misc_feature (61): n=t or g
tcttatcctctctttctgtaatccaaaggcttgttaatggtgtccaacaaaatttacaatnccacagcagacagcagcaggttaagaggcagaatgggctatcacttgggtgaagactgct

SEQ ID NO: 13823 - DNA, 121 bp, Artificial Sequence
  Synthesized
  misc_feature (61): n=t or g
acttacattcctggagagcatctgcccgggactcaagtgttggagaagcccttatgtcgtntgttgttggttgaatgtactatggtatgctttcgtgtgcacagtttcatgctcttctgtc

SEQ ID NO: 13824 - DNA, 121 bp, Artificial Sequence
  Synthesized
  misc_feature (61): n=t or c
ctgttaatccgttacgagccgaaggcctagaaaagctttttacttattgctttccactganatattgatcactccagccttcagatgatgccatccactgtcttctgcatctggaggagat

SEQ ID NO: 13825 - DNA, 121 bp, Artificial Sequence
  Synthesized
  misc_feature (61): n=t or c
gtaccagtgccaaggaaagcgtctggtgaggcagacgaaacaaaggcagcagacctcagcnatccaagtggggttagggagttcataagatccaagcacgttccagctcccatccctttgc

SEQ ID NO: 13826 - DNA, 121 bp, Artificial Sequence
  Synthesized
  misc_feature (61): n=a or g
taagcagtacatagtaggcactacttctttttaatacttcaaactctaaatgttgtcctantctgacatgagcaacattaaagtttatttaatattatgatttctaaacagtatttcatga

SEQ ID NO: 13827 - DNA, 121 bp, Artificial Sequence
  Synthesized
  misc_feature (61): n=t or c
gtccaccaagtcatttcggatcaccctgaccccaaagtagatcctcttgatgaccctgaangtcttcagcatgcgcacatcgcagcggtacgtccccgcatcggactccttggttggggaa

SEQ ID NO: 13828 - DNA, 121 bp, Artificial Sequence
  Synthesized
  misc_feature (61): n=t or c
cactgtcctttattgcaatagaactgtgcaatagagctgtgcactggagcagctatcatcntaaatgcctgtgatactggtcagacccacagaggacttaatcctcaaaatgaatgaacac

SEQ ID NO: 13829 - DNA, 121 bp, Artificial Sequence
  Synthesized
  misc_feature (61): n=t or c
gcttagaacataaccagacataattatgaaatctgatccagaaaatgctctggggtaatangtgtttgccaaatttttaacaaaggtaagaaatacaaagagcagtgtgaaatatcagagt

SEQ ID NO: 13830 - DNA, 121 bp, Artificial Sequence
  Synthesized
  misc_feature (61): n=a or g
aaacgcgtggaaggagagcaatgtttaaccagaccagaggaggagggaggtgcgcaaagcncacagatcacaatcagcaaaatctccttctgcttcagctctcccacactgggtcatctgg

SEQ ID NO: 13831 - DNA, 121 bp, Artificial Sequence
  Synthesized
  misc_feature (61): n=a or g
ctgttgtacagtgctgttcagtctctatgcttgtccttttagtgtgtgacctaaattactntataaaattttaaaagcccactgtgctaccatcatctccttgtatcgttctgacttttac

SEQ ID NO: 13832 - DNA, 121 bp, Artificial Sequence
  Synthesized
  misc_feature (61): n=a or g
cgggaaatagaaatgcttacatgctttatcttgctctttttaattgcacaccagttgaaancacgacccaccccatcagttgcattactgatgattcatatgtaccttaaatagcacttct

SEQ ID NO: 13833 - DNA, 121 bp, Artificial Sequence
  Synthesized
  misc_feature (61): n=a or g
ttatttcgtggaagtattttagtcacaaaactactggttattctggtgctactttcttcantttaagttaccagggttcatatgaagagatgatgacacagtcacagttttggtcacagga

SEQ ID NO: 13834 - DNA, 121 bp, Artificial Sequence
  Synthesized
  misc_feature (61): n=t or c
ggttataactcttgcttcacatcacatactgtacttcaatcaaaatttagggttatttccngacacaagcaagaataggattatagatactaccaagggaaaaaacttatttacaaaatag

SEQ ID NO: 13835 - DNA, 121 bp, Artificial Sequence
  Synthesized
  misc_feature (61): n=a or c
agtcagctgcaaggtgtaataggctcattccccacaatagctatcattttaatgaaccacnaaggaaaaatcagcagccatgttgacaattttaaggctgtgggttggaggaggagctgcc

SEQ ID NO: 13836 - DNA, 121 bp, Artificial Sequence
  Synthesized
  misc_feature (61): n=c or g
ctgggacctcatgtactagaattaagcattttaacaccgcttatggggttttcacacaganacgagcatcaccattttaaagttttaagatttcacttaaggacgtacttcatatgtaaaa

SEQ ID NO: 13837 - DNA, 121 bp, Artificial Sequence
  Synthesized
  misc_feature (61): n=a or c
taactctgcaaaatgaatgctgtgctaataggtatgaaaattcacaacatttatacttaangaattaaattccaaacactcttatctgatcacaacttcagcaatggttgaaacaacttca

SEQ ID NO: 13838 - DNA, 121 bp, Artificial Sequence
  Synthesized
  misc_feature (61): n=t or c
cgccctccctgagagcactgtcaggtgctggaaagcagcaggttgattgccaggatgtgcnacaatgccttttgttcactatttgtttggaggagctgtttttcgcttgcggagcactttg

SEQ ID NO: 13839 - DNA, 121 bp, Artificial Sequence
  Synthesized
  misc_feature (61): n=t or c
ctttcggtcacagtgggcaagctccttccctggcgatgtaaggagtgaaagacaacagagnggcacagggacaacgccaaggtcttcacgtttccattcactcataaatcctcacacggct

SEQ ID NO: 13840 - DNA, 121 bp, Artificial Sequence
  Synthesized
  misc_feature (61): n=a or g
aaggtattcattcagtggatctcaacgtacaaatgagtcctaacgaaacttcaccacctcnttacatctctcattttagaaactgctgaaaccgagatatgtgaaggccaagcaaaccgct

SEQ ID NO: 13841 - DNA, 121 bp, Artificial Sequence
  Synthesized
  misc_feature (61): n=t or c
gtgttggcagagctgtttcaggtcccaccttacaaacaaatgctgtgatatgtgccagctngtggcatttccttgaacccatggtagcaacagggaatgaaggcacacatcactctctagc

SEQ ID NO: 13842 - DNA, 121 bp, Artificial Sequence
  Synthesized
  misc_feature (61): n=a or g
ggaccacattttcagtcagcctcaacatcaagacagtaaagccaaaactgaagggctaagnggtttcatctacgtaaaactaaatggatggctctattatatatatatgttataacttata

SEQ ID NO: 13843 - DNA, 121 bp, Artificial Sequence
  Synthesized
  misc_feature (61): n=t or c
ttttttctacataatcatcccacaaagggttctctgttctgaccagaaggcatgttccatnctggctcctggttctctccaggtacaggtaaaatgaggggcagcccaagctgcctcagca

SEQ ID NO: 13844 - DNA, 121 bp, Artificial Sequence
  Synthesized
  misc_feature (61): n=t or c
aaagaaagaggaaatagcagctctgcaaagttctccaggagccctacaggagggatgcagnctacagcagaggagcactgtatgatgttccgggagatcaaaaaaaaatgcaggcccgttt

SEQ ID NO: 13845 - DNA, 121 bp, Artificial Sequence
  Synthesized
  misc_feature (61): n=a or t
agattaaatgattttgtaaatccttggtctttagagcaagtgttttaagccattcaaactngttgtacatttgctgtactttgtaaaggccaagaaaaaggacaaaatagtactggcactg

SEQ ID NO: 13846 - DNA, 121 bp, Artificial Sequence
  Synthesized
  misc_feature (61): n=a or g
ttgttcttctttctcaacttgtttttcatttcactgccattccacgttattgctaatattnttatttccatttaactgctaccttagtcctctctcctggcccaaatatgaaaaagacttt

SEQ ID NO: 13847 - DNA, 121 bp, Artificial Sequence
  Synthesized
  misc_feature (61): n=a or g
cctcctctcattccaaatgtgacaagactacttgttccctgaagttagaataagttgcccntgtgaactgtgtgtgtggagcagataaccttcagcagaatgcacagtgtactatataaga

SEQ ID NO: 13848 - DNA, 121 bp, Artificial Sequence
  Synthesized
  misc_feature (61): n=t or c
taagacttctctggaatattgcccatacaggtagagctccagctgattagacataacaaancaaactggacaaatgatttgataggttcaatttttattattattgttcagttttgtatct

SEQ ID NO: 13849 - DNA, 121 bp, Artificial Sequence
  Synthesized
  misc_feature (61): n=t or c
taattgcaagattgttatagctttgttgggactgaggagacagaagcagatggttgtattngaaaattcacagagttactggagtaataggtcacttctgcagtattacctccccttgcct

SEQ ID NO: 13850 - DNA, 121 bp, Artificial Sequence
  Synthesized
  misc_feature (61): n=a or g
ccggaagtttttaatcctttgcaactgttcattttcagagttacctattatcactgtcacnccaagtgtaggaggagtagctaaagaacttgtccaggacatttctggatccacttctgct

SEQ ID NO: 13851 - DNA, 121 bp, Artificial Sequence
  Synthesized
  misc_feature (61): n=a or t
actatttgtgtggagaagtgtcacagatttcaatgttttaggctgttttctgttgactatncctgaagatgaaagtgttacctgcacacttcactgtcagttgatggtaaacctgactcct

SEQ ID NO: 13852 - DNA, 121 bp, Artificial Sequence
  Synthesized
  misc_feature (61): n=a or t
ttttaaggtaaaaatcaaacgaagaaaggtgtaaatgcttctcatacattcccaacttccnagcctcgtattacctctatacatatttccaccatttcactgcctaatcccatcacttcta

SEQ ID NO: 13853 - DNA, 121 bp, Artificial Sequence
  Synthesized
  misc_feature (61): n=t or c
agatcaatattttctccattaaaaagtaaatatatgaagatgaaaagcttttttaagggtntgaaaatgtcttgtaggctctaaaacgctctgtagacgttgatgctcaccaaaaaaagag

SEQ ID NO: 13854 - DNA, 121 bp, Artificial Sequence
  Synthesized
  misc_feature (61): n=t or c
tgaagggtagttgagtttctcacagtgagcatattgtagtgtctgaaggaaccctagatgngcagttctgcatcaagcaaagtttattattttccagtgcaacactaaagttaatataatt

SEQ ID NO: 13855 - DNA, 121 bp, Artificial Sequence
  Synthesized
  misc_feature (61): n=a or g
actacaaatagaatggaaaatctgaggtagattattgcctctattttttgtttttccaacntgctattaggctattcgtaacaaaaagcaaattaatattacttgaattagcaattaggac

SEQ ID NO: 13856 - DNA, 121 bp, Artificial Sequence
  Synthesized
  misc_feature (61): n=a or g
ttcagatgaaactaaggcgtaagctgtagtcttgttttgggtcagtgttactgagtggctnttgatcttctctttgtgtgtgctcagttctagacaaaatgtgtgttcctttttttatttt

SEQ ID NO: 13857 - DNA, 121 bp, Artificial Sequence
  Synthesized
  misc_feature (61): n=c or g
gacctttttggaactttgtttctaaagcattttcaccaacatctatcattgtttagatcanaaaacgagtagtacgatcctgtggataatgcaaattgaccctaatctttttcaaaaccag

SEQ ID NO: 13858 - DNA, 121 bp, Artificial Sequence
  Synthesized
  misc_feature (61): n=a or g
caaaaaactggatacataatacttggctgcttttttcagtgcatacattagacccctgagngcagcctgtttgtaaggttagggaagcaatgtgggtgtattcttgcatgctgctgagggg

SEQ ID NO: 13859 - DNA, 121 bp, Artificial Sequence
  Synthesized
  misc_feature (61): n=a or g
gatttctttaagatattggctaccaggcacatggctccgagtgccagatcctgcagagatnctcacacactttttaccttcccttttctgtaacccatcgtaccccttttccctgtcagtg

SEQ ID NO: 13860 - DNA, 121 bp, Artificial Sequence
  Synthesized
  misc_feature (61): n=a or g
tccccaatttctggcaagataaacagagatggttctctgagtggctctctttcgtatcttngatgtcgtcaatacactcttaaagctaagaacatgaaatacattttgatctttagactga

SEQ ID NO: 13861 - DNA, 121 bp, Artificial Sequence
  Synthesized
  misc_feature (61): n=a or g
gttaaaaattcaacgtgttaaacagttacactgtacctgcagcaatatctgtttgctactntatgggaaagttcactgaaggcaccgctggtctttaccaaacatggttaagaattcaaac

SEQ ID NO: 13862 - DNA, 121 bp, Artificial Sequence
  Synthesized
  misc_feature (61): n=t or c
cactgtacactgctcttcatttgttgccctgcagtgcctgtaagcacagaaagaggaatgntttcttagtatttacccatacaagtatgttaaactaccttcaaagagattgaagtggcca

SEQ ID NO: 13863 - DNA, 121 bp, Artificial Sequence
  Synthesized
  misc_feature (61): n=a or g
atgaactaaccacgactctttctctcactcccacctgaagaaaagagggagctgatggcantataactcactgcatttataagacaaggtatggtatatatctgcttcttactgttatttg

SEQ ID NO: 13864 - DNA, 121 bp, Artificial Sequence
  Synthesized
  misc_feature (61): n=a or g
tcccataaccccctgctgattagcatcatgttcctgtaattctttattaatcgagtcatcntgagatgttccttcattttgcctggaatcaatggcaggcaataattatccaagtcaacat

SEQ ID NO: 13865 - DNA, 121 bp, Artificial Sequence
  Synthesized
  misc_feature (61): n=t or c
tgaatacgtattgctctgtcccagcaatgcagacaagggctgggggaatggatgcccccangatgctccccatggctctcggtgccctcctcaccattcattctgtccacagagtttagac

SEQ ID NO: 13866 - DNA, 121 bp, Artificial Sequence
  Synthesized
  misc_feature (61): n=t or c
agtggggttgatgcggatgtaacgggctatgatcggagggttgaagcgattttctttcacngtggttgcgtccacgtttgcaaagaacatctgcagggaaggggttaaaaagggtgctgtt

SEQ ID NO: 13867 - DNA, 121 bp, Artificial Sequence
  Synthesized
  misc_feature (61): n=a or g
tcccacaaaacaaaagctcagtatgacagaattttttgtttattccttgaccacagttgcncagatactaagtgcagtctgtttatatttactctcttttacatgcactaccaaagaaaac

SEQ ID NO: 13868 - DNA, 121 bp, Artificial Sequence
  Synthesized
  misc_feature (61): n=a or c
ctcacttacagaaagagcctgcaagtacgcagagtagttcatgtgaggtaagtgcacaccntggactttttgcatccatttctatacctgtgtaacaaactgtaaccagtgcttccttgct

SEQ ID NO: 13869 - DNA, 121 bp, Artificial Sequence
  Synthesized
  misc_feature (61): n=a or t
ccatcttgaagatgcgataaatctgatttccttttctgtagggcaatcacagctaattacnaaggaacaaccaatatatgtattcaaaataaattacctgagattgtccctgtgccctacc

SEQ ID NO: 13870 - DNA, 121 bp, Artificial Sequence
  Synthesized
  misc_feature (61): n=a or g
aaatacactgagcggatctgggaagcagaagcaaacagtccttagtcaccggtatgggtancgcacgaggcaccccgcactcagcagcactgccagattgcagagtgccctttgctgggag

SEQ ID NO: 13871 - DNA, 121 bp, Artificial Sequence
  Synthesized
  misc_feature (61): n=a or g
gtgggagatcctcctacaaagaaccctaggcacaggaacctcatacaatacagctgtgccnccaacagtgggctttgtgcatatgctgtctgcataggttctttctcaaaaagagagtctg

SEQ ID NO: 13872 - DNA, 121 bp, Artificial Sequence
  Synthesized
  misc_feature (61): n=a or g
gaacagagaaatcacaccttcaaaattaacagctttgttctgtcaaatgttatgaccttgnagccatgtttattaatagattcattctcttcccgtttatgattttaatgtggttgttatt

SEQ ID NO: 13873 - DNA, 121 bp, Artificial Sequence
  Synthesized
  misc_feature (61): n=t or c
aaaggagggctgcccctaagacgagtactgttttttcagagaggtttggcagaggtgtggnggggtgttttcagcttgcatcaagaagaagtagggtagggtagaagagggaagggggagg

SEQ ID NO: 13874 - DNA, 121 bp, Artificial Sequence
  Synthesized
  misc_feature (61): n=t or c
tcttccaaaaaaaaaacttatctacagaaacagactggtttattcacaggagtgtttttantcaatcctcctctcctttatcctcgtacaaacttgagttgagaataatgtgcatttgcac

SEQ ID NO: 13875 - DNA, 121 bp, Artificial Sequence
  Synthesized
  misc_feature (61): n=c or g
ctacaaagaaagctgttggaaaatgaatgtcttagctgcttaaacatttgactaggtaagnttatttaccaactcacacgggcaaatccgtgcagttaactcatggatgaaatcaggcctt

SEQ ID NO: 13876 - DNA, 121 bp, Artificial Sequence
  Synthesized
  misc_feature (61): n=t or c
ggtcatgtcatctaactgacaatccacatgtcttttttgcaaggctatctacaccaaccantttctagcttccaattcactttatctttctatcccatggtgacttaacattccacttgtc

SEQ ID NO: 13877 - DNA, 121 bp, Artificial Sequence
  Synthesized
  misc_feature (61): n=t or c
aaggatttacttacaaatttgtcagattttatttatatttgcaataaaagggatcagaatnataatgaatgctttcattgataatgacaggaaacacaaaagaactaaggaaaacacagag

SEQ ID NO: 13878 - DNA, 121 bp, Artificial Sequence
  Synthesized
  misc_feature (61): n=a or t
tctttacataaatttctatgagtttgtgtggtaaaacattcagacaaaatgtttgagagangtggaagagtctttactcttccacatctctcttgcagtcctggttaaaatgaaacaaaca

SEQ ID NO: 13879 - DNA, 121 bp, Artificial Sequence
  Synthesized
  misc_feature (61): n=t or c
ataaaacacgcctggcccctttcaggataaaatatagaataatcaatgtggctttagaacngcacaccattttctttaactgtttgcatccagacaggatagtgtatcattctaatgcagc

SEQ ID NO: 13880 - DNA, 121 bp, Artificial Sequence
  Synthesized
  misc_feature (61): n=a or g
accagtggcttcatccagtaggttgtttatagaaaggttctggaaagagccattgaaattnctgtagcagtggctaaaaaaacactttgcaagtgttaaagtcatgcttttttgtcttctg

SEQ ID NO: 13881 - DNA, 121 bp, Artificial Sequence
  Synthesized
  misc_feature (61): n=t or g
ttccaaagtagtttcttcacaggatatttcactttttgagtgatattattgagtgtttgtnttggttattttattagttataacttttcagttttcatattgctaatttttggaaagtaat

SEQ ID NO: 13882 - DNA, 121 bp, Artificial Sequence
  Synthesized
  misc_feature (61): n=a or g
gcgccacattcaaatcaggtcactattacttcttagttcacaaacattatatttttggggngacactcactacatacttaagtagaactcctccttcatttcttattctgatcctcttctt

SEQ ID NO: 13883 - DNA, 121 bp, Artificial Sequence
  Synthesized
  misc_feature (61): n=t or c
agtttttctatcctgctaagctggcagaagctgaggcacctctgcagacaatactgctaantttcacctgctgcgaatgtgggccacaagaagtattccagtttttaccagaaggatgtct

SEQ ID NO: 13884 - DNA, 121 bp, Artificial Sequence
  Synthesized
  misc_feature (61): n=a or c
gcggcgcgggctccctcccctcggtgtgcgtggggttgctgttcccgcagcacagggaggnggccgctgtgaaagggaagagccttactggatcacagcactcataaatatcagatggaac

SEQ ID NO: 13885 - DNA, 121 bp, Artificial Sequence
  Synthesized
  misc_feature (61): n=t or c
aatttttcatgtacattcatatgctgctaaggttagctttaacgtgtgcaacctgtgctancttcactgctacacttgtagtgcatcaggccgtacagcagaagtgtgtaggtgctgtagg

SEQ ID NO: 13886 - DNA, 121 bp, Artificial Sequence
  Synthesized
  misc_feature (61): n=a or g
tttgaagaatagagtcatgctcttctgtgcattttgaagcagtagtagcagaagatcatcnagcattcaatatgcccatcacctctgatgtagctgtggcatgctggctacctgacaccat

SEQ ID NO: 13887 - DNA, 121 bp, Artificial Sequence
  Synthesized
  misc_feature (61): n=t or c
agcatcacttatatgtcactaattaaagcaaaattttgttaattatttgtgctgtcagtcnacactgattggttaagaaaaaagggccagaggaattttttttaggaggaggttaatcacc

SEQ ID NO: 13888 - DNA, 121 bp, Artificial Sequence
  Synthesized
  misc_feature (61): n=a or g
gctgcaccgtagaaaatgggctctaagactagtgggactggagagacagtcttctaaatgnaatctgaaagtcagctgtcctaagcaccactgctgctacagattctgtgaacttcactgc

SEQ ID NO: 13889 - DNA, 121 bp, Artificial Sequence
  Synthesized
  misc_feature (61): n=a or g
aaggcaatgaagttgatcaggaatgatttgacatcaataaacacttgctgactgctcccanttaccttcttgtcttttatgtgttcagaaatattttcttagagtcatttatcccttagca

SEQ ID NO: 13890 - DNA, 121 bp, Artificial Sequence
  Synthesized
  misc_feature (61): n=a or g
tctttctgtactaagacaagtcatcatttcccagctttcctcatacatttttacaaatcantttgcatttccactgctcttttcagaccctctttccctgtctgatgtgtgggcatggaat

SEQ ID NO: 13891 - DNA, 121 bp, Artificial Sequence
  Synthesized
  misc_feature (61): n=t or c
ataaattgcatggatgacaaactggaaaaatgagaaaggtactgttctggaattcctggtnttatgagacatttggcaatgaggcagtgttttggtccgtaagcaataagaactctgtcac

SEQ ID NO: 13892 - DNA, 121 bp, Artificial Sequence
  Synthesized
  misc_feature (61): n=a or g
tgcttttgctcttaagtatatctgtcctgggtatttgtggttttctgtacaaaaagcaatnattttaagggcttctatgttctggcctcttgccttgcacttcactatatgggttagtgtt

SEQ ID NO: 13893 - DNA, 121 bp, Artificial Sequence
  Synthesized
  misc_feature (61): n=t or c
atcttcttcaatggtataaccttcagaacagcctgacacatatgactgctctggtctctcngtgaagacaagatattttgatagtatctcttcatcagtaatgaaaaatcctagttctggc

SEQ ID NO: 13894 - DNA, 121 bp, Artificial Sequence
  Synthesized
  misc_feature (61): n=c or g
tcaagaggtagagcttgtggttggttctctccatcaaagagctgcctcttctacccagggntctccattctgaccatggctgtgcctctggcactccaggagcacgagggaaatgctacat

SEQ ID NO: 13895 - DNA, 121 bp, Artificial Sequence
  Synthesized
  misc_feature (61): n=a or g
gtcacacttccaggatagaaataaaacatgtgatacaatgaacacagacttcaatatgagnttccacatgctctacaatctttttcattagtagcttgcagaatcattgtttgtgaggaaa

SEQ ID NO: 13896 - DNA, 121 bp, Artificial Sequence
  Synthesized
  misc_feature (61): n=a or g
aaatgcatactaaacttcccaataaaacgtttacactctaaattttgaccaaaggttatgnaaattgttccagctaacaaaaccccggcatcattctgatgagctgaaggtgaggcatgac

SEQ ID NO: 13897 - DNA, 121 bp, Artificial Sequence
  Synthesized
  misc_feature (61): n=c or g
aatgtcaattttccttttctgttactttatttctaattgcgtatttctatacgtggggagncaaatgagacactctaccaccttttcaaatacttttattaatctctttacctttctctcc

SEQ ID NO: 13898 - DNA, 121 bp, Artificial Sequence
  Synthesized
  misc_feature (61): n=t or g
aatatcagaccacggtcatttggtttgaaggctgagaaatactttgtgctaagcaagtcanattggagccctgtcaagtatctttaaatgattactgagttttaatagatgccaaaactta

SEQ ID NO: 13899 - DNA, 121 bp, Artificial Sequence
  Synthesized
  misc_feature (61): n=t or c
acacaattagggaaaaaaatgtaatattgaaaggtcgattatgagaaaggggatcttgttntggaactgaatccttttattatttctgtcaatgactacattacatggaatcatggcagtg

SEQ ID NO: 13900 - DNA, 121 bp, Artificial Sequence
  Synthesized
  misc_feature (61): n=c or g
cccctggtaggcagtcatagaaatttttagcatagggatttctgagaacagttttctttgnttcacatttggtctgtagaagagacaaaaagagtcatctccctctttgcctgttcttgtt

SEQ ID NO: 13901 - DNA, 121 bp, Artificial Sequence
  Synthesized
  misc_feature (61): n=a or g
tattcttctttgctggttattcattaactgtcaggatacttgctgatacttgcccactacntttttatcagtgtattttatttcccttttaaaaatcacagctatgaggaattcacaaact

SEQ ID NO: 13902 - DNA, 121 bp, Artificial Sequence
  Synthesized
  misc_feature (61): n=a or g
aaacataacaaaacaaaacaaaacaaagtcgccatctctgcagtatattcttagcaagctntaagatgagagctgatctgctagcagtcatgtagcacattaattttacctgctcttcctt

SEQ ID NO: 13903 - DNA, 121 bp, Artificial Sequence
  Synthesized
  misc_feature (61): n=t or c
ggaatgtaatatattgtaaatacctgaaaattcttgagagaaataggcattttgtcatgangttttctgctctgccagagttgtggttcccatgacagtgaaaggatccaaccctgagccc

SEQ ID NO: 13904 - DNA, 121 bp, Artificial Sequence
  Synthesized
  misc_feature (61): n=t or c
gggaacaaccaaatgcgtgatgtttaaagcacttaaagcatcccctggatgaacagtctancaccaaccaacactttcacaagttttgtttatttgttttaaacaaagcagtgatgtgggg

SEQ ID NO: 13905 - DNA, 121 bp, Artificial Sequence
  Synthesized
  misc_feature (61): n=t or c
agctgtggggtgcagctcacccagcccagtgggacacatctctgagacacagcacgctccngatccatttatcagcattaaaaaaaccccaaaggctcaaatgtgggggatttggccacgg

SEQ ID NO: 13906 - DNA, 121 bp, Artificial Sequence
  Synthesized
  misc_feature (61): n=t or c
agcttgcccacgagctgggatgtaatgacatgggacacactttgcaaatgcatctgtcttntggcctaacggcagccacattgtatagggtgcaattaggaggtcacagaaatgctgtcac

SEQ ID NO: 13907 - DNA, 121 bp, Artificial Sequence
  Synthesized
  misc_feature (61): n=t or c
atactaaaatgaacaaaaatgatgcagttggcaagagattaacatagactatatagcaganggtgggacctcagtggtgcctcgcacaagaatggatgatatgcttgccaaaaggcagcaa

SEQ ID NO: 13908 - DNA, 121 bp, Artificial Sequence
  Synthesized
  misc_feature (61): n=a or g
aatcaatcggccttatgctcagaatacataaaaatacccagacctttctgtcagcatcagngtgtggatgggacaccacagcattgaaaggagggtgggaggagaaacacagcagtgggag

SEQ ID NO: 13909 - DNA, 121 bp, Artificial Sequence
  Synthesized
  misc_feature (61): n=c or g
aataaatgttgctgcgagattctttttttcactggtgtaacaacagtgcgttaagccattntctttttggggagatactaaatggatactggggaagaagttctcataacaatcttagaaa

SEQ ID NO: 13910 - DNA, 121 bp, Artificial Sequence
  Synthesized
  misc_feature (61): n=t or c
ctttgccattttagctgatcgctccccacacttccatcttccatccttcctattctagacnatgttgtgtcactactctttgctggtagaaagccgcactatgctgtgagtctatgattat

SEQ ID NO: 13911 - DNA, 121 bp, Artificial Sequence
  Synthesized
  misc_feature (61): n=t or c
cactttttagagatacagaaaaaaacagaggccatttcagggacatatggagggaacatanagcacatattccttaagtaaaatatttgacctatacaaaatcaaaatgatcttcttctgt

SEQ ID NO: 13912 - DNA, 121 bp, Artificial Sequence
  Synthesized
  misc_feature (61): n=a or t
cctgggaaggctttgaagcaaagcgccccttgtcacctctgctcacctacaatgagccttntggtttagcactgaaatgaaaccatctggaaaaaaatctcccagtaaagcactcctcata

SEQ ID NO: 13913 - DNA, 121 bp, Artificial Sequence
  Synthesized
  misc_feature (61): n=t or c
aaatgtgaactttaagaacagagtacttaagtgtaagtagctccatgcattctctatgcangtcaagtcattcagtgccaaggtgaggcttaagggtggtgatgaggtgagctacagaaga

SEQ ID NO: 13914 - DNA, 121 bp, Artificial Sequence
  Synthesized
  misc_feature (61): n=c or g
tctcctttctgaagtcccttaatctattaacgttcttcttgcattgcacatgtgaggccangacacttctaaaccatgaccagttaaagactttgtcctcgacatgcaaagttgccacaca

SEQ ID NO: 13915 - DNA, 121 bp, Artificial Sequence
  Synthesized
  misc_feature (61): n=t or c
tctaaatagggcacaaaataaaaactggagctaggcagagtttttccaatgaaaacgtttncaagctgtgattgtactccaactagcatccgaacaagtgcattactacagcagctacacc

SEQ ID NO: 13916 - DNA, 121 bp, Artificial Sequence
  Synthesized
  misc_feature (61): n=t or c
caaaatttacttcaactaactcctgtctgagcaatggaaggtttctggagtattatgcaangggtaatagtgtatgtcttgcagtaagttatattctagctcaagcaagatcaatcaagtt

SEQ ID NO: 13917 - DNA, 121 bp, Artificial Sequence
  Synthesized
  misc_feature (61): n=a or g
aagaatgtaaataaatgtgttgccaagcaggctgattgcaaattaaagatttgctgaatcngaatatactggtaatgagtaggcttagttgaagagaaaccatgctttgtttcgagcagaa

SEQ ID NO: 13918 - DNA, 121 bp, Artificial Sequence
  Synthesized
  misc_feature (61): n=a or g
ttcccacctgcagttctcagactcagagtgtgccaaaaaggctttggaacagctcaatggntttgaactggctggcaggccgatgaaagttgggcatgtaactgagcgcactgatgcttcc

SEQ ID NO: 13919 - DNA, 121 bp, Artificial Sequence
  Synthesized
  misc_feature (61): n=a or g
tgacagttcagatactcaccttagtctcactgtcatttagctcaattggagtaggatgcangcaagatattttccaaaacttagaaagtgagaaatttactctgatactgctatgtctgaa

SEQ ID NO: 13920 - DNA, 121 bp, Artificial Sequence
  Synthesized
  misc_feature (61): n=t or c
cctgctgccacccacccacagctgactgtcccgaaaagcacctgagcattgagatgtctgntgaatgtcatttctgtattaacttgcacacatctctatttcaatccctgccttcccatgc

SEQ ID NO: 13921 - DNA, 121 bp, Artificial Sequence
  Synthesized
  misc_feature (61): n=t or c
atatggtcttaacgtgcaagtttcttaataaaaaataagagcttgatctgtaggattccangaaaagtggtcagtatgtctttttacttcgatgaggatttaactgtgccctttctgagca

SEQ ID NO: 13922 - DNA, 121 bp, Artificial Sequence
  Synthesized
  misc_feature (61): n=t or c
tccttgtatcaggaacacgtctgtctgcttctgatacatggagcaaattgaccccaaatanagccctggactcatcggtcgttttccctgggagcagtaaataaggagcagggctgagaag

SEQ ID NO: 13923 - DNA, 121 bp, Artificial Sequence
  Synthesized
  misc_feature (61): n=a or g
gaagtcagttttctggtaagggaaaacatcagagcctgcagagtttgaaactccgtgcatncactcagccaacctgcacgtcacagatgttttctgtctgtggaaagccagcactgagctg

SEQ ID NO: 13924 - DNA, 121 bp, Artificial Sequence
  Synthesized
  misc_feature (61): n=a or t
catcacaattaactttctttgtcacgatcttcacaaactgagttgtcagagaagtaatacnttaactaagcaggtttatggggagatttttgcactgtgcctgttctatgtctgtactaat

SEQ ID NO: 13925 - DNA, 121 bp, Artificial Sequence
  Synthesized
  misc_feature (61): n=t or c
actaacacacaaacaaatactactttggtccatccaggcatgctcagagtccagagtttcnacattggcagctgctaccttttcttaagattaggttgtaaatctgtgccttcaacagatc

SEQ ID NO: 13926 - DNA, 121 bp, Artificial Sequence
  Synthesized
  misc_feature (61): n=a or g
aacaaggtcaggggacagtagctactgccaagagaaattcccagaagcagaacagcctacntccaacaatattcagcaatccttttagctacttgatttgtttctcttctattactactat

SEQ ID NO: 13927 - DNA, 121 bp, Artificial Sequence
  Synthesized
  misc_feature (61): n=a or g
gttcccttttctgtcctgtactttagtttttttcccattggttccctactaccaaagtcanaactgcatgtctgtgtttttcatagatatttcctagatatctactgaaatgtcagtaagc

SEQ ID NO: 13928 - DNA, 121 bp, Artificial Sequence
  Synthesized
  misc_feature (61): n=a or g
aattgcaaccatatgtccacatagtagaactacttttaaagtgtagttctttttgttgttnttgttgttaactgtcaccagagatgaaagggaccacagaacaataaggaattgattaacc

SEQ ID NO: 13929 - DNA, 121 bp, Artificial Sequence
  Synthesized
  misc_feature (61): n=t or c
ggctttgcttggaaaggggaacatgcaaaaccttcaggaaaatcccagcctggcaaggaangccagtttgggtgtaactctgagcccatccaaagggaagatctccgcgtggaacagcaac

SEQ ID NO: 13930 - DNA, 121 bp, Artificial Sequence
  Synthesized
  misc_feature (61): n=a or g
aacttatattcagagtaagtaggcactaatttaattccactgggtgctttggaatgccaanccttgtcactcagagaacttgttacaggaaggcattatgctaattgttaaaagaaattaa

SEQ ID NO: 13931 - DNA, 121 bp, Artificial Sequence
  Synthesized
  misc_feature (61): n=a or g
gcactcactatttgtcttcactttacctcagatttatatttgggcaaatgggtgcacacanaagtctcatacatctggagctttcgtaggaggcaaaaatcaatggaggatatgttgaagg

SEQ ID NO: 13932 - DNA, 121 bp, Artificial Sequence
  Synthesized
  misc_feature (61): n=a or g
ctgtcagatttcactcttctgcaatgcagaaaattaagcttgataatatctgcagtttcanatctcaaatttcatcctaccaggtatcattcttcatcttctacgtcttctatgcacttct

SEQ ID NO: 13933 - DNA, 121 bp, Artificial Sequence
  Synthesized
  misc_feature (61): n=t or c
cacttacagagatgctcaagaccaggtgggttggacactggaccacctgagttcttgattnagcgggtggcagtgagcccatgactctgggttggaactggatgggctttgaggtcccttc

SEQ ID NO: 13934 - DNA, 121 bp, Artificial Sequence
  Synthesized
  misc_feature (61): n=t or c
agaataacaaatgagaagtcagtctttgtacataatgcaccaattatgatactcattcctngtggtggtcatgtattgtcttacggtacttttgcctttggagtgggattctaatatattc

SEQ ID NO: 13935 - DNA, 121 bp, Artificial Sequence
  Synthesized
  misc_feature (61): n=t or c
aggaaaatcaccactagaggaaaagactggccactcctttgtgggaggtgatggtggcttncctctgttgattattgaaggcaatgtgttttgagtttgatggttttcagtgcaagtcttc

SEQ ID NO: 13936 - DNA, 121 bp, Artificial Sequence
  Synthesized
  misc_feature (61): n=a or g
gcagctgcagctcaccatgtgtttgaaggcgttctcaatggcaccgatcaccaggctctcntgggaaaccgccttctccaggtggaagcgtggcagagcatcattggggacctccccgttg

SEQ ID NO: 13937 - DNA, 121 bp, Artificial Sequence
  Synthesized
  misc_feature (61): n=a or g
gccagaaatttaaaagcaaggagtgctaaccagggagaatccatgcctcttcttcagtatnaagttattcttttcatagtctgtttctgagactcagtagtggtgacacagcaggtaagaa

SEQ ID NO: 13938 - DNA, 121 bp, Artificial Sequence
  Synthesized
  misc_feature (61): n=c or g
ttccgctgcatgcactagatggctttactggtgccatcacaaaaggtttgcacaaaagatncagcctcaggtcactgtctccagcatgcagacaacagtacctcagcttatttggggatct

SEQ ID NO: 13939 - DNA, 121 bp, Artificial Sequence
  Synthesized
  misc_feature (61): n=t or c
tggtgtgaactcctgacttgcttggataccatacatcccattgggccattctgaacacctntgtgctgatgaatgttacaaacagacaacctagattccttgaatagggccaaatcatgct

SEQ ID NO: 13940 - DNA, 121 bp, Artificial Sequence
  Synthesized
  misc_feature (61): n=a or t
aatttattcctgcaaacatgcttatgccactacagtagccaagaaacttcaaaagagactngatatgctgatttggcattcctcttacaataggtagtgcatgaggcattcatttaacaag

SEQ ID NO: 13941 - DNA, 121 bp, Artificial Sequence
  Synthesized
  misc_feature (61): n=t or g
tccggctgcaacacatcccagggacagaaaccgagcaactagagatggttcttaaggtctngtttcttcatgcactaccgagcatcccactccactcctgtaatataaagtccaatttaag

SEQ ID NO: 13942 - DNA, 121 bp, Artificial Sequence
  Synthesized
  misc_feature (61): n=a or g
catgcaattttttaatactaactctcttcaaatctacctattttgggacacgtgactagcnaataccaccaagcctagggctcatctgttgtaagcttgccttaccacctcaaaagtagag

SEQ ID NO: 13943 - DNA, 121 bp, Artificial Sequence
  Synthesized
  misc_feature (61): n=t or c
agacaatttctattactgcttttaattatggtaaacatattcgagtgctttttgcagtcantgctttttccttaagccacctataaacccctgctctatttttcttcactgtctttcttgt

SEQ ID NO: 13944 - DNA, 121 bp, Artificial Sequence
  Synthesized
  misc_feature (61): n=a or c
tcagttatttactcaatagatgagtaaacgaagacagaaatccagcaggtagtataaccanagagcatacaaaatccagccctctcctatctaccaatgactgaaaagctttttgactttt

SEQ ID NO: 13945 - DNA, 121 bp, Artificial Sequence
  Synthesized
  misc_feature (61): n=t or c
aattaattactattttaacattcttctgctacttcttggaacttcctattctgtttcattnatattaaatttacaatcaactaatattctgactacttgacaaggaactgcatgattataa

SEQ ID NO: 13946 - DNA, 121 bp, Artificial Sequence
  Synthesized
  misc_feature (61): n=t or c
atgtaactgatcatatttaaacctagtgaccaaagatcccatttgactggttacatagcancagttcacatcttgtaagtttagaacataattcctgtaacacatgacttactgacaccat

SEQ ID NO: 13947 - DNA, 121 bp, Artificial Sequence
  Synthesized
  misc_feature (61): n=a or g
ttcaaacttccccctccattcctctctgtagtggatgaaaagctggcagtggtgtaaaacnaaggttaaatgcctctactccaatcaggaaaaaaaaaaaaaaaaaaaaagcccttgggaa

SEQ ID NO: 13948 - DNA, 121 bp, Artificial Sequence
  Synthesized
  misc_feature (61): n=t or c
tgtctggatggccacttggctgaagatttcgttgcacagagccttgttgttcaaagctctnccagcaatgtagttgcccagaaggacctcctgccagtcatggagattcctgtcaccaatg

SEQ ID NO: 13949 - DNA, 121 bp, Artificial Sequence
  Synthesized
  misc_feature (61): n=t or c
tctgtttctttctgtctgatctaatagaagaaggcaatctttacaatcagaaagcactttntggcatttcccagcatgaggttttgtaggctgttgagaaggaggcagatatttcaagttg

SEQ ID NO: 13950 - DNA, 121 bp, Artificial Sequence
  Synthesized
  misc_feature (61): n=t or c
cagtgtgatggggctttttgtctctcctctcaatgggattcacagcacaatatcagtgtgnccttggcttctaagtggtctgtagcagctccaggatgtatgaagcaactgggaatgttga

SEQ ID NO: 13951 - DNA, 121 bp, Artificial Sequence
  Synthesized
  misc_feature (61): n=t or c
tagcatttcttttactgcacacttgtgtatctggttggttgagcttttaaaaggcagtttngattcagtcatcaaactgcaaatctggaagttgtcagttatatgcacacctttgtaggac

SEQ ID NO: 13952 - DNA, 121 bp, Artificial Sequence
  Synthesized
  misc_feature (61): n=a or g
gtactgcatagctgtgacattccaagcacagcatttagcataggaaaagatgctgttagcntgaaggctgctgttaaaccaaatacacgagcaactaaactttagtttagcatgaagatta

SEQ ID NO: 13953 - DNA, 121 bp, Artificial Sequence
  Synthesized
  misc_feature (61): n=t or g
gatgcaatgccatgcttcagaagctgtggtgctccaagtagttgtaagcatgcctactcangaatgtctaacatgctgcttcattgtattatttagacataatcagaatgaatcatcagaa

SEQ ID NO: 13954 - DNA, 121 bp, Artificial Sequence
  Synthesized
  misc_feature (61): n=a or c
acgctattattatgggcacaaacttggatttcctctgacaatatagtccataatgtttcangaggtagaacttctaatgctgtatctaacactgggaagctttgttctctgcagtggtatt

SEQ ID NO: 13955 - DNA, 121 bp, Artificial Sequence
  Synthesized
  misc_feature (61): n=t or c
cagcactaacaatggctttgctgtcattctagataatatttcagacttctacctgatgcangggatgtttttcttctctctgttcatccgcctgttctttatgttctttttttctgttctt

SEQ ID NO: 13956 - DNA, 121 bp, Artificial Sequence
  Synthesized
  misc_feature (61): n=t or c
acttggagtacttacagccaatcagcttcaaaaccagtctcatccacacgcagagcactgncaatcacaggtacagctgtcggttccatcacggagaggaaaaccaagcagttctgagaat

SEQ ID NO: 13957 - DNA, 121 bp, Artificial Sequence
  Synthesized
  misc_feature (61): n=t or c
tcttcccttgatgctcacgtagaacctttttaaatagatgttttaggcaaataaaaattantggactccattaaaggtgaagtagtgaaatgatctgaatgccaaataggatgataaaact

SEQ ID NO: 13958 - DNA, 121 bp, Artificial Sequence
  Synthesized
  misc_feature (61): n=a or c
cggctcagaaaggacatcaatacaccaagagcccagtggttgcatcttcacacagtagagntgaagctccaagggacctgggtggatggttttttttggcttttggtatgtttgctaacaa

SEQ ID NO: 13959 - DNA, 121 bp, Artificial Sequence
  Synthesized
  misc_feature (61): n=a or g
atccattatctggctgctacatcaaggttacctttggcaaccctggcattcaacgcctttntatgtgaacattaaatgcccagttcttctatctgattagagagagaaaagaattctgaag

SEQ ID NO: 13960 - DNA, 121 bp, Artificial Sequence
  Synthesized
  misc_feature (61): n=t or c
gggtgtggagtcacggctgaggcacagcagttctgtgcagagaaatagctgagaactctcngtgatcaagctcaggtactagaaacagccttcccaggttaacatgcactgtgagtaaaaa

SEQ ID NO: 13961 - DNA, 121 bp, Artificial Sequence
  Synthesized
  misc_feature (61): n=a or g
gtctcagccaagttctgagctggatatatttactctgtctgcctaaatcccctctagcagngctagggaaggtcatctccataaggtactattgtgtcagcattgtggggctgggttatgg

SEQ ID NO: 13962 - DNA, 121 bp, Artificial Sequence
  Synthesized
  misc_feature (61): n=a or g
tgtggaacatgtgggcaggggggaagcacgcatgcttttaatattcctgtaataaaacaanggacttcttgcagaacagcagataaaaaaaatgatttctagagctggaaataactgttac

SEQ ID NO: 13963 - DNA, 121 bp, Artificial Sequence
  Synthesized
  misc_feature (61): n=a or g
gaaacaaggaaggaaaggaagtggatcttcactggttcctcgcacactagagacacagagnagactgcaaacatatttctgccagctgcaaaatagggtaataattgagaggaacccagaa

SEQ ID NO: 13964 - DNA, 121 bp, Artificial Sequence
  Synthesized
  misc_feature (61): n=a or g
cagctaaactacttaaattacagcacaggagctgtaaacaaatttagctctggaaatcaangtaccagaatttttcaaattgtactgttttacattgttcacaacatttaaaatgaattaa

SEQ ID NO: 13965 - DNA, 121 bp, Artificial Sequence
  Synthesized
  misc_feature (61): n=a or t
atggggcaggacccagaggagaggacatgggaggaattactgctcctctcccacttgattngttctgggagtgaaacgttgtgtgtatccaccagttgcgactaacctcggtcattaagtg

SEQ ID NO: 13966 - DNA, 121 bp, Artificial Sequence
  Synthesized
  misc_feature (61): n=a or t
gggttactgcagacgccacaaagcagagaaaacacagccctgtaatgctgaggctcctgcnatgagaacacataatccgcaccttaccgcctaaccagacatgcaaaagctgctgacatgc

SEQ ID NO: 13967 - DNA, 121 bp, Artificial Sequence
  Synthesized
  misc_feature (61): n=a or g
aaaatatttccagcagttcattaaaattcccatctactagctctgaaatctaatcatcaanaaaaaggctgatgttaaggagaattaagtacatttctcacaaaccatttgataaaaacac

SEQ ID NO: 13968 - DNA, 121 bp, Artificial Sequence
  Synthesized
  misc_feature (61): n=a or g
cagtagagacaaagggaaaaaagatgtaactgtagcttgtgtaatagggctggaaggctgntcttgatcataagctgtgagatcattgtaaaatcacaagcatgtaactattagggcacat

SEQ ID NO: 13969 - DNA, 121 bp, Artificial Sequence
  Synthesized
  misc_feature (61): n=t or g
aacaatttgcatccctgacttatcccaagagcttgggaagcaaacagagacaacaaggagntaagggtttgctgaataaaaatgtaacagtgtggggaagatgctgagctctgctctctgg

SEQ ID NO: 13970 - DNA, 121 bp, Artificial Sequence
  Synthesized
  misc_feature (61): n=a or g
tctctgataataaaattttatacagtaatgtgtaattcatcactgtcttaattttctgacntggagacacagctaagataaataatacccagccttttgattacgttcccatttcagttga

SEQ ID NO: 13971 - DNA, 121 bp, Artificial Sequence
  Synthesized
  misc_feature (61): n=t or c
ttcctttgactgttctgttattttcttctattttctcagctctgaatagaagaaaaactancactctctgctagtagcaggatgtagcgctgcccgtgctcacttaggtatcagcaattgc

SEQ ID NO: 13972 - DNA, 121 bp, Artificial Sequence
  Synthesized
  misc_feature (61): n=a or c
ctgtttgctattgtttgttttgtgtcttttttcctctgacttcttgctgtcatttaatttnaagggcaggctttgcacttacactcacttaaggaaaacgctctaaagagctcagtatgct

SEQ ID NO: 13973 - DNA, 121 bp, Artificial Sequence
  Synthesized
  misc_feature (61): n=t or c
tagcacccagaataaatctgtaacttctttgtttagtttacaactcttttcctgaagtttnatttagagagcataagattgcaggcaaagccagaagaatgttgtgcatacttcagggcag

SEQ ID NO: 13974 - DNA, 121 bp, Artificial Sequence
  Synthesized
  misc_feature (61): n=c or g
gtagcatcttgcaaaccgcaaataccgttaaccggctcggacgaatctgttacgacagatnctggaagacatgccgactacagaacttactttttctttctaattttttttaataaccact

SEQ ID NO: 13975 - DNA, 121 bp, Artificial Sequence
  Synthesized
  misc_feature (61): n=a or g
tcccatctgcagaagtgctctctttgttattaaggtgcactgttgggtgtatgtgaggggngaatgggtttccttcaccttcctggttcttgctagcaagaaaatctggatctttgatgaa

SEQ ID NO: 13976 - DNA, 121 bp, Artificial Sequence
  Synthesized
  misc_feature (61): n=t or c
ctgattctttttctaatagatgattatttgtgcttttattacacatccctttaatgctaangcaaccttcagtgaacaatccaatgttaagaactaatgaagagtaacttactggactttt

SEQ ID NO: 13977 - DNA, 121 bp, Artificial Sequence
  Synthesized
  misc_feature (61): n=a or t
ggaaatttttatagtataccacgaacttgatcaattaagaatacattgagcaattacttanaactcccaccctcaatgccaataaggaaactggacttattcactgatgacagaaggctcc

SEQ ID NO: 13978 - DNA, 121 bp, Artificial Sequence
  Synthesized
  misc_feature (61): n=a or c
tgcattagagcaggtaaccaatatctctctgtgtttacagaataaatagttgtggcaagtnactgcacaaaaataccttttcacactctcacacattctctctcacacacacactctcctt

SEQ ID NO: 13979 - DNA, 121 bp, Artificial Sequence
  Synthesized
  misc_feature (61): n=a or g
aaagggctgaaaggcatttgggactgcagagcttgtgaataactggaaggctgcccagganatcagggatgtatattgactaagagagagaaaacaagtcggcgtggatggaagctgaaac

SEQ ID NO: 13980 - DNA, 121 bp, Artificial Sequence
  Synthesized
  misc_feature (61): n=t or c
gattgcagggcggcctcaacacttaattgcagagcagtgaatctgtgtgcgtggcctgtanaaagtgatgctggttagagaaagaccaactgatttcccacagtggactcttaagaacaat

SEQ ID NO: 13981 - DNA, 121 bp, Artificial Sequence
  Synthesized
  misc_feature (61): n=a or c
accttaaacacaagacaattaaagaaggagccagtctttctgattaatctttggaaaagangttgctttactggaatgcaacacaacaggaaatatccttctgaaactgcaggtaaagaga

SEQ ID NO: 13982 - DNA, 121 bp, Artificial Sequence
  Synthesized
  misc_feature (61): n=a or g
ctttcagccctttgtgatgtccagtggttgaggagaacaaatcagaagtcctggagcccantcaaattgtgtttcctgaaatgaagtgcagcacctgaacaagtaaaagacagtgaaagta

SEQ ID NO: 13983 - DNA, 121 bp, Artificial Sequence
  Synthesized
  misc_feature (61): n=a or g
tggcagttgccctatggagtagcagtaaaagccgtgcttcatccagccctaccaatgcaancaacagatacacaaggggaactgtcagactgcccagcacagagctcttctaaaagccacg

SEQ ID NO: 13984 - DNA, 121 bp, Artificial Sequence
  Synthesized
  misc_feature (61): n=a or g
tcagcagtgaaaatacctaagatttttagggagaagaggggcagacatgctacagaaaaanaatgcaattgctactgtgccagctataactgtgtttcattctcttattggtgaggtactt

SEQ ID NO: 13985 - DNA, 121 bp, Artificial Sequence
  Synthesized
  misc_feature (61): n=t or c
tttttttttcccagtgaatttttttgttgttgtttctttccctaaaaacttaaacctttgnctcaacagttatattgatagtctctggaaagtactgctagctctcatagttctccttagc

SEQ ID NO: 13986 - DNA, 121 bp, Artificial Sequence
  Synthesized
  misc_feature (61): n=t or c
tggcattgagcttgcttgcttgcaacctctttccaaatatcaggaaagtatgtgaaatagngggaacatagtgaactgaaacatttgaacagtaaacaatccaagttgccacattggctga

SEQ ID NO: 13987 - DNA, 121 bp, Artificial Sequence
  Synthesized
  misc_feature (61): n=t or c
tgatatttgattggcttgtcagagtgagataaaagtgcacacagatgttcttttatgcagncttattatgtaaacaattttaagttgaaaaacagtgggaagtattttgcttctttatttt

SEQ ID NO: 13988 - DNA, 121 bp, Artificial Sequence
  Synthesized
  misc_feature (61): n=a or g
tcagcccatgtggttttgagatcgttattctggatgactaactcagctcacgtgttatacngagttttggttctgaacttaaggcttctgcaaataccccgttagcaactaagcttctgta

SEQ ID NO: 13989 - DNA, 121 bp, Artificial Sequence
  Synthesized
  misc_feature (61): n=a or g
gtatgaacattcaggaatgaagcacctccctgtagggcaacaactctgtccgccctcactntttcatccaaactaggaatagaactggtctcatgttaagaagttttagtataattcaaat

SEQ ID NO: 13990 - DNA, 121 bp, Artificial Sequence
  Synthesized
  misc_feature (61): n=t or c
ataagaaaatttaggtgttctatacgattattgaatgtatttaatcctttgagaaaacaantgaatccctgccctttgaaagagagctgaaccataggaatagccaacaaacggcagaaaa

SEQ ID NO: 13991 - DNA, 121 bp, Artificial Sequence
  Synthesized
  misc_feature (61): n=a or g
ggggcaggtgggacgagatgggaaaccaccttccactgaaggcttcaccagagagcacagntgggtcctcctggtcacaaagtgggcaccacagagcagcaggagctgccaaggggtcgag

SEQ ID NO: 13992 - DNA, 121 bp, Artificial Sequence
  Synthesized
  misc_feature (61): n=c or g
cctggtggccttccagagcccagctcctgagtaccacacatcttgcgtgtagggatcaagnaacacagtgctccttatccataaggaaaggaaaaagcactgttcaatccctgaacatgtt

SEQ ID NO: 13993 - DNA, 121 bp, Artificial Sequence
  Synthesized
  misc_feature (61): n=t or c
taccacacttaaaagttctccagtaacaacaccagtaaagtgcatgcacgtcaaagggtantgcacactatcttgacagaagatcagatagatagatggatggataaatagacagtgtgca

SEQ ID NO: 13994 - DNA, 121 bp, Artificial Sequence
  Synthesized
  misc_feature (61): n=t or c
ttgtcatgcttcagctcaggctgggcaaggttcaggaacaaaacccagttaagacagacangctttgcctgcacacactacaacatgtgcagggtgtgtcttttttatactaaataaaggt

SEQ ID NO: 13995 - DNA, 121 bp, Artificial Sequence
  Synthesized
  misc_feature (61): n=a or g
atattaaatgctttctgctgttaaaaaaacactagattcttattgtgcctgacccacatcngacatgttttagaatgtcaacactttttcaagcaaacctaggactaatattacactgaac

SEQ ID NO: 13996 - DNA, 121 bp, Artificial Sequence
  Synthesized
  misc_feature (61): n=t or c
aagaagtggaagcttgtacagcccctcgcaccaggtggtacaagaccttctttaagagaangattttaataagattaattcgattctaaaataaacaattgcagccttgagcctttcttct

SEQ ID NO: 13997 - DNA, 121 bp, Artificial Sequence
  Synthesized
  misc_feature (61): n=t or c
attgggctgatgatggctgggaaaagctagcctgttacataaaatgttagatgaggcatanatgcaaagtaatatattttcaaatgtaatttattgttgctgttgttttgttttgtttgtt

SEQ ID NO: 13998 - DNA, 121 bp, Artificial Sequence
  Synthesized
  misc_feature (61): n=t or c
gttttgaaaatcttcattgtttaacacatgagcatatgtctcactatttggtttagccagnattatgcatattgcagcaaaggttaatatattaggttcagttgtttctcttggataacaa

SEQ ID NO: 13999 - DNA, 121 bp, Artificial Sequence
  Synthesized
  misc_feature (61): n=t or c
ggacctaggattggctcagcaagaaacatggtacaggaagccaggaaagcgcagacggaantggtgagatagcacaaaggtaaagagaggggtaacaacaggttggagggagtggggcaga

SEQ ID NO: 14000 - DNA, 121 bp, Artificial Sequence
  Synthesized
  misc_feature (61): n=a or g
ggaggtgagttagcagcacggctccgcgtggggcttggcactgggtcggtccctgggcacnctgtgggattcagcattgctttggtggaggggaagaaaaagctattttggcacgtgggca

SEQ ID NO: 14001 - DNA, 121 bp, Artificial Sequence
  Synthesized
  misc_feature (61): n=a or t
gtggaatctgggttgttttgaaagtagagggaattacagcaggatttttactaaaacaatnttaccacagctatgataacatttattttcttcagttctggcatgtggcaacataatgaat

SEQ ID NO: 14002 - DNA, 121 bp, Artificial Sequence
  Synthesized
  misc_feature (61): n=a or g
aatccatgtgtgcgaaggctggagcagaagccagtgggttgttctgcagtttgttccattngcttggcagtctcaggctgagcaccactgtgccccactcagcactctgttccacgagggt

SEQ ID NO: 14003 - DNA, 121 bp, Artificial Sequence
  Synthesized
  misc_feature (61): n=t or c
ggctggcctgtcttctaggagtttgtatgttttctaaacctctcttatttctgatttccgngatagactgtgacaatgaattccacagtttggctatctattggattttggtttttacgct

SEQ ID NO: 14004 - DNA, 121 bp, Artificial Sequence
  Synthesized
  misc_feature (61): n=t or c
tcagcagaaaatgccccacagaaagaaatccagattgacttaaagcactggtatggcactntgcaggttcaagttcattttttctagaaagcagtcccatgaacaccctgatcttaacctg

SEQ ID NO: 14005 - DNA, 121 bp, Artificial Sequence
  Synthesized
  misc_feature (61): n=a or t
aagacacagaaatgtagctttcacatccctagcatggagatttgtgggtataagatataanatattgtcttctatggacagtttcaggtgccacatcctccttccccatcaggcttctctc

SEQ ID NO: 14006 - DNA, 121 bp, Artificial Sequence
  Synthesized
  misc_feature (61): n=a or g
tgggagcatatttaggatattctgtttacattttggttcattgttgagctctggacttcantagataaggctttgtgttgaagtattttgttgtgcagttaaaagctatatatgtagaagt

SEQ ID NO: 14007 - DNA, 121 bp, Artificial Sequence
  Synthesized
  misc_feature (61): n=a or g
tccttttctcccattattcttggcaggttggttggcatcatgagtcctggctcagccatgngagggacatcgtccttagtgggagcacctctcaacacacagatgcaaatttgcttctgtt

SEQ ID NO: 14008 - DNA, 121 bp, Artificial Sequence
  Synthesized
  misc_feature (61): n=a or g
gatgttcttaaatgatgttaggtgttcttttaatgaacagaaaataagattattaattaanacaaggctagtcaatcattagtgcaagaaaagaaagtgtaaattgttttgtttttttcct

SEQ ID NO: 14009 - DNA, 121 bp, Artificial Sequence
  Synthesized
  misc_feature (61): n=a or t
ccttcccacaatacaggagaggttatgcatatgcacttctctgagtctacaggaatatccngtaaaatgtgattcagtaccttgtgaatttcctaaggtgtgttttttttgtttttttggg

SEQ ID NO: 14010 - DNA, 121 bp, Artificial Sequence
  Synthesized
  misc_feature (61): n=a or g
tagcgaactggattttgttcttaggatttgtggcagagatgagtacattactggagacacncccatcaaggattttcactggataagacagtgccttaagaatggggaagaaatccacctt

SEQ ID NO: 14011 - DNA, 121 bp, Artificial Sequence
  Synthesized
  misc_feature (61): n=t or c
atagcagctacaaggtgaaagtgtaagtgcaagttgtacagagtcagctcttatgagattngttaatagaagtgtcatcttcttaaattagttcagtttgtcacacctctctgttaacttc

SEQ ID NO: 14012 - DNA, 121 bp, Artificial Sequence
  Synthesized
  misc_feature (61): n=t or c
gatctttcctcagctcttaatcaccagtaaattcacacaacttcaagatatctttatgttntaggttctcatgcagaattttcagacccagcagcagagcaatacaactccctttggggta

SEQ ID NO: 14013 - DNA, 121 bp, Artificial Sequence
  Synthesized
  misc_feature (61): n=a or c
aaagagaggagaggagaggaaaactgtcagtgcgtgagtgcttaataatttgatagcatcngtacaggtagtaagatcacgaaatttgaatgaaggaaacaaaagagaaaaatatctattt

SEQ ID NO: 14014 - DNA, 121 bp, Artificial Sequence
  Synthesized
  misc_feature (61): n=a or c
cacttaaaacttttcctgcccaggggtgactcaggacacccagaatagctgttacaccaanggtgctgagatctgtgcattcacttctcaagcagtgctgcaacagcaggttaggagtctc

SEQ ID NO: 14015 - DNA, 121 bp, Artificial Sequence
  Synthesized
  misc_feature (61): n=t or g
atgggttcaaatatatgtgaaccttttgtctttaatattacattagtagcaggactcattntactgggaaaatatcaaaactgatgtagcctctcattttaaatgacaattattattgtta

SEQ ID NO: 14016 - DNA, 121 bp, Artificial Sequence
  Synthesized
  misc_feature (61): n=a or c
gatgctgatgggtgaaatcatttgtggcattatccaccacttcaattcacttctgctaaanaatgaaatctactaataaattgaatagacaagcaaaatctcttaaatatgctctggaggg

SEQ ID NO: 14017 - DNA, 121 bp, Artificial Sequence
  Synthesized
  misc_feature (61): n=t or g
aaagtacttttggatattttcgaaggatcttcactatagttaagctggtaccttaattagntgattaagtatcatgaaaactaatccatgttcaaatcattgaagctgagttagaacaaag

SEQ ID NO: 14018 - DNA, 121 bp, Artificial Sequence
  Synthesized
  misc_feature (61): n=a or g
atgcaggtgcataaatacaaggagatgatgacaataaggaaacccgcccaaaaggttcacngtatggatgctacgagatggaagaagcaccatgggtttaatgaatcacaaagtttatttt

SEQ ID NO: 14019 - DNA, 121 bp, Artificial Sequence
  Synthesized
  misc_feature (61): n=c or g
aaactgccttgggattccttccaggaattcttcatagtcttgttgtaaagtcctatcattngtgcatcattggtccccagaattttttgaaaggccaccacgccttcacatgcagacagtt

SEQ ID NO: 14020 - DNA, 121 bp, Artificial Sequence
  Synthesized
  misc_feature (61): n=a or c
ttttgcctgcgctatccaacactctcctccacgacctactggttttggaagggtagcagcngagcatctgggcaacgtcaccttcccagctccaagcggccattgaacagggttacttccc

SEQ ID NO: 14021 - DNA, 121 bp, Artificial Sequence
  Synthesized
  misc_feature (61): n=a or g
tgtaaattcaactctttgtctagccttttcctggttcatgaagctctgtgtgtgagtgatngataaaagaaatttgactctaaactgcattttccttatcctcagtcaggctgagagcaaa

SEQ ID NO: 14022 - DNA, 121 bp, Artificial Sequence
  Synthesized
  misc_feature (61): n=a or g
aaattccttctgaacatttaaaatgttttaaaaactcaacattttgtatttatttgttctngaaaaccatgttcttttcctccagaaaactgtatgcagcagttgttgacatcaccggtga

SEQ ID NO: 14023 - DNA, 121 bp, Artificial Sequence
  Synthesized
  misc_feature (61): n=t or c
ttcgttgctaacattaaaatgcagtgacccttgtatgtatagtaagtattactggtagtancagcactcataaaaaaaatctcaggtaatttacttacaaaagacaataaattaagatgac

SEQ ID NO: 14024 - DNA, 121 bp, Artificial Sequence
  Synthesized
  misc_feature (61): n=c or g
catgcactggcattgtgtagggctacttcagggccatatcctgaactctgtcattctacantgagaaataagtgttccagaacttgcaaatggtctgactggtacttctgtatccattctg

SEQ ID NO: 14025 - DNA, 121 bp, Artificial Sequence
  Synthesized
  misc_feature (61): n=a or g
gtgagccaaccttatatactctgtgtgtcacgtatggaaatcaatgattttcaagcaacantattctctctaaaataatacggtaaataagtctttcaaatgaggctggtaggaaaatggt

SEQ ID NO: 14026 - DNA, 121 bp, Artificial Sequence
  Synthesized
  misc_feature (61): n=a or g
aggaagacttcaaaacatgctcaactctccaaatgtgaagtcccaaagaaatgaacaaaancgactctggtgcctccaaaaattctcaagtcaattttaccacataaagagatgaaacaga

SEQ ID NO: 14027 - DNA, 121 bp, Artificial Sequence
  Synthesized
  misc_feature (61): n=t or g
agatgaggcagatgcatttagcttgggaggaaagaacaggtctggagatatgtcacaaatnatgatttctttgtttaactacttcaagtctgtgggctacttaactgtgcagctccatgag

SEQ ID NO: 14028 - DNA, 121 bp, Artificial Sequence
  Synthesized
  misc_feature (61): n=a or t
tcttgaaaccttacagaagtaattgtgtgcaatttttctaagggtaaattgagtatacagncatgaagactgatagactctagagaaagagaagttgagtagcaggacaaagtccagtgac

SEQ ID NO: 14029 - DNA, 121 bp, Artificial Sequence
  Synthesized
  misc_feature (61): n=a or g
gtagaaagagagttcagagggacactccgcagaacaaatccgccttaggaacagacgagcngattaataggcatagcctcgcctgctcgctcacaacgtgcgtgatgctctcacgcgggat

SEQ ID NO: 14030 - DNA, 121 bp, Artificial Sequence
  Synthesized
  misc_feature (61): n=a or c
agagagacagagtgaggattgcttttgccttgcctctccacatttacgttgaaagagcagnagccaagtaaaccccaaaacagcacacaggacctcatgtttctcttgcaaacaagtctgc

SEQ ID NO: 14031 - DNA, 121 bp, Artificial Sequence
  Synthesized
  misc_feature (61): n=c or g
aaaaggcctagggatgctgaacaggtgagctttcctagcactcttccccagttatgaatgncaggaatgtagctgtgtgtcttcagtaggcaagtaccatggcacacctctcagactgacc

SEQ ID NO: 14032 - DNA, 121 bp, Artificial Sequence
  Synthesized
  misc_feature (61): n=t or g
atgcgtttcatgtgaatagatgtcagaatggcacagtttcaccccttgactaaaccaaacncatttaaatgaaactacatgtattacaatggagagaacattagcagagtatcaaattcag

SEQ ID NO: 14033 - DNA, 121 bp, Artificial Sequence
  Synthesized
  misc_feature (61): n=a or c
tacttttgctctgtctcagaaccattatgcccatttatcacacacaggtaagtgctttccntcagacatttgccaaggttgtcacaacagcagtggtggtgattctcacaatatccaatgc

SEQ ID NO: 14034 - DNA, 121 bp, Artificial Sequence
  Synthesized
  misc_feature (61): n=a or g
gctggaagggcagtctggggctcagctgtcaatgacctgcatatttctgctactgaagcancagcatagctagggttggtgctgaggttctcatctcatgtagtgaaggctatttgctttc

SEQ ID NO: 14035 - DNA, 121 bp, Artificial Sequence
  Synthesized
  misc_feature (61): n=t or g
gaaatggtgactaagccaattaattgttgccagagcaaagcttgcagactctctcaaagtntgagctcaacaataaagcccagcgctcagcagaacagtagaagtccataccgagctggag

SEQ ID NO: 14036 - DNA, 121 bp, Artificial Sequence
  Synthesized
  misc_feature (61): n=a or c
attgattctggtctttatttttagaccttttatgtacttaattcagtgatcattttaatgnaacattgtggtgtaactgcatgaagactgctaagaattttaatagaggacagccttgttt

SEQ ID NO: 14037 - DNA, 121 bp, Artificial Sequence
  Synthesized
  misc_feature (61): n=t or c
gatttctgagagctgaagagtaaaatgcagagtagatgagaagataactttgtgcatctgnagaggtatgtgtatagctgtatttaatgacgaagaggaaagaaaaaaggacagaggaaag

SEQ ID NO: 14038 - DNA, 121 bp, Artificial Sequence
  Synthesized
  misc_feature (61): n=a or g
tttaatcactacctcaaacttgcaatgcaaatactagtcactgagtaccacatcaaaacantaaataagtgcagttttattcacaaatgtattttcctgttttcaacactagtgatcattt

SEQ ID NO: 14039 - DNA, 121 bp, Artificial Sequence
  Synthesized
  misc_feature (61): n=c or g
gattttgaaaaggcaaagatgtaaaaatctcaaaaacttgcactgtacaaagcaacaaatncaattaaaattacacaaagcatgataataagagaggggagggtggctatatcatgctgag

SEQ ID NO: 14040 - DNA, 121 bp, Artificial Sequence
  Synthesized
  misc_feature (61): n=t or c
cataattctttctaggatggaatcgatgtgttctggaggcagatctaaagaattaatctanaggtgtaagtatttggtgtcctaacactgtgaaagcgtattggaaatacatttcatcaga

SEQ ID NO: 14041 - DNA, 121 bp, Artificial Sequence
  Synthesized
  misc_feature (61): n=a or c
caggcatgatggggttttcaacatttctttagcctcctaagattagaatatcttatttttncaagagcaagtcagaacctcctcttccctgaacaataaaattcagcaaaaccatggaaga

SEQ ID NO: 14042 - DNA, 121 bp, Artificial Sequence
  Synthesized
  misc_feature (61): n=t or c
cctagctttgggtctgcaacctgcttgtctgccccggagatcacaggtctctgcaattcanagcgggtctgccttcctgtcagctgcaaaggaacacctgcacagtggggactggggtatg

SEQ ID NO: 14043 - DNA, 121 bp, Artificial Sequence
  Synthesized
  misc_feature (61): n=t or c
cacccttagcagagctatttttgcacatagtgttatcacatctaacctacttcaaacaccncccaaactgggaagagctccgaggagcctttgtcgctttctgaaggcaaggcatcaccaa

SEQ ID NO: 14044 - DNA, 121 bp, Artificial Sequence
  Synthesized
  misc_feature (61): n=t or c
ttgttattttaaatagactgaacatactgctactattttcttgaatacagtattattttgntgtattttactagagtctctcacaattagctcatgtttcttgaccagcaggatacagaac

SEQ ID NO: 14045 - DNA, 121 bp, Artificial Sequence
  Synthesized
  misc_feature (61): n=t or c
aaagtacatggtgatgtgaggcagaaaactgcaactggtataatgctccaggaacctctgngacccaatctacctttagcttccttactcagatgacacaaaggcagacaatgagttacta

SEQ ID NO: 14046 - DNA, 121 bp, Artificial Sequence
  Synthesized
  misc_feature (61): n=a or g
tatactgctaatgatgcttcaggacagacccatggaataggatggagtgggtatggaagangcattctcagaagggatggtacataacacataaggaccactacagaaatccccttggcac

SEQ ID NO: 14047 - DNA, 121 bp, Artificial Sequence
  Synthesized
  misc_feature (61): n=a or c
gaaaagcaagaaatgaagagtaaggcctggagacataaaggaacttaacgtttgaaacagncggttttgcctgattaatgtatgctctgggttgcagaccaaaccaagttctaaaaagaaa

SEQ ID NO: 14048 - DNA, 121 bp, Artificial Sequence
  Synthesized
  misc_feature (61): n=t or c
gaaatgagcaacccttaatgagacagtccctcctactgccagagagttataagatttgtcnttcaagtcagatcctagtttcaagtgaagttctcctctaacttacatcagtataaatcca

SEQ ID NO: 14049 - DNA, 121 bp, Artificial Sequence
  Synthesized
  misc_feature (61): n=a or g
cagccctgggatgtggctgtccatctcctttctgtggggcagcactgtgttaaagaatccngagctcagttctctccttttgtctttaaatagaagcaagctttgcccttactcttaacca

SEQ ID NO: 14050 - DNA, 121 bp, Artificial Sequence
  Synthesized
  misc_feature (61): n=a or c
gatttgctgtcaggcagggctttgcagcagtagggccgttggtttgcatctcccgtgcctnattatctctgcagcaggatttcacgtctgtttccacgagatggcattgctgaggctggta

SEQ ID NO: 14051 - DNA, 121 bp, Artificial Sequence
  Synthesized
  misc_feature (61): n=c or g
tcactcattgagtctcctgggcagcctttgtgctacataaggtaactctcagcagctgagnccatcacctttgtacatagtccactgcaaaaggcaaggaaaatagagggctggtgatacc

SEQ ID NO: 14052 - DNA, 121 bp, Artificial Sequence
  Synthesized
  misc_feature (61): n=t or g
aggttccttccaacccctgcaattctctgatcacctgctcatgaaaagatataagctttgnctctcagatttctagagaagccacaaggcttgtaacgctacaagttaacatctcaagttg

SEQ ID NO: 14053 - DNA, 121 bp, Artificial Sequence
  Synthesized
  misc_feature (61): n=c or g
ttaccacagtctaagtagtggaggacattgagcccagattacattccctatttaattaacnagagttttaaatttgttagtgaattttgccacggggctagaatgtctgatatgaatccat

SEQ ID NO: 14054 - DNA, 121 bp, Artificial Sequence
  Synthesized
  misc_feature (61): n=t or c
acatgcattttctgagtgcctttgaggatggcatggatcttacttatatatttaatagaantcctcaaattatttgctgagatatattatccagtcacactttcagaactgccatatataa

SEQ ID NO: 14055 - DNA, 121 bp, Artificial Sequence
  Synthesized
  misc_feature (61): n=t or g
gagcgatgaagggccggtttgccgccggcacctgactctgtaaccaaggaccttcccgtcngcagcatcccatgaagccttcagggtgttggagcccatgtcttcaaagcgaagatgcctc

SEQ ID NO: 14056 - DNA, 121 bp, Artificial Sequence
  Synthesized
  misc_feature (61): n=a or c
atgagactttgacccaacctgttttacctgtaataccatgcagctgggagagctgtttttnccctttttctcttggagtgtgtttagccacatccttgcttgcttttctgctcaccttccc

SEQ ID NO: 14057 - DNA, 121 bp, Artificial Sequence
  Synthesized
  misc_feature (61): n=t or c
gatgtgcacccaggtgggtcactgagcccctaccctagctgcatttgggacacattgcaangcaacgaccaaaaccaatgcatacatttctgcagctttaacctcaccttggggtgcactc

SEQ ID NO: 14058 - DNA, 121 bp, Artificial Sequence
  Synthesized
  misc_feature (61): n=a or g
aacatgcctcagaatcaaacaatgagatgtcattgaaaagtaatgctctagatccatcagntgcctttttcattcagcaatacactcaaaataagaataattgctttctattccatttttt

SEQ ID NO: 14059 - DNA, 121 bp, Artificial Sequence
  Synthesized
  misc_feature (61): n=t or c
gtgtctgcactgtgtccttctcttcctttgggtgggggatgtctgagagctgcatgtaagngggtacttctgtggggattctggtgtgccgatttcttctctgcttcctgctgtcaccatt

SEQ ID NO: 14060 - DNA, 121 bp, Artificial Sequence
  Synthesized
  misc_feature (61): n=t or c
tcaaggaggattctatgaagttcagggctgtatttaggattcggctctgcacaggtagaancaaattctgccttatgtggcagttactttttttcagagtcaaatactcccccccaaaaaa

SEQ ID NO: 14061 - DNA, 121 bp, Artificial Sequence
  Synthesized
  misc_feature (61): n=a or g
gtagtctgtgctcttgatcatctgtggcacccttgaatcagtgtttcaaatcttggctccngcaggcagcaggcatcttgagacaacttgtcagtagtctcttttaaaagtgacccaccac

SEQ ID NO: 14062 - DNA, 121 bp, Artificial Sequence
  Synthesized
  misc_feature (61): n=a or g
tttcaaatctctcctgggttgctggtttcaaagctttccaaagagtatcatcatccagganacagatgtctaggactactgggcttccttgggggaaagcagcacagaggatggttttgtg

SEQ ID NO: 14063 - DNA, 121 bp, Artificial Sequence
  Synthesized
  misc_feature (61): n=t or c
cagccgggtgctgtgtgctggtcaggagctggggcacgttccagcagggctggcgcttcangaagctgtaaacatatttgcagtctgtgcaccatgcaggtgagactcccctcaggcaagg

SEQ ID NO: 14064 - DNA, 121 bp, Artificial Sequence
  Synthesized
  misc_feature (61): n=a or c
gcagaaacgcttcggtggaaaaagaatccagatattcctggctattctctacttgttcatntatatcttcaccaaaatatcagtaagtaggaaaaaaaaatggtaggaggttgaatttaac

SEQ ID NO: 14065 - DNA, 121 bp, Artificial Sequence
  Synthesized
  misc_feature (61): n=a or g
ccacttccccagcaccaagggaaagcattttgggatttttttcacctaacacggtaacacntcagggatgttggccattaccaaaagaaaggcaagacttggtgaagacaccactgggaag

SEQ ID NO: 14066 - DNA, 121 bp, Artificial Sequence
  Synthesized
  misc_feature (61): n=t or c
gcagagccgtgtttgtgtgctcccaccactgacttacggttggtggccagcaagcaaaagntctgtgttttcagcaggcagcagcaaagcgggctttaatggcacgggtagggctgggaat

SEQ ID NO: 14067 - DNA, 121 bp, Artificial Sequence
  Synthesized
  misc_feature (61): n=a or g
agaaccatcccttttccctgccttccctccactgtatatatttttcctctcatcccaccantgtcactacatcggttttcccccacatcttccctactggagttcaagtacagaaggactc

SEQ ID NO: 14068 - DNA, 121 bp, Artificial Sequence
  Synthesized
  misc_feature (61): n=a or g
ccagttcaaaagctgagaacactatgaatggtctaactgtccatgggatctgttgcaaacntagtgcaaacctaaaatgtttcaagagacatttctaatacagttcagcaagtattggcgc

SEQ ID NO: 14069 - DNA, 121 bp, Artificial Sequence
  Synthesized
  misc_feature (61): n=c or g
aaaaactccgagattatcgcccttggtggagagcaaaaagtgcaaaggttgtgagcacagncgtgctacgagacacaggagaatccgcagctgctgcagagctggggttcccgcaggctct

SEQ ID NO: 14070 - DNA, 121 bp, Artificial Sequence
  Synthesized
  misc_feature (61): n=a or g
aaaagtctcagcattgatcactgtttttaccatagcgaagtgtttaagaatgaaagccgtnaggctacactgctttttcttgggtgttaaaaatgaacagcaggttgccagtgagcaaagc

SEQ ID NO: 14071 - DNA, 121 bp, Artificial Sequence
  Synthesized
  misc_feature (61): n=t or c
catactcaaaacagtgatatatcctaaaccagagtcacactcaccacagttagcttcatcngatccatcagcacagtctgggtcttcatcacatacccacagcttagaaatgcagtgtttt

SEQ ID NO: 14072 - DNA, 121 bp, Artificial Sequence
  Synthesized
  misc_feature (61): n=t or c
cctttgtcatatatacttgctgctaattaggtctaactcttccaactcccatatttttaantgagattttttggaattgtcctttctcgtagacacttgaattggatgagtgcttgaaata

SEQ ID NO: 14073 - DNA, 121 bp, Artificial Sequence
  Synthesized
  misc_feature (61): n=a or g
tactgtccaatgatctacctggcactagcatttcagatcccagtgtcatgctacaaactcngttaagtagtttttaagcactgtctgatgtggaagtttgctcctctttgatatagcatgt

SEQ ID NO: 14074 - DNA, 121 bp, Artificial Sequence
  Synthesized
  misc_feature (61): n=t or c
tcgtgcatttggtaatacaccgtctacttatgaatcagttcaaactaatgatgctgactanattgttctgatctaaatcagtaatgtaaacaaaatatcctgggaatacaattctccagaa

SEQ ID NO: 14075 - DNA, 121 bp, Artificial Sequence
  Synthesized
  misc_feature (61): n=a or g
ctagatatcagacaccagctgtatgcttaactatttaaagattgtggctgtacatttactnaaatagataatttaaagcactactccagtcagctttgctcactttggagcccaactgaaa

SEQ ID NO: 14076 - DNA, 121 bp, Artificial Sequence
  Synthesized
  misc_feature (61): n=a or g
agaaagctaattctcagctggaatggtgctagagcacacagtcgagattgacactgtgatnggcagacaatacatagaacagctagatctgtcaaggatgagagttcttattaagtagaca

SEQ ID NO: 14077 - DNA, 121 bp, Artificial Sequence
  Synthesized
  misc_feature (61): n=a or t
aagtcctcttgtattggtaacccctttttaaactccttttattgttgaccttgacggtgangttctgcagcttgattgtgcctgtgtgaaaatattacttgtttcatttcaaagctgctgc

SEQ ID NO: 14078 - DNA, 121 bp, Artificial Sequence
  Synthesized
  misc_feature (61): n=t or c
cttctgtcagccctaccaaagagcagcttggcatcatggtttcctaccgttgcccatctcntcctcttccaccattctcagtgtgactgtgaacccacatcctcctgtgctctgtggtgtg

SEQ ID NO: 14079 - DNA, 121 bp, Artificial Sequence
  Synthesized
  misc_feature (61): n=t or c
caccaggcgcacagcagcaagctgcctctcctgtctcagcactgcatgtgactgcatctcngagtggctgacagcatttcagtgtgtaggagcaaagtttaggaggaataaaactaaaaga

SEQ ID NO: 14080 - DNA, 121 bp, Artificial Sequence
  Synthesized
  misc_feature (61): n=a or g
ggtgctaacatttcagataggtctacgccagcagtcttcccttaacagtgacaacagatancaatttcagttatgatggtgctgagaataaagcatgttttgtttgctatgtgaaagcaat

SEQ ID NO: 14081 - DNA, 121 bp, Artificial Sequence
  Synthesized
  misc_feature (61): n=t or c
cctggggtgacctcatctctgggaacacgtggggactgtccatccagaggtatccctgtcnatcagattgtcccatgggttggcatggacaagtgaatgtgagacaaagcattgtcttcac

SEQ ID NO: 14082 - DNA, 121 bp, Artificial Sequence
  Synthesized
  misc_feature (61): n=a or g
attgcccctctcagaacttgaactaaaactggagtttctctgaagcaatgttgtttttctngtaccttggcctcaaagtaactgaagtggctttaagtgctcagaagtcacctgcttgctt

SEQ ID NO: 14083 - DNA, 121 bp, Artificial Sequence
  Synthesized
  misc_feature (61): n=t or c
ttaaagtaattcgtatctcttcttaggatcctaaatcagagctccccattcactgaggtgntctatgaagccaggatactttgcacactgcaggcctgtttaagaagcctacagggctgga

SEQ ID NO: 14084 - DNA, 121 bp, Artificial Sequence
  Synthesized
  misc_feature (61): n=a or g
cagataccgttaactattacttagttgactgaatgacctcttctcatccctttgtgagatnaccacatctgcctttagcagagcgtggctggctcagagcccagcatgaggtgggatgtgt

SEQ ID NO: 14085 - DNA, 121 bp, Artificial Sequence
  Synthesized
  misc_feature (61): n=t or g
gaaggcagccgtacacatcatgtatatgaagctctgtggtttcgtataattaacatctgcntttttctttattgtcctttcatttttggagatttgttccagactggactagtgccctgtt

SEQ ID NO: 14086 - DNA, 121 bp, Artificial Sequence
  Synthesized
  misc_feature (61): n=a or g
ctgccctcctcccaccctcatccctctggtctgaaataatggtgaaggttgtgcaaaaatnaaatcagtttgcaaaccagaagtttatttgctggaagaaaaaaaaaaaaaaaacaaccca

SEQ ID NO: 14087 - DNA, 121 bp, Artificial Sequence
  Synthesized
  misc_feature (61): n=a or g
ataagttgttggcttattaaaaatataggatcacaatgtggaagttcctgcaatatctctntataattagaaagtgttggcacgtgtcttactaattctccctgccaaagaggcagagagt

SEQ ID NO: 14088 - DNA, 121 bp, Artificial Sequence
  Synthesized
  misc_feature (61): n=t or c
cagatttgtaatttttttttttatttttttttaatttttgcagggactgtatggcaaatangtcacaggggatccacaattatttaatacttcgtgacctagactctccacttctgagcca

SEQ ID NO: 14089 - DNA, 121 bp, Artificial Sequence
  Synthesized
  misc_feature (61): n=a or g
atctactctccctcacagcagctgtagttgtctagaccttgcagttccatggactgacctntgttccatggtttgatttgatcccactttcctctcagcatcttagatttaatgtgcgtgc

SEQ ID NO: 14090 - DNA, 121 bp, Artificial Sequence
  Synthesized
  misc_feature (61): n=a or c
tgcaaatctaagtataaagagcttcaaaactgaggtcaaaataaaagaacttgcacaagtntgtcatactaaaagagtaccaaaatgctgggggaaaaaaatgcacactaaaaccttctga

SEQ ID NO: 14091 - DNA, 121 bp, Artificial Sequence
  Synthesized
  misc_feature (61): n=t or c
ctgaggctattggcagggaaagattgagacaaggccatgctttttcaagtgcatgcttganatcgtatggcttaaactaattccagaaaccacagcgtgtgtttcatttgttgcagcatag

SEQ ID NO: 14092 - DNA, 121 bp, Artificial Sequence
  Synthesized
  misc_feature (61): n=t or c
caacagtgtagtttttattctctctgccattgcggtgtgcaacaaataggggacaacaaanatggtaacatcaagaagtatttgggtgcccttccttgtttttgttgacataagctgagat

SEQ ID NO: 14093 - DNA, 121 bp, Artificial Sequence
  Synthesized
  misc_feature (61): n=a or t
tgtcataacactttctcaatatactagtttcctactgccttacttctacatccagccatangcagatttatatagtgcctgttactttatggcatagtttatacagattcacaaacccatt

SEQ ID NO: 14094 - DNA, 121 bp, Artificial Sequence
  Synthesized
  misc_feature (61): n=t or c
gatacatctatttcatttaaaagctactttttataatgtattgaatcctttatgtactgcngtaagcctgaaaacgttgagaaaataggtggttgatgctcaactgttgctcaattggtga

SEQ ID NO: 14095 - DNA, 121 bp, Artificial Sequence
  Synthesized
  misc_feature (61): n=a or t
attctaccaaaaacaatgtatctatctctcctaggtgtcatcatactgggataaactcgcntgagttataagcaagaaatatttaagtctttagagcatcactgggagttaaatcagaatc

SEQ ID NO: 14096 - DNA, 121 bp, Artificial Sequence
  Synthesized
  misc_feature (61): n=a or c
tccttgtgttttgatttatgcctcttgctaggttgcataggtctgttaaatatctttggcnggaaatctctttctcttacgtataccatgtatgttttgcctcttacaacatattaaacag

SEQ ID NO: 14097 - DNA, 121 bp, Artificial Sequence
  Synthesized
  misc_feature (61): n=c or g
caggagtacttttctggtcacaaacgtatcttgctttaaaggaaacagaatgataacatanttatgaaagataatgacacattaacaaggagcaaagtagctgacatggatcccaagtaac

SEQ ID NO: 14098 - DNA, 121 bp, Artificial Sequence
  Synthesized
  misc_feature (61): n=a or c
tttgcacatacatttgatgcaactttctcaaggtaaaaactatttttgatggaggtacttntttttaagagtaaagaccactatttaattcctatgtgtttttatctgtgtttatgtgtgc

SEQ ID NO: 14099 - DNA, 121 bp, Artificial Sequence
  Synthesized
  misc_feature (61): n=a or g
tgctgcagcaagttccgtgtccattatggttgcaaatattttaagactttttaaggtaagnaatattttctacttttcttttgaattttaagtgtaaggaagtatgtgaggagtttgtgtt

SEQ ID NO: 14100 - DNA, 121 bp, Artificial Sequence
  Synthesized
  misc_feature (61): n=a or g
caaaggggggtcctggcctcagcagcagcatgcaagcactgcagagcaagctgctctgaanggagttaagcactctgggcagcacagaaatgcctgcgtcagctcacatgcccaacgcagg

SEQ ID NO: 14101 - DNA, 121 bp, Artificial Sequence
  Synthesized
  misc_feature (61): n=a or g
cctttatcttggttagtttttaatcaagccgtttgttcttggagcctttttccacttccantcctcttttgcttccttcctttggctgttatttcaaatacaaacgcctcaagaaaagaaa

SEQ ID NO: 14102 - DNA, 121 bp, Artificial Sequence
  Synthesized
  misc_feature (61): n=t or g
aactcttcaaatatatgcatgtttctgatagaatcggatgtatcagaggtatggggtgaancattgctgctgttaccccagctaatcctaaagtgagtttgccctttggccatgtttctcc

SEQ ID NO: 14103 - DNA, 121 bp, Artificial Sequence
  Synthesized
  misc_feature (61): n=t or c
cttgaaaataattgttttatgcttagcatagaggagaaacagataattgttatcagaaaanaatttgtctctggcaaagcaggtgctcgatttgttttctgtcacaaagaactttaagtct

SEQ ID NO: 14104 - DNA, 121 bp, Artificial Sequence
  Synthesized
  misc_feature (61): n=t or c
cattaaaacagcagcaaaagggaaacatttgaatgaatcccatttactgatccagcagganagctaaaacaaatccacttaatcttccaggccatctgcttctttgtttcagggtacagta

SEQ ID NO: 14105 - DNA, 121 bp, Artificial Sequence
  Synthesized
  misc_feature (61): n=t or c
gcctctaaatatcagatttcaagtatgagaatgtgtatacagctgcgtgctttctcagtcngctcttgactaacgttggagataaagatgctgaatggaccttttggttcaagttcatgca

SEQ ID NO: 14106 - DNA, 121 bp, Artificial Sequence
  Synthesized
  misc_feature (61): n=a or g
gaatctggaaggggatggggggggtgatgctgttctttgtcctgtgccctttccctgagcntttataactggctgttccaaggagaatgcttggcaagaagacctttagtctgacctggtg

SEQ ID NO: 14107 - DNA, 121 bp, Artificial Sequence
  Synthesized
  misc_feature (61): n=a or g
gccgacggcagctctgggggcaggtgccaaattctcccaagttcctgattgagaaagcccngcattgaacaatagctccgcatcacatcagctctgaccaaagcgagcagcactacgcacc

SEQ ID NO: 14108 - DNA, 121 bp, Artificial Sequence
  Synthesized
  misc_feature (61): n=a or g
cctacataaccacaccagcagatgtaaggcccaagtaaccatgtcaccatcatacactgcnttggagttgtttaagaaaaggttgctagagaatatgccaacattgtatctccatagacag

SEQ ID NO: 14109 - DNA, 121 bp, Artificial Sequence
  Synthesized
  misc_feature (61): n=t or c
gggcacccctaatgcaccactgtgcatcttctctcctttgaatctcctttgtgtgcctcangcatcctccatgcatctcctgggcatccctggtgcatcacctgctcatcctcctacatct

SEQ ID NO: 14110 - DNA, 121 bp, Artificial Sequence
  Synthesized
  misc_feature (61): n=t or c
gtttaggttcaagccattagtccgtgtttcaaatgatacaggctcctctggtgttcttcantctgaatcaatcccttaattttaaggtatcggtagaatgatttatttggatcattctttt

SEQ ID NO: 14111 - DNA, 121 bp, Artificial Sequence
  Synthesized
  misc_feature (61): n=a or g
tcttctacatggatatgtgtccatgggtttcaggtgaatagcagtcacagaaataaagcantgtggtccagccacactgcaaggacactttccctccattttggccttgctgtccacacat

SEQ ID NO: 14112 - DNA, 121 bp, Artificial Sequence
  Synthesized
  misc_feature (61): n=t or g
ccatcagtttccctacactgtccccttaacatgctcagtgagcaatcagcgttaatgaagngcccgtttttctgctgcccacatcagcatctcctgaggagtcccaacgggaacttgtgca

SEQ ID NO: 14113 - DNA, 121 bp, Artificial Sequence
  Synthesized
  misc_feature (61): n=c or g
gcaaaatcaatgttttcagtagtttccacaaccaatagcactgcaaaagctaagaagcacngaggtagctcagagtacctggaggtgtttttctggaacgataactggcccacatcgtgtg

SEQ ID NO: 14114 - DNA, 121 bp, Artificial Sequence
  Synthesized
  misc_feature (61): n=t or g
ggttttacttccaaccaaccttgctcagcactgtcctactgatgtaggctatgcatgaatntgactgtggccaaagtacatcctggaaaaaaaaaaagtactttgagtttcaaataatcat

SEQ ID NO: 14115 - DNA, 121 bp, Artificial Sequence
  Synthesized
  misc_feature (61): n=t or c
ggtctggaaggataggtacacaggtctgtaaagctatcaagctacggtgtctaaagctatnaagcaatccaaatggactgagaaaaaagaagagttttctttaaataaaaacaacataaac

SEQ ID NO: 14116 - DNA, 121 bp, Artificial Sequence
  Synthesized
  misc_feature (61): n=c or g
ttttttttttttactgttaaaaaactttttagactggtttcaattctgtagtcttgctgancaccaggggggtgcatttgatttcatctgttttatttaaagattctagaacaggttgaat

SEQ ID NO: 14117 - DNA, 121 bp, Artificial Sequence
  Synthesized
  misc_feature (61): n=t or c
ccctcctgtattaactacagacttaactgactccatccaaataacactctgaactcctccngataaacagtaaagctgcaattcagtgttgaacaaggtaacttagcatactaggcaacac

SEQ ID NO: 14118 - DNA, 121 bp, Artificial Sequence
  Synthesized
  misc_feature (61): n=t or c
ggcatagctgaaaatttatttgccttttaatcttgcatcaggagaacaacattgcaacagnttgacacagcagattctgccaaatacacatcattaacataaaaaaaaaaaggatttttat

SEQ ID NO: 14119 - DNA, 121 bp, Artificial Sequence
  Synthesized
  misc_feature (61): n=a or g
cagctgtccaatggagcatcttctcctcacctaaagctccaggaacaaaccaggaagatcncatgtttccaggcactccagaagtacctggcttttgatatcttctgtcaaaacaaagggt

SEQ ID NO: 14120 - DNA, 121 bp, Artificial Sequence
  Synthesized
  misc_feature (61): n=t or c
gagatacacgctatcacacatgcacagaatattgtacactttatcgaggaccacaagcagnatattttaacaaattgtagagagaatcactacagtgtcacagcagtatcaccattccttg

SEQ ID NO: 14121 - DNA, 121 bp, Artificial Sequence
  Synthesized
  misc_feature (61): n=a or g
atcagggaatggcataaaactttgacaagggaggttctgaccactaatgtcatcaaaagcnttttgtttcatagagctgagattttccagcaaaatcttgttctaactggaaatctgcaac

SEQ ID NO: 14122 - DNA, 121 bp, Artificial Sequence
  Synthesized
  misc_feature (61): n=t or c
agggcaaacaatgtcagaagccacttgaggctccaccacttcagtaacagagtaataagtncccctggtgacttggaaagaagttttcctcctctttctgagcaaaaggggatttctgtgt

SEQ ID NO: 14123 - DNA, 121 bp, Artificial Sequence
  Synthesized
  misc_feature (61): n=t or c
gattaggtgtttaagtagttgttttaagtaagcagaatcagtttgttctacagcagatagncttgaaaagctttgtaggaagcctgtgaaatgactgggctagtaggtggaagaggatgat

SEQ ID NO: 14124 - DNA, 121 bp, Artificial Sequence
  Synthesized
  misc_feature (61): n=a or g
tacagatttgctctcatggtacacctccacagcttaacaagagtcagggagtacaggactnttttagtttcatttacaaaaggagagcagacaaagaccatgttgactatgccccattttt

SEQ ID NO: 14125 - DNA, 121 bp, Artificial Sequence
  Synthesized
  misc_feature (61): n=a or g
ccttggcagatctggcatggtcctatggattcctggtcctacaggagggtcaagataagantgtcaaagctgcatatccactacaggaaggggtctaaactcagaattttgacaaactaaa

SEQ ID NO: 14126 - DNA, 121 bp, Artificial Sequence
  Synthesized
  misc_feature (61): n=a or t
taagaagtagatcatttcatgggctgcaacagatgccagaattgataagaggcttttttanttcctgcatctcaaagcgtgcaataaggtaggatggtatatgccatttcaagtgatggtc

SEQ ID NO: 14127 - DNA, 121 bp, Artificial Sequence
  Synthesized
  misc_feature (61): n=t or c
caaacatcaactttttctttagatttcccctaaaggaaaaaggtgtattttctgttcctangtgaaaggaaatctatcttagtggtggcatctgtgatgttacagttaagactattagctg

SEQ ID NO: 14128 - DNA, 121 bp, Artificial Sequence
  Synthesized
  misc_feature (61): n=t or c
aggtgttatcacttctttcgacctaacacaacagagaagttgattgctacatttcatagantgtactctggaagtgtgttagctcttctgctctctacaacattttaaactatttgctcat

SEQ ID NO: 14129 - DNA, 121 bp, Artificial Sequence
  Synthesized
  misc_feature (61): n=t or c
tgacactgaataacttgggagtaaagttctggctgagcagtggaacgtgccttggtaaaanatttttaattcatctaacatcttaaacattttatcctcttgcgtttgtgatgccacctga

SEQ ID NO: 14130 - DNA, 121 bp, Artificial Sequence
  Synthesized
  misc_feature (61): n=a or g
cataacgctctgcagctccagatggcttcacagggcaacagccctgtcctgggtgccaatntgcacggtagaacttagggacccagtttgccagcagtcagacattttaaagtaaatcaag

SEQ ID NO: 14131 - DNA, 121 bp, Artificial Sequence
  Synthesized
  misc_feature (61): n=a or g
acccttgtacgtctttgcttcacttcccccataccagctcccttttcagatatgatgcccntggctctggttgggtggtgatgagccctttgatggtgccctcttcttttgtgtgggcatt

SEQ ID NO: 14132 - DNA, 121 bp, Artificial Sequence
  Synthesized
  misc_feature (61): n=a or g
aggaaaaaaccaaaacttgaagtcttgctgtaacagatgctactttgtcttgagtgactanctgtaaaaatgcagggtaactttttcaagtagcatacaagctactgaaggctgaacagat

SEQ ID NO: 14133 - DNA, 121 bp, Artificial Sequence
  Synthesized
  misc_feature (61): n=a or g
atcaacagacgcgtgtaatgaacttgtcaaaccacaaggttaatttcacaccacggtgatnaagttgttacagatggggcaatgcctctacctcaactttaggataagacagaatccaata

SEQ ID NO: 14134 - DNA, 121 bp, Artificial Sequence
  Synthesized
  misc_feature (61): n=a or g
gtcaacactgcattcttctgaaaactgaatgaaaactgctaataaaagtaccacttctacntcagggaaaatggaaattaccacccaacacctaattcagttgcaattcatcaatccaaac

SEQ ID NO: 14135 - DNA, 121 bp, Artificial Sequence
  Synthesized
  misc_feature (61): n=t or c
gggaagcatgctgaatattactcccacatccccctccaacatcatatgcattaaaccaaantcaatctggccttacaggttggttatcagctatctggagcaagtggcaccttttcctttc

SEQ ID NO: 14136 - DNA, 121 bp, Artificial Sequence
  Synthesized
  misc_feature (61): n=t or c
attatctgaatgtgctgccttaagaagagcaaaaggaaggactgagaagctccgaactgtnagctattagatctgttagaactctgaaatgctattaacttgcacttgctttcttagtgac

SEQ ID NO: 14137 - DNA, 121 bp, Artificial Sequence
  Synthesized
  misc_feature (61): n=a or g
gactgtcactccattcctgatgttgattttcttttggctttttttcgccttgatgcatgcngtgaccatatcccacgtgttttctgttcacagagtggtttgcaaaactactgcttcctcg

SEQ ID NO: 14138 - DNA, 121 bp, Artificial Sequence
  Synthesized
  misc_feature (61): n=t or g
aggagggagaaccaaggccgtgttaaacagaaggagaaattgatataaaagcttttacttnacatttatctcagagttttttcccagttgtctcttacgtatttggccttcagcactggag

SEQ ID NO: 14139 - DNA, 121 bp, Artificial Sequence
  Synthesized
  misc_feature (61): n=a or t
gtactgaaaagtacgtagttggcttgtgtggcagtacgtgctgtattgggaaacctttgtnagcaaaagatcgagagagactgaggatcttgtaactaaggtgcaatagcagaggacagga

SEQ ID NO: 14140 - DNA, 121 bp, Artificial Sequence
  Synthesized
  misc_feature (61): n=a or g
gtgccaaaacctgcaaaatggaagtcagcaatatatacaatacagtcagcaatacactgantgaaatgtgaaagcaaactgttctctctttccacaccctcttcatttcctcaatgttggc

SEQ ID NO: 14141 - DNA, 121 bp, Artificial Sequence
  Synthesized
  misc_feature (61): n=a or g
gcctgaacactttcatggagtagaagcctcagctacacccagtctccttcatgtgggaggngatacagagccagcatcttgggctgcaacatgaagccaaggaagttcaggagggcctgtg

SEQ ID NO: 14142 - DNA, 121 bp, Artificial Sequence
  Synthesized
  misc_feature (61): n=a or g
gcagctgttcctcaaggatgtgttgttcttcagtaccatccaacttgagacaggacctgtngcatccttgaaggaaggttttggagacacagcatgctgtgtgttataggctctgagtcta

SEQ ID NO: 14143 - DNA, 121 bp, Artificial Sequence
  Synthesized
  misc_feature (61): n=t or c
tttgtctcttccaaaccagtactcatcattcacacagtctgcagtgaattggagagagaanacagcacggcaggcattaggaactgctgctctacagaacgatgccacacatggcagtaaa

SEQ ID NO: 14144 - DNA, 121 bp, Artificial Sequence
  Synthesized
  misc_feature (61): n=a or g
tgttctacaactaaactaatgcctctctatcccttcccacttaggtagatgccttatagancggaattttctaccaatgcaaattaagtttagcacttttggtcatatcgattggcaaaac

SEQ ID NO: 14145 - DNA, 121 bp, Artificial Sequence
  Synthesized
  misc_feature (61): n=t or c
aacttaggtctgtggtattcataagaaatcatataggtagtttgcactatgagaagacatngtagaaatcagcattggtatgacagagggaaaaggatgaaaacacttgcataagcaaaaa

SEQ ID NO: 14146 - DNA, 121 bp, Artificial Sequence
  Synthesized
  misc_feature (61): n=a or g
agcggaatggggctgcggatgtgtgaccgctgttccctatgtggggggagggaaaaattgnggaaataaacgggcggagatggagcctcggggcgtttctctcctttctttttcttcctct

SEQ ID NO: 14147 - DNA, 121 bp, Artificial Sequence
  Synthesized
  misc_feature (61): n=t or c
agagatggtgatatgcaaatcttgtctagttagggatggctctttaaaagaataagtgttnatgcacttctcatggaagtatactttccatttgctatataataatgcctcttttttttaa

SEQ ID NO: 14148 - DNA, 121 bp, Artificial Sequence
  Synthesized
  misc_feature (61): n=c or g
tctctcaacactttgctccctccctaaatgtctcctttttccaggacatgctttcactttncaggtgggctttcctcagctacctggacaacctttggagccaggcttcttcctgggcatt

SEQ ID NO: 14149 - DNA, 121 bp, Artificial Sequence
  Synthesized
  misc_feature (61): n=a or g
taaatcaaagctcttagagagataataatatgaaatgatatggctgaactgccaggcaatngaagctacctacttaagacataaagggaaatattgctttccttatggggatctttattgc

SEQ ID NO: 14150 - DNA, 121 bp, Artificial Sequence
  Synthesized
  misc_feature (61): n=a or g
acagatacccaagttttactgttctgctgtaaacttcactgcccaacagtgtttacccacntacagggaaggaaaacacaagcaatactggaggtcagccctgtaggtttagaggactgct

SEQ ID NO: 14151 - DNA, 121 bp, Artificial Sequence
  Synthesized
  misc_feature (61): n=t or g
tgccaggataactgaaagttttaggctgcggggtttcttctatgcctctctctgatgtatnttcttggttttgtcattagacttttctatggtgaccatgcaagtgctgccagatgggaca

SEQ ID NO: 14152 - DNA, 121 bp, Artificial Sequence
  Synthesized
  misc_feature (61): n=a or g
ttattctgttagcatgcacgtttcaggttaagttaatgtccttgcagggggacacctggcntaaggaaaataaacatctgacaaagtgcacagaatacgctcaacatttgtggatctcagc

SEQ ID NO: 14153 - DNA, 121 bp, Artificial Sequence
  Synthesized
  misc_feature (61): n=t or c
atcttccatacctggccccctggacacgtttaggacactctcgggtgtcccagattgcacnaggaacccataaaaaggcagctgaatcctgcccagacagtttaacactgttttacatgtt

SEQ ID NO: 14154 - DNA, 121 bp, Artificial Sequence
  Synthesized
  misc_feature (61): n=a or g
aatagcagtcaagagtatactctacacagagcaattcataaaaaagtagcttgtaatgagntgtgcactttgtccttttatgttaagctaattgttccttgaaggataattcaggctatga

SEQ ID NO: 14155 - DNA, 121 bp, Artificial Sequence
  Synthesized
  misc_feature (61): n=a or g
tagtttaacgtattcagagttggcaacctggtaagttatttacttcctctgttcctcccancaaagaaatgttagaggtcatattgtaactttttaaaggcacttggagatataagattga

SEQ ID NO: 14156 - DNA, 121 bp, Artificial Sequence
  Synthesized
  misc_feature (61): n=t or c
ttgacaacagcacaattctggacatcaacaaaatctgatgaaggtacaatgaatctctctntgatacagtgtatcgttactcttagctactgacttcaatttaattaatgaatggcatcag

SEQ ID NO: 14157 - DNA, 121 bp, Artificial Sequence
  Synthesized
  misc_feature (61): n=t or c
aggtttttttttttctgtttgctatggactgtttgcatcttcttctttaacatctaatagnatccatgtctgtgatagcagtgtatgtagataactgagctaacccattgtggcagaaacg

SEQ ID NO: 14158 - DNA, 121 bp, Artificial Sequence
  Synthesized
  misc_feature (61): n=t or c
ggtccaagatttctggaggaaaagtgatgtggcagtgcaccatgatcccttctgctccaantggcagtttgtaaacagctacaatgtagagacgactaattattttaacaccaatgggtca

SEQ ID NO: 14159 - DNA, 121 bp, Artificial Sequence
  Synthesized
  misc_feature (61): n=a or g
tcaggagttaattacaattatgtccacatatcaaagttttagacagtatctgaaaataacntgagaagcactgtagaagagatgaaaagattcatgtatgctccgcatgacagaaaatatc

SEQ ID NO: 14160 - DNA, 121 bp, Artificial Sequence
  Synthesized
  misc_feature (61): n=a or g
ggcagtaaccgagaagaataaagggggtcggcagatggaaatagaaatcaatagccctganatgtttcacccaaagcctcctccaggtgacttcagaaaatgtaatgtctaaatcaggttc

SEQ ID NO: 14161 - DNA, 121 bp, Artificial Sequence
  Synthesized
  misc_feature (61): n=a or g
aaagttgtatctcttactgctgttcatgagatcaagttcttatggaagatgttaagccacntgtcatgcatgattctctgttctgcaaagcatcttcatttgcattacttagccacaaaga

SEQ ID NO: 14162 - DNA, 121 bp, Artificial Sequence
  Synthesized
  misc_feature (61): n=a or g
tgaggccttgaagtgaagctaaacatatgggagcagaacatcaccaccacgcatcagggtnctgtgaagctcacggcctctctgcaggtattaataaacacgctggatccattgtgaaggt

SEQ ID NO: 14163 - DNA, 121 bp, Artificial Sequence
  Synthesized
  misc_feature (61): n=t or c
attcactcaatcacataaggatgctctgcaccttactgttacttttcagaaacaaagtgcnttctgctcaagttttaaatgggagcaagttaagctaggtcagtataaaatgtaaggctgc

SEQ ID NO: 14164 - DNA, 121 bp, Artificial Sequence
  Synthesized
  misc_feature (61): n=a or g
cgccttattttggaggctgtacaagaatctaaaggcccagatggacaaggtacccatgtgngtcacctacaacaacacccatatgactaagggcaggtctgccttataacatttcattaac

SEQ ID NO: 14165 - DNA, 121 bp, Artificial Sequence
  Synthesized
  misc_feature (61): n=a or g
ctaatccatcagttagtcccatctcattatagttccatcagggacacctaatgatgctggntacttaatagaagtctgtaggtgatcttaaaatgtgactaagtgcacttgggaggcatga

SEQ ID NO: 14166 - DNA, 121 bp, Artificial Sequence
  Synthesized
  misc_feature (61): n=t or c
gggaagttccaaaatgtggctctgaagggctctgaggtcacaggaagttagcagtcatagnggctcctggggcttcactgcaaatatcaactcgtgatgctgttctaaaagcctgagctcc

SEQ ID NO: 14167 - DNA, 121 bp, Artificial Sequence
  Synthesized
  misc_feature (61): n=c or g
tgtgctggagtgagcagatggctggggaccaaacagatccatggaagcatgtaaggaaatnatgttgcatcattgctaaggagcttgtgccaagacttggattttcttattttgcctacag

SEQ ID NO: 14168 - DNA, 121 bp, Artificial Sequence
  Synthesized
  misc_feature (61): n=a or t
cattaaataacttaaaatcatgacgtaaattgaacaaataatcgtccatcacctaaatacntgagtctatcactttggcacaaaataaaggctgtccaggtccagcagattcagggctagc

SEQ ID NO: 14169 - DNA, 121 bp, Artificial Sequence
  Synthesized
  misc_feature (61): n=c or g
ttctcacctaaatgctagccactaacctctcttttcaaatgatctgttcggtaattgatanggttgtacctgtaaaatgagcctctccctgccaaagacagggactgctaattcaggacag

SEQ ID NO: 14170 - DNA, 121 bp, Artificial Sequence
  Synthesized
  misc_feature (61): n=c or g
ggtttttcttacctcttggattatcaccaacgatattggttttgccattccagtaccagantagcaatgttgcatcacgtgaccctgacagaatgtaacaatttcctccaatatacgactc

SEQ ID NO: 14171 - DNA, 121 bp, Artificial Sequence
  Synthesized
  misc_feature (61): n=a or g
acaaatgttttattaagctttcttctccatatttgaatttatcactgctaagattacctgnaataaaagctgctgtcaagtaagaaaaagcacaaagggtctgatccacacaatactactg

SEQ ID NO: 14172 - DNA, 121 bp, Artificial Sequence
  Synthesized
  misc_feature (61): n=a or g
cttcacacgtcccggcagaggcagcaacacaaacccaacgcataaacaagaggaacatacngaagtagctctggattctgaaccagtaggacctgatgacttcttgtttcatggaagctgg

SEQ ID NO: 14173 - DNA, 121 bp, Artificial Sequence
  Synthesized
  misc_feature (61): n=a or g
tttaaacaacttgagcaattttgtgcttcttatctatttaaatatacgtgcctcaaaaccnaacagacaaatcaagctgttaagtattttcatttgggaatgctctttgttcttaagatgc

SEQ ID NO: 14174 - DNA, 121 bp, Artificial Sequence
  Synthesized
  misc_feature (61): n=c or g
tattccaaacactggaggcatgcacaatgctactgatactgctgattggcacgactggccntactgtatgtatctggtgtaaggcactgtacaattatttttaactagactgcctaaagaa

SEQ ID NO: 14175 - DNA, 121 bp, Artificial Sequence
  Synthesized
  misc_feature (61): n=a or g
tatttctgtatttgtctaattccataactggtaatgagaactgttaaaaaagtagttaagncacaaaaaatagagatatgacaagcagtttgaaacactgcttaaacatggattttattgc

SEQ ID NO: 14176 - DNA, 121 bp, Artificial Sequence
  Synthesized
  misc_feature (61): n=t or c
gagcaaggctcttctacctaaaatacaagcaatacatgggcctacaatacatgcaacacangatggtttggttgtgcaagatatggtcatccaggggatcagcagaggagccttgcccatc

SEQ ID NO: 14177 - DNA, 121 bp, Artificial Sequence
  Synthesized
  misc_feature (61): n=a or g
ctcttgctcagctttagtagctcccaactagctttccttactgttgttctgaggtctctcntaactctcattaactgtttccaaactaacgtttctgattataatcaacaacaacaacaaa

SEQ ID NO: 14178 - DNA, 121 bp, Artificial Sequence
  Synthesized
  misc_feature (61): n=t or c
aggccacagtgcagacccagacagggctgggagcaagacaccctctgtaattgctcacagncctgatgcaaagccaccccccttccccgctgcgtgggatcaccaatgcagaccatgtgca

SEQ ID NO: 14179 - DNA, 121 bp, Artificial Sequence
  Synthesized
  misc_feature (61): n=t or c
tcccagttttcttgttatttgtgttgaaagcttggcagtagagatctcagagtttgaaganaataaatacagttagaggaagtcttctatactctgcccttgtgaggccccatctggagta

SEQ ID NO: 14180 - DNA, 121 bp, Artificial Sequence
  Synthesized
  misc_feature (61): n=a or g
tttaaaacattattactttcttccccaaagtaaagcaataagagtggagttattaaatgcnatcaataaataatgaaatcaatagtccccacatcattcaacagataataacactgaatga

SEQ ID NO: 14181 - DNA, 121 bp, Artificial Sequence
  Synthesized
  misc_feature (61): n=a or t
tatctcaggatggatgacagtagaactaacgctgctagctacattttgatttacatttccnttgtatagaccaaacgtgattaatgataagtattccctgctttatcatacaaaatactat

SEQ ID NO: 14182 - DNA, 121 bp, Artificial Sequence
  Synthesized
  misc_feature (61): n=t or c
ttaaagctgaccaagcagcttccctgaactatggtctgtgctgcctgcagcagtttctganagctatgtctaaacaaaaacagagcgcttttaatatgggtgttgatttgggggggggggg

SEQ ID NO: 14183 - DNA, 121 bp, Artificial Sequence
  Synthesized
  misc_feature (61): n=a or g
caggaattgttcctagcatgattttctctgctttggattcagcatagttacatttagcacnggcactgcaggagtaacacaactttttgttaacttctgcaattcgtatcaatgtctttgc

SEQ ID NO: 14184 - DNA, 121 bp, Artificial Sequence
  Synthesized
  misc_feature (61): n=a or g
tatttcgaacgtagcctgtcaaatttacggtattaaaagaaattttgaatgggttttttcnaagtaaagaaacatgctgcaaagtcagcattggaaacaaaatatgtacaactattcttcc

SEQ ID NO: 14185 - DNA, 121 bp, Artificial Sequence
  Synthesized
  misc_feature (61): n=t or c
agagttaaaaagtctgtactaaacatatacctatatccttttctaatactgacaacatgantctatttttggaaagcttgagttgtttgcaaaatgctgacatctgaacccatatgttcgc

SEQ ID NO: 14186 - DNA, 121 bp, Artificial Sequence
  Synthesized
  misc_feature (61): n=a or g
atcagcatataactcaccctgctccttatcttcagtctgtaattttccagggtcctctccntcctccatcagattactgggggtgatacttaatgacaggtatgatgtaaagcagcacagt

SEQ ID NO: 14187 - DNA, 121 bp, Artificial Sequence
  Synthesized
  misc_feature (61): n=a or c
ggggacacgagacacccaaagctccatctgttttgggggcctggagaggttctttggtccncatgtgggtgtcctgtccgacgtggtgtgcctggggccgggggatgctgtgccacctcca

SEQ ID NO: 14188 - DNA, 121 bp, Artificial Sequence
  Synthesized
  misc_feature (61): n=c or g
agataaatcctgctagggtaccatacccacagtagggttcacattcagctgactacaacanggtctttggtgcttgatgacaattaaaaataaataaatacataaaagatactcttcctga

SEQ ID NO: 14189 - DNA, 121 bp, Artificial Sequence
  Synthesized
  misc_feature (61): n=a or c
ctgaatggctttgctgttccttttcgggaaaacacaagttatgcaatatgctaaaaattgncttgtaagctttgataaaactttattgttctcaatggaaatgtctccagagcagaagatt

SEQ ID NO: 14190 - DNA, 121 bp, Artificial Sequence
  Synthesized
  misc_feature (61): n=c or g
catgccgtgctctcagctgcatgtacagactgagtctaaaggaaatggtcacagtgcaagncagctccatgccgtcaacattgccatagggaggcatttctctcatcttgctttccttctg

SEQ ID NO: 14191 - DNA, 121 bp, Artificial Sequence
  Synthesized
  misc_feature (61): n=a or g
ttgcccaggctttgggggtcttcagggtccccctagcacacatgtaccaacccaaacaacnaggataaaagaaatctcattctgtctttctattggggctgccctaatatgtcaagcccta

SEQ ID NO: 14192 - DNA, 121 bp, Artificial Sequence
  Synthesized
  misc_feature (61): n=t or c
atttaattcatccacatcgggacaatccgtctcttcttggagtaacgtcacatgatgtttntgctgcagaattttctgatgtatctcctgaagtttaaaaaaaaaagaggatctctattat

SEQ ID NO: 14193 - DNA, 121 bp, Artificial Sequence
  Synthesized
  misc_feature (61): n=a or g
gaacaaagcaaatgcatctccgtctatgggaaatatcaataatcttaattctgaagttcancatagcaagaatgtggaaaaagaagaaatcctgcatgtcccaagtgtcaattataaaact

SEQ ID NO: 14194 - DNA, 121 bp, Artificial Sequence
  Synthesized
  misc_feature (61): n=a or c
aatacggtaatgtgtgctgtatattcaacaataatgaagattgaaaactaatatgcttacnaagcagcaagtaaaaaagcttatcccttgttctgtttttcctgaggcgtgttgtctgtac

SEQ ID NO: 14195 - DNA, 121 bp, Artificial Sequence
  Synthesized
  misc_feature (61): n=t or c
cacatacatgatccgtgagacgatccccgtggtggaatgtgcacactgtgagtatgatttnaaaccattgttagctttattctcacagcgttccttttgttctccccattgcagatgaatt

SEQ ID NO: 14196 - DNA, 121 bp, Artificial Sequence
  Synthesized
  misc_feature (61): n=a or g
cgtgcgcatttcatgcatttcacataacttcaagtttgttgtccttcctatcagaaaatanaaagtcatcttgccctgctggtgatgatccctgctgtaaccaactggaagattcaaccaa

SEQ ID NO: 14197 - DNA, 121 bp, Artificial Sequence
  Synthesized
  misc_feature (61): n=t or c
agtagggaaattacacctcagcatcgttttaaaaggatcacgacggctgaagcgtaccacngcgctaaaacaagctaagcacactaggtaggaagaatgaaaactagaccaacccatagat

SEQ ID NO: 14198 - DNA, 121 bp, Artificial Sequence
  Synthesized
  misc_feature (61): n=a or g
tgttctctgccacagcttcattacatcactgtttcattactgtgtgtttagttttcattgntgacagtattatgctgcctaggagcaatttgtttgctcagtggcttgaaactagtaaaaa

SEQ ID NO: 14199 - DNA, 121 bp, Artificial Sequence
  Synthesized
  misc_feature (61): n=t or c
gtggtttcatgtacccatttccaatggcattcaacaaaacactgtgcctgacaatcaagtncttagtatatttccatgtcaggtttttaatcagatctattttctctatgaaaaccagtca

SEQ ID NO: 14200 - DNA, 121 bp, Artificial Sequence
  Synthesized
  misc_feature (61): n=t or c
gatgaaaagggagccaggcacacatgttgtacagctgaaaaatgggagcaagctgtgcccnggatgcaaaccctgtggcctgccaggctgtgagaattgtagaccatggggctgagtctgc

SEQ ID NO: 14201 - DNA, 121 bp, Artificial Sequence
  Synthesized
  misc_feature (61): n=t or c
atgttttagggaatccatataaattaaactgcctagagaaagtttgcatggttgagaggantgggtagaggtctgggattttcagctttgtaattctatgaaaacctcagctgtcacctat

SEQ ID NO: 14202 - DNA, 121 bp, Artificial Sequence
  Synthesized
  misc_feature (61): n=t or g
aaaacatttttctcctacttcagtctgtaactgcaaacttagcctaataaaaaatggcatntttgacctgcaacaataaaccataaaacacactgtggccaaaatgagaatattacttgtt

SEQ ID NO: 14203 - DNA, 121 bp, Artificial Sequence
  Synthesized
  misc_feature (61): n=t or c
aaaagctccgtcccgatgagcacttttaaactacttaaaagtcacttagcaagattatggngttttaagctgtaggccctcagtgcaacaactggcccctcccaccacgtttcatgggccc

SEQ ID NO: 14204 - DNA, 121 bp, Artificial Sequence
  Synthesized
  misc_feature (61): n=a or g
tgccatagcaaaggctgaattctctatttaactcatgatttcatctcctgttttaggcacnggaatctctccttacaacagaatatgaacaaacaataagctatcttacagctacatataa

SEQ ID NO: 14205 - DNA, 121 bp, Artificial Sequence
  Synthesized
  misc_feature (61): n=a or g
tgggtactcagctactgctcctcttcagaatacatgctattgaaatcacaaagcatctgcnttgcttgggaaactgattctgcgctctttcatcccccttccagatgaaacaaaacacaaa

SEQ ID NO: 14206 - DNA, 121 bp, Artificial Sequence
  Synthesized
  misc_feature (61): n=t or c
ctgcaccgatgcttgtgtgtgcactagcaggccaacaggcagaggacaaaatcaacataangcttactgagagtaacaaaattggcaaatactgggatattcactccccttcttcaccttg

SEQ ID NO: 14207 - DNA, 121 bp, Artificial Sequence
  Synthesized
  misc_feature (61): n=a or g
taaaagcgtggggtcttggctcagcaagtgggctgaagtggcactaagtgaaagtaaacanaatgcactatgaatgctgcagtgtgcattggtgtagagggacatagagaatgtaaatatt

SEQ ID NO: 14208 - DNA, 121 bp, Artificial Sequence
  Synthesized
  misc_feature (61): n=a or c
ggaaaaacaggcatttccacacacctatttgtattcaggtaccagaatgaagtgtctgggngtaaagccttagactcagcattttacaatcttaaacagcaagatgcagaacaaagtacac

SEQ ID NO: 14209 - DNA, 121 bp, Artificial Sequence
  Synthesized
  misc_feature (61): n=a or g
tccacctgctccaattcttctgatgcactacaggtaaatcacttatcactcactggggatnccatacagtaccactcagtctcatattacctgtaaaatttgcagtatgctcttcataccc

SEQ ID NO: 14210 - DNA, 121 bp, Artificial Sequence
  Synthesized
  misc_feature (61): n=t or c
tggaatatgatgagagttttctttgttcctggtgtagtttatctagtctgggtaattgatngtggtttatctggataagacattcttcagggattttagctattattccagatgagcagtg

SEQ ID NO: 14211 - DNA, 121 bp, Artificial Sequence
  Synthesized
  misc_feature (61): n=a or g
gtttttctttttaagaggctgtccaaatgagctaatgattgtaagagaaacagagccattntaaaagtacatttaggttggtgttctaataaagcatcttttggtttacaagtctaagctg

SEQ ID NO: 14212 - DNA, 121 bp, Artificial Sequence
  Synthesized
  misc_feature (61): n=a or g
ccctttgaagcaaagtgacacatcctgagctggtctttgccaggacctttttggcttctgntactacttcttcagttgattatcagtcagaaaattcataaataaccaggcatctgtgtaa

SEQ ID NO: 14213 - DNA, 121 bp, Artificial Sequence
  Synthesized
  misc_feature (61): n=c or g
tcctccctgccgccctcccacccgctccttcattaaagtcggtacagaaaccctgctgcanactggaagtgctcaacgaatgtggaggttggccatccctgtagtgtttggttatcatctt

SEQ ID NO: 14214 - DNA, 121 bp, Artificial Sequence
  Synthesized
  misc_feature (61): n=a or g
ctatgtgaatatcaaatcctgaagcactgccactacacaagagatctatcctctcaggttncattgcttcacttgtgtccaatgccttttcctggggccctagagcacagaagggaatggc

SEQ ID NO: 14215 - DNA, 121 bp, Artificial Sequence
  Synthesized
  misc_feature (61): n=a or g
gctcatcattacatttgattaatcctactggttgaatgcagagaaccaacagattaatacntctcttaactcaagtttatttaatgcagctggttgagggattctaggtcagacttttagc

SEQ ID NO: 14216 - DNA, 121 bp, Artificial Sequence
  Synthesized
  misc_feature (61): n=a or g
tggttttctttctgtagaagtggtggtggtgcagaaatgctccgtgctttccacacaaagngtactggttggacctcatagtgtcttgttaagcaaatgaacatgggaacagcccttgtat

SEQ ID NO: 14217 - DNA, 121 bp, Artificial Sequence
  Synthesized
  misc_feature (61): n=a or g
agtgatgacctgaaggtttaattgctctcttaaaattcttgaccacattctacctgagtcnagccagaacccagaattgctcttaggcagagctttgtaaaagatagactttttatttcat

SEQ ID NO: 14218 - DNA, 121 bp, Artificial Sequence
  Synthesized
  misc_feature (61): n=a or t
tatgtgtctttgaaagaatggagctgcaattagaaaagtgagatatatgaaacattccctngttaaagcagttacacttagatattttaaattcttttagttcataacattatgaagtgtt

SEQ ID NO: 14219 - DNA, 121 bp, Artificial Sequence
  Synthesized
  misc_feature (61): n=c or g
aagcctcttagtctttaaaatctaggtttccacatctacaggcaaacaatgattgtccatngtgcgtctttgagtaggccggtgtctcatttttctccaaaactaggcacttcaacttttt

SEQ ID NO: 14220 - DNA, 121 bp, Artificial Sequence
  Synthesized
  misc_feature (61): n=t or c
cacgtggtctttttttccccttctccttcactctccaggttgcaaaatcaaagccctgcgngccaagacaaacacgtacatcaagacgccggtgaggggcgaggaacccatcttcatcgtc

SEQ ID NO: 14221 - DNA, 121 bp, Artificial Sequence
  Synthesized
  misc_feature (61): n=t or c
aggatgccctgcctgggtgtctgtctgtccttgagcagtgtttctctcagaggagcagagngccaaggggctccttgagtttacccaattctatgtgcacatgggaagatttgacaccctc

SEQ ID NO: 14222 - DNA, 121 bp, Artificial Sequence
  Synthesized
  misc_feature (61): n=a or g
aaaacagagggattctttaaaggcagagttggtatgaattcagcagtgacccagcgctacntgggaagtaaagcttttcttttctagctgcttgtccctttcactgagtgctatgttgtag

SEQ ID NO: 14223 - DNA, 121 bp, Artificial Sequence
  Synthesized
  misc_feature (61): n=a or g
gtatcctgcttttgcaagctcatctgacgggcagttctcagtctgtaagattgggtcatgntcactgtacaaatacattcagtcctgggacaaatgcagcaagatgcctccatgctacggg

SEQ ID NO: 14224 - DNA, 121 bp, Artificial Sequence
  Synthesized
  misc_feature (61): n=a or g
tactatgacgcttgctcctgggtaaggaatcactcttatggatcaagtattagattgaacngggagatggacatctactgaagaggtcaagccaaattgatttaaaaccctctggatgatc

SEQ ID NO: 14225 - DNA, 121 bp, Artificial Sequence
  Synthesized
  misc_feature (61): n=a or g
ctgcttcatgaataggttctgcagttagaacttgcctgaaaagatgggacaaatcacacgnaaaggtacagtttgcattcacccggcagtgacagtgaagaggagtccagtgctcatggag

SEQ ID NO: 14226 - DNA, 121 bp, Artificial Sequence
  Synthesized
  misc_feature (61): n=t or c
tcaacgacagctaaaatgaacaactaaactctttatattttgatttactcagttttcaganttacacttgacaaggcagtaacatacagaacatatcagaagaggaaaagtagaggtttat

SEQ ID NO: 14227 - DNA, 121 bp, Artificial Sequence
  Synthesized
  misc_feature (61): n=t or c
ttgttcggatcagggctggttggcctgggctgagctgatgatgggagtatgctaacagttnaacagtgcagacagtccgactgccagctgtattgagttcactggtatagatagaccaact

SEQ ID NO: 14228 - DNA, 121 bp, Artificial Sequence
  Synthesized
  misc_feature (61): n=a or g
ttcaccttagcaatatgacccctctttaaagtacatttggtgttcccagttccatcttgtntttctgtaattctctctcatttgatgtgtctggagtattttgctccctgttaaccaatct

SEQ ID NO: 14229 - DNA, 121 bp, Artificial Sequence
  Synthesized
  misc_feature (61): n=t or c
atccccctgaagtcagcactgccacgccagtacacttcggttatggaactgacccacaatnattgcttgtcattgcttggcaaagatactgttatgtgatactttccttaaatctcatgca

SEQ ID NO: 14230 - DNA, 121 bp, Artificial Sequence
  Synthesized
  misc_feature (61): n=t or c
aaactcctcttggctcagatgactacatacagaaagcaccaataatggctaccattgctgngtcacctgctggacagaagttgcacttcaagctatggctacacaactggaacaaccaaac

SEQ ID NO: 14231 - DNA, 121 bp, Artificial Sequence
  Synthesized
  misc_feature (61): n=a or g
ggcctgcacctgctctgagggtgatctccagcaagtcctactggatttgacaggagatganatggatgaggagcaggcttgagtgacagttgtcatgggctccccagctgtagatggaggt

SEQ ID NO: 14232 - DNA, 121 bp, Artificial Sequence
  Synthesized
  misc_feature (61): n=t or c
ctttttcaaattctgctagattcatgtacaacccactatattggcaaagttcattcaatanatcaaatacaataggctgaatatgagattgtgaagtaaattaattagctccaaaggctgc

SEQ ID NO: 14233 - DNA, 121 bp, Artificial Sequence
  Synthesized
  misc_feature (61): n=a or t
catggatctttcttactatgcttattctcaactagaaggtcttatattcatgcagataggnagagctatactgcctacttatgatgagacgcataacagatcagagctagggcatataaca

SEQ ID NO: 14234 - DNA, 121 bp, Artificial Sequence
  Synthesized
  misc_feature (61): n=t or c
gaggaaggaggaggattgcaagaatttaaatgaagcatccaggtgaagcaggctgccagtntcttggtgtcaactcagaagccatctgctgcacctctaaactgattcagtctctgcagtt

SEQ ID NO: 14235 - DNA, 121 bp, Artificial Sequence
  Synthesized
  misc_feature (61): n=a or g
tttacaaatatatttcattggaactggcagttgctgcatacagcatttcctcaaaaaacanaataatctacagtgtgtgttaaattgtgaacaatctcgaaacacagagaaaggtgctaat

SEQ ID NO: 14236 - DNA, 121 bp, Artificial Sequence
  Synthesized
  misc_feature (61): n=a or g
cctgagctgatgtatatcagcatagacttgaagtcatcacagctatatagatctgtgagcntatagatgtgatttgatagcttatatttggtagaattttgatgaccaagtattgaagtgg

SEQ ID NO: 14237 - DNA, 121 bp, Artificial Sequence
  Synthesized
  misc_feature (61): n=t or c
tcttggtgggaggagggagggacgatgctggagggaatgggaagactctgctctacagaangggcttgaaaagagggtgcagcccctggtcctgttgcccccagccagctctccctctgga

SEQ ID NO: 14238 - DNA, 121 bp, Artificial Sequence
  Synthesized
  misc_feature (61): n=t or c
acataatgttcactgttgaggtcacactctgctgaaatgcagcacagaactcagagcatanctacatccatctcccacccatcatcttgtggggactcttagaaacaaaggaccaaaagga

SEQ ID NO: 14239 - DNA, 121 bp, Artificial Sequence
  Synthesized
  misc_feature (61): n=t or g
aatccagaggcttgtttgttttccttcaacatcagaaggtcaactcttgtatttttggttngagaagagcaggtgattttgcaggattggaagcatcaggaaagcgtattcccattgccgc

SEQ ID NO: 14240 - DNA, 121 bp, Artificial Sequence
  Synthesized
  misc_feature (61): n=c or g
cagtctgagttcgttaaatattttaaagctgtggtggttagatcaatacttcacagctctntgtagcgtacataggacatcgtaggtacttagtctctttgaaagccagcaattagagcag

SEQ ID NO: 14241 - DNA, 121 bp, Artificial Sequence
  Synthesized
  misc_feature (61): n=t or c
aatgaggatggctgaagtaattactgctcccagcttcctgatcactcattgcaaggagagnttcaaaggctgtgtaaaatctacagcacccatgatggtttatatgtgacgattagggtaa

SEQ ID NO: 14242 - DNA, 121 bp, Artificial Sequence
  Synthesized
  misc_feature (61): n=t or c
ggtggccatagatggaactgatttaagcaagctatgcaggactgagtcgcaggtttgaacngatcaaaagctgcttctcaagagaattatgcaatatctcacaattcctatccctaaagaa

SEQ ID NO: 14243 - DNA, 121 bp, Artificial Sequence
  Synthesized
  misc_feature (61): n=a or g
tcgggtttctacataagatgaactactcacatatcataaactcttttgaactgaaagtgcntggatgtggacagagttcatgttcctgttcttcctgctgtgtccatgtatgagttgcaga

SEQ ID NO: 14244 - DNA, 121 bp, Artificial Sequence
  Synthesized
  misc_feature (61): n=t or g
agaagagcaatactttgcctttggagctcaaacctagaaccttctacctagaacccacgcngcctcaagatgttctaatgaagggaaaattgtatgacaaggctgccttttgatgaataga

SEQ ID NO: 14245 - DNA, 121 bp, Artificial Sequence
  Synthesized
  misc_feature (61): n=a or g
tcagtgatgacaattcagaaattggccactcattgctgactcttaactgaaagagataaantgagaatcatccagggtgtaaagctttaagttgacatggctctatttgcgttcatcagca

SEQ ID NO: 14246 - DNA, 121 bp, Artificial Sequence
  Synthesized
  misc_feature (61): n=a or t
aggaacagcagctacccacgcctgggacagatggactggggtgcgatgctagctgtcatangtctgctggaaatgagcatttttccatgttggctaatggagtttcctctgtgttcacggc

SEQ ID NO: 14247 - DNA, 121 bp, Artificial Sequence
  Synthesized
  misc_feature (61): n=t or c
ataatggcattcactgcccatgtcctgggcaccaaattgtaaggaacctcaagaatttctnatttgaagtcatgaaaacaaagaccagtctgctctttcaatctccagtcaatcttcattc

SEQ ID NO: 14248 - DNA, 121 bp, Artificial Sequence
  Synthesized
  misc_feature (61): n=t or c
agaacaaagccattggctgggaaatagataagtgaaaactgaatttatcatcctccttganagcacacattacatgtattgcaaaactacttcttaggaagctctttgtttttctagacag

SEQ ID NO: 14249 - DNA, 121 bp, Artificial Sequence
  Synthesized
  misc_feature (61): n=a or g
ggatcaatgttacacttcatcctcattataaactggagctctgctttgaattatagatgcnatgtcctactgactgattggcaataatccccaagatgaaaaggcaaccacttggtcttgc

SEQ ID NO: 14250 - DNA, 121 bp, Artificial Sequence
  Synthesized
  misc_feature (61): n=t or c
aactcgtaatgctgtttgacctgcttgctgtccctaagaaatgcattaaagcaaatgggcngatggacaagcagggcagtgcttccctgggaaaagggaagagaaaccatttgacaataga

SEQ ID NO: 14251 - DNA, 121 bp, Artificial Sequence
  Synthesized
  misc_feature (61): n=t or c
gtccaactccagcagcagcctcctggagggccaaacccatggatgctgctcccagccctgntctccaggcacagcacatatgatatcagttttctgaccctgcggtaagcacctcatcctg

SEQ ID NO: 14252 - DNA, 121 bp, Artificial Sequence
  Synthesized
  misc_feature (61): n=t or c
tacagtgaaccaacacagtgaatgatgccaccaagaagggctgaatgctccagaagggganggaactcaaagcggtttgaacagatgcgtaagttggaggtaactgctacaaaactggtga

SEQ ID NO: 14253 - DNA, 121 bp, Artificial Sequence
  Synthesized
  misc_feature (61): n=a or c
gagcagtggtttttcccaggcaagatttacatgaattgtcacagattgaaagaggaaaaanattccttctcttaattccactagacattgtcatcttcctctgatctcagagaaggttgtt

SEQ ID NO: 14254 - DNA, 121 bp, Artificial Sequence
  Synthesized
  misc_feature (61): n=a or g
ctcctctccctgccagcccggcttcccaagctgctcagagcactgaactgtaacagcacanaggcagatttctcagctccatttggtgttgcttgtcttgtggaaatacaccactgccgaa

SEQ ID NO: 14255 - DNA, 121 bp, Artificial Sequence
  Synthesized
  misc_feature (61): n=a or g
aggatttatcggatgcattacaagtttttctagcttcagagttcaacaggggaaaccatcncaacttctagtggtgtttgatgtcaggatcaaaacccaaatgcagtaggagaattatctt

SEQ ID NO: 14256 - DNA, 121 bp, Artificial Sequence
  Synthesized
  misc_feature (61): n=t or c
ctgcagttctcaagcagattagtgcttgaaacttactgaagaacagtatcaactaagaagnagtttctgaaaaactggaactatgaaagaaaatggtataattattctcaaactttaaata

SEQ ID NO: 14257 - DNA, 121 bp, Artificial Sequence
  Synthesized
  misc_feature (61): n=t or c
actgtatttgcacaatgttgggtagagcagaagtgatattgcaaatctaaggatgtaaaanttcttgcttgataatgagctatgtccttgaaagtttcattttgatggatatctatgggat

SEQ ID NO: 14258 - DNA, 121 bp, Artificial Sequence
  Synthesized
  misc_feature (61): n=a or g
tgacttttgtgatataaaaagcaatgtatgactttatgtttcacaccagatagtctgaagntggtgttcttccatcatcccacatgaaacttttaaaactaaacattatacctgctgagct

SEQ ID NO: 14259 - DNA, 121 bp, Artificial Sequence
  Synthesized
  misc_feature (61): n=a or g
caacaaacttctaattccaacatttcttaaaatgttctaaaggagccttctgggatatgcngtgctgtcagacggaattctgagaagttaattttaaagtatgaaaacagcacactaaaat

SEQ ID NO: 14260 - DNA, 121 bp, Artificial Sequence
  Synthesized
  misc_feature (61): n=t or g
gtccagttagattcgatccctgctttccaggaggggacataaccagcagaaagcagcccangttgtcctgagaaatttccataagcaaagatgtgggcaagccagcaaagcttcttgtaga

SEQ ID NO: 14261 - DNA, 121 bp, Artificial Sequence
  Synthesized
  misc_feature (61): n=a or c
cacccgcaccccctgagggatttttatgcctgatagatcagaagtagcaagagtatctganttcatcctgtggagaccatttatattttgtgagctgcatctgaggtgccaccacttccca

SEQ ID NO: 14262 - DNA, 121 bp, Artificial Sequence
  Synthesized
  misc_feature (61): n=a or g
gatcttattgaaatgcttggcctagtatggttaactatacacctgaattgggctgtagacncttatttcattggcctgatattcctgttggtattcctgttgaggggactcttttcttggg

SEQ ID NO: 14263 - DNA, 121 bp, Artificial Sequence
  Synthesized
  misc_feature (61): n=t or c
gagtcccagcagcagcccactgcctgcccctgtgcagtgatcgcagtgccccgattgtgtncaagctctctccatacaccaggaggtataaatattaataggtgccgggtgagggctgggg

SEQ ID NO: 14264 - DNA, 121 bp, Artificial Sequence
  Synthesized
  misc_feature (61): n=a or g
atttcttccagttgaaaaagacaaaaggtagtaccctgacttaaagatatgatggtgcttngaaagcgaaaaggatggaaaagagaaagtaaacactgagaccaccaagtggttggcatgc

SEQ ID NO: 14265 - DNA, 121 bp, Artificial Sequence
  Synthesized
  misc_feature (61): n=a or g
cccgtactacttagtgaagaagtggagatgtttgaagaaataccatttgggagctgaaatntccatctcaataactacatgggttcagagcatctcttgtccctggggaggaagatcccat

SEQ ID NO: 14266 - DNA, 121 bp, Artificial Sequence
  Synthesized
  misc_feature (61): n=a or g
agtaggacccaatcacaagaaatgcatatataaatatatttcaatatttctgaaattcatnactataaagcagagtagtggaaatgtgagtgtggcagagtctcttgtttatttcactgaa

SEQ ID NO: 14267 - DNA, 121 bp, Artificial Sequence
  Synthesized
  misc_feature (61): n=a or g
tacattagtaatcaggtgctgggtagaacattggataaatacaatttctgtttggtttatnaattattctccatgaaggacaaaaaaataggaatgcgaaggccctcataagtcaaacagt

SEQ ID NO: 14268 - DNA, 121 bp, Artificial Sequence
  Synthesized
  misc_feature (61): n=t or c
aatgacaaggaaagaagctgtgcaatatgttttccagaagagaaaagaacatcagggtatnggaaaggccaagaccattttacacatagcacagtcccaacaaagtccatgacaggagatg

SEQ ID NO: 14269 - DNA, 121 bp, Artificial Sequence
  Synthesized
  misc_feature (61): n=a or g
cctccagtttcttattccagttacataaacacgccagagtattcctgtaaattgaattaancaaaccttttatgttctctccctgtttcaagatagctaaggtggctgcttgcagatttgc

SEQ ID NO: 14270 - DNA, 121 bp, Artificial Sequence
  Synthesized
  misc_feature (61): n=t or c
tcactgcagtttcatttctgaagtaatgctcttggacagtctccatttcttggctaacacngaggatagcttgaagaccagaagtatctgaatcatcaacagaactcactaaaggagttag

SEQ ID NO: 14271 - DNA, 121 bp, Artificial Sequence
  Synthesized
  misc_feature (61): n=a or g
tgtttcactggtctccacgtggtggttgtttcccatgacgatatttttgattctatacctntgcgtatgtgcaattttttaagaaacaaaacaaaaactcatagctcttggtagtgacaac

SEQ ID NO: 14272 - DNA, 121 bp, Artificial Sequence
  Synthesized
  misc_feature (61): n=t or c
ttagtcagccctgatatgtcttcgtctactctcagccatataacacagagtacatatacancgccattatctagagaatttcagcttgcatggtagcacagtagttctgctttaaataaca

SEQ ID NO: 14273 - DNA, 121 bp, Artificial Sequence
  Synthesized
  misc_feature (61): n=t or c
tcatcatttttttttttctggacagaagagttaaatgttcttatgtgcttgtttgcttacntgttttaatgttgcaaggtaacctgtaaagttttgaagacactgagttccatgacaatta

SEQ ID NO: 14274 - DNA, 121 bp, Artificial Sequence
  Synthesized
  misc_feature (61): n=t or g
gcaacatttttttctcaaatagccaccaagatgtgtttttaatctatcttgtaggtactangcatacattctacatttagctatcaattttgggagattttgagggtattactatgtattc

SEQ ID NO: 14275 - DNA, 121 bp, Artificial Sequence
  Synthesized
  misc_feature (61): n=a or g
catccccaccccatccccaacccactgctggcccatcaccacccatactcaatggggaccntgtttggctcctggtgacactgagccacagctggatcctgtttggtggcagaggggatgg

SEQ ID NO: 14276 - DNA, 121 bp, Artificial Sequence
  Synthesized
  misc_feature (61): n=a or g
gaacagagctgaagaacgttgcttctttggggcgtgtgtaatacagatttgttctagaaancaagagagtgtaattaatgtgtggcttattgttacccttctcccccttgatttttcttta

SEQ ID NO: 14277 - DNA, 121 bp, Artificial Sequence
  Synthesized
  misc_feature (61): n=a or g
tggaccaagctctgtatttcagttacgtttgttacaagaagtcttggcaaaatgtggcaanatgttttgtatatttttgtcagggaagggaacaagaaatgggcgttttcctgtaaagagg

SEQ ID NO: 14278 - DNA, 121 bp, Artificial Sequence
  Synthesized
  misc_feature (61): n=t or c
aattgttggaaaaaaatctgctgaaatatgtaatctaacatcatatatttggtgaaaatgnatcagttttagtgagaccatcttaagttaaaaaagttatatttctgctggaaagtggagg

SEQ ID NO: 14279 - DNA, 121 bp, Artificial Sequence
  Synthesized
  misc_feature (61): n=a or g
cgctgattttccacctaaagtttcctcctgaagtacagccctctaaagcccagagtccagntgaacctttcatcttctttggcactgcgtgggtggggaagaaccagggagtgagacagca

SEQ ID NO: 14280 - DNA, 121 bp, Artificial Sequence
  Synthesized
  misc_feature (61): n=t or c
acagagtgataacttactgcatcccatagtttctgggatggggtgaatgcattgtgcctgnccacagcctggggagggttaaagagagccttaattacctcccccagctgagatcaggcag

SEQ ID NO: 14281 - DNA, 121 bp, Artificial Sequence
  Synthesized
  misc_feature (61): n=a or g
ctgggtaataggttttcatggaagttaactagaataggtccagagcaaagtgaattaccangaatacttccatttccttcagtggctttgaggaggcatcctgaattctaagacagtgagt

SEQ ID NO: 14282 - DNA, 121 bp, Artificial Sequence
  Synthesized
  misc_feature (61): n=a or g
atcaataaacatcccagagtctgttgcagagccttgagaaaatgtttacttaggcatgatnctgggtgtatgacaatgttctccgttaaattatcaagtacacaatcaaacattaaatgcc

SEQ ID NO: 14283 - DNA, 121 bp, Artificial Sequence
  Synthesized
  misc_feature (61): n=a or t
ggtgctttgctcttctcgggccttattccaaatcactaaattcatcacaacactttctatncagttcaaaagaccttgaatgaggctttatagttatatttttaacctagagttctttgac

SEQ ID NO: 14284 - DNA, 121 bp, Artificial Sequence
  Synthesized
  misc_feature (61): n=t or c
aagggtaagaatgcttgaatgtgggaaatgggcaggacatagtatggcaattcctactttngtggatcttcatatattagctacagagtagaattttcttgtggcaaagaaataggtatca

SEQ ID NO: 14285 - DNA, 121 bp, Artificial Sequence
  Synthesized
  misc_feature (61): n=a or c
ataaatgataccttatgtgatattttctgttagagtctctctaatgactataaatgatttnaaataaatttaacagaaggaccgagttcacagagttccctaaaatgtagtggaaatcagc

SEQ ID NO: 14286 - DNA, 121 bp, Artificial Sequence
  Synthesized
  misc_feature (61): n=a or c
aaagctcctctaaaacactggcaagagaaaatctacctttgttttaacatattaaacatgnatttgacactttaccacatatagtgagcatatgtcatactctaatgttttttgcatattg

SEQ ID NO: 14287 - DNA, 121 bp, Artificial Sequence
  Synthesized
  misc_feature (61): n=t or c
ccattccagaaggtactatgggtttttgctgctgctaacaacctttcccttctgtaccctnccatgtctgcagccacagaggtgccaccaggacaggccctccagctgggattaagtgaag

SEQ ID NO: 14288 - DNA, 121 bp, Artificial Sequence
  Synthesized
  misc_feature (61): n=a or g
gagcaaaatctgggcagaaacatgttggctgtggtagctggccatagatgtctccaagacnctggagaccaatgtgctgtgccacctcatatgcaccaagacaggggcagtgggatgaagg

SEQ ID NO: 14289 - DNA, 121 bp, Artificial Sequence
  Synthesized
  misc_feature (61): n=t or c
agtttgattatgctgttcaaaagttaatctctttacaaactactgtctggaataattgaangtttctcagatgaatctctgcttatctcaactccactggtataaaaactctttgtttcta

SEQ ID NO: 14290 - DNA, 121 bp, Artificial Sequence
  Synthesized
  misc_feature (61): n=a or c
gagagctgtaaaaatattatcataagcatttactgtgtttaaattgcagcactcttttccnctgctccatcacaccccatgacagctaccacaccaaggtctgtaactcagtaactgcttt

SEQ ID NO: 14291 - DNA, 121 bp, Artificial Sequence
  Synthesized
  misc_feature (61): n=a or g
ttctagcatggttttagaggttcctttggacttcttgcactggcagtgtgttgtaaggggnctattgcagagctacggagaatgctctttagtgggaccatttgggatgaagtggaaaaat

SEQ ID NO: 14292 - DNA, 121 bp, Artificial Sequence
  Synthesized
  misc_feature (61): n=t or c
gagcatttatagtaatgatttctattttttaagtagcacattctattatcaatgctataantcatcaggattagagatgcatgataaaaacaacaggtagttacatcatcctgctctttca

SEQ ID NO: 14293 - DNA, 121 bp, Artificial Sequence
  Synthesized
  misc_feature (61): n=a or g
tgtctgagcgtgtactacaaatattgcagcatgcccaaccaaaactgcaatggcgagagcngcaggtcagatgaagggctacagtctgcccctagaataatttccactggcacaccaccaa

SEQ ID NO: 14294 - DNA, 121 bp, Artificial Sequence
  Synthesized
  misc_feature (61): n=c or g
aaatacagacatgaatcatctagacaggctgcttacatccacttatgatcactggtaatanagaaacacatgaagttgattccacttgtcaagaaggaattagagttctgacttaattttg

SEQ ID NO: 14295 - DNA, 121 bp, Artificial Sequence
  Synthesized
  misc_feature (61): n=a or g
atgttttagggcatatgtaacttgcagaagcttgatcaggcaaaacatgtaagcacatgcnagtacctttaaagatgagaagaaaccacacaatggaaatattagttttcattaatattgt

SEQ ID NO: 14296 - DNA, 121 bp, Artificial Sequence
  Synthesized
  misc_feature (61): n=a or t
ttccttccctacattcctgtccagaagagattgaacacactgcagagcagaaaaactaaantgctatattccactgagggaaactacccccttccaaccctccttcccactcagctcttct

SEQ ID NO: 14297 - DNA, 121 bp, Artificial Sequence
  Synthesized
  misc_feature (61): n=a or g
aagaacatgcagtcatccaggattctatgaaaaacaactccaacagatttgatcgagattntaaggatggtgatttgcatttgaattcttctctggaatgggctgagcgtgaagcaaaaaa

SEQ ID NO: 14298 - DNA, 121 bp, Artificial Sequence
  Synthesized
  misc_feature (61): n=a or t
atttatttatttttgtcgtgcttacattcctctgcaggagtgtgaaagaatgcgttcagcngtgtcagatgaagctcattgctatgctaactgcacgactgtactcctttaggagggcatt

SEQ ID NO: 14299 - DNA, 121 bp, Artificial Sequence
  Synthesized
  misc_feature (61): n=a or g
aactcctgttccatgtgatgtactggagtgcaacctgtgtggcacagcgtgctatgctggntgtcccatcttcactggagacatgaaagggtaatgaggatcagtttgaggccctatttgt

SEQ ID NO: 14300 - DNA, 121 bp, Artificial Sequence
  Synthesized
  misc_feature (61): n=a or g
ccctttctttgaaatgaataatatattttttgaaagtttggattgttatctgcccaggccngataggcactgtgacttaccaacacactgagtagttacagctattaaaaacaaaacaaac

SEQ ID NO: 14301 - DNA, 121 bp, Artificial Sequence
  Synthesized
  misc_feature (61): n=a or g
tagatgaggttggatcaatttgtcaacatgaataaacaaatccttgggaggaagatgtatntagacagttgttttgtacatgtatgtatttttcttcttatgcaggtatgtgcacacacac

SEQ ID NO: 14302 - DNA, 121 bp, Artificial Sequence
  Synthesized
  misc_feature (61): n=a or g
aatgtttgctctttgtccagtcctgacagatatattctccaggtgttgtcacccataacanacacataatggcagagagcagcctatattaacatttgagctaatacaaacatgcactgtt

SEQ ID NO: 14303 - DNA, 121 bp, Artificial Sequence
  Synthesized
  misc_feature (61): n=t or c
caaatatcctctatttcatctcagcaagcatatatcattttgtttagtgacaaaagaagcnaataaagtctttgttttggagggaaaaatgtacagtgcaggttgaaagctatgagtgaag

SEQ ID NO: 14304 - DNA, 121 bp, Artificial Sequence
  Synthesized
  misc_feature (61): n=a or t
caaaaattttcatgatgacagagaaactactgactaggtacatccctgcacatcaaccctngcagcactaagtgactaagtgggaggtagcaaagagaggatgtactgcctgtgctaagca

SEQ ID NO: 14305 - DNA, 121 bp, Artificial Sequence
  Synthesized
  misc_feature (61): n=a or g
gggttttttgtttgtttgttttttaacctttcagattcttactggtatggttttacctgcngagtgtctttcagtttaacaacttcttactgcatgtgacatggtgctgattccttgctgt

SEQ ID NO: 14306 - DNA, 121 bp, Artificial Sequence
  Synthesized
  misc_feature (61): n=t or c
cttgcattgcagtaattacaggaagctcagtatgcaaagcaactgcatcagtgacgttatnattgcagttagattccctcataaatcctatttttcatcactaataggttggttcttccct

SEQ ID NO: 14307 - DNA, 121 bp, Artificial Sequence
  Synthesized
  misc_feature (61): n=c or g
catccagcaggttaaacaaggtgattttcccctcttctcagtgttcacaaaccacacttgnattgctgtgtctggtcaaggggcacctaaaaagaattgtcaacagatgggaaggagtcca

SEQ ID NO: 14308 - DNA, 121 bp, Artificial Sequence
  Synthesized
  misc_feature (61): n=a or g
aatatctgcaaatgaaagtgctttctttccccaattccccgtctgcaatggccaaaatacngcccagcagtgcagtaatagaagtttttcagggtggcccctctgcacaacagctgtttca

SEQ ID NO: 14309 - DNA, 121 bp, Artificial Sequence
  Synthesized
  misc_feature (61): n=a or g
tcgcccgctccgttctatggccacattttggacacacggctctgatcagacgacagatgancagcactgcttcactgcctccacatcccagcattcacagccctaacttcgccccccctcc

SEQ ID NO: 14310 - DNA, 121 bp, Artificial Sequence
  Synthesized
  misc_feature (61): n=a or g
tctgtggtactgcttagaaaatgaggtgagtgatagattatataatctcattcttcttgcnggagcctgatctgctccattaaaatccttttcttcaagaaaactaagcttatactatatg

SEQ ID NO: 14311 - DNA, 121 bp, Artificial Sequence
  Synthesized
  misc_feature (61): n=a or t
cagacctcacagttctgcaacactgactcagtttgtggtatcttcatagagcaatggtagngcactcatcccttccgagtaggtgaaaatcactttactcagggattttcccatcaggttg

SEQ ID NO: 14312 - DNA, 121 bp, Artificial Sequence
  Synthesized
  misc_feature (61): n=c or g
gttggtttgtaggtacttctgcttcccaagtttatgccattctctcagctcaaaaggtagngatttgagcacacactgagccaggacctcatagaacaaatgcgtgcaggccattcacaaa

SEQ ID NO: 14313 - DNA, 121 bp, Artificial Sequence
  Synthesized
  misc_feature (61): n=t or c
tgctggcaggaaaataaatagaaataaatcctttctgttaatatatgaaagtcatttctgngattatccaattttcttctactgctgtgttcacaaattccttttctaaaaatttctgtag

SEQ ID NO: 14314 - DNA, 121 bp, Artificial Sequence
  Synthesized
  misc_feature (61): n=c or g
gggcagaagagattcacaagtctggggaaaaggggcaataaaactgataagagatcaatgnaagtgagagaacgtagctaatgccataaaagaataatctttattagttatgttcaactga

SEQ ID NO: 14315 - DNA, 121 bp, Artificial Sequence
  Synthesized
  misc_feature (61): n=a or g
gttgctgaggatctttttggtttgatggatagggggaagaaaaaagagagaacccacgccnagctgtctcccactcccatgggacatagcgaggggggggggggagaggaaggaaagaggg

SEQ ID NO: 14316 - DNA, 121 bp, Artificial Sequence
  Synthesized
  misc_feature (61): n=a or g
cttgcacgaggtcttgaaacagggccactcttccctggaaggggccagtgagtactttctntgggctagagggctttatcttccagttctagtgttacgttgaatttaacttcagactgga

SEQ ID NO: 14317 - DNA, 121 bp, Artificial Sequence
  Synthesized
  misc_feature (61): n=a or g
tctgtaaataaatatatgcacactaaaggaaatggaaggagcagattcttacaaggactgnaattactgattcagatgtatagcttcacactgttacctgtgctggaagccagtctgtact

SEQ ID NO: 14318 - DNA, 121 bp, Artificial Sequence
  Synthesized
  misc_feature (61): n=a or c
tttgaattatagggccttctaaaagtaaagagataagaaaacagttttaaatgaggtacancaccttataacatttcaacatttactttcttttaacatttactatctatagcatatttgg

SEQ ID NO: 14319 - DNA, 121 bp, Artificial Sequence
  Synthesized
  misc_feature (61): n=a or c
gcaaaaagaataaataattatgactgacataagccagtgtgattcaaagtgagaagcaaanaattctattttaataattgcatttactttcattttgcattcacgcttcattgttctctaa

SEQ ID NO: 14320 - DNA, 121 bp, Artificial Sequence
  Synthesized
  misc_feature (61): n=t or g
gaaaattagacccatcccagccaaaatcatgtcaatgcatacgttaaagggttaattaaanttatgtgaactttaagacagaatttgctcaagttcagcttcaggaacagaatgccactga

SEQ ID NO: 14321 - DNA, 121 bp, Artificial Sequence
  Synthesized
  misc_feature (61): n=a or t
gttgcaaagaggaattgtcaaattcttagatgttagtgagtgatttattaggtgtccaaangcaaacctgtgagccacaagatataaagaaaacaggcctcaaatggtcagtccagatttc

SEQ ID NO: 14322 - DNA, 121 bp, Artificial Sequence
  Synthesized
  misc_feature (61): n=t or c
ggtcagaaaccacttgtaattagaatgtatgttgtgaatgtgaattaatagatgtaataangtaactatctcttcatttcccaggatctgaatcagtttccagaatactggaactgctgtt

SEQ ID NO: 14323 - DNA, 121 bp, Artificial Sequence
  Synthesized
  misc_feature (61): n=a or t
gggcaggagagatgagcatgtagggaagagccagcactgtgccatcctatttttgtggacnactggaattaggtccttttatgtattgtctcaacaagaggctaattagacagcaagctca

SEQ ID NO: 14324 - DNA, 121 bp, Artificial Sequence
  Synthesized
  misc_feature (61): n=a or c
tcagtgacataagtgagatcagaatttggcctcctgctttatcttttcagaaagtccttcngtatacaaatgcagatgttgtaattctcaaattaagtgatgtggctagcattcggaataa

SEQ ID NO: 14325 - DNA, 121 bp, Artificial Sequence
  Synthesized
  misc_feature (61): n=a or g
aaaaattcagatgaattgtcatttccatcaattgttaggagggtgatggtccttaatctcncatcaatctcaatgtgtgccactaggacaaaagaagagatgctctgctgagatcagagca

SEQ ID NO: 14326 - DNA, 121 bp, Artificial Sequence
  Synthesized
  misc_feature (61): n=a or g
aatatttggcaggacaagatttgctatcgctgtacaaaatgtggctgtgttattgcatgcntggagtttagttgtataatcataagcttcataggcagcccattgaaagggtgaatacaaa

SEQ ID NO: 14327 - DNA, 121 bp, Artificial Sequence
  Synthesized
  misc_feature (61): n=a or g
acaattcaagtctcacactttgtcaataccacccacacccaaatgactttttgtgcaactngccataaaactcacctgctctgcatgaagctcagccaggtgacacagtactacagcaaag

SEQ ID NO: 14328 - DNA, 121 bp, Artificial Sequence
  Synthesized
  misc_feature (61): n=c or g
actctctctttcacaccaaattacacttgctccaaatcagagatccttagtagcacagcanaactgtaaagagcttaatttacttccagcctggatcacgtaacacctacatgagctaatt

SEQ ID NO: 14329 - DNA, 121 bp, Artificial Sequence
  Synthesized
  misc_feature (61): n=a or g
tctgcccgagtgttcttggcaccgcaagtagccttgttatcatccatttaactttgtggtntggagcaaatgttactagaacttaacagttcgcatttggatgactattactgttgttata

SEQ ID NO: 14330 - DNA, 121 bp, Artificial Sequence
  Synthesized
  misc_feature (61): n=a or t
ctgtttgttgtttctggattactttttctttacatctctttttcttctgtttcaggaacanaataaatccaccaaagtttcccatatgctgcccagatgtcctacaaatagattatgagat

SEQ ID NO: 14331 - DNA, 121 bp, Artificial Sequence
  Synthesized
  misc_feature (61): n=t or c
cccctcatgactttatagcataataggttttggtgcctgaatcttcacacctgttgtttgnacgcagtgtattaacacagtgcttgtagatgtgtctgactttaaaagtttgtgttgccat

SEQ ID NO: 14332 - DNA, 121 bp, Artificial Sequence
  Synthesized
  misc_feature (61): n=a or g
ctttcgacagattttcagaaataactccgtattttatcctgtttgttctcagattagctcngggatgggtttaattgggcacagtggggaaattaatatccttggtgaaattacgcagaga

SEQ ID NO: 14333 - DNA, 121 bp, Artificial Sequence
  Synthesized
  misc_feature (61): n=t or c
ctatttgggcatgtggggggtgggaggacagctaagatcccccaattgcagcagcatgaangtgccatctccctgacctccttaatgagtaggtctggaaaatgccagctcttcatcactc

SEQ ID NO: 14334 - DNA, 121 bp, Artificial Sequence
  Synthesized
  misc_feature (61): n=t or c
tgtccagttcagttccccatcacagcactatgcccatggttatgaagcactgcagcaacangtctgagtccccagcccagatggccagaatctttattaaatcattcatggatgcacttct

SEQ ID NO: 14335 - DNA, 121 bp, Artificial Sequence
  Synthesized
  misc_feature (61): n=t or c
accgcaggcagcgcatctccgggatcatcacacacccaaatcagctgagtgtgagcagtcncagccccagcatcagcccagccctcacactgggaggggtatgggcacacaggggcaggtt

SEQ ID NO: 14336 - DNA, 121 bp, Artificial Sequence
  Synthesized
  misc_feature (61): n=a or g
ggcaccttctgcttcgcctccaggagcagagccttcaagtccatgagcactgattcatctnggggcagagatgcagatcaaatacagtcctagcagaagcccaacacaaggagaggcaaag

SEQ ID NO: 14337 - DNA, 121 bp, Artificial Sequence
  Synthesized
  misc_feature (61): n=a or g
tgtcaggtctttgaatcacacccaaatgagaatatgatctttctcagggaatcttgctacntgtttgtgttgcaattggattttgtaggtaaagtaagtcctttagacccaagtttttatt

SEQ ID NO: 14338 - DNA, 121 bp, Artificial Sequence
  Synthesized
  misc_feature (61): n=a or g
gaaaaaaagaacaaaaaagaagaacaatttgtgtaggatgagaagtattacatagttatcngaggaaatctgtcagcccctgaaccacagacaatgcttctttttgcctaataaataaact

SEQ ID NO: 14339 - DNA, 121 bp, Artificial Sequence
  Synthesized
  misc_feature (61): n=a or t
ctttattcatgacgtataacattcttagacaagactgcagaagtaattctcagatctcatntaagttaggagctatgagaatcttatagtctgttaatagtttctttcagcttggtgaacc

SEQ ID NO: 14340 - DNA, 121 bp, Artificial Sequence
  Synthesized
  misc_feature (61): n=a or g
gaaggaaggtgagttgaagggaaatgtggtgtgtgtgtgtgggaggggtgtaaatattccngagttgtgaaacatcggtcatgtgtggccctgcctgttctttcctaatcattccatgcca

SEQ ID NO: 14341 - DNA, 121 bp, Artificial Sequence
  Synthesized
  misc_feature (61): n=c or g
gctgcaggacggcaccatgatccacccagctgctcccacaccgagccctacagcgcccaanctgtgtgcatgacctcttcccatggggttccctcactatagggttcttcaggatgaatgg

SEQ ID NO: 14342 - DNA, 121 bp, Artificial Sequence
  Synthesized
  misc_feature (61): n=t or c
ctatatctagtacaaaaaggaaaaggcagcaatttgcttaagtctctattataccgttaangattatgagctgaaaaactagaccataatgctggaaacttgtaattaaaaagcatgaatt

SEQ ID NO: 14343 - DNA, 121 bp, Artificial Sequence
  Synthesized
  misc_feature (61): n=t or g
tggccaagtaggcttgctcactaaagagaaaaatataaacttgttacaatacctaatttcntttatgtaaaaatatgcaaacatttaagcacccaaacaagttacagagatttcagtacag

SEQ ID NO: 14344 - DNA, 121 bp, Artificial Sequence
  Synthesized
  misc_feature (61): n=t or g
atcgctactcaggaaagtcctagttgactgaatgtgccattacatggaaatattgaagccnaagaatcacattattttccactgtctccaagactcattttagagcagctatttggatccc

SEQ ID NO: 14345 - DNA, 121 bp, Artificial Sequence
  Synthesized
  misc_feature (61): n=t or c
gaatcctattttttctttctacaatgaacaccaacgcacacaccttgtacctgtcttctcnagccttcaaacagctacacacctccctcttcctccacacacacagcctgtctgccagcct

SEQ ID NO: 14346 - DNA, 121 bp, Artificial Sequence
  Synthesized
  misc_feature (61): n=t or g
taaaaattatgcataaaaatacatgccaagataatacactttgaaaaatggccatcattgnataagcagttaactttcttcttattctaaaggctgtttcctatggaaaccatactagtgc

SEQ ID NO: 14347 - DNA, 121 bp, Artificial Sequence
  Synthesized
  misc_feature (61): n=a or c
ttaaagtgaattcagtaagttagaactgtgataaaactctcagtcttgaaaagaggaacgntgaaactgtttagttgccagatcaggaaatacatctctgaatgtgtaaatagtctgctct

SEQ ID NO: 14348 - DNA, 121 bp, Artificial Sequence
  Synthesized
  misc_feature (61): n=a or g
ggtcaaatagggacaattactgttattgagtgggagaatattaagtgttgaagtggggcantcgcttaagtcagttctgacacgttttgtcttttttgaatactatttttattataagtat

SEQ ID NO: 14349 - DNA, 121 bp, Artificial Sequence
  Synthesized
  misc_feature (61): n=t or c
tcttgaccttaggaagaccttcagtaattcctccttcagtattcttatagccaaaaagganatgttggataaatggagagtgattggaatgtcaggtttaaaagtctgactggcagtttgt

SEQ ID NO: 14350 - DNA, 121 bp, Artificial Sequence
  Synthesized
  misc_feature (61): n=a or g
aagaccaaaaattaaagtcacctggcaacttatttttgatagaattggttgttcttttccncaggaaaatgcttgctggactttctatatgaagcaccaatgaatctgccaaagaagtcag

SEQ ID NO: 14351 - DNA, 121 bp, Artificial Sequence
  Synthesized
  misc_feature (61): n=a or c
cccgaggttctccaaggaacatcctcatacgaagggctcagtgtgatttatgacaacgccncactgctgttatcctcacacctcagacaaaggaaagaggtggagaggttttgccatcatt

SEQ ID NO: 14352 - DNA, 121 bp, Artificial Sequence
  Synthesized
  misc_feature (61): n=c or g
ctggctatgttgatagatacatagagatacctacaatggaaatgcttacggtaattttgcntactctatatgaaataaatatcacaagtaaactctaatactcagaactgaatagcataca

SEQ ID NO: 14353 - DNA, 121 bp, Artificial Sequence
  Synthesized
  misc_feature (61): n=a or g
ttacagaaaaaataagcataaattagagtttttatcagattttcctctcttggacacctcntttaccatcttcataggactgacatgcatttgtatatatcatctagatgcctatcataca

SEQ ID NO: 14354 - DNA, 121 bp, Artificial Sequence
  Synthesized
  misc_feature (61): n=a or g
ctggttctgcatgttctgtaaatgaacccgagcaatcaacagaagagtttgtaaattcagnaacacaaaagcttgtttgttatttgcagttagatcagcaggtttaatcaaagaaaggcta

SEQ ID NO: 14355 - DNA, 121 bp, Artificial Sequence
  Synthesized
  misc_feature (61): n=a or g
cacatagaaatgatcatatggaagtagcatgccacagtagtaatagtgatgagtttaagangaatggctgtggttagatgttttctgtgattctcacctatttggcctttttcagcttcag

SEQ ID NO: 14356 - DNA, 121 bp, Artificial Sequence
  Synthesized
  misc_feature (61): n=c or g
gaaatgttacaaggaactgaaaatcacaaattttccagtgtattccacacatacacccctngtctatcattttcattatggtcagtgaattttacataacactgggggattgttggcagtc

SEQ ID NO: 14357 - DNA, 121 bp, Artificial Sequence
  Synthesized
  misc_feature (61): n=t or c
cattccagtagctgtgcccatgcagtcccccatttgcactgacatacttcacgcaggtacngtcacaccttccttaaataagctttgaaccccgatctctgctgcagagttttattcacca

SEQ ID NO: 14358 - DNA, 121 bp, Artificial Sequence
  Synthesized
  misc_feature (61): n=a or g
ctctatggactgcttgtgtgatgtttggctcacccagtacctaagtaagtgcttgactctngctgagttcaatgtgatttaactgctaatacctttgaggatttagccctctgttatattt

SEQ ID NO: 14359 - DNA, 121 bp, Artificial Sequence
  Synthesized
  misc_feature (61): n=a or g
ctgagatgtagcttcaaaaacaaaaatgacatcaactgttatttgaaagcacacttttatncaatatctatttgactgcagaggcttaagctcacttcccaaaaggtaaagagcagtatga

SEQ ID NO: 14360 - DNA, 121 bp, Artificial Sequence
  Synthesized
  misc_feature (61): n=a or g
gcaggctttgggttggagcccactactgagggatacgtacgcatccctcagatgctgtggntacaggacttttgggaaagaaggcacattagcctctctcaaccttgcagattcttcactg

SEQ ID NO: 14361 - DNA, 121 bp, Artificial Sequence
  Synthesized
  misc_feature (61): n=t or c
cagtgaggactcatccacaccgggcagcaggggcaggacggcccagagcagtgaatagaancattttgtgtgccatcaccaagccttggagcttccagcttcagcatccccgcaggtggga

SEQ ID NO: 14362 - DNA, 121 bp, Artificial Sequence
  Synthesized
  misc_feature (61): n=a or g
gagacttacacacaggagatgatattgtctgtcagcttcaatgcactaactgatctggaangaaaaaggaagagatagagggtaaaactagtcttagaacaagcaagtcactgtaccctgt

SEQ ID NO: 14363 - DNA, 121 bp, Artificial Sequence
  Synthesized
  misc_feature (61): n=t or c
gccataactcttcaaactcactgagcactgatctgctgagggaaacctgtctgtgatttanggccctgcacgaagagctccgacatctgctgggacacgtctgcagggccgactgcaagtt

SEQ ID NO: 14364 - DNA, 121 bp, Artificial Sequence
  Synthesized
  misc_feature (61): n=a or g
ctatgggcaactgatgacatcccttggacattaatgcccccagttgctccactctacaccngagcacagacaggttacatttgcagactgtaagctgtgatgtcttctactttaagatagg

SEQ ID NO: 14365 - DNA, 121 bp, Artificial Sequence
  Synthesized
  misc_feature (61): n=a or g
gtctcttgtaatgattttattaaatccctattttgcccagtttgcttacaggaatgttaantggactgcagtatgtctgagatgcattacaattttgctctatcagcaagactgctgctct

SEQ ID NO: 14366 - DNA, 121 bp, Artificial Sequence
  Synthesized
  misc_feature (61): n=t or g
gcttctgtccaagcaggacttgacacagtggggagctgtaaatagggtacacagagctggngctccccatggctcacccttgcggttatctcattatgcacagctccacattatgagatgt

SEQ ID NO: 14367 - DNA, 121 bp, Artificial Sequence
  Synthesized
  misc_feature (61): n=t or c
gtaattagcaatcaccattgatttttctgtgtcatgggacagatttgtcccacagtcatcnagagaccaagccagatgattctcatgaaaaagctctgctcctgctggcacctaagatctg

SEQ ID NO: 14368 - DNA, 121 bp, Artificial Sequence
  Synthesized
  misc_feature (61): n=a or g
ttcacagagtgacagatttttgatctcaggcaggggattcacattcttctttgcatgctgnattcttctgcatgaatcctcatgccattatgctctgtggaaaatggagacatagtggttt

SEQ ID NO: 14369 - DNA, 121 bp, Artificial Sequence
  Synthesized
  misc_feature (61): n=t or c
cctttgtcccatcacagcaggctgtactaaagcatctgtccctttatttcttgtagcctcnctttacatactgaaaataacagagccagcaacaaagcaaggctgtgcaggcaactaatgc

SEQ ID NO: 14370 - DNA, 121 bp, Artificial Sequence
  Synthesized
  misc_feature (61): n=t or c
cctatgcctgcgcccagcttgggaagggctcaaaatggtgcagtttatatccttctaaacnagatagagttgtggcattttgcacaaagctggctatattgtcccgtggtgacagaaggga

SEQ ID NO: 14371 - DNA, 121 bp, Artificial Sequence
  Synthesized
  misc_feature (61): n=a or g
atttgtccatcaggggatattaagaggggtccctctaacaatcctttcttcataaaacacncgctgtcaaaaaaatcagtcttggagcttacccatcaagactacctacttaacagtcaaa

SEQ ID NO: 14372 - DNA, 121 bp, Artificial Sequence
  Synthesized
  misc_feature (61): n=t or c
atactccaggattaacaatttgttgcatctggctcctgcataatgtctgtgataaagtgcntgtgcttcctgatcgcaaggagtatgtgattttccatagttatcattgccacctgattaa

SEQ ID NO: 14373 - DNA, 121 bp, Artificial Sequence
  Synthesized
  misc_feature (61): n=a or g
gacctcatctttctgaacaggaattgcctcctagctgtgcacagacacagagaaactttcngcttcaaagacaagccttcaacctccagctaatgctactagagaagttatcagactaggg

SEQ ID NO: 14374 - DNA, 121 bp, Artificial Sequence
  Synthesized
  misc_feature (61): n=a or g
gccttttttctccccattttaaagacgcaattttctggagggtaccgcagggctgatcccncactctgaggtgtcctcgagagccttccataacccaactgtggttgcctgtcgcctggca

SEQ ID NO: 14375 - DNA, 121 bp, Artificial Sequence
  Synthesized
  misc_feature (61): n=a or g
tagctcaagtgagaaggggaggggggggaggtgaacagaaaggttaaaccagtgaccctgncctggagaggaacccactccctatccatactggggtgtgtgttgctttgacagttggatt

SEQ ID NO: 14376 - DNA, 121 bp, Artificial Sequence
  Synthesized
  misc_feature (61): n=a or g
ccctggtgtgctgcctgtttcaagacaaagtttgtgaaggctttatccttgccatccacanatccttgttatttccatctttaatgccacgtttctttccttcttattacagtaatgatta

SEQ ID NO: 14377 - DNA, 121 bp, Artificial Sequence
  Synthesized
  misc_feature (61): n=a or t
ggaggatcagtcatggttgtttctgctttattctgtgtagctttcagtgatttgacttgtnggaagggtactttgctattgtaaacacgctgttctagatgaaagtatgtacttattcttt

SEQ ID NO: 14378 - DNA, 121 bp, Artificial Sequence
  Synthesized
  misc_feature (61): n=a or t
atattatgtgataggaaacattaatttcagagctttcatagatgtgttacaatttattagntgaagacaggctgtttaatagggaaacaaaagaaaagatagattaaaacagcagagtctg

SEQ ID NO: 14379 - DNA, 121 bp, Artificial Sequence
  Synthesized
  misc_feature (61): n=a or g
cgtccccacggtgccatcagctctgacctggatgtggatgggcagtgctgccagctgtgcnggcgtcaggtggaaatgctgagaaaacacctaaaaacaggcaaagccgtgagtgcggtgg

SEQ ID NO: 14380 - DNA, 121 bp, Artificial Sequence
  Synthesized
  misc_feature (61): n=c or g
cagcaaaataactaaatgcagcaactgggaactgaagaatcatgatacgtttctgcctccntggtgtcagccatcactaaagggaaggtgatgtctggagataatttaagggatctgcaaa

SEQ ID NO: 14381 - DNA, 121 bp, Artificial Sequence
  Synthesized
  misc_feature (61): n=t or c
tctaagaaaccaagcacagtgagcgtggagaggtctgggaccagcagaggatttcagttgncactggtaattgtgccctgcagcacagagctcgtggggatggcgttggttcctggcagac

SEQ ID NO: 14382 - DNA, 121 bp, Artificial Sequence
  Synthesized
  misc_feature (61): n=t or c
agtatttgatttcttttgttcaagcataaatgctcttatgtgattcagcgcaggatccctncaaggtgtgaatcaaggggtctaagcatgccaaaggaattgctcaagcagagtttggctt

SEQ ID NO: 14383 - DNA, 121 bp, Artificial Sequence
  Synthesized
  misc_feature (61): n=a or g
aggagcagagccctgttttcaggggacttgatgttgcaggaataagatgaaggaggctgantaatgactgtggtctccatctaaaggttgtgcagcttcccagacccaaagtaaatctgat

SEQ ID NO: 14384 - DNA, 121 bp, Artificial Sequence
  Synthesized
  misc_feature (61): n=a or g
gcaggtgcctccaagagacctacagccccaaaaactccacttctgccctcatatgagctgntctttcctcattttgtttctcctcgtttgacaccaccctgacagactctaagaggcacca

SEQ ID NO: 14385 - DNA, 121 bp, Artificial Sequence
  Synthesized
  misc_feature (61): n=a or t
gacccttttgaacttagccctctgccaaagttgtttgctcttggggagatgctgaagaacngtagtattttaaagaacttttgaaatttcagaggcctttgacttatttatctgtaatgaa

SEQ ID NO: 14386 - DNA, 121 bp, Artificial Sequence
  Synthesized
  misc_feature (61): n=a or g
atgacacggataaacgactttgctcggtcggcattaggggattacgccctccaggatggtncagattgcacacgagattcttgcaaagctgtggctcagcccggacctcacagaaatgaca

SEQ ID NO: 14387 - DNA, 121 bp, Artificial Sequence
  Synthesized
  misc_feature (61): n=t or c
tatttacttggcttcttgcaaaattgggtgcttgacacgaggtctaaaatcatacttagtntctgaaaccaatgctgtgtccaatagtgtctgtacccaatgctgaagttgcatcccctct

SEQ ID NO: 14388 - DNA, 121 bp, Artificial Sequence
  Synthesized
  misc_feature (61): n=t or c
ggaatgaaagagacccaagcatgtatttagaagagagtgtagtgcttattgagtgttttanctgtacatgaaataattcaaggcggttctgcctgggaaaagaaaaatgttctattcctca

SEQ ID NO: 14389 - DNA, 121 bp, Artificial Sequence
  Synthesized
  misc_feature (61): n=t or c
gactgagagccgtgcccaccgccttgctctggaggattctgcgtttccccaggctctgctngcagccctgacatcctcccaggaaacacaaagcaggagctgagtcagagagctggaacac

SEQ ID NO: 14390 - DNA, 121 bp, Artificial Sequence
  Synthesized
  misc_feature (61): n=a or g
agctgaaatcctttgacagttgagacacaatgatgcaatgcaatgtgaaaaattctatgantcagtttgcgtactgaaaccaagtactaatgcatgaagttacatgtttaaaagtgatata

SEQ ID NO: 14391 - DNA, 121 bp, Artificial Sequence
  Synthesized
  misc_feature (61): n=t or g
cacacgcttctcatctttcttcagcccaaatatttctcagtattaccacctttgtcatttngtccagccaccaaaggaaacactgtcaatatatccttcgtgcatggcatatacttgagca

SEQ ID NO: 14392 - DNA, 121 bp, Artificial Sequence
  Synthesized
  misc_feature (61): n=t or c
gctaatcttagtaagatagtgtgaaaacactttggcaccactgcattatgaattaggaganacataaaaggaaaaaggagccaagttcttgtagcgaagcagctaagaatgagcttggctt

SEQ ID NO: 14393 - DNA, 121 bp, Artificial Sequence
  Synthesized
  misc_feature (61): n=t or g
tcttgagaaagcagaatatgtgccagtgtactcatcctgcttctagtacctgagtagtcanttcagaactctgatatccctgcgcctgtctgagccaaatggtcaagttggtctttttatt

SEQ ID NO: 14394 - DNA, 121 bp, Artificial Sequence
  Synthesized
  misc_feature (61): n=t or g
accttggtgtccgtgattggttatcctgatgctggattatgaccaaaatagctatggctgntatgaagaaaaggtaaccttggattttagcagacaccgtgcatcctttgtgattacagct

SEQ ID NO: 14395 - DNA, 121 bp, Artificial Sequence
  Synthesized
  misc_feature (61): n=a or c
aataaatactgtgggatttaaagttgctgggaaaacactaaaataggtgctgaaggcctcnttatgggcatcattaaaaatagatcaggagttagaatattaagaaaacaaagcaaaacca

SEQ ID NO: 14396 - DNA, 121 bp, Artificial Sequence
  Synthesized
  misc_feature (61): n=a or c
ttgtttccaaagcacatattctgtgcagaaagctgcaagaaagtgtaggtactgagtgtgngagcttattgccctaacaaatcaacaatggggctttttgaggaaagaactggctgagcta

SEQ ID NO: 14397 - DNA, 121 bp, Artificial Sequence
  Synthesized
  misc_feature (61): n=a or g
ctaggtatgtcttcatgatttcatacaacctacttgtgtcagattttcaaaaactcattcntctaattttggtggttcagttttgagaatcacagaagagacctctggaagtcacctagta

SEQ ID NO: 14398 - DNA, 121 bp, Artificial Sequence
  Synthesized
  misc_feature (61): n=a or c
ggagattttagatttgagatgtaatagacattttctgtggaagacctactctacttctttnctactcatcccctaaaatgcctaaatttcaggtgaaaaatgttttaacagaaaatatttg

SEQ ID NO: 14399 - DNA, 121 bp, Artificial Sequence
  Synthesized
  misc_feature (61): n=t or c
tgagtttttacaacacggcatccattatacataagtaaaataccagttgcagagctgcaancatggtaggcatgactgcttctcttttaaactcatatttcgtttattcatttcacttttt

SEQ ID NO: 14400 - DNA, 121 bp, Artificial Sequence
  Synthesized
  misc_feature (61): n=t or c
gacaaactctttatttgaaggttagactgtactgtagcctaagactctagaaactgcacanagagtcatggtatcatgttttgtcagtagctgaaacactgacaggtgggcacacgttatc

SEQ ID NO: 14401 - DNA, 121 bp, Artificial Sequence
  Synthesized
  misc_feature (61): n=a or t
gggaggcttttggaaagcacagacaaaccgtgtgcctgctgccttcagagaagtccaaatncttttgatgttactgctcttctcttgttcttctccttgttgggtgaggagcttatgatcc

SEQ ID NO: 14402 - DNA, 121 bp, Artificial Sequence
  Synthesized
  misc_feature (61): n=t or c
cccaacatctcatgtgtctgccctgcatcgagtgaaccaccacttcagacacttgcatgantacagcaggaattcaagaatttgggagttctatgcagcaaggaagctgggtcatatagca

SEQ ID NO: 14403 - DNA, 121 bp, Artificial Sequence
  Synthesized
  misc_feature (61): n=t or c
agagccactctgccattgctgttatcatctttgtctctattggattctcccttagtatttnggggctatgttacaaaaagctccttgcagaacaaaggtgctgctgctggaagagtaaata

SEQ ID NO: 14404 - DNA, 121 bp, Artificial Sequence
  Synthesized
  misc_feature (61): n=a or g
ttacagtgcatgtgcaacttacgattacctgtgaaatgtgcagcaagtcctctcttgaatnttcatagcagtatttctagtactgatttgcaaaaaggattccagctgatccagggaatgt

SEQ ID NO: 14405 - DNA, 121 bp, Artificial Sequence
  Synthesized
  misc_feature (61): n=a or t
ccaatgcatcttgtttatgagctagagaagttgatttggttgttttaatctttatttcggnaacgaggaatagtgcagaaatgtggtgtcttttttttttttttttcttgctgtcaaggtt

SEQ ID NO: 14406 - DNA, 121 bp, Artificial Sequence
  Synthesized
  misc_feature (61): n=a or g
acaaaactatttatgcatgctgtaatgcatatacaagtgtatgcatctctatgttatttcntgaatgtatttgaaatttctggtttatacaacaagccatatatacgaaacacgtagtaaa

SEQ ID NO: 14407 - DNA, 121 bp, Artificial Sequence
  Synthesized
  misc_feature (61): n=a or t
agtgtgaagcaaaatgttctgtagcttaacatgcagtgatgatgtttaaatttctaggtcnaatccttttgttcatagtcagtttaaaattcaagtgaagtttttaagaactttttctgaa

SEQ ID NO: 14408 - DNA, 121 bp, Artificial Sequence
  Synthesized
  misc_feature (61): n=a or t
actctccaaaataacaaggttgaaaagaacatgattgttgatggggctcttgaaaaacacngcaaggaatcacaacgcaatgcacaggctccttcccattcctactaagttgcagcagtgt

SEQ ID NO: 14409 - DNA, 121 bp, Artificial Sequence
  Synthesized
  misc_feature (61): n=t or c
aagtggtgagaagggagatacagagcaatatctcaagcagactgatgtggaataaaccgtncaaagaatagtttattgcttaatattcattggttagtggatcacttccttctagctttcc

SEQ ID NO: 14410 - DNA, 121 bp, Artificial Sequence
  Synthesized
  misc_feature (61): n=a or g
gccatccttttgagtccttactcatcttgattgttctccaagcctcaggttctgccatttnagtcagtcaatgaaatatttcttaggcatttgtgataaaacctgaggtgctctggcaaag

SEQ ID NO: 14411 - DNA, 121 bp, Artificial Sequence
  Synthesized
  misc_feature (61): n=c or g
tcctgcagaacgcggtttgagtttcctttgaacgtaggttaatagacccctccctcatttncagaagaaacctctcagttttttccattggatcttgctttcttcaaagagcaagggaaac

SEQ ID NO: 14412 - DNA, 121 bp, Artificial Sequence
  Synthesized
  misc_feature (61): n=a or g
cagttttgccatcttatcttcaacagcaggtcatctattctactttcttgtctctacttgncaacaagtttctcagcctctgcattttgtacttgagtttacatctatgcaagcctcctgt

SEQ ID NO: 14413 - DNA, 121 bp, Artificial Sequence
  Synthesized
  misc_feature (61): n=a or g
taagccagtgacaagtcctctgcagcaggcagcaggcagcccgtttgacagggggaagatntacaaaaataatgcggtattactgcattttctgccctacactgcagatcgaggcagcaag

SEQ ID NO: 14414 - DNA, 121 bp, Artificial Sequence
  Synthesized
  misc_feature (61): n=t or c
atgaacatgcctggtagtcttgttgccattcttcagtgccaaattgaaaccacgccacccngtaacaaaccttgacctgcaatgtaattgctccatttttcatggtttctcaccctgtctt

SEQ ID NO: 14415 - DNA, 121 bp, Artificial Sequence
  Synthesized
  misc_feature (61): n=a or c
gtgctgtgaatacagcaaggagaaagacacaagcctctggtatacagagtagaaacatganagtccaaagagagataagctctgatggagaaatctgaattactccaactagcatctgttt

SEQ ID NO: 14416 - DNA, 121 bp, Artificial Sequence
  Synthesized
  misc_feature (61): n=t or c
tttagacagctaacaccatttttggacaaaatattccaggccatcaactcttgaaagactnggctttaaaagcaatcattctccattacatcaattgttttaaactgaaattattccaaat

SEQ ID NO: 14417 - DNA, 121 bp, Artificial Sequence
  Synthesized
  misc_feature (61): n=a or g
gcgtgtgctcggtgtgtctctctgtttagggatcaggctgtcttgagggtgggaggacacnggaggggtgataggatatgtgagtcgaatattgagctgtaagaggatgtcttttaccaaa

SEQ ID NO: 14418 - DNA, 121 bp, Artificial Sequence
  Synthesized
  misc_feature (61): n=a or g
ccagtccgtcccatgctcagtctgatgcctatttcaggttggggctgatcccaccaagacntgcagtcacatgtccccatgaaggtcacagcttcccttgagagggagaagaaaacagcag

SEQ ID NO: 14419 - DNA, 121 bp, Artificial Sequence
  Synthesized
  misc_feature (61): n=t or c
tttcagcagaagcccaattttggcagaagaactgatgtgaataaactgggtaagagtatantgaggctgggaattggaagatttctacgtttccaaggagctgcagtaagattcctcttct

SEQ ID NO: 14420 - DNA, 121 bp, Artificial Sequence
  Synthesized
  misc_feature (61): n=a or c
cttgatagatagcacacagcctggtacagctgtgctaaacacttcagatatctgtaatagnaaaggtagagaattgggtctggagtgtaccagaacaaatattaaactgtgctctccttgt

SEQ ID NO: 14421 - DNA, 121 bp, Artificial Sequence
  Synthesized
  misc_feature (61): n=c or g
ccacaaaatcataatgaattctgcaatagtcagtgggttaaggtctcttttccagtatganagagtctgctttaagtccccagtttgcatgattgggaacaaagactgaaacttggatttc

SEQ ID NO: 14422 - DNA, 121 bp, Artificial Sequence
  Synthesized
  misc_feature (61): n=t or c
taagtgaaagaacactactgtgaaaaacttcgcttttgagcttcctagtattttaaatttncattcaaaatctgaactgagaaaggggtttgctgtttccatacagatataaaatatttgt

SEQ ID NO: 14423 - DNA, 121 bp, Artificial Sequence
  Synthesized
  misc_feature (61): n=t or c
acagcttccatccttcacacctgtaataccatcactgccttcagctgtgacctcactgcanctgcaccacattgggttgaagtcatcaagactcactgtgcaccactaacatccttaaaac

SEQ ID NO: 14424 - DNA, 121 bp, Artificial Sequence
  Synthesized
  misc_feature (61): n=t or c
agaagcttgattgagattcctgttgtggtttgagcttatggtttccgaggcagattaacantgctctgaatcatagtgccacatgatcacgttgttgctttatgaattaaataatgaaaca

SEQ ID NO: 14425 - DNA, 121 bp, Artificial Sequence
  Synthesized
  misc_feature (61): n=t or c
gggaggatgaatacaggacttcctttctgcttttaaacccatctttgttaccatgttccangagaaggagcaatcttggtttttcagggcctcatggcggtgcatatttcacctcctcctt

SEQ ID NO: 14426 - DNA, 121 bp, Artificial Sequence
  Synthesized
  misc_feature (61): n=t or c
agatgagcttatgtcctaagatatgacattaacactgtcacggatgcctgctgcagtgtgnttgagctgtactcgcagcgctgtgtatcccggcaataggtttggatacatcccctgacaa

SEQ ID NO: 14427 - DNA, 121 bp, Artificial Sequence
  Synthesized
  misc_feature (61): n=a or g
aattatgttcatgtgtgtgtatgtgtgtaagtaacttaactgtgaagaaagagacaacaanatagttgtgtttggattaattaattatatggaagactgcatttctacatttactcactga

SEQ ID NO: 14428 - DNA, 121 bp, Artificial Sequence
  Synthesized
  misc_feature (61): n=t or g
acaacatcatgtctacaagtgtaacagccatgtcaacattcatgagctcccaaaatctgangaagagaaagaggtctcttaatacagccaagcaggcaatgaggtggtacactaaaaagca

SEQ ID NO: 14429 - DNA, 121 bp, Artificial Sequence
  Synthesized
  misc_feature (61): n=a or g
tttaagtagcagttagagacagtttcctaaagcctgtctccagcttgtttctttgcagctngaagcttgtattccctagattgacatcagctttggtcttaaaatgaagatctaagaaact

SEQ ID NO: 14430 - DNA, 121 bp, Artificial Sequence
  Synthesized
  misc_feature (61): n=t or c
catcttcccttcctatgagatattacactgaagtttcctgcagtactttgagctggaaatngtacagtggtcaggaagtcaaaagcttgcagtatgcattatttcagatcctgtgttttta

SEQ ID NO: 14431 - DNA, 121 bp, Artificial Sequence
  Synthesized
  misc_feature (61): n=a or g
acaaagctcccaagagatggttcagatgtaagaatgacaaaggttctcatacgggagagancaaacagctaaagagcaaacagccacacttctaaaaaaagtttaagaaaaatggatcact

SEQ ID NO: 14432 - DNA, 121 bp, Artificial Sequence
  Synthesized
  misc_feature (61): n=a or t
ttcatagatgaaaacaactactcatgcctactttgggagcttaaaagcaaaagatgcaagngcatagcaagttacactgcagtatttctataaagttgtattaaggtgaaatatgggatac

SEQ ID NO: 14433 - DNA, 121 bp, Artificial Sequence
  Synthesized
  misc_feature (61): n=a or g
tacatgtctctgtcatgacacagctctaaatttctgcgtgtttgggatcaatgttttatcntcctgaaagcattttcctcattccccactgccagacatgtcagggatgggacattttttg

SEQ ID NO: 14434 - DNA, 121 bp, Artificial Sequence
  Synthesized
  misc_feature (61): n=c or g
gctctaaaacgttacaacatgaaaataccagtgcctattggtaagttcagttagagctcanctacaggtctaagagtctttcaaaattaggtgaagacaaaatacagcaacataggtagga

SEQ ID NO: 14435 - DNA, 121 bp, Artificial Sequence
  Synthesized
  misc_feature (61): n=a or g
atcactgctgtaacacctgccaacaaagcactcctgtgcagattcttaaacaataaatctnaagtaacaagcagaggaactttagaagatcaagatagacattattaccctaaaagtgaac

SEQ ID NO: 14436 - DNA, 121 bp, Artificial Sequence
  Synthesized
  misc_feature (61): n=t or c
aatcagttctaccaccaaaaccaaaactcagggccggcgtttgcgaggactgaccaaaganagctcagtactccccaaacagccccaccaaagcctgcatacaccgcccaaacgtgccgtg

SEQ ID NO: 14437 - DNA, 121 bp, Artificial Sequence
  Synthesized
  misc_feature (61): n=c or g
attaaaagaatttgtttttcttttgttaatgacatcagtccatctaagaggttgaactttnaaaatgcaaacagtcttgagttttataagtgaataagagaataatactcagcattttgtt

SEQ ID NO: 14438 - DNA, 121 bp, Artificial Sequence
  Synthesized
  misc_feature (61): n=a or g
ttttcctactatcgtgaggaaatgcacttgaaaaacggcgtcactgcttttgaaactgtcnataaagggtcagaaacagtaatgggagaatatcactgctattgggtgtctgttggaaggg

SEQ ID NO: 14439 - DNA, 121 bp, Artificial Sequence
  Synthesized
  misc_feature (61): n=t or c
gtactgatcttgagcttggaagaagtggtgcttgaatgtcaactagctctcttggtccctnttaccttccaacgcaataactcatgggagctccaggtaggtccttgaagaggttagagtt

SEQ ID NO: 14440 - DNA, 121 bp, Artificial Sequence
  Synthesized
  misc_feature (61): n=a or g
ttctatggcaaggatttgaaattttctatagtaaaataggcattatgtcttaggaactgtnaactaaaatactcacttctcttcctgttactagtcaattgcagttcactgaaacagaaat

SEQ ID NO: 14441 - DNA, 121 bp, Artificial Sequence
  Synthesized
  misc_feature (61): n=a or c
acagtccctaagttgggtctaacgcagcccaacaaatcccagtaaaactgttacactgctncaagaggcaacaatgagtgccatccatgagccagactcggcttgctctgttttttttttt

SEQ ID NO: 14442 - DNA, 121 bp, Artificial Sequence
  Synthesized
  misc_feature (61): n=t or c
tctaatgtacttccttagaactgctgctgttcagggtatatagccaattcacacttcatcntatgatatttttaattacaaatgtgatgttcttctttttctgacacttaaaacaggaatt

SEQ ID NO: 14443 - DNA, 121 bp, Artificial Sequence
  Synthesized
  misc_feature (61): n=a or c
ggcctttggaggaagaaaccttgacttcctcacccagacgaacccaaaggtgacccgaggngtaggagagcatccgagtggtttcacagtgagattcagccatcagagtggaaggttccca

SEQ ID NO: 14444 - DNA, 121 bp, Artificial Sequence
  Synthesized
  misc_feature (61): n=a or g
ctgatacatggttataggatattaagaggaactccgtgtgaagctaagtcatggaaatgantcagagctcttcaactggggcagaactggcactagggcacctgtggcatctagacaccac

SEQ ID NO: 14445 - DNA, 121 bp, Artificial Sequence
  Synthesized
  misc_feature (61): n=t or c
cgagacaactgtttggagggaggcacatggatcccagcgcccctgtgatgatctttggggngcaatctcttcatagttggcctgacagtgacggagttgtcatcggtctgctccaatggag

SEQ ID NO: 14446 - DNA, 121 bp, Artificial Sequence
  Synthesized
  misc_feature (61): n=t or c
tagtctgcagatccctgggagctgctgagacattgttttgccaggcaatctgcacaccttnacctgtgagcagtacacagtaggctacctctgaaagagtccagcatttccaaaatgcaat

SEQ ID NO: 14447 - DNA, 121 bp, Artificial Sequence
  Synthesized
  misc_feature (61): n=a or t
attttgctcagattttagctaagagtgtttcaagatgtgcttgaaatagtgaaatgaacanaaggtggagtttagagtagccatctctacccatggccagcaaattacttaagcgccataa

SEQ ID NO: 14448 - DNA, 121 bp, Artificial Sequence
  Synthesized
  misc_feature (61): n=t or c
ggctgtcagctggtctgccgctccaagagcttgtgcagttatgtgcaaagcatgcataacnggaggcataggggctgaaatgagacgcagaacatcagtgcagtgggcaaccagagacttg

SEQ ID NO: 14449 - DNA, 121 bp, Artificial Sequence
  Synthesized
  misc_feature (61): n=a or g
agccttcttcctaagcaatgaacaaaaaggcagcaacacagaaataactctcacacatcantgaaattcaggttgcagcttttctttcagtagaaagagcttccatgctcttctttgtgtc

SEQ ID NO: 14450 - DNA, 121 bp, Artificial Sequence
  Synthesized
  misc_feature (61): n=a or g
tttttttttcctagttaaaatgagaatcagatgattttgattcatgcagagcaaggactcngatattaggtgggtgtttgtaccctgtgggactgggcctgtcaatggaagattatgaaaa

SEQ ID NO: 14451 - DNA, 121 bp, Artificial Sequence
  Synthesized
  misc_feature (61): n=a or g
atattatgtgctttttaggggagcaaaatggcagcttgtatccttagaagcaatggacacnctgtaaacaagatgggcttcaggagcagccctgtgctcattaagaaatgaaactcacctc

SEQ ID NO: 14452 - DNA, 121 bp, Artificial Sequence
  Synthesized
  misc_feature (61): n=a or g
caccgacaagaagttattatgtcctataaaggcaggctgtctcccagctcgtctgctttcnctgtttgacccttgctgttccatctcaatagagaacagatgccaaacaacgagttacgac

SEQ ID NO: 14453 - DNA, 121 bp, Artificial Sequence
  Synthesized
  misc_feature (61): n=t or c
taataagcaattaagaatataaagaggcagaaagacacatttgcttgctctgttactcaangtgctaccatcctgttcagtcaaagattaatgtgacagatctttggtactgatggggtac

SEQ ID NO: 14454 - DNA, 121 bp, Artificial Sequence
  Synthesized
  misc_feature (61): n=t or c
gtttttgtcaggcaaaataatttggcccggtcaaaaactctgtaaaagaagtttggatgtnggtgtaaggaacttgaatctttgagacattaaatagttgaattcagaacatgacaagtga

SEQ ID NO: 14455 - DNA, 121 bp, Artificial Sequence
  Synthesized
  misc_feature (61): n=t or c
ctggtctcagcatctctttagataagctatgcaagtagaaagtgagggcacaaagaaatangtcttcctcatcctcttgctttgtttcaatctttcgttccaggcaacaaacaaactacca

SEQ ID NO: 14456 - DNA, 121 bp, Artificial Sequence
  Synthesized
  misc_feature (61): n=t or c
tctgagacagcaaaacactgatgactaaaagcagaaaaatcttaaaaccacgtaacaattnaacaatcaggcttctttttattaaaagagaacaaatgcagactgataggtagtaaacaga

SEQ ID NO: 14457 - DNA, 121 bp, Artificial Sequence
  Synthesized
  misc_feature (61): n=t or c
ccagcatgaagtggcacagccttgcagaatattattgtggcttagaaagtacagtttagtnaaattcttccataaggatggttttgactgaaacatctgaataattaatctggcatttatg

SEQ ID NO: 14458 - DNA, 121 bp, Artificial Sequence
  Synthesized
  misc_feature (61): n=t or c
agtcggtaaatgaactgaagccagtatttctgcttttcagcctgagatcaattcactacanagctctgcattagtgcttgctgagcttaaaagaaatattccaccacctgcccaagcaaag

SEQ ID NO: 14459 - DNA, 121 bp, Artificial Sequence
  Synthesized
  misc_feature (61): n=t or c
tgcatattcacataacatcctctgtgagcagcagaattaatgaagcctgcttcctaccacnactgatgaagcaaaaaaatcgatatattcagaaatcccccaccagtattatacaacttcc

SEQ ID NO: 14460 - DNA, 121 bp, Artificial Sequence
  Synthesized
  misc_feature (61): n=a or t
ggacaaatgtgactttactgtgctgaagtaaaatgaggttttaatgagaacctatgaatgntatgaaacttcttaagcttttagttttgagttctctcttcattagtacgataactttaat

SEQ ID NO: 14461 - DNA, 121 bp, Artificial Sequence
  Synthesized
  misc_feature (61): n=a or g
ctagcaaattaatagttttattctgtaattaagaaatctctttaattttgtagaaattctnttactcttagcatgaattgaggctgacaataccaaatgtcaattcttgatatgagactga

SEQ ID NO: 14462 - DNA, 121 bp, Artificial Sequence
  Synthesized
  misc_feature (61): n=t or c
gagcgagaagactttctgccaaaacatctccttaggggcctggtgacagtacacgcatcantgacaatccccatacaattggggtaagaacacgcttcccattcccccttcccttgctgaa

SEQ ID NO: 14463 - DNA, 121 bp, Artificial Sequence
  Synthesized
  misc_feature (61): n=c or g
tttggaaacgtcagcattttcaactgcttagcagcgtatttactgtatgttgtgctgtatnttaaatcagctccttgctgcttatctgctacagaggcaaatctgctgtccattttaaaag

SEQ ID NO: 14464 - DNA, 121 bp, Artificial Sequence
  Synthesized
  misc_feature (61): n=a or g
atattaggttgtgagacataatcactgaagaatttaacatcagaacataacaagtattganatttattttggttttctcaccagctctctatataactccatcttggttagaacagaatct

SEQ ID NO: 14465 - DNA, 121 bp, Artificial Sequence
  Synthesized
  misc_feature (61): n=a or t
tactatcaactatttttgtgggttattcccagaggttattccagcaagctaaatttgtacngtagcataaacattggcatggtatattgacttggcaaagaatgctgatgaaaaagataag

SEQ ID NO: 14466 - DNA, 121 bp, Artificial Sequence
  Synthesized
  misc_feature (61): n=t or g
tttcaatccatcacagactgtattttaaccttttcttgatagatttctgccagtgatgctntatgaattcacatacccttttgaaaggaacctgtatgtcatattactcatctttctttga

SEQ ID NO: 14467 - DNA, 121 bp, Artificial Sequence
  Synthesized
  misc_feature (61): n=a or c
ttgcttcccatttcataccatcccattccatcctaacttatcacttcccattccatcacancccctttcataccatcacattctgtctcaccccatcccatccatctcatctctttctatt

SEQ ID NO: 14468 - DNA, 121 bp, Artificial Sequence
  Synthesized
  misc_feature (61): n=t or g
tctgcaccagtcttgtgaataatgaaatcagggccttggcaactcagaaacacaacacaancttcattggctcctggattctgaggaagagcagaaaaaggagcgactgaatgcagacagt

SEQ ID NO: 14469 - DNA, 121 bp, Artificial Sequence
  Synthesized
  misc_feature (61): n=t or g
cccagttaattgcatagaaagagtccaatgcttcgctttgaatgtaacccagtgtttgttntaagtcttgaatgtgttgtgtgcatctaataccaactggagagtctcttactgtcagtca

SEQ ID NO: 14470 - DNA, 121 bp, Artificial Sequence
  Synthesized
  misc_feature (61): n=a or g
ttcacagaaacactgacacagatattgattttggctttatatccttagatgaatgctcagngtcatgaatacggaaatttggaaagcagcactatgggaaatgcacaaccaggcaaaagaa

SEQ ID NO: 14471 - DNA, 121 bp, Artificial Sequence
  Synthesized
  misc_feature (61): n=t or c
actccttgaactaagagtggatgccaggggttattcttcctaagtgaaaaacctacatggngtaaggccttgcagtatataaccttccacctttaaggaactgtggcatgaatgtgccttt

SEQ ID NO: 14472 - DNA, 121 bp, Artificial Sequence
  Synthesized
  misc_feature (61): n=t or g
gaacaatctatcaatattttcacaacagaaactgaaagacataattctttattctttcttnctgtgcctgctgtacttgagtacaacgtcatgtgtggactgtctgccttaaattttgatc

SEQ ID NO: 14473 - DNA, 121 bp, Artificial Sequence
  Synthesized
  misc_feature (61): n=t or g
agcttcagctgcgttcccttttattgagatggggattttcttacagacagatctttcaacncagagtttagattgtgaagatccattggttacttaagggaaactgttaggagagcggcac

SEQ ID NO: 14474 - DNA, 121 bp, Artificial Sequence
  Synthesized
  misc_feature (61): n=t or c
aactttttaattgcagtgccttggtaccgtgaaatgcagaccggggcatgtcaggaatccnagaaggccagcagagcatggaacttgagtttcagctcctgttcaccttccgcgatagttt

SEQ ID NO: 14475 - DNA, 121 bp, Artificial Sequence
  Synthesized
  misc_feature (61): n=t or c
cagagagcagaacttctacacaggaagtttccaaatggtactgatttctgtgtgactcttnctatgtttctaaccaaacaagtcaaagcatcacttacggtagttgggcctattgagacat

SEQ ID NO: 14476 - DNA, 121 bp, Artificial Sequence
  Synthesized
  misc_feature (61): n=t or c
gaaagatttttcacagattgctacaattgagtagaaagtaagaccatggagaaaggtactncatattgatctctaggtgtggcagttattcctttagactgagaaactggtgatctccaag

SEQ ID NO: 14477 - DNA, 121 bp, Artificial Sequence
  Synthesized
  misc_feature (61): n=a or c
agaattcctcttttgttcttaaaactcttttgttataaaacatagcagcatgcacaattgntgcaactaccatctactgtttggcatgcagaatgacattacggtttgaggagaaaataac

SEQ ID NO: 14478 - DNA, 121 bp, Artificial Sequence
  Synthesized
  misc_feature (61): n=c or g
cttagtgaccttaattgtcctactgattcccttttcttctgctggttaatgcatacgcaantatggttttgtttttattcattattactgagcacctgacgtaaattttattgggaaattg

SEQ ID NO: 14479 - DNA, 121 bp, Artificial Sequence
  Synthesized
  misc_feature (61): n=a or t
tcagcaatgtgatgtgccatccagtttcacacataaccagtgtgaaaaagtccctcattantagtgtaaaactgcaagaaaattttttaaaagatgatgtgtgaagttattttcactggcc

SEQ ID NO: 14480 - DNA, 121 bp, Artificial Sequence
  Synthesized
  misc_feature (61): n=a or g
agagcacagagatcatagcatgtgttattgtctaattccactctccacggtgttcctttcntaatgacttcaagtttgacagcggaacagggaaaatattctattatctattaagaaactg

SEQ ID NO: 14481 - DNA, 121 bp, Artificial Sequence
  Synthesized
  misc_feature (61): n=a or g
taacttcatatggctttttaatctattcacgttacctgaatacctaaaataaaggtctttntaatgttactggacatttgcaagatgtatcaaaggaggagtgttacttgttacaatctca

SEQ ID NO: 14482 - DNA, 121 bp, Artificial Sequence
  Synthesized
  misc_feature (61): n=c or g
gttgctgtagtgttccttttccaagatggtcagcttgtgctggtttaacccagttgaagantaccacaggccaaagcagtcttggaactacagggaggactggatttgggaggaaattagg

SEQ ID NO: 14483 - DNA, 121 bp, Artificial Sequence
  Synthesized
  misc_feature (61): n=t or c
actgtgcatcatgcatgatattcgagtctgtcccttctattgtagatggaacatttgcatngagttattttcatggtttttgataataactgtactttctaatatttgcagctatacatgt

SEQ ID NO: 14484 - DNA, 121 bp, Artificial Sequence
  Synthesized
  misc_feature (61): n=a or c
ctctcactgtttatgcagtcagtcataaagtcatctttcacccatctgttcccattgatgntctctacaattctaagcagcactttttctctaaaaaggatttctcttttgtaaatgacac

SEQ ID NO: 14485 - DNA, 121 bp, Artificial Sequence
  Synthesized
  misc_feature (61): n=t or c
ttaatgattactcttattattcctcctagaaccagtccaaggcatcagcagctaaagatangtcaaagtcaccagacattacgcactgtacaagactctgaagaacctggaatgtgcatct

SEQ ID NO: 14486 - DNA, 121 bp, Artificial Sequence
  Synthesized
  misc_feature (61): n=a or g
gagaaatgtcctctcaaacaaaacaaacgttgtgacagaaaaggtgattccagacagaacnattcacaatgcgagcaagggaaaaaaaatccaaggagaaatcgtggcatgcttgatttca

SEQ ID NO: 14487 - DNA, 121 bp, Artificial Sequence
  Synthesized
  misc_feature (61): n=t or c
tctttcttccagaaggaggtttgggccacttgcaggtgccatacaagtatctctcattctnagtacactgcagttagccctatgctagagcgctgctgctgctgcttagcagtgcacggta

SEQ ID NO: 14488 - DNA, 121 bp, Artificial Sequence
  Synthesized
  misc_feature (61): n=c or g
gcaaaggaaagatagaaggtaggaggaaaattcagcactgactgtacagatgcactgggtnaaggaaaaagagtaagaacggaagactgagattagataaggaatctgggatgggagacaa

SEQ ID NO: 14489 - DNA, 121 bp, Artificial Sequence
  Synthesized
  misc_feature (61): n=t or c
tctgaaagatacacttctagcttaaatggagatcaagcagcattcaagttttcagccacanaggatcagcaggttgaagtgaagtcttagaagcacagctctgtaaaatgtacaaaataga

SEQ ID NO: 14490 - DNA, 121 bp, Artificial Sequence
  Synthesized
  misc_feature (61): n=t or c
tagctagctctttaaaaatttcagtaacgccacttaatgttaattacactagaagtatggncactctacagtacagaaaaacattaaagttcattaactaaaatcagctctcgttgaatta

SEQ ID NO: 14491 - DNA, 121 bp, Artificial Sequence
  Synthesized
  misc_feature (61): n=a or g
aaaatgccattcatcataatggaagaggacgtgaatttcagccagatggtattttctttancacaggatgctgtaacacaatgaatgcatccggcaacagcctccgttaggaaagcggtgt

(The sequence listing continues in the following parts.)

What is claimed is:

1. An egg-type chicken whole-genome single nucleotide polymorphism chip comprising 43,681 nucleic acid molecules comprising SEQ ID Nos 1-43,681.

* * * * *